United States Patent 10,724,096 (METHODS AND COMPOSITIONS FOR INHIBITING AND TREATING NEUROLOGICAL CONDITIONS) - sequence listing, part 56

SEQ ID NO: 1295 - DNA, 757796 bp, Homo sapiens
aaactgacttataaaaataatgtaatgtaaacatttcacaaaaataacttctattttgaatttcttgaatatcatggtattaactgctcaacagttattttagtaaaaataaggtatataaatcagtgaggaataccgatatatttattaacctacctgtagatgctttgttctttaatagttaataagtaaatgaatgatacttggatgaagtaaagtttattttttgttgttgttttgggtttttttttttgagaggggtcttgctctgtggcccaggctggtgtgcagtggcgcgatctcagctcactgtaacctctgcctcccgagttcaagtgattatcctgcctcagcctcccgagtagctgggatttcaggcacacgccaccgtgcctggctaattttttatatttttggtgcagacggggtttcatcatgttagccaggctggtattgaactcctgacttcaggtgatccacccacctcggcctcccaaagttctgggattacaggggtgagccaccgtgcccagctgctttttatcttctatattatgtcttggcagactgcaggccatgggctaaatctggcctgcagcatgtttttgtaaaacttgtgagctaagaatggtttttttttgtttgtttgtttgttttgttttttttttgttttttaagacagagttttgctcttgtgcccaggccagaatacaatggtgcgatcttggctcactgcaacctctgcctcctgggttcaagcgattgtcttgcttcagcctcccaagtagctgggattacaggcgtgtgccaccacactcagctaattttgtatttttagtagagacatagtttcaccatgttggtcaggctggtcttgaactcctgacctcaggtgatccacccacctcggcctcccaaagtgctgggattacatcatgagccaccgcacccaacataagaatggtttttaccttttaaagggttgtaggaaataacaaagattatgtgatagagtcagtatgtggacagcaaactgcactatttagtctttgatcttttacagaaaaagttcaaattttatgttgttactaattgcagacaacccgaataaacatactagggcctgggattaaatggcatgcagccttttttttttttttttttaagtacaatttccattttattttttctctggagaatagtctgtcttcaatctttttattttcattttgttttttttgagacggagtctcgctttgttaccaggctgcagtgcaatggcacgatcacagctcactgcagcctccgcctcccaggttcaagcgattctcctgtctcagcctccctagtagctgggatcaggggtgtgccatcatgcccagctaactttttgtattttagtagagatggggtttcaccctgttgcccaggctgatctcgaactcctgagctcaggcaatccacccacctcggcctcccaaagtgctaggattacagacatgagccaccacgcctcgccttgtcttcagtgtttaaggactcagctccttacatgggctttggtgggggttgtggggcagcactcctcgaaggtctaaatcggggtgggtgtgtttggtccttgtgggctttacaaggtggattcctgatgacttttctgtgaattgcacatctcacacagtaatttagcttcccatacagcttgggaagcacataggcattgaagacactcgcttcagaaatgtccctgactgctgcagcctccaccacatttcgaatgatgaattaatttctttttttttttttttgagacagagtctcactctgttgcccaggctggagtgcagtggcgggatctgggctcactgcaagctccacctcccaggttcacaccattctcctccctcagcctcccgagtagctgggactacaggggcccgccaccacgacccgctaatttttttattttagtagagacggggtttcactgtgttagtcaggatggtctcgatctcctgacctcgtgatccgcctgcctcagcctcccgaagtgctgggattacaggcgttagccaccgtgcccagcctcgaatgatgaatttcttaatggccttgtccttgggcacgcgtcaggcacagtttgtgcaacgaataggctgcatgtggctgcgcccctttttggcacgattgttgttccttcttttctttgtcttcttggaggcacggactggagggaggagtgcagccattattgatcatatttttgaataatatttagtgaactagaagttgcttatttgtaatgtcaagtaggatacaaaactttaacacagtatgattataattttgtaaaaatgtataaagtgtgtatatatgtatgaaaaaaacaaaaattctctaatgtattaatagtagatattttgagatggtggcatgatttttatttataaagtatttcttatgattataaaatcatattttaaaatttttcaatattttaactgaatgggaaacatttcctgtcaaataaggatatggagaccagtccatggtactttagattaaaagctgaactcactgggaaaaaccttattttgcatgtgtaactagtaaagcagaaacaacagtgtactgttcggcactgtctgaatagtaattatagagtacagctttcatacagaagaacagaaccaataaggaagtcaaacttggcagaatagttgagtgcaatttataaataagtcagttgaagaaatcatcgaccttttacctgtggctgattcgtgtaatggtgagagtcagcacaaatcttaacatttagcaacagcatgtatgtgaagctaaaacttgtaatgctctcatctttaatgtattttaaggaagttgatgcctaaagtaaatttattaaaaattcagagttaattatttaagatagtaatagatttcgtgctctctttggcttggttgttctttatctttaacaattttaagagctccgttcataaatatcagtcttgtaaagcccgttgttctatacctgatttttctattttatttttaaggtctttttggttcattacgggtgcaatatgttgtagatcatgcaatgaaaattgttttcctcaatactgacccctctattgtaatgacttatgatgctgttcaaaatgtgcattctgtgtggactctccggagagtcaaatcagaggtaaggagaaaggcaagtcacttctccttaacaggaaagggtaggctgggtgcactggctcacacctgtaatcctagcactttgggaggccaaggcaggcggatcacttgaggtcaggacgttcaagaccagcctggccaacgtggtgaaaccccatctataccaaaaatataaaaaattagccaggtgtggtggcttctgtaatcctatctactcgggaggctgaggcaggagaatcacttgaacctggaaggtgtaggttgcagtgagccaagatcgtgccactgcactccagcctgggtgacagaatgagactccatctcaaaaaaaaaaaaatgtatgtgtgtgtgtgtatatatatatatgtatgtatatatatgtgtgcgtatatatatgtatgtatatgtgtatatatatatgtatgtatatatgtatatatgtgtatgtatatatgtatatatatgtgtatatatatgtgtgtgtgtgtatatatatatatgaaagagtagttaatacttcataccctcacattttttttttggaaaaatcacttgtgaatagttgttttattattattatcatcatcatcatcatcatcatcatcatcatcatctctagagacagggcctcactctgtcacccaggctgaagcataatggcacaattacagttcactgcagccttgaactcctgagctcaagtgatcctcctgcctcagccttccgagtagctaggactacaagtgtgtaccaccactcccagctaatttttaattttttgtagagatgggatcttgctatgttgcccaggctggtcttgaattccttggctcaagctatcctctcgcctcaccctcccaaagtgctgggattatagatgtaagccacggcacctggcctcatttgagaaatagattgagcttcttaggaaagaagaaatactgtgtctttagtaactgacttcaacttgcattcttacaaggaaattgctattttattctaattattgtttttttttcctctttctctttattttgacttaaggaagagaatgttgttttaaagttctctgaacatgggggaaccccacggaatgtggccactagcagctccctcacagcacatctcagaagcctctccaaaggagattcccctgtgatttcacctttccggaattactcctccattcacagccagagtcgctcaacctcatcacccagtctacattctcgctcaccttctatttccaacatggcagctctaaggtagaagggtttcctggtttttctttctaagctttctgttttgttttgaaggatttagaattgctgttgacagctgtttttaggggaaatatatttaggggagttttttttaggggaaatagccattatcccaattgagaccttttttttttttttttttttttttgagacggagtcttgctgtgtcacccaggctggagtgcagtggcgcaatcttggctcactgcaaactccgcctcccgggttcatgccattctcctgcctcagcctccagctgggactacaggcgcctgccaccacgcctggctaagtttttttttttttgtatttttagtagagatggggtttcaccgtgttagccaggatggtctcgatctcctgaccttgtgatccgcccacctcggcctcccaaagtgtggggattacaggcgtgagccaccgtgctcagccctgagccagttttactaagatttctaagtttaccatgtcacattctttcctgagtcatattttgaagctgcctatgcttgtcctaaggttagttgcctcatttctaccactatgtgggcaacagtttgatgaatattaattcccaaaatattgtggcactattttatttttgccttaatttatgttagtttttcttttttttcttgttatttgatatctaaatgtatctatttctctatatagatatttatttaaatcaccagatatgtatatctggtgctacagggacattgttttgttgatatatatatgtctgactatacagggacatagtttagagctttttgaataatcattcattttccgaaaaagaagatgatctaagttttagttgtaaaagatgagttcttctaataataattctaaatctttagaatatagtaaagcacattgacatgaaccatttaaatagctactcctttttgaaaaattttaatttctgacctggattatgccatgaatgctcttctgtctgtggaattttgggaagtgtcattggagtgtgtgtcatataagcctgccctgctaactgtgatgtactctctcctctgtttcttttgcagtcgtgctcattctcctgccttaggagtgcactctttttcaggggtgcaaaggttcaacatttcaagccataatcagtctccaaagagacatagtatttctcattctccaaatagtaagtctaatggcttctttcttgcaccagaaacggagccaattgttcctgaactgtgtattgaccatttgtggacagaaacgattactaatataaggtttgttatatatattattatattcaaagaaaaatgttgctgaaagtcttgggaaatatatggcattttgtttaaagtttccttttaatgtgatcagttattaatatatgtaaaaatatatagagatatgtattaaggccacctcagtttcagtagaggatattaatgagattaaagtgatcataggctggacgtggtggttcatgcctgtaatcccagcactttgggaggctgaagctggtagatcacttgagcctaggagttcgagaccagcctggccaacattgtgaaaccctgtctctactaaaaatacaaaaattaactgggtgtggtggtgcatacttgtaatcccagctactcaggtggctgaggcagaattgcttgaacccaggaggctgagcttgcagtgagctgagatcgtgccactgcactccagcctgggtgacagagtgagactatctcaaaaaaaaaagtcatcataaaaatattattttgtcatctgatatttcttcctttatagtaataatctctcatttttcaggtgttttttgttctggggagaaacagttaatttctatccgtgaggaaatgtgggttttttagcacgtttcctaagttttatgttcatgttagttgagtgccagctttactttttgggaaacatagcttagatctctgttctgggtgacctttcttcttttatattctctttaataattcacgtgttaatttatatgccaatgtgtgtgctagttaacagtctaataagtcactgtccctgtcctcaaaagaggcagatagctgaaggatggtgacacaggagggactacttttgctggtagggctttgaaaaatgaacaggtatttgctaggcaggtaagtttagaaagaccacagacggcagctgggatcagaacaaaagttctggtgagtgcgtggtgtatttagggaattataaatactcccactctggtttttgcagaggggagggaaaaggctaatgaagaggaggcttcctaggtgcagtggctcacacctgtaatcactcactttgggaggctgaggcagatggatcacttgagctcaggagttcaagaccaacctgcccaacatggtgaaaccccatgtctactacaaatacaaaaattagccaggcatgatggcgtgcatctgtagtcccagctactctggaggctgaggtgagagagtcatttgaacctgggagttggaggttgcagtgagccaagagcacaccactgtactccagcttgggtgacagagtgagactgtctgaaaaaaaaaaaaaaaaaaaaaaaaggaggcttgagagattactgattgccctttaggcctctggtctgtttgatgacagcggtaagaaggcacttcataagtgtgtcggaagtttgggaaacagcagaacaataaatgtggaattgtcagcttataagtggtgattgaggtaagagaattagattagaattgaagaattattgtattcaataattgtgtgtacatgtagtatataggccttttcccaaggagagggttttaacagtccttagattctcaaagggatttgtggcctccaaatagttaaaatccagtggtgtagaattagaagagggctaggaactgaagtcctggaaacttaagatttggggaatggaaagagacaaagctggcgcagagagacaaagcaaaagaagtcagatgggagaagcagcaggaaatacagaatacaaaaaagaacatttcaagaatacagagatgccagtattgccaggtactggtgaagtgtggccctgagagttgaacccagagaggaggtacctgggtggcagtgggttccttggtgaccttggccagagcattttaagctgggagggtggcgggggaaagtggggtagaaaaagtaaatggggactgaggaaatgaacataggcatacagactctttaaggagtttgcctttgaataggaatgaagatacaaaattagagggagtcttggtcaaggagagttttgtttttgctgaactataataaaattagttttcatgacatcttgccccagtattttctttttctttttttttttgagacagggtctcactctgtcacccaggttagagtacagtgagtgactcaatcacagctcactgcagccttggccttctgggctcaggtgattccccaacctcagcctcccaggtagctgggactataggcacacaccgccacgcctgactaatttttgtagagaaaggattttgccgtgatgcccaggctggtctcaaactcctgggctcaagcaacctgcttgcctctgcctcccaaagtaatgggattacaggtgtgagccactgtgcctggcccccaatattttcttacctaaccacaatacaagttttatatccagtcaaattgagaaggtcttttatatactctaatgttgagtctattttatattttaagacttttaatgtgaaatagtaggctatacggactatactcaagggaaagtattgaaaatacagaagagaggaaacgattgatggaacaagtaaccagaaaggtgcacaagtggtgagattagcgttgggataaagaagtgaaggttgatcagatacgtaaggcaggaggttgagctcaagccttagagcctcattttatctgaaatggaaggcaaatgcataatcttagagagaatgaaatgggggataggtagtctgaagaaagtaaagatgtggatacaatgttgaagtagtctctctggcttgtttctcatatatcaaataaaagtatcctacaattatagatcatttttctttaaataacttatttgtaagttgaatatattatagactcttattttttagatttatgggtcttctgtagcactttatttatttatttatttatttatttatttattttttgagatagagtttcgctcttgttgcccgggctggagtgcaatggcccgatctcggctcaccacaacctctgcctcccaggttcaattgattcttctgcctcagcctcccgagtagctgggattacaggattactggctaattttgtatttttagtagagacggggtttctccatgttggtcaggctggtcttgaactcctgacctcaggtgatctgcccgcctcggcctcccaaagtgctgggattacaggcgtgagccaccacacccggccttctgtacactttagaaggaagggtttgggaattagagatacaatttcaaaaagagatgtgaatgaggtctaatctgagaaggagagggggtagataggagaaacagcattatgaaagatctggccctttgcgggataggaattcaagtttgcatgcattactttacaagtaggtggcttagtttgcattacaagtagggagcttagatagtatgtaatttaaaagttcatcagtaattgttaaatttattgtagctttccccagcaaagctgtgtaatgagctcataatcaaagaactgaaaggatcttagagatcatgaagtttaattcttagaaatgtttgtgtctttgagattattgcttgacctaagtagtttttagatttcttgcagaatattttcaaagactttttttttttttctctctctttttgagacggagtctggctctgtcgcccaggctggagtgcactggcgcgatcttggcttactgcaagccccgcctcctgggttcatgccattctcctgcctcagcctccagagtagctgtgaccacaggcgcccgccatcatgcctggctaatttattttgtatttttagtagagacgggatttcaccgtgttagccaggatagtctggatctcctgacctcgtgatctgcccgcctcggcctcccaaagtgttgggattacaggtgtgagccaccgcgcccggcctcaaagacttttaatagttactgtggtagattcttggaccagtgctgacagttactttattgatgtatctattatagagagaaaaattcacaagcctcaaaagtgtttattacatctgacctatgtgggcaaatttcctgtgcttttcagtggagtcccagctccagttatggtaggtgtatgtatttcccattgtttctgtataaataactcagcattgctttttctttttcttttctttccttttttttggcttaagtagttttatttagaaataatttacatgtcataaaattaacatgttttaactgtacaattaaatgatttttagtaaattacagtgttatacaaccatcaccatgacccaattttacaagatttatatcaccataaaaagatttccttgtgcttgtttgtagtcagtcttgttcccatttccagcctcaggcaaccatgctaggcttctgcctttatagatgagtttttctggacatttatatatatataatgtatgtacacacagtgtagctttttgtgtttagctttcacttagcgtgatgtttttaggatccaccgttttgtaacatgtatcattatttcatacctattgctatgtaatagtccattgtatagatctaccaccatgttttgtttatctgttcatcagctgatggacttttggtttatttccacctcttgactgctgagaattaggacagtatgaacatttgaacaaaggtcttgagcaaaaatgtggacatatgtgattttatttttcttgagtaaatgcctaggattgggtcattgggttgaatggtaaattcatatttaactttttaagaaatcaccaaactgttttccaaatagcctgtatcattttatattcccaccagcaaaatatgaaggttaatgtctctttatccttgacaggattggatatcatcacactctttgattgtagctattttccagtggttgtgaaatggctttaatttgcttttctctaatgcattctgatgttgatcatctcatgaagttattagccattcatttatcttcttaggtaaaatatctattcagatcttttgcccatttatttaccttcatattttgaaatacgatagatcacaggaagttacaaaatagtaaacaagtcctgtgtaccttgcattctttttccctcacaggtaacctcttgtacaactataatacattatcataaccaggagatagatgatgtacacactttatttcaaatttcatcaatttgacatgtactcatttatgtgtatgtatggttctatgcagttttttcacatatgtagatgtgtgtaaataccaccacaatcaagatacaaaacatctttatctgtcttacgttaactccttatagtcacatacaccattacccactgatcctggtaaccactaattctccatcttgataatttggcatttgtgaatgttttataaatgggctcatacagtatgtaaacttttgagattgtctttttctgttcagcataatacttttaatacccatacaggttgttgcatgtatcaagtttctttttattttattatttagctgtgtaaagtttcaagagagtaatgataaaacccagctcatctttgtttcagtgaccaacataccagcgaaggatgcagcaccagtggaggtaatgtaggcacatttgagaagttgacaattacgcttcatcagatttttcagtcaaaaaatctattaatttgctcaaatcgggaaataaatttttagtctttttttttttttttaaagaaaatagacaccatgctggtcttggaaggcagtggaaacctggtgctatacacaggagtggttcgggtaagcaataagtagcacttcatgcctttagtaggacttcaggctgcctgcatgaatatttgtaaagttactttagattgatattttaaatttgttatgttcctgtctgcacaatttggcagaagaattttgttaataattctcagtgaagcttcccatttaggtgggtcctaatttggagggctatggctcactgctattaaatgcattggtactctaaacctgtcacagatgggaaaccttcaatgagtataggtagatttttttttttttttaaagttaaactagttttgaaattgaagcatgggtacctttgaaattgaagcatgggtacctttggtaagtactaaagttttggtaaagtttcactatattaaatgtggtgtatgttagctgtattttttttttttttgagatggagtctcgctctgttgcccagggtgatctcggctcactgcaagctccgcctcccgggttcacactattctcctgcctcagcctcccgggtagctgggactacaggcgcccgccaccaagcctggctaattttttgtatttttagtagagatggggtttcaccgtgttagccagggtggtctcgatctcctgacctcgtgatccacccgcctcggcctcccaaagtgctgggattacaggcgtgagccaccgcgcccagctgttagctgtatttttttaacatttgtgaaatgtacatagagaatatacattttacaaatttaaattatgaaatttaaatacatacaatttgaataataataatgaagtgaatattcatctacccagtactctggttaagaaatagaatattgccagtatccttatttttattacattcttttctgattgcatcctatcttcccctgccctcgagatagacagaatcctgattttgtgataaatcagttgtttgtattactagtttttacagttatgtatgtatcactaaagaatgcattatttagttttccttgtttttgaatttttatataaaaaataccatgtactcgcctctgatgtacttattttgctcaacattatatttgttttagatttgtctgtgttgatgcgtactgttgtttactcattcagtgtgatgtatatattcaatagtattccatcgtacctcattttgtgctttgctttattgtacttcacagatactgcatttttttttttacagattgaaggtttgtggcaactttgtgttgagcaagtctgttggtgccatttttccagcagcatgtgctcattttgtgtcactgtttcaaatattgataattcttgcagtatttcaaacctttttgttattagtttatctgttatggtgacctgtgatcagtggtctttgatgttactattagaattcttttggggcaccacgaactgtacccatataagatgaggaacttaattgataaatgttttgtgtggtctgcctgatcatttgacccctttcctgtctctctctctcctcctgcctcactatatcctgagacaaaacaatattgaaattagaccaattagtaaccctgtaatggcctctaagttttcaaatgaagggcagaatcacaagtttctcactttacatcaaaaactagaaatgattaagcttcgtgaggaaggcgtgttgaaagctgagataggtcgagagccagaccacctgtgcacaagagccaacttgcgcatgcagaggaaaagctctcgaaggaaattaaaagtgctatttcagtgaacatggcaactgataaagcgaaacagccttatcgctgatatgaagaaagttttagtgtctggacagaagatcaaaccagccataacattcccttatgctgaagtcgaatccacagcaaggccctaactctcttcaattctgtgacggccaagaaaggtgaagaagctgcagacgaaaagttgtaagcaaacagaggttgattcttgaggtttaaggaaaaaagccctccccataacacaaaagtggaaggtgaagcagcatgtgctgatgtagaagctgctaagataattgatgcaggtggctacactaaacagattttcagtgtggatgaaacagctttctgttggaagaagatgccatctaggactttcataacctgagaggagaagtcagtgcctggcttcaaaggacagtctgaccctcttgttaggggctaatgcagctggtgacttaaagttgaagccagtgctcatttaccattccaaaagtcttagggcccttaagaattatgccaagtctgctctgcctgggctctataaatggagcgacaaagactggatggcagcacacctgtttatagcatggtttactgaatgtgttaagcccactgttgagacgtattgctcggaaaaaagattcctttcaaaatattaccgctcattgacagtgcacctggtcatctaagagctctgagggagatgtacaggagatgaatgttgttttcatgcctgctgacacatctgttctgcagcctgtgaaggagtaattttgactttcaagtcttactatgaaatacattacttaactagagctgccatagatagtgattcctctaagagatctggcaaagtccattgaaaaccttctgggccgggtgtggcagctcacacctgtaatcctagcactttgggaggccgaggcaggtggatcacgaggtcaggagatcgagaccatcctggctaacacagtgaaaccctgtgtctactaaaagtacaaaaaattagccgggtgtggtggcgggtgcctgtagttccagctactcgggaggctgaggcaggagactggtgtgaacccaggaggcagagcttgcagtgagccaagattgcgccactgcactccagcctgggcgacagagggagactccatctcaaaaaaaaaaaaaaaccttctggaaaggattcacctttctagatgccattaagaatattcatgattcatgggaggaggacaaaatatcaacataaacaggaatttggaagaagttgattccaaccctcatgggtgactttgaggggctcaaaacttcagtggaggaagtcactgcagatgtggtggaaatagcaagagaattagaattagaagtagagcctgaagatgtgactaaattgccaagatcttatgattaaacctgaacagaattgccaaacttgaacagaattgccaaaatcttatgatcaaacttgaagagttgcttcttctggatgagcaaagaaagtgggaacatacagaaaacaaacattaaatggcagatttaaatcccactaggccactaattaaatacaatggtctaacacaaataacagagactagcagaagagattagaaaatacagcccaactatatatgttggttataagaagtgttcttcaaatataatgacataggtaagttaaaggatggaaagaagatatattatgcaaacagtaatcaaaagatagctggagtcgctataaagtgggaaaaaaaaaatgaccaggaacaaagagagactttaaagggccaaatcaccaagaaggcacccttgagtattttgtaaatgtcagttcattccatttggttgataatgttgttcatgtcctctccaaccttggcaatttcttttcttctttttcgatacagtatctcgttctgttactcaggctggagtgcagtggtgggatcacagctcactgcacccatgacctcctgactcaagcgatcctcccacctcagcctcccaaagtgctgggatattacagacatgagccaccacatccagcctggcaaactttttatgtaggagttcagacaagtatcttagcctctatgggccgcatgcagtctctgttacatatttgtcttctgtttttttttttccttaaccatttaagtacataaaacctattcttagctcacagactgtacaaaaatgggatacaagccagatttggtcatggaacatggtttgctgaccaaggatctaaatagatgcagagaaatcatttgataaaatcaaatatccgtgatgaaaaaaaatcctcagcatcgagaaatagaaggggacttcctcaaatagacgagggacattcaaaattttcactgtgcctcctgatgaggaggaagggacggccatgacttttttcttggtgtttgcaaaaagtagggcagatatagtgaaaagtttctgtcctggtcggtcattcttttcccaacactttggctggaaagagtaagattttcttagggcgtgttttgtctgtgaacgttggcatgtctgtgttataggcactttgaaagcctgaggcctggttatgtaaggagtcaaaaaaaccagaaacctaggaaattcatcattaggtcattcctgggtctcaggttactagccagtttgtcttcttttcttcactttttcagaatcctctgttagttgcattataaattttattcagttttttttctttctggtgattaatgagggaatagcatggtatgtgcttattccatcttttcgtaaattaggggtttgagatagcttttaaaaaattatgcataattagttctcactgttattttgttttttaagcctaaggattttattggggcaacttctgttattttgttagctgttgagtagtgtgttaacatgaatatgtacgttgttaagatctcattttagttctgagcatctcctttttagtcttatcaagttttcagcctgtacagatgtgaatttctgtttttgctaagtaccctacagatagccaaaataaggagtggttagcacggattgtcaactcattcttttttttttttttgagacagagtttcattcttgttgcccgggctggagtgcagtggcgcgatctcggctcactgcaagttccgcctgctgggttcacaccattctcctgcctcagcctcagagtagctgggactacaggtgcctgccaccatgcccggctaattttttttttttaatttttagtagagatggggtttcactgtgttaggcaggatgctcttgaactcctgaccttgtgatccgcctgcctcggcttcccaaagtgttaggattacaggcgtgggccaccgcgcctggccgctgttcttactgtctttatgaccaataaggtagaagagtacatagtgtacagatttttatataatgtgttgactatattaacattcctctccttgccttccaaaaaagtcttcagtaatgaagagaaggaatccaaccaagagaaattataccaaggtatgagaggtctaggtgggcagatggcttcagcccagaagttcaagaccagcctggataacatggtgaaaccctgtctctaccaaaaaatacaaaattaaccaggcatagtggcatgtgcctgtagttccagctactcaggaggctgaagtgggaggatcacttgagcctggtaggttgaggctgcagtgagctgagatcatgccactgtactccagccacagggaaagagtgagatcttatctcaaaaaaaaaaaaagaaattataccaacatatttgcagttggatagtggaattcaatagattattgacatttgaattgtttctttgctgtgtttggtgagaataaacttagaaatatcaaaagaaatatatgtttatattccttaacattttatttaaggatgtgatgcattaaaggcagtattttttttttccacatgtttttattgcttaaaggtgggaaaggtttttattcctggactgccagctccctctctgacgatgtccaacacaatgcctcagcccagtactccacttgatggcgttagtgctccaaagcctcttagtaaactccttggatcattggacgaggtaagaaaaggactaggtgctgccaaaaagttaacattttttaaagaagtttggttaaatattagttctttccatggttaacttaattttagtttctacttgcagaataaatgttttcaaacagaagtgattcagttaacatacgctgacctcccttgtgatgtatgtgatactttttgaaggtgctggagagatggaaatgatacattcttttccatctagggatctcacaatcgtgtggagttgatgtactgtctgcataagaaattagaatttaagaaagactcatgactcagtaatgtggaaaagagagtaccatcgttgattgactgatgggaagataacatccaatgggaggacatggcaaaatcaaagcctcatctctgagagacatgtcagtcttcgtttggaccttggggatgagtaggatatctgtaggtagaaaggagcattcagggcaaggagaaaccacacaggcacaggcaggaaggccagataatgcggaacattttttaatggatatttgtatcttcatctcctagtcataaggactgaataaatctgtagaataaatacttataaaagtacaagtagtctgtagggtgaggcaggatagggtttggataacaataataaccttttttgagcattttctatgtgctaggcattgttctcagtgctttattggtaataattatttccttagaacagctttattgagaagatagtactatgattcttttttttacaaatgagatagaggttacaaatgaaataaacctactaagtggtagaactgggatttacactcttactaatgtgctcttaaagggagaaaggatgaaaaggtggttttcttctgaatgcaattgacagggcattacaggattttgagaaaggagttacgaggttttggatctgtgttgtaaataggtgtattttgggattcaagataaggagaccagttagcctccaagtgaggttgtctgtgtcagtttaagaagtatgaagagggtctgagctagggcagtatatgtgtggaaaggagggattaatatgagaggccttgagaggtggaaatgagtttgtcagctgattggttttgtgctgctgggctggggaaaggtgatgtggaaggaggctctgaattctctgaacgacctgggaaggtacctggatttaccaagttaggaagcctggagaaaagtggtttgtatttaaaggacatgtgagtgtggatgtttagggacggttcaaagggaaggttagtgctatctgttgtatttgataatgtctatgtcttcattatatttttaaacatgtgccacattgaattttttttccttcaaaccagcacatttgcagaacattcaaagggggaactggagaagtgtcagagtgttttgtgtgatttggaagaatttcttttataatggaaaatggtttccaacttttttagaattctataagcctggtaatagtgcctttttgataggtgtaaggtcatggaaatgatagtctgacacattggctgatggcttttccacttctctggaagattttgctagtagacttagagccaggaccagtggagctgaatttttcctggtgacttttagagtagaatctggaatagaataaatacatcttagtcttgattgtcagtgttgacaagatattcacttagagatatataaattgaattaaaggaatcaaaaaaggatcagtggtcatgactagagattaagattggaagcatctgcatgtagatagtaactaagaccatttaaattttttgtttgcatatctgcagttaagcaaataaatgctgttcctgtatttttgaataaataattgcctataggggaaataccactaaatcctggtctcatttgttggctttttcattactgtcctttcttcctgggctcttagttcctcagctgcctcaaatcacagtttagtcttttgttttttgttttttgtttttttttgagatggagtcttgccctgtcatccaggctggagtacagtggggcaatctcaccgtactgcaacctccacctcctgggttcaagcgattctcctgcctcagcctcccaaatagctgggactacaggcacctgccaccgcacctggctaatttttgtatttttagtagagatggggtttcaccatgttggccaggctggtcttgaactcttgacctcaagtgatccgcccacctcagcctcccaaagtgctgggattataggcatgagccaccacgtgccccggctcacagtttagtctttagccctgtaaggttgctaacagtgctgctggcttctctccctcttagctatgactttccttgcatattgtcagcctttccatatgttcctcttaccaccaaaatttgcagatggccagagcagaaaaagcaaggttctccaagaacgttggcccctttccctgcagttgccttctctcctagatcttggtccctcaagtccaggttgcttccacagcttttccacagccaccaatcagatgttttccttttacctaccttttctagctgtttcctgtgaggaccttggtttgctggtacttcattgtatctggaacaaaatgttttaaacagcctgggtcttgccgtgtcatccaggctggagggcagagactattcacaggctcactacagcctcaaattcctaggcttaagtgattctcctgtctcagtcttctgagtagctgggactatacaggtgtgcaccaccatgcttggcttggagcagaatgtttttgaatcattacatattattgtttgttagaccatatgcaaaaaagaaatagttaaatttccttgtccttaatttctcagaaaacaattcatttgtgttgtatttacgactttttacaggttctcctgttgtccccagttccagaactgagggattcttcaaaacttcatgattctctctataatgaggattgtactttccaacagcttggaacttacattgattctatcagagatcctgtccataacagagtcaccctagtaagtataaacatttggtagctttccaagaagtgggctggcatttcaaatttgacagaatacagaattttgtctgaaaaatgacaacaaacatttctcatgatttaaaaaaatctattgtgtcattttttggcactattttactttttactatacagtaattctgcttgttttctacagtttctgtattattaaaaacttagtgaaaacaaaagcttgttgagtcagttgaattgtaaattgatgtgattttttgtcgtctcattaaaagtaaatgtccttttgatgatggtgactcactgtataaagattagacactttttattaaaacaagcattttggaaaacattttgcaaataattacatttaaagtttctgaaatttggaagtgttcatttctgtttgaaaattgtttttcatttattttattgctttgatgggcaaagtcttgtaccagctatttttaagacattcaaagacttagaatgcacagattttatttactttctcatttgtttccatctaggaactgagtaatggctccatggttaggatcactgttcctgaaattgccacctctgagttaggtacgattgagaagtttcatttataagacatgaagtaattgtgatttacattaataattggggttttaaacattattttgccatttttgaagccactggatcaagttcttagctttgtagaggagccttaaagagctagggagtgctttgtgatgtccactctatgtgtgctctaaggctggagtacaggtgaaggatgtgctatttctgttctctgaggttcttctgttggggaatattgtgcagtataataatatatggacatgcctgctgggcatggtggctcactcctgtaatcccaacattttgtgagactgaggcaggtggatcgcttgaggtcggtagttcgagaccagcccggccaacgtggtgaaaccctttctctactaaaaatacaaaaatcagcggggtgtggtggtgcacttctgtaatctcagctacttgggagtctgaggcaagagaatcgcttgaacccagaatgcggaggttgcagtgagccgagatcgtgccactgcgctccagcctaggtgatagagtgagactcagtctcaaaaaaaaaaaaaatatatatatatatatatatatgtatatatatatatgtatatgtatatatatatgtatatatatatatgtatatgtatatatatatatgtatatgtatatatatggacatgcctcttgcaagaacatctgggaaactggaagcctaagcgactaagataattcttggcatatttaatgtttttttctgtaatgtattaatgatgtttttaattttaaaatgaatatctcaattttcagataaattgtgaaagtaacctaattgccttaattgaataaaacttaatattattgtcaaaatacaatcagaattatcttaataaatattggattctgcttgaattattcctgagatgcaatttcaaaaatgctagaggagaatatttctgaacatagcatagtaaacaaaatgttagaattgaagggatttgccaacaaacgtaggttaagaaaagaatgcctgtatgatataaggaagttcatgacatatcttggtttccaatctaactgccaaagcaagacattggcagattgtagacaagaataactttttcattttaggaattttcactgctggtaaatggtattccaagttgctatagagattccttgccttctaaaaggtatttcgtaatcacaaggccaggtacctagaagtatgataagcctaagcaaaatatataaaaacaaataataatggaagaaattaaataaataaaaacaaaaaatcttacccctttatagccaaatagaagccccatagtttatgcacataagtttatgtactttacctgcaaagggttctcacacactcatgcagcattgggtttacacttattttggattcagctatgacatacttggttatatggtattttaatattatttgcttccaacctgtgctgtgtgagtttgcatattgcaaactgacgggatagaggatatgctgatgagggtgggcccagtggcatgacagtggaaagggaaaaaagaatcctggaagagaggatatgtgagtacacaaacattgcagtttgggattatttactactaaaagcagatttgggtctcttcacagtggtagccctggccactctgaggggatcattgtatgacagtgtagtgctataattgatgtggagccactgagaatggtataaggccaggtgtggtgggctcgtgcttgtaatcccctccctttggaaggctgaggtgaggggattgcttgaggccaggagtttgagaccagcttggacaacatagtgagactcggtctctacagaaagaaaaataaaatcagccaggcatgctggcatgcatctgtagtccttgctacttgggaagcttgagctggtggaccacttgagcccaggagctggaggtgacagtgagctataattgcaccactgcactccagcctggggacagaggaagaccctgtttccacttaccaaaaaaagaatggtgtaaattatgtggtatcaactcttaacccttttaaggcagagagcatgtgaaacattttagaaactgaacgacatcagaaataaagttataaagctttggttaataggcatgttaagtcatttagaacatcatgtaatgctagctaagcattgctattcgtggatgcatatattgaatattatatatttactgaagtatgtaggcagtattttatataaatgtataaacatagaagttgtatgtttttcatagtgacttttttttttttgagacagttttgctgtagtcatccaggctggagtgcaatggcgtgatcttggctcactgcaacctctgcctcccgggttcaggcgattctcctgcctcagcctcctgagtagctgggattacaggtgcctgccacaatgcccaactaatttttgtatttttagtagaaatggggtttcaccatgttggtcaggctggtttcgaactcctgacctcaggtgatccacccgccttgacctcgcaaagtgcttagattacaggcgtgagtcaccatgcctggcccatagtgacttttaatttgtcacccgagctagaacatctttaagagtgaaggggagcagttagtaattgctaggcaatggatgtaaatcaggactgtctctggcaaactgggctatttggttactttatttctgatgcaaaattaatgatcaaaaagctgtccttggccgggcacagtggctcacacctgtaatcccagtgctttgggaggccaaggcaggtggatcatgaggtcaggagtttgagaccagcctggccaacatggtgaaacatggtctctactaaaaatacaaaaattagcctggggcagtggcagacgcctgtaatcccggctacttggtggctgaggcaggagaatctcttgaactcaggaggcagaagttgcagtgtgccaagactgcgccacagcactccagcctgggcaacagagcgagacaccctctcaaaaaaaaaaaaaaaaaaaagctgtcttcagacccctttcaagccctgttgaattcagtagttggttttagtttcagatgatgggttaggtaatgtttgcatctcattggctctttaatgacagttttcttttcataataattggcctttacatagtagaagttaaagaaacttggttattgaaaggggaaaagaaatgcatgcagagtaagaatactaaaattaatctttgcttttaatagtacaaacgtgtttgcaaacaattaagtttatcctgccaaaagaaatagcagttcagatgcttgtcaagtggtacaatgtccacagtgctccaggaggacccagttatcactcagagtggaatttatttgtgacttgtctcatgaacgtgatgggttttaacacagaccgcttagcatggactagaaatgtaagtaaatacaattgttttctttatgagttattctgttaatgtaatggttgcataattggtaatataacattgagactatataataggcgtaccatattcaaaataatagaataatattaaggtttattgtatctatatgttgtaaatcaaatctcacttaatatttaatgttaacattttactagtgattataattactgagctttagaatgttaaagcatatatgactatttctcatttcacctttgtaaaatgactgcaagttatgctaggattagtgatagtcttggttttattgatgaagaaactggatcacaaagaaatcacagatctgtgattttttaaaaactatgactagactgcatcttctgactccttgtttaacattgttttctgaagataagattgtctttttacacacatattgcttgggatgtgaagaggaaggtttgatttgagggagatttaaagtgctttagcctgagtatctactctgttaatggtagaaagccttacctctcaccctcttcccccagtaacatccttacaggcccttattagattatttacaaaatcagcagagtggtgtcttcagtattggtgatctccttctagctttggagatcactcccaggacaactttgcctgggtcactctgaaaaaaaatcactctagactataattaccccttttccaggtagctcagctgtaccattctatatgttttagccttgcacaccaaatccttttttttttttttttttttgagacagaatgtcgctctgtcgcccaggctggagtgcaatggcacaatctcagctcactacaggctctgcctcctgggttcatgccattttcctgcctcagcctcccgagtagccgggactacaggtgcccgccaccacgcccggctaattttttgtatttttagtagagatggggtttcaccatgttagccaggatggtctcgatctcctgacctcgtgatctgcccgtctcagcctcccaaagtgctgggattacaggtgtgagccaccgtgcctggccagcaaatccatttttaaaacttgttttttgtcttaattatgaaaggaaaatgtggaaaatggaggaattaagaaaataattatactactcagagataaccactctaaatatttttgatgttaccttctatataaaaataccaatgaaaatttcccgttatcattaaaaattttttctaaaatatctccatcatttcttcatagtgtagttttatcataattaaccaatagctaataattgtaccttgtgaatctgttgttttcgttattggaatttataaacatcctttttcacgactctttaaccacatctctagttacttcccaagaattgaatcttaaaagagaaactgtgaggtcaagtaatgtttggaaaggggttcccaggtgacattcttactagcatcatttaaaagcgcccatttcaccacagtgtttatttgtggtgtggtgaacctttgccagcttcctgagaaattttatcttatttctctataagtaaatgggaatggttttttcaaaatttcatcagttatttatagttcttattttttgattcgtatttcatgtcctttgtctatgttccagtctcttctcagaccagtggccaaagtaatcctgtttgataacgtcaggttgcgttcgtcacgcctctgcgtagaatcccccagtgacttcccatgtcactcagagtaaaggccataggcctataagatgccatgtgacctagcccttgctcaccttcctggtcttatttcttaatgctttgcacacatcatcccggccacattggcctcagctctgttccctgagcactgccagcatgtttctgcctctgagtgtttgcacttgccattacctctatggagaatgctttccctccgacaagacgtgcttaggtctttattcagatgtcacctcagtgctgcctgtcctgtctctctctatagaattacacctgcctccatacctttagtgccatttacctgtttttctttcttctcacttaattaaatataatatactatatgttttacttattttgttttgtatccctcctcccccaactggaatgtaaattctaggaaggcaaagatttttgcttagttttgtttactactctctctctccaggacctgtggtattgcctggcatagaaggatactcagtgaacatttgttgagtgaatgccgttttccatctgagtgaggtactgtttttaagagtttgtgtctatttcagcacatgaaggaattgctgtctgcaatttcctttagaaaaatcttatgggaaaatagggacaattttcttttcttttctttccttttttaagacggggtttcactctgtcgtctagggtggaatgcagtggcgctatcctggctcactacagcctctgcctcctaagttgaagcgattcttgtgcctcagcctcctgagtagctgggattacaggcatgcacctccacgcctggctaatttctgtatttttagtagagacagggttttgccacgtgggctatgctggtttcaaactcctgagctcaagtgatcctcccaccttggcctcccaaagtgctaggattaccttcttttcttattttaaacaattgtatccaagtgacattatccccaatttttctgttctttattacatgtgaaaagattaagcctcatagaaactggatttctacattatgaaaaagcatgtcagctttctgtagttttgtgtatcattgtccttggaacttgttgatgagtacagattgttgtgtcctagtctctggcagagaacctatgccccctcgcgtttccatgttttggggaggactgagcacctacccattttttcctttgcaaagaaggacatggctctttgacttacttattgcatgataattataaaggaaggaataaggaaatcaattcttgaggccaagttgctttgccatttatttataggactgcgtggttaaacccttgctatcttttgtcctcatagtcaaagcttaggatgaaatggtcctcattggcaaatggttttcattttgctttgttcagatttattctttttgttttcacatatataatgtggtggagtacagaatttctgccaatgactcgttacacaatttttggcatttctttgtgctttctttaatttgctgatgtgttacatgagtgcactggactgtacattgtaggaacagttgcatttggggttaactttttgtggcttttgggctgctctttttttcattagataaatattgaatccctgctgtgggccaggcatgatgccaggtttctcacatataccccagacaaaacagattgttcctctggaattgactgtcttgagggaaacaaataaataatatttgatacatgtgttatgatagatgaagggtaagggtccataggagcatataacagggttggctaacctgagacacattgaaagagtgaagattaaacagatccatgtatggcacaaagagccatccttatcaggcagtttctactttctcataactccaggccttatgaatctgataattatagcagggacattctttttgactgtgggactttgtgtgtgttacattttggttgaagttttaggttagatagttactgttatatttgttgctttgatttcactgttactaccaggttttttataatatatatgagttgggctgttttttatttgaatgcttcacaagcaaatcttctctctcaataacattcggttttaaaaatcactttattgctacctatgtttagtttttatatagaaatcaactctgtttaggtgagtgagttgataaatatgtaagtttttcagcataggaaaatagccattgccatttatagagttacagtttattagttgatggtcaatgtccatgtgaagtagctggggcagcaaagattatgccaggggaaattgaagaagagcaacttgcagaaaactgctttgatgtagttgtactagttaaaagataggctcactattgtaatagaaaggcctcaaaagatacaatggctcaaacacaataaaaatgtctgtcttgtttacataacagggcttagcagataaacaggccacacagttattcaggaacccaggttgatggaggatcttttgtcttcggttcaaagcttgccgttggttgactgcattccagtcaggtggaaggggcaaagagcctggaggagcaggggtaggactggactggtcctggaagtgatgacagtgacttccatttataattaactctgtcaaagggtcacacctaacttcaaaggaggcagacgtatgtatgtagtctggctgtgggttcagtagaaagaggagaaaaaagattttccagagtagctacttgtctctgccatagaattgttagatagtttactgtaggtggactgtaaataaatgtttgcttagttctaacatttgactgatattgggttgatcctttgagacttggtatattgtggatatgcctaaagtttctttttctaccaaagatgtgatgtaatctatgtcgttacagaagtaggagagggaaggaaactaccattaaaatcagtccttaggagcccaggcactgttctagatgtttgcatatattaatatgatttcatttcatctttacagtaacctggaagaaagatatttaaataatgactttccagatcaaaaaatgagttttgatggcttttctcagttttcataattggcagaactgatttccgaatcctttaagttgatcagttgacaggaatgcatttatgatttttatcttttcttttggggttacttttcagtttgactttgaaggatcactttcccctgtcattgcacccaaaaaagcaaggccttctgagactggatctgatgatgtaagcattattatttcttgctaatataaattaatttatggatattcatactattcttccacttctgtggtattcctatcaattcctctatctttccaacacctttcactttatttattttaatactgaatagcaattattttgaagagtaggatctgttacattttctagggtctttaatgattatccaaaaattaatgtatgtattactgcatgatttcagtttgggtttgtagacattttattatcaactgatcacctgaaatgacagcatttaccttttttatgcagtgttttttaaattaaggttctcaatcgtatcaggttccatggtatattcctttttttttttttttttttttttgagacggagtatcgctcttgttgcccgggatggagtgcagtggcacgatctgagctcactgcaatctccgcctcccaggttcaagcagttctcctgtctcagcctcctgaatagctgggattacaggcgcccgccaccatgcccggctaatttttgtagttttggtagagacagggtttcaccatgttggccaggctggtctccaactcatgacctcaggtgatccgcccgcctccgcctcccaaagtgttgggattacaggcgtgagccacggcgcccggcgggcaagacaccctcagagcacagggtgctgccaagagcccggccgagtgcagctggagcgccgacgtcgccaaggatacacagtgctgacgcagtacacaagtgcgtcacagtggtcctccgccggctacgtcagtggctttcaggcgctttcctgttggaattggcgactgctgcggggctgagcgctggtttcacgcgtctcgggagccaggttggcggtgcgatgaggcgcagcaaggcctacggggagcggtacctcgcctcggtgcagggctccgccccgtcgcctggaaaggtgagtggatctcgaagagaccgacggcctcgacctggcggggcggtggcctcgacctggccgggcggcggcggcggcctcggcctcggcctggccgggcggcggcggcggcggcggcggcggcggcggcggcggcctcggcctcggccccggcctggccgggcggcggcggcggcggcggcggcggcggcctcggccccggcctggccgggcggcggcggcggcggcggcggcggcggcctcggcctcggcctggccggacggcggcggcggcctcggcctggccgggcggcggcggcggcctcggcctggccgggcggcggcggcggcggcggcctcggcctcggccttggcctcggccgggcggcggcggcggcggcggcggcggcggcggcggcctcggcctggccgggcggcggcggcggcggcggcggcggcggcggcctcgacctggccgggcggcggcggcggcggcggcggcggcctcgacctggccgggcggcggcggcggcggcggcggcggcggcggcggcggcggcggcggcggcggcggcctcggcctcggcctggccgggctgcggcggcggcggcggcggcggcggcggcggcctcggcctggccgggcggcggcggcggcggcggcggcggcggcctcggcctcggcctcggccttggcctcgacctggccgggcggcggcggcggcggcggcctcgacctggccgggcggcggcggcggcggcggcggcctcgacctggccgggcggcggcggcggcggcggcggcggcctcgacctggccgggcggcggcggcggcggcggcggcggcggcggcctcgacctggccgggcggcggcggcggcggcctccacctggacgggcggcggcggcggcggcggcggcggcggcggcggcctcgacctggccgggcggcggcggcggcggcggcggcggcggcggcggcggcctcgacctggccgggcggcggcggaggcggcggcctcgacctggccgggcggcggcggcggcggcggcctggcctaaggtacttctgttggggaatattgtgcagtataataatatatggacatgcctgctgggcatggtggctcacacctgtaatcccaacattttgtgagactgaggcaggtggatcgcttgaggtcggtcgttcgagaccagcctggccaacgtggtgaaaccctttctctactgaaaatacaaaaatcagcggggtgtggtggtgcacttctgtaatctcagctacttgggagtctgaggcaggagaattgcttgaacccagaatgcggaggttgcggtgagccaagatcgtgccactgcactccagcctaggtgatagagttagggttagggttagggttaggcaagacattggcagattgtagacaagaataactttttcattttaggaattttcactgctggtaaatggtattccaagttgctatagagattccttgccttctaaaaggtatttcgtaatcacaaggccaggtacctagaagtatgataagcctaagcaaaatatataaaaacaaataataatggaagaaattaaataaataaaaacaaaaaatcttacccctttatagccaaatagaagccccatagtttatgcacataagtttatgtactttacctgcaaagggttctcacacactcatgcagcattgggtttacacttattttggattcagctatgacatacttggttatatggtattttaatattatttgcttccaacctgtgctgtgtgagtttgcatattgcaaactgacgggatagaggatatgctgatgagggtgggcccagtggcatgacagtggaaagggaaaaaagaatcctggaagagaggatatgtgagtacacaaacattgcagtttgggattatttactactaaaagcagatttgggtctcttcacagtggtagccctggccactctgaggggatcattgtatgacagtgtagtgctataattgatgtggagccactgagaatggtataaggccaggtgtggtgggctcgtgcttgtaatcccctccctttggaaggctgaggtgaggggattgcttgaggccaggagtttgagaccagcttggacaacatagtgagactcggtctctacagaaagaaaaataaaatcagccaggcatgctggcatgcatctgtagtccttgctacttgggaagcttgagctggtggaccacttgagcccaggagctggaggtgacagtgagctataattgcaccactgcactccagcctggggacagaggaagaccctgtttccgcttaccaaaaaaagaatggtgtaaattatgtggtatcaactcttaacccttttaaggcagagagcatgtgaaacattttagaaactgaacgacatcagaaataaagttataaagctttggttaataggcatgttaagtcatttagaacatcatgtaatgctagctaagcattgctattcgtggatgcatatattgaatattatatatttactgaagtatgtaggcagtattttatataaatgtataaacatagaagttgtatgtttttcatagtgacttttttttttttgagacagttttgctgtagtcatccaggctggagtgcaatggcgtgatcttggctcactgcaacctctgcctcccgggttcaggcgattctcctgcctcagcctcctgagtagctgggattacaggtgcctgccacaatgcccaactaatttttgtatttttagtagaaatggggtttcaccatgttggtcaggctggtttcgaactcctgacctcaggtgatccacccgccttgacctcgcaaagtgcttagattacaggcgtgagtcaccatgcctggcccatagtgacttttaatttgtcacccgagctagaacatctttaagagtgaaggggagcagttagtaattgctaggcaatggatgtaaatcaggactgtctctggcaaactgggctatttggttactttatttctgatgcaaaattaatgatcaaaaagctgtccttggccgggcacagtggctcacacctgtaatcccagtgctttgggaggccaaggcaggtggatcatgaggtcaggagtttgagaccagcctggccaacatggtgaaacatggtctctactaaaaatacaaaaattagcctggggcagtggcagacgcctgtaatcccggctacttggtggctgaggcaggagaatctcttgaactcaggaggcagaagttgcagtgtgccaagactgcgccacagcactccagcctgggcaacagagcgagacaccctctcaaaaaaaaaaaaaaaaaaaagctgtcttcagacccctttcaagccctgttgaattcagtagttggttttagtttcagatgatgggttaggtaatgtttgcatctcattggctctttaatgacagttttcttttcataataattggcctttacatagtagaagttaaagaaacttggttattgaaaggggaaaagaaatgcatgcagagtaagaatactaaaattaatctttgcttttaatagtacaaacgtgtttgcaaacaattaagtttatcctgccaaaagaaatagcagttcagatgcttgtcaagtggtacaatgtccacagtgctccaggaggacccagttatcactcagagtggaatttatttgtgacttgtctcatgaacgtgatgggttttaacacagaccgcttagcatggactagaaatgtaagtaaatacaattgttttctttatgagttattctgttaatgtaatggttgcataattggtaatataacattgagactatataataggcgtaccatattcaaaataatagaataatattaaggtttattgtatctatatgttgtaaatcaaatctcacttaatatttaatgttaacattttactagtgattataattactgagctttagaatgttaaagcatatatgactatttctcatttcacctttgtaaaatgactgcaagttatgctaggattagtgatagtcttggttttattgatgaagaaactggatcacaaagaaatcacagatctgtgattttttaaaaactatgactagactgcatcttctgactccttgtttaacattgttttctgaagataagattgtctttttacacacatattgcttaggatgtgaagaggaaggtttgatttgagggagatttaaagtactttagccgagtactataccatctactctgtacttataccatctactctgttaatggtataaggccttacctctcaccctcttcccccagtaacatccttacaggcccttattagattatttacaaaatcagcagagtggtgtcttcagtattggtgatctccttctagctttggagatcactcccaggacaactttgcctgggtcactctgaaaaaaaatcactctagactataattaccccttttccaggtagctcagctgtaccattctatatgttttagccttgcacaccaaatcttttttttttttttttttttttttgagacagaatgttgctctgtcacctaggctggagtgcaatggcgcaatctcagctcactacaggctctgcctcctgggttcatgccattttcctgcctcagcctcccgagtagccgggactacaggcgcccgccaccacgcccggctaattttttgtgtttttagtagagatggggtttcaccatgttagccaggatggtctcgatctcctgacctcgtgatctgcccgtctcagcctcccaaagtgctgggattacaggtgtgagccaccgtgcctggccagcaaatccatttttaaaacttgttttttgtcttaattatgaaaggaaaatgtggaaaatggaggaattaagaaaataattatactactcagagataaccactctaaatatttttgatgttaccttctatataaaaataccaatgaaaatttcccgttatcattaaaaattttttctaaaatatctccatcatttcttcatagtgtagttttatcataattaaccaatagctaataattgtaccttgtgaatctgttgttttcgttattggaatttataaacatcctttttcacgactctttaaccacatctctagttacttcccaagaattgaatcttaaaagagaaactgtgaggtcaagtaatgtttggaaaggggttcccaggtgacattcttactagcatcatttaaaagcgcccatttcaccacagtgtttatttgtggtgtggtgaacctttgccagcttcctgagaaattttatcttatttctctataagtaaatgggaatggttttttcaaaatttcatcagttatttatagttcttattttttgattcgtatttcatgtcctttgtctatgttccagtctcttctcagaccagtggccaaagtaatcctgtttgataacgtcaggtagcgttcgtcacgcctctgcgtagaatcccccagtgacttcccatgtcactcagagtaaaggccataggcttataaggtgccatgtgacctagcccttgctcaccttcctggtcttatttcttaatgctttgcacacatcatcccggccacattggcctcagctctgttccctgagcactgccagcatgtttctgcctctgagtgtttgcacttgccattacctctatggagaatgctttccctccgacaagacgtgcttaggtctttattcagatgtcacctcagtgctgcctgtcctgtctctctctatagaattacacctgcctccatacctttagtgccatttacctgtttttctttcttctcacttaattaaatataatatactgtatgttttacttattttgttttgtgtccctcctcccccaactggaatgtaaattctaggaaggcaaagatttttgcttagttttgtttactactctctctctccaggacctgtggtattgcctggcatagaaggatactcagtgaacatttgttgagtgaatgccattttccatctgagtgagatactgtttttaagagtttgtgtctatttcagcacatgaaggaattgctgtctgcaatttccttgagaaaaatcttatgggaaaatagggacaattttcttttcttttctttccttttttaagacggggttttgctctgtcgtctaggctggaatgcagtggcgttatcctggctcattacaacctctgcctcctaagttgaagcgattcttgtgcctcagcctcctgagtagctgggattacaggcatgcacctccacgcctggctaatttctgtatttttagtagagacggggttttgccatgtgggctatgctggtttcaaactcctgagctcaagtgatcctcccaccttggcctcccaaagtgctaggattacaggtgtgaaccatggctcctggccttcttttctaattttaaacaattgtatccaagtgacattatcctcaatttttctgttctttattacatgtgaaaagattaagcctcatagaaactggatttctacattatgaaaaagcatgtcagctttctgtagttttgtgtatcattgtccttggaacttgttgatgagtacagattgttgtgtcctagtctctggcagagaacctatgccccctcgcgtttccatgttttggggaggactgagcacctacccattttttcctttgcaaagaaggacatggctctttgacttacttattgcatgataattataaaggaaggaataaggaaatcaattcttgaggccaagttgctttgccatttatttataggactgcgtggttaaacccttgctatcttttgtcctcatagtcaaagcttaggatgaaatggtcctcattggcaaatggttttcattttgctttgttcagatttattctttttgttttcacatatataatgtggtggagtacagaatttctgccaatgactcgttacacaatttttggcatttctttgtgctttctttaatttgctgatgtgttacatgagtgcactggactgtacattgtaggaacagttgcatttggggttaactttttgtggcttttgggctgctctttttttcattagataaatattgaatccctgctgtgggccaggcatgatgccaggtttctcacatataccccagacaaaacagattgttcctctggaattgactgtcttgagggaaacaaataaataatatttgatacatgtgttatgatagatgaagggtaagggtccataggagcatataacagggttggctaacctgagacacattgaaagagtgaagattaaacagatccatgtatggcacaaagagccatccttatcaggcagtttctactttctcataactccaggccttatgaatctgataattatagcagggacattctttttgactgtgggactttgtgtgtgttacattttggttgaagttttaggttagatagttactgttatatttgttgctttgatttcactgttactaccaggttttttataatatatatgagttgggctgttttttatttgaatgcttcacaagcaaatcttctctctcaataacattcggttttaaaaatcactttattgctacctatgtttagtttttatatagaaatcaactctgtttaggtgagtgagttgataaatatgtaagtttttcagcataggaaaatagccattgccatttatagagttacagtttattagttgatggtcaatgtccatgtgaagtagctggggcagcaaagattatgccaggggaaattgaagaagagcaacttgcagaaaactgctttgatgtagttgtactagttaaaagataggctcactattgtaatagaaaggcctcaaaagatacaatggctcaaacacaataaaaatgtctgtcttgtttacataacagggcttagcagataaacaggccacacagttattcaggaacccaggttgatggaggatcttttgtcttcggttcaaagcttgccgttggttgactgcattccagtcaggtggaaggggcaaagagcctggaggagcaggggtaggactggactggtcctggaagtgatgacagtgacttccatttataattaactctgtcaaagggtcacacctaacttcaaaggaggcagacgtatgtatgtagtctggctgtgggttcagtagaaagaggagaaaaaagattttccagagtagctacttgtctctgccatagaattgttagatagtttactgtaggtggactgtaaataaatgtttgcttagttctaacatttgactgatattgggttgatcctttgagacttggtatattgtggatatgcctaaagtttctttttctaccaaagatgtgatgtaatctatgtcgttacagaagtaggagagggaaggaaactaccattaaaatcagtccttaggagcccaggcactgttctagatgtttgcatatattaatatgatttcatttcatctttacagtaacctggaagaaagatatttaaataatgactttccagatcaaaaaatgagttttgatggcttttctcagttttcataattggcagaactgatttccgaatcctttaagttgatcagttgacaggaatgcatttatgatttttatcttttcttttggggttacttttcagtttgactttgaaggatcactttcccctgtcattgcacccaaaaaagcaaggccttctgagactggatctgatgatgtaagcattattatttcttgctaatataaattaatttatggatattcatactattcttccacttctgtggtattcctatcaattcctctatctttccaacacctttcactttatttattttaatactgaatagcaattattttgaagagtaggatctgttacattttctatggtctttaatgattatccaaaaattaatgtatgtattactgcatgatttcagtttgggtttgtagacattttattatcaactgatcacctgaaatgacagcatttaccttttttatgcagtgttttttaaattaaggttctcaatcgtatcaggttccatggtatattccttttttttttttttttttttttgagacggagtatcgttcttgttgcccgggatggagtgcagtggcacgatctgagctcactgcaatctccgcctcccaggttcaagcagttctcctgtctcagcctcctgaatagctgggattacaggcgcccgccaccatgcccggctaatttttgtagttttggtagagacagggtttcaccatgttggccaggctggtctccaactcatgacctcaagtgaccttcctgaccttggtgtcccaaagtgctgggattacaggcatgagccactgcacctggcctccatggtgttattcttaagtggtccaaatatgtttttttaaattgtggtgtaatttacaaaaatgaaatacatcttgagtttacagtttgatcagttttaatatatgcacactcatgtaacctacactcctatatagacacagaatatttttataactccataaaatttccttgtgcggttttttttttttgagacggagtctcgccttatcgcctaggctggagtgcagtggcacgatgttggctcaccacctcctgggttgaagctattctcctgcctcaacctcctgaatagctgggattataggcatgcgccaccacgcctggccaatttttgtatttttagtagagatagggtttcaccatgttggtcaggctggtcttgaactcctgacctcgtgatctgcccacctcggcctcccaaagttctgggattacaggcatgagccactgggcctggcccctcttgctgtttttaatcagctttattctcttcttctagcaatcactgatctgaattctgtcaccatatcttagttatgcctgttctagaacttgatgtaaataaaataatatagtatgtaatctttggtataagatttattcagcataatgcttttgagattcattcatattgttacagatacccgtagtttgtgcttttttattgctgagtagtatgaatataccatagtttgtttatccatccttcttctgctggtagatatctaggctatttccattttttttttttaagtcatgaataaagcaagctactgccaaaattcactggcaagtctttgtggatatatattttctttttttgggggagggggacagagtcttgctgtgtcatccaggctggagtgcagtggcacgatctcggctcactgcaacctctgactcccaagttcaggcagttctcatgcctcagcctccccagtagctagaattacaggtatgcgccaccatgcctggctaatttttgtatttttagtagagactggattttgccatgttggccagcctggtctcaaactcctggcctcaataatccgcccatgttgacctcccaaagtgctgagattacaggtgtgagccaccatgcccggcccgtggacatacattttcatttcttttttaagagacggggtgtcactttttgcctacgccggactgcagtgatgctatcgtagttggctgtaatctcgaactcataggctcaagccatcctcctacctcagcctccaagtggctaggactaccggtatgctccatcatgcctggctaatttttaaatttttttggcagagacaaggtcttactataatatgttgcccaggctggtctcaaactcctgggctcaagcagtcctcctgcccctatctcccaaagtgctgcgattacaggcatgaattttaatttcttttaatttaatttaatttcttttaaattaaaattcacatctgtaattttaatttcttttaatttaatttcttttaaatgaaaattcacgcctgtaatcacagcactttgaggggtaggggcaggaggactgcttcagcccaggagaccagcctgggcaacatattatatagtaagaccagttgtctaccaaaaaaatttgaaaattagccaggcatgatggcgcataacctgtagtcctagctacttggaggctgaggttggaggatgttaaacactctttcatgtgctcattagctgcttatgtatctttttgtgaagtttctgttcaaatctttatcaacttgtaaattagattttaaaaaatttgtaagctggtgaagttcttacatgttctagacatgagttcttgaccatattttcccttagaatgtggctttaacagtgtctttgatgagcagaattttttattttagttatccaatgtatcagttttttattttattttattttatttttgagatggagtcttgctctgttgcccaggctgtagtgcagtggcatgatctcagctcactgcaagctccacctcccaggttcacaccattctcctgcctcagcctcccgagtagctgggattacaggcacccgccaccacacctggctaattttttgtatttttagtagagaccacgtttcaccatgttggacaggctggtcttgaactcctaacctcaagtgatccaccagccttggcctcccaaagttttgggattacaggcatgagccactgtgcccagccaaggatattctttttataacattttcaaaaattaaggcatattgtatatacaggaaaaaaaatgaagcctatgatttatatttacaattgctttgatttaatacaaattaaaatattactgtttatgagaatgagattctaaatgtaaatggaattcacagaatgcataatttttttctcgtttaaagaaatagagtctcgctgtatgcctaggctggtctcgaactcctgggctccagccatcctcccatttcagcctcccagagtgttgggattacaggcgtgagccaccacgcctggccttgtacatgttatatagtgaccattttgcacaagattgtttgccaaatgaataattaaaaaaatccatttagtgtactttcctttaaatattttcacacctggagttaaaacattgtattttataaaatgttattaatataaaaatacttgtaaataaacttgtggctatgtagaatgtagtagaggacttttgcataagcccagagcctagtttctaaaggtctttagaaatatataatagacatagaggggaaagagttgggggaaatcagagggaggtataattctggtctctcgtcgttcagttctttttcattcagttctctcaggcacgactccagccacttagttttatatttcaactggatgttgacccaattaaaacaattcacagctcctgaagatgaaatactatgagtccctgctttggacacatctgtagtagagtaggaaaagataaatataacccaagtaattgttacagaatcttctgaaatatacaaatggtaaaaggttttgtagggcgtgtactggggaaaaagataatttttcaacatgaaccttttaagagcttgtgagtctcaaagagtctttaattgataggtgatatggataatactcccctttgggaggaggtttataatacataaacaacctccccacccttccctcacagctttctgtcctgtactacaagaacaacaaaactccaactagtcagaattgcaagtggtttatggccccccatatagattgaaaacttgctaagagactgcactggagaacctgaaaggatgaggatggaaaagatgattatacttttcatttgcaacagggctttcatttgattctcacattaatcccatgtggtagttaattaaggtagtattacaaggttcagtgaattgtctgagatctcacaaatacaacctagataagaacccaggtattattattttcagtcttgcaatattattttcctacttgcaatattatcttcactcttcattaagtttgcacagcaaagtaatggaataagttctgggctttaatccttgagtagtttggaactgtaatgtgttacatttgagagagagcccttcattttgaataaaaccttggtactgttcctgatcttctaacttgggttaatgctcttcccattttcatgatttttttcatttgtgaaatgaagtagttgcactagatcattttcaattttccttcccacttaaatcagttttaattaaaaaaattgcagatgccttttctcagattggagtacactttttgctccacacaatatctggtgtgtaaattggtatgttccgtggagtaaatacctttcctgactagccattaacttacttctgattcctgaatccactaatttaactattgttgaaattactaaaggaaatttttctttagcaaatgtaaaaactcatatcaggtctcaggtttgatgttgtaaagcactctgactcttaggaagactctttttttcccccaacctctcataaacaaattatttcattcattataaaatttcattcattacattttcattcttcagacttgcagtgtttcctctctgctaagtatagtgttaaacactggcaaaagaactctggacacaacatcatgaacttgctctctgggatcttataatctagttgcagaagcagattggtaaatacatagtatagcacaagtactataatggaggcctgaactgagtgctgtgggggtacacagatgaaggcttctgggagacatcatggcataactagacctggaggatgaataaaactttggccaagtaaatacagagatacatgaaaagcatggataaatggcacaagtaggttcagggatgataaaagtgttagtatgtggagagtgtacaactattttggggaatggggaaacagattaaatttggggccagaccccgaaggatgtggggatcccatcaaagtcttttaagcaggagaatgatcagatgcattttttggtatactacctgggggataggaggaagtggactacagaaggggagatcagtagaaggaagacaagttaggaagcttttcagtcattttcattaaacatgaagcttaatacatattgttctaagatcaggaatacagcaataaagaaaaaaacttgctgtaatgaaacttacattttcttgggagagacagaaaataaacatgaaaaacagatgtgttcaatggtgataaagcagaaagggagatggggagtcaagtgcatgtggggagggtgtttagggaagcacttatgaaagagtaacatttgagcaaagagccctgatacaagacaacaatccagacccaagacatttgaggaaagagcatccatataaagggagtgggaggtagagaaaacctggaccaggaatgagcctggtatgattgaggaaaacacaagggatgtggccagagaataataagagaataaattagaggggtaataggcaattgtatagggccttgtgagccattgtgtggaccttggatttcactcttgagtgacctgggagctaatgggggattaaacagaggagggacaggatcctctatggtatatggtaaatgagtagtatggtaaatgaggtaaatgaatagtaaaaggaactgctgtggtaatttaggtaacagatgatgatggtttaggtgaaagtggttggattgtggatatggtttgattggtgttagaaccaataggatttagtggtggctggatgtggacaatgggagaatagaatgaaccaaagctattgtaaacgtctagaaatcagatgaggacttgacgaaaggcattggcaatgagaaagtagacaggcaccattcatgaggtatttcttagcattgatagagttggatataaatatctggaattcttagctgattgaaatgttagttgaaatgaatgataccactcaaggtatgtgtgtcaagaggtatggagaagagcacagaagtttttggaaaccaagggaggagaaaagaagggatagtcacagagcagtaaagaaaaataaaggttaaaaataggtcacaggatgtacattatcctaagttaaaatattttaaggtttgaatgaaagggtgctgcagggtttgcaaactggtgggcttcaggcctaaaatctgcctatactgttgtttttgcctgacagaatatcttaaaatatctgtatttgaaagcatttaaggcttgacttgtgctctacgctccacagtcttatcgttcatagtttcttggcaaactcaccactcaagctgtgcctcacttatttaggagatctgcctcactagggtagacattttaggtttatgactcttaagttttcacctggacagattggctaacaaaaagaacctcacaggtgggtgaccttgaattcaccaggtcatgccatcagttcagagcggccggagaactctgttctcttgtgcattgatgcccccggagttgtgaaacacagtggccctgcttcagttttttagatttagaaactggtcagtgtcagagcgatcagacacagaaatgttaattcatgttcaaaaataataaccaggctagcatttgtttagcacttgctatgtgacaagtactgttttaagtgctttacatgaattgtttaatcctcacaacaaccctgggaaataggtcctattattaggcgccctttctacagatgaggaaacagacaacagattggtaaatttcccaagatcacaaagtaagtcagtaggagctcaaagtaacctgactccagagcccacactctttttttttttttttttttttttttttagctggttcacgtctctttaatgagatcaaaggctcctgtgtatgtcttgcgggggtaaagctagcacagtcccccaatactgcccctctcctcagggctccagccctttcaggcagattctaggtaggcagggaggggccaaaaggaacgcaaggagttgggactagggctgtttctggtgggcaagtaacccatccaccctctcaaaactacttatgggatgtccccttcactggaagacagccccatgggaaagacctgcggtacagaatctgggggcagtgcacacggggagtagtcctccagatctggcagggtggcactaaccctcacctccttgactggctcagcctcaccggaggcaggacaagggcagagcttaataccggagtcgccagttaaacggcgatagcggcaggaggggggtgtgggggcaggggtcacccctgccccagactcaccctcctgatgagggagggcactctggtgggaggaaacaccttccacatttgttccttcaaaatgggcagggcagctggatgaggaggaacagcaggtttgttcactggaagcagtcaaggggcggcctggggcgacagtataaggcgcggaggcggggggcggggggtggtgcctgggcggtgaaccacatcctcgtaggctgggggcttgaaggtgctgaggaggcgaaggtcaagcagtgaaccggtagggaaaggaccagccccatggcatgccccatgataagccaacaagttgatttcacgctgccgctgctgttgttgcagcctgagtttagctcgtcggtggcggaaggcccaacagcagctaaagaggatgaggacagtccagagcagccagaaccaccagagctcatagtagtaggtgcagcagccagtctccccgcagcagtgaacactctcacagaggtagggctggttgttcactcctgggcacagctctcgaagctgctgttgcggcgcccgaagtgccccccaggcctcctcgctgccgttcccgctgctggcccgagccatacctccacctacagccccctgaggaccacagcctcctctaccgccagccgccccgcccctgccacctctgctgccactgccatggtccctgcccggcccatcttcgctgaggccaccatcactccgcggccggagcttccatccccagagcccacattcttatctgagcatatacatccccatcacaagagaacgccagtttattcaagtaaaataaggactagaaatttacatcagggaatgtattctttcactgtagaatgctgaatggaaaaccaaatttcaatagttgcctactgaacaagatcatgagataacaacaagggagttgattataaatgactagaagttttaaatggcatcgactctgataaagtgataatctcagctccatgatatactcgtcaagcagttacttacatcaatctgccttataggatatcctttctcctggttaatgcttatgtgatagtgttttgtacctttcctttttcactgctttcattactgaccaaactactcacccccatatttctggtagatatatttcttttcattgcatgttagtatcttaaatttagtcctatcttttacttgatcctccgtgcttgacttcctaatctatgttctggtttatgttttagttttacagttgagctttctgaggacattcttattcccagtatctttttttgggtggttgggttctgggaggtggtatttgactgctgctgatgtgtaccaaccaagacagtagtcattaagtgactaacaataatgatttcagcagattattactcttggcaaagagcaagctttctctattataaatgattttatatttgttttgtttttctttatttgtaatttgagttctagcttaacattattacttcagataactgttaatacattttcataaatcatacattcttgaatggcaaataaataaataatcaagttccaagtagtttctaaagagagtaaacattaaaagtaaacataaaactacataaaaatcgatcacagtctattcataaagttggtatgaaaataaagatcctagatttggaaccctcatgatactcaatattttacatatatcagagtttgtaatttccataacttcatttggtagttagacatatagacagagaagataataatatattcattatatatatatttatgtattatattcattatatatatatttatatataatattcatattatatatatatgtctataacatatagacagagaagataataatatattcattttatagtttaggaaacagacttggaagggcaaataacttgtctaagatgactaagcagctgagtgagaaccacagcctatctgtggcattcagtttcagccatctttcccttgcttcataaggatagttactctggtatcagttgctggattgggattttgggcatttataaatgtttttattttggatattactgaatcacagacaatttcatcttagttaattaaaaattcatcttacgtgacacttgtctaaatcttaaaatattaaaattttaatgtataaggatgttaataatctttatattttaagagactatgaagtcaagtctagctaacttagatctgtaagtttttagctatggaaagcaattctattgtgtacaagtttcagcctgtgaagggaattcattgaaaatgtatagagatcagaagaactaacacctttcttgcatggatttttcttgattattggcagttaacaataaaatgttattagatcactggtgcttctgtgtggggttgagttttttatgatatcttctgttagacccataagggaggctgtgagttgttttctacatccttggaatatataagatcctcttttaaaattatattttatataagcacatgaaaatggaatgaaataatgaattgacataggaattacctacatattttggctgtacatttagtgcacaaaatatcccttttttgaatgccaaatggccaagtgtgaaaaccaatatttgttaaagctggagcagaagtcggtatcatcatcatagagtaaacttctggcatatgtgaagatatgaaatgttatccctgaagttattataatttattctcagaaatattagtaatcttattttaagagtaggacattatagtgcagtaatgataattttctcagtgctgcctgttgctagattgttcctatgattgctgtcatgcacatacagacactaaattgagggtcactttccactgaagttagtggaatacaaaataggtggaggaactttcttcctctaacgtctttatatgtgtctgtgtttatatatacgtgtatgtatataaatatgtatacacatatataatatctggagcaaaaatgattatgttgtaagaacttttggaggttttcctcctcgtaaaattccgaagtggtagagttaacattctgcttttaatttatctacaaaaacatgtgaagaatccccaaataagattttctcatagaagattcatggattttgagtctcagaaaaaaaaggaagaaaaaaacttcatggtataaaacaactaaaaattaaatatagtctttagaaatgattttgtttagtataaataatactggtatgacaactgaatgcaattgaaattatgatataaaatttctattctgctttgtatttttcattaaagtttttataattgtcatctgaaaaaggatttaatattcttaaattcattagctaactctctcaatattattacactattatttgcctatttgaaaattgttactttctttcgtacataaatagcattcataatcattgtgacattttcttcttgcattaatgtacatttatacttcatctaattgagaaaattttaacatacaaagtgacacaaaaagattttcattccaagttttatgtaaaacacctaaaattggaaaatgaatattcagatactaagagtaaattttttttttttttttgagacggcatctaactctgtcacccaggctggagtgcagcggtgggatcttggctcactgtaacctctgcctcccgggttcaaattattcccctgcctcagcctcctgagtagctgggactacaggcccacaatgccatgcccggctaatttttgtattttttggtagagacggggtctcaccatgttggccaggctggtctcaaactcccaatctcaagggatctgctggcctcagtctcccaaagtgctggaattacaggcgtgagccactgcacctatatgacatacttgaaaaaatattcttgggccgggtgtggtggctcacgcctgtaatctcagcactgtggaaggtcgagggtggatcacctgaggtcagtagttcaagaccagcctggctaacatggtgaaaccccatctctactaaaaatacaaaaattagctgggtgtggtcgcatgcgcctgtaatcccagctacttggcaggctgaggcaggagaactgcttgaatccaggaggcgaaggctgcagtgagcagattgcaccactgcactccagcctgggagacagagcgagtctctgtctcaaaaaaaaaaaaaaaattctcactttctgttgttgttgtttgtttaatgattaatagacgatttatttaagcaagaatacatagtcatcattgccagacttaatatgacaggttaaatgttggacccaattttccttcccagataagtttttctttcctatccctgtcagttttgaaaacataataccagaagaagaggggcccaattccacacagagctcccaagagtgagtttttaggagtgggtctgaaattaggaaagacacttgctgatcttgcataggtccaaggaatcaaggcaggattttcgatgagccctcggcagttagggtaagcaggtttcagccaggctcttaatggtcaaccacttggcttgcgcctgctgggtttccgaagacatgtcctattcggctggtttgagggcatagtggccaggggtgaaggagtatactttgggaacgacatcttggcgacccagtgcacaactcacttttttttggaaacgaggttggctctgtcgtccagactggagtgcagtggcgcaatctcggcgcactgcaacctccgcctcccgagttcgggcgattgtcctgcctcagcctcccaagtagctgggactacgggcgcacaccaccacgcccggctaaattttgcatttttggtagagacggggttttgccatgttgcccaggctagttttgagctcctgggctcaagcgatctgcccgctttggccttccaaagtgctgggcttacaggcatgacactctgcctggccagatttttgttaccctgtttagatatgatggtaactgaatgatcatgcaatctctgaccatgtgacattcagggataccaaaaatgacttgagatgggccaaggcagaattggagaagcatactttggctgaatacttaggccaaagtataatttggaacatttcttttaaaaaatctactcccctatgcctcccagttgcagtaccttacaattacagttaatctagtagcagatacttgattgggatattaggtatttacagaccaaatgcccattgggatattactcggtaacaggcagtttcactctggttcattgtagattcatccagtaagcatttctagagaactgctatatgaaaatattgtggaaagtatcaactttttaaacttttgatgtcatgacacctagaagattattttctgatactcatattctaagggaattttattttctgagatttgtttctgtggaatttttagttccccagtctgcactgaaagcctaaatcaagaggataatttgaaaggtaatgaaagtaaatcaattctagcttagatacccaagagagtaaatgaaatataaaaataataacttttaaaatgtctcaaaaaaaagctatggtaagctaattctgtttggtttattcatgcaatagtctgtctctgcttatgacataaagtataatatattttaggaatagtgtggttttcttcatgatgtcaaacatacaagcttatggatatatttaaaaattcttaattttctagattaatgttcagcactacttcttccatcttgcattggatgggggcagataattaataattatcagatattttcttatcaaaaacaaatttgttggaaaaaaaattttttttttttgagatggagtctcgttctatcacccaggctggaggtgcagtggcgcaatctcggctcactgcaagctccacctcccgggttcacgctgttgtcctgcctcagcctcccacgtagctaggactacaggcgcatgccaccatgcccagctaatttttttgtatttttagtagagacggggtttcactgtgttagccaggatgctctagatctcctgacctcatgatctgcctgccttggcctcccaaagtgcggggattacaggcatgagccaccgcaccaggcctcaataaaatattttataaatacctttaaggaataatacaaacacaaccagagcttaaataaataaatgtaaatcaatctgcttgctggttaagtaatgagttcagtgtttccgcacagaaagtgggagagatagatgaagaagaaaataaagcttattacatgttgggaaggattctaggcactaagttcctttttttgagacagagtctcattctgtcgcccaggccggactgcagtggctccatcttagctcactgcaacctttgcctcccaggttcaagagattctcctgcctcagcctcccaagtagttgggactacaggcacctgccaccatgcctggctaatttttgtatttttagtagagatacgggttcaccattttgaccaggttggtctcgaactcctgacctgaagcgatctgcccaccttggcctccgaagtgctgcgattacaggcgtgagccactgtgcttggccagttctaggcattaagttataattggttcatttggggactcgaaattctccattttattttattttattttattttttctgcttttgtcacaaaagcacagacattgcttaacaaagaggtctgagacaggatatgaatgttaagctcagggacatagggtcaacacttttgagtgcacagactgggaacctggcagagttttaacaatcccctcccctattttcaccatcccttagtcctgtagaagtagagcagatgattacgtattcactgctgtatggcttattacctttgtaggaattctaactgaagggcttggcatttggcctgactgaatatcagaatccctttatttttcgttccattgcaaaataattttttgtgccatcagtgaaataacagctatgcagtggcatatacagctctggagaccaggcattagaagactgagacaagaataaccagaatgatgataaggagacactggaagtcactttagattgatgaccaaagatttccttattctgaccaggaggtcagatctcaagggtccttctgagtccacttttgattagccaaattgtcttttctttcagtttgactataggttagtcaaccttccctccacattcatcagggactgttagcaatatgtcatatttttttcttggtgtaccattaagcaatctaaagctatgctgttacctgtaaccacttggattaattattttagattagttggttatacttctagggctttatggctttatcttttcagtcagcattattaaccaagttttgatagctttttcaacttttgtaacccccatccagggagatcagtgtcctctcagacacttccaggtaagcatgatctcctggaagacatgagaagtctcttaaattgtctaattattacattggagctacataataactccaatatacctggagttattatgtgtatatgcaagttaggttctaatgaggcaaatataagtaaatatgttgttgattcaggaggtaaaaattaggagagccacgtgtagttttaaaaacaaaagaggaattacttgtaacagaagtaagtaagaaaggaattctcagttatctcttgggtagagataccttgcatagagttcagcaaaaattgcaaaggttgtcataggactatggaggccattaggctaattaaaatttataatattgcccatatatttgtactaagtctcattcctgaaggattttatatttgggttgaggctttgagaaattctaagactggcttgggcagtaaaacaaaccaagtaaaaattgccatggctgtaaatagtcaaaaaggggtaagctaagtttctgcaaactaaacaatttcagagggtgtaagaatgtattggataaaggatgaagataaaaagcactttggagactattgatactcatcagattttaccactgataatttttcaagaggaactgtttatgaaactataaagagaaaatggagatacaaaaagccatccaagatgtaaatgccgaaggccaagttttgagataaacagaaaatcacaaaaactcatgtcaggtggttcttccatggccccagtgtgagcagacagtattttccttgaggagaaatactagtttggtgggggtaaggtagggagttaaactttaaggattaatcaagagaactatacatatgctatttaggttgagggtaaagatcagagtaggcatgggcaacgcctagactcaatcaagttacctatcaagcaagctgacatattcagacaaagcaagactccatctcaaaaaaaaaaaaaaataaataaataaaaagaattccttcattattttgtcatgctttaaggcccaggacaggcctaggcaaaagttttgatggccttttgttacatcccagcctttgtataagggcactggcttttagtatttaacttcattcagtcattactgaaacagttgttatggaagtctgcattagtgagacctggcctgccacaggaggttgcagtgagctgagatcgtgccactgtactccagcctgggcggcagtgtgagactctctcaaaaaagaaaaatgatgcagaaagatttgtttgacacagagtgggcataaactttcaatttgtcaaaaacatagtatctgtgaagtacaataaaatgtagtgcaataaaatgaggtatgcttggatagcaaaacatcatgttgtacctagtaaaggtatacaatttttatttgtgaattatacctcagtaaagctggacaaatgaactgtatttgcaacatggtaggaatatatgacattggacattaatgcaaatggaattttcagtgccatggtgaaaatgttataccactgaacaaaaaaaaagtagtgtgaaatgaagtaaaatgtgaaaatccgtaataaatgcagaaatatgaactgcttatccaaaagagaaaagtcttttgagttcctcaagaagattctctctttggatgctgggcacggtggatgccgggcacctgtatccgagcactttgggaggctgaggaagatggatcactggaggccaggagttcaagaccagcctgtccaacatggtgaaaccccgtctctactaaaaatacaacaattagccgggtgtgatggcacgtacctgtaatcccagctactcgggaggctgaggcacaagaattgcttgaacctgggaggcagaggttgcaatgagccgagattgcgccactggagtccagcctggaccacagagtgaaactccgtctcaaaaaaaaaaaaaaagaaagaaagaaagaaaagaaggttctctctttgggcactccttttcaacatattcagcataaatgaattaatgataccatttttactaggtgagtgtgtttgggcaagttgcttcagtgctcattctcttggtttccttttttttttttttttttttttgagacagggtctttctctgtcacctaagctggagtgcagtggagtgaacatagctcactgcagcctccaacacctagcctcaagagatcctcctgcttcagtctcccaaatagctgggactactggcatgtaccaccatgcctggctagtttttaatttctctttttttgtaagcacagggtgttgctatgttgcccaggatggtcttgaactactgggctcaagtgatcctcccacctcagcctcccaaagttttggattacaggcatgagccatggtacctggctgtcttttgctttccttatctgtaaaaactgaggataataacagtacccttacaaagttggtggaagaatgatattagttaatacaaatgaagtgctaacaaaaagagctttggaacacagcaagtacttgttaggtatggctattgtcatcaacacacttttcaaggcaaacttgtggtttcacctatcacctgagatatatgacttctaagttcatcagatcttctcttttggtttttatttttaaattaattaaatattattattcttattatttgagacagagtctgctctgtcacccaggctggagtgcactggcacgatcccagctcactgcaacctccacctcccacgttcaagcaattctggtgcctcagccatccaaagaagctgggattacaggcgtgcaccaccatacccagttaatttttgcatttttagtagagatagggtttcaccatgttggccaggctggtcttgaactcctggcctcaagcaatccacccatctgggcctcccagtgtgctgggattacaggcgtgagccatcgtgcctggccctcttttcattttagagataggaatctcattctcttccagaggctggagtgcaaaggcatgaacataactcattgcagtctccaactcctgggctaaagggatgttcccccctctgcctttggagtagctgggcctcagaactgtgccacaactactggcttccatcaagatctctgtcctaccatttcatcttcctactaggctatccccacatggatagataaatggtacctcaagtgaaagaaatcaactacctaaaataggattttccactccaaactagattttctttacatgtcatttctgttaatgtgggccacacacactggtaagctcagaatcatctttttcttttcttttattcacatccaatatggttgaaataaaacaaaatgctgtttttccttttttagaaaggcaatacttgttcattatatcaaaatttagaaaatatggaaaaacaaaaaggataaaaaattatccacaaccaaaatagcccaaatttccagttaaaaatatcaacgcatttgatatttgtccacataattaagactgtaatgtttacacaaatgtgagcttttaaaatctaaaaggctctcactattaaaaatgttttgttaaattttgttttaaaagtaagattttaatatccaaattcccaaaatagacatttttgaagatttggaaaatacagacggctgaaaatctttacattattactgttaaattttggtatgttctgttattctgctagtgaaatatatatagatttggggggctattccttttccttttttttttttttgagacaagtgtctcactctggtgcccaggatggaatgcagtggcgctatcacagttcattgtaacctggaactcttgggatcctcccgcctcgacctcccaaagtgctggggctaccggcttgagccactgtgccaggcgaatggctgttcctatatacacagttgacccttgaataacatgggtttgaactgcctgggtccacttataagctgacagaaaatacagtattggaggggcctgcatatagagaggtctgacttttcctctaagtgttccacccgcaggactgactgcgggatttgagaatgcgctttgttttttttttttaggaagtcttactctcgcccaggcttgagtgcagtggcgcgatctcagctcactgcaaccctcgcctctcagtttcaagcgattctcgtgcctcagcctcccgagtagctgggattacaggggcccacctccacgcccgggtaattttttgtatttttagtagagatgggttttcgccatgttggccaggctggtctccaactcatgacctcaggtgatccgcccgcctcggcctcccaaagtgttgggattacaggcgtgagccacggcgcccggcgggcaagacaccctcagagcacagggtgctgccaagagcccggccgagtgcagctcgagcgccgacgtcgccaaggatacacagtgctgacgcagtacacaagtgcgtcacagtggtcctccgccggctacgtcagtggctttcaggcgctttcctgttggaattggcgactgctgcggggctgagcgctggtttcacgcgtctcgggagccaggttggcggtgcgatgaggcgcagcaaggcctacggggagcggtacgtcgcctcggtgcagggctccgccccgtcgcctggaaaggtgagtggatctcgaagagaccgacggcctcgacctggccgggcggcggcctcgacctggccgggcggcggcctcgacctggccgggcggcggcctcgatggctcaggcgtcatggctcccgacgggcgctgctccctggcgcgctctgttgaggcgccggcctcgacctggccgggcggcggcggcggcctcgacctggccgggcggcggcggcggcctcgacctggccgggcggcggcggcggcctcgacgtggcccggcggcggcctcgatggctcaggcgtcatggctcccgacgggcgctgctccctggcgcgctctgttgaggcgccggcctcgacctggccgggcggcggcggcggcctcgacctggccgggcggcggtggcctcgacgtggcccggcggcggcctcgatggctcaggcgtcatggctcctgacgggcgctgctccctggcgcgctctgttgaggcgccggccggctggcgcagtcctgtgggcggcgtggcgcttgcaagcgcaggaagagtcctggggggaccgcggtgggcgggatacctttggcgccggatcttcctctttctcccggtttgttcccgacggtgctcgctcgtgggcccgccctggcccgggctttctggccccatagtacccgcgcggcctagttctcgggggcttgggcacccgggtgctgtatcggcgggtttcttcccatgtcctggacatttactttatatgctgcggcggaggtcgtacctccttggcctggaggaacccagtggggactgacgcagctccgggtgagctttggcggctgtgtcgagtgacaacgtaggcatctcagcacggacatttgcagtggcccgacggcgcaaatgacaggggaagtccccttgttttgagtatgaggtgtttgtcgctgtccctttataagggtccaactccactcatactcacctccctcgccccccccccaccccgcccagaacactttggtagctgcctttgcttaaaaaaaaaaaaattctaaagttcttacaaatcgttagtatggcttacaatttttaaccttttccacaaatgtttttagggtatttttcctctttacaggtaaataatgtgatctattttggattcaataagactttagtaattggatctaaagagtgacggaagaagctattaaaggtggatgtgcacagaatcttgagtcagtttgctttggcttgaataatcacagcactgtcgtttataagctgggtatttggggccagttacacttttcatccatagatggagttgtaacattaatagaatttgataggatgatccattttaaacatttagggtattgcttgacacatagcactaagtgttagctacaagtcactgtttttattgttgatgttaaaaggatattggcggggcgcagtggctcacgcctgtaatcccaccactttgggaggccgaggagggcggattgcctgaggtcaggagttggagaccaacctggctaacatgtcgagacctcgtctctactaaaaatagaaaaaaagttagccgggcgtggtggtgcacacctgtagtcccagctacccgggaggctgaggcaggagagtcgcttgaacccgggaggtggaggttccagtgagccgaggtcgcgctactgcactccagcctgggcgacagagggagactccaaaaaaaaacaaaaaaaaaccaaaaaacggaaactcaacggatgaccatgattataatagtagcataattgtgtctcttatcataactaagcatacgttatcttattttgcgcttccagcaaccctgtggatattgagacctgtagagatttaagatacttgttcagggtgaaataggtagtgcagcagaattttggcagtgggtctgatttagtttctcttgggaacagtggagtaagttacagtctattcctccagagaagaaggatagatatctacttgtacattgtaatttcaaactgctagcatagtataaatatgaatgtgatgatagagtctaaaacagaccttaattgagggttcctgtaactcctgaaattaaagactttaatttttgtgttatttttttttttttaggtggggtctcactctgtcacccagctggatgcagtggcgctatctcgactcactgcaacttccgcctccccagctcaagcgatcctcccacctcagtctcccgagtagttgggaccacaggtgtacccaccacacctgctgttttgttctgttttgtttttatttttggtagagactgggtttcaccatgttgcccaggctgttcttgaactcctgggctcaagtgatttccccgcctccacttcccaaagtgttgggattataggcgtgagccactgcactggccattattttatttttgagacaaggtctctttctgtctcccaggctggagtgctgtggcaggatcgtggctcactgcagcgttgacgtcctgggctcaatccatcctcccaccttagcctcctgggtagctgagactacaggcatgccagctacaggcatgcgccaccatgcccggcttttttctttaatgtagagacggggtcttaccatgttacccaggctggtctccaactcctgggctcaagtgatcctctcgccttggccacaagtgctgagattacaggtgtgagccactctgctcagcctgatttttttttttttaaacaagcttaaaaaaaaaaaaagcatgtttagagcctttctgagattcttagtggggatcttggcttccaaaagattaaaaaccactggtctagacagaagttagaatgttctttcaactacataacgtctccattaaataaagtggagtggtagcaacattttgaggattggttattatgaccacctctcttacacttagagtcttttttttttcccccaaatttaaagtcatttacattagaacctggggatttcagcggaatatggattaactagtgagtaactttggaacatgtgaagctattctgtaaagttaggtttgagtgaaatgacaaaacagggtgctttggatagaaggtaaggaatggagggagaagaggcagtggctgtgaagaatataaagaggttaatattctcccccagtttggcagagactggccatctgtgaactgcccatgctttctagaatgtctgagttttggagtgtgatgatgcgtctgtatatcatatctttctagtcttccattgtgctttcatttgttagtcttctcttgttttgccatttttgtactccctcacatgtgcttttgcccttcttaaaaatattcttcgtctgtaatccaagcactttgggaggcagagagaccagcctgaccaacatggtgaaaatccgtctctattaaaaatacaaaaatgagccgggcgtggtggcagcgcctgtagtcccacctactcggtaggctgagacaggagaattgcttgaaccctggaggcagaggttgtggtgagcagagattgcgccactgcactccagcctgtgtgacagagcgagactctgtctccaaaaaataaaaaaataaaaaaatatataattctttctctagtttttctttttccagatggcttctgtttagtttttctatgttctgtcaagttggtttcttattctgcagctgattcctacttctcaaactctacttgacagctcttatttttatttatttgttttttagaatagggtcttgctgtgttgtccaggctgccatcaaatttttgggcataaatgatcctcctacctctgttgcctgagtacttaggactacaggcaggcacctttgacagctgttagttgttttttctgccctttacatctatacttcatgcttctgagtaacacacacatatacttttgttattttgaattccctttctcccattttagacattttgttttcttttttttttttgagacagagtctcgctctatggcctaggctggagtgcagtgtcgcgatctcggctcactgcaaactctgcctccggggttcacgccattctcctgccccagcctgtagctgggactacgggcacccgccacaacacccggctaattttttagtatttttagtagagacggggtttcaccgtgttagccaggatagtctcgatctcctgacctcatgatccgcccgcctcagcctcccaaagtgccgggattacaggcgtgagccaccgcgcccggccccactttagacattctgtactggctattatgctcctccaaaactgtcctcagacactttgctttgcccctcattgtttcagtactgttattggagtttttgtttaaatgaatatttaacatttatataaatataaggtaaatattttgcatttgaattgcccttgttgtgcagttttgtttttcctggactgaataattgctttattttttggtttgcttgtatgttgtgttactacttggttacttaaactcagcaacttaaaccctcaaatgtggtcaaactggtcacataatccgatcaatttcagcttaaaacattgattgattgattgattgattgattgtctgtctacctggaatacccttactaaccgacttctccaacccagattggtttttcttcctctttgctacacagctgtgctcttgggacttccctttatcaccagtttgagaattcccttcatcttttttctgagttagaccctttgtttcttgtatctcatgtcatcttcatttactttctttgttttggtgtagcatagttcacttgctttgaggaaaagtggatgagaggtttttttgtttgtttttgttttgggacagagtcttgctctgttgcccaggctggagtgcagtggcatggtctcagctcaccacaacctccgcctcccgggttcaagtgattctcctgcctcagcctcccgagtagcgggattacgggtgtgcgccaccatgcccggctaattttttctatttttagtagagatggaatttcaccatactgttcaggctggtctggaaactaatggtatgtctttaaaacatctttacttaatttagttgatcatttggttatcgaattctgagtttgaaataatttttttcgcaattttgaaagcattgctccattttccagaagttctgttgttaggagtctgatgagagtcttgttcttggtaacaaaggttttctggaagtgtcctttcaattgggaaactcatttctttcagttctgtagcgtttcttgtattatttctttgaccatttcttaccctttttttaatgatgtttacctgaaagctggagtttctctaatttttctcttattctcctcttttgtttgttctgccttttgagagatttccttacccttatgttccaggggaagaagattggggaattcatgtttcagtatctagacttttcctcattgtcctgtataatcacggccttcacccttgttgggactccacagatttggagctgatcagatcggtttgttgagaacagcagcttttttggaggattttagggggagggagattcatttgactgtgcaagatgggcgacagagcgagactccgtttgaattaaaaaaaaagagagagaaatttagaactgcataatgaaaaagtaggccacaaatgttaagttttggacaattacaattacatctctatcttactgtgcaagatagcgatgatgtggcatctcttagggtcttactgttcctgttttcagccctgcatcagttcttgatatttggcagcttaagtgaattcaggtatttgcttatagtgacatctgctgtcatgtaaagaagtactgcttgaatcagatattgtcctgtttacataacgtgggctgtgctccttcctagctgtatatctttaaacaaggcatttgcctgcttgagcttcagttcccttgtaaagtgaggttagaggcaaaagatcatacagaagaataatttgtaaagttgtttaattatcttaagattgtctactttaataacatagttggaagcaaagaaggtaatggaattatttttctattatgttttggcattgtaccttgaatctatttcttcattttgaaaagggggaactggccgggctcggtggctgaggcctgtaatcccagcaccttcggaggcggaggaagtcagattacaaggtcgagagaacgacaccatctggccaacatggtgaaaccccatctctactaaaaatacaaaaattagctgggcatggtggcgtgcgcctgtagtcccagcttgtacccgggacgcagaggttgcagtgagctgagatcgagccaccgcactccagcctggcgacagagcaagactccatctcaaaaaaaaaaaggaagcggggaacaagccttgttcctttatgtgctgtcctgactgttgtgtattatttttgttaagattgctatagttcttttttttttgagatggagtcttgctctgtcgccagtgctgggattgcaggtgttagcctggcattgagcaacgttttgtaatttaagcatacaagtctctcacctccttgtttacatttattcccaggcatttttttcatttagatgcgattgtaaatggaattgctttcttaatttccttttctgattgttcgttgctggtacagtagtcccttcttatccacagtattgccttacgtggttttacttacctgcgtcacccgtggtccaaaaatattgaatggaagattatataaataaacatttcatgagttttaaattgcaaacagttctgaataacatgataaaaatctcacagcctcctgctccgtcctacccaggacacgaatcatccctttgtccaatatattcatgctgtatgtgctccccacccgctagttacatactagccatctcagttatcagatcagttgttggagtattgcagtgcttgtgttcaagtaacccttattttatttaaaatggcaccaaagagcaagaatagcgatgctggcagttcacatatgccagagagaagccatatagtgcttcctttaagtgaagaggtgagtttttgacttaggaaagaaaaaagatcgtatactggggttgctaagatctacggtaagaacaaatcttttgtccatgaaattgtgaagaaggaaaaagaaatttgtgctagttttgttgtgacaccccaaactgcaaaagttacagccacagtgtgtgataagtgctttgttgagatggacaagacattaaatttgtgggtggaggacacaaacaggaaacatgtttcgattgatggcaacctggtttgatactgttcatcgttttggacattcactggggtcttggaatttcaaaaataagatgtttgagtggctgtatactctttatcacatggatggaacatactctggttgtatcagcttttttttttttttttttttttttttttgagatggaatcattctgttgcccaggctggagtgcagtggtgcggtcttggcccactgctgcctcccgggttcaggcgattctttgcctcagcctcccaagcagcggggattacaggcgtgtgccaccatgcccagctaatttttgtatttttagtagaaaggaggtttctgcatgttggccaggctggtctcgaactcttggcttcaagtgatccacccgcctcagtctccgaaagtgctgggattacaggtgtgagccaccgcacccagcctggtgtgcatcagcattttggactttggagtttacgtaaccaaggagccaggctgtggaccttgtttattacttgaagaattcaatatttatttctgcctttttgactccttgactgtaaaatactgatctgatctgtagagagaacagtacatgtactattaaggcacagggaatcctcagtgccttaatagatcgtaagtacttacttattctttcccatagaggcttacacatggtaggagaagagatttctggaatacctttcctccccaaagaaagctggtttcttttgtttgttaagtgagagagtggtaccacagggtttccaagatttccaaggctgatgaaaattcttaacttctgttgtctgcttgtcttgctttcttgaatttattttttgtatgttatgtatttattatttagagacaggatctccctgtgtcacccaggctggagtgcagtgtcacagtcataactcacggcagtgtcaacctcctgggctcaagtgattctccttccttggcctcctgagtagctaggaacacaggcatgctccactatgcctggctatttttttccccctggagacaggatcttgttgtgttgcacaggctggtttcaaactcttggcctcaaagctagcctcccaccttggtctctgaaagtgctagaattaaatagaattaaaggtgtgaccaactgcacccagcttatttatgatgacgatgatgatgatgtttgggagatggagtctctgtcgcccaggctggagtgcgatggcacgatctcagctgactgcaacctctggctcactgcaacctccacctcctgggttcaactgattctcgtgccttagcctcccgagtagctgggattacaggcacccgccatcatgcctggctaatttttctatttttgtagagacggagtttcaccatgttataacgccaggctggtctcaaactcctgacctcaggtgatccgcccacttcggcctcccaaagtgctgggattacaggcatgagccgctgcacccagctctattttttgttttgtgataggaaattataaaacatggaattatgcatttgtcaggctttaaaaaaaacttttaagtgaatgaaaatggcatatttgaacataaacttagggcagatttttactacttttgaaaaaatgttggagaatatttctgtatgaaacgtaaaacaacttttaattttttttagaagttgagaggattctattttgcaaagctgtattatgaagctaaagaatatgatcttgctaaaaagtaagtacaaactgtaacatgtattctttttttaaaatcaatgccttttctcattttcttctttgaaataggtaaaaatatgttcttagtagttcttcctaagtgtattctggaataagggatttatcactcagactgatgctaaggaccagcctagattccattgagattgaaaccgtaattagtgttttctgcatgctgctgctttataccaagggcaagaaattgtttggcttaaaacactttttctaaaaattgtcttctgttggagtaaaagaggaccatgcctatatcttcatttgtttttggttagatatctgataccttaatcagatggaaaatagcaatgaataaaaaactgtaattgtaaggcaggagaatagcttgtataaaagatctttaattgacacaatatgtgatgctctaaggctctatcctagggataagaagcttggtgattctgatttcctgactgggagtggattaaagcaggaaattaagagggaggcagggtttttttttttttttttttttttttaggcagtatctgtctctcttgctcaggctggagtgcagcagctggctccatctttgctcactgtaacctctgccttctgggctcaagagatcttcccacctcagcgccccaagtagctggggatacagatgagcaccaccacacctggctaaggtttgcattttttggtagagacaggtgtcactatgttgcccaggctagtcttgaacttctgagcacagcagtctgcctgcctcggcctcccatactgttgggactacaggtgtgtgttactgctcccagctgggaggcaggcttttaaaggcatccaaaggaagatggaaatgctggtaagaaaggaaaatggtggtacataaattatgtaactagcagcactgtgactgttaactcttgtacctttttactgtgagactttaatcccttagtttgggtctggcctaatttctctgatggtaatactgtcaaggaacctagaggatatttacttattttagttgttacttgatttgagaaatggaaatttcctgtatttggtactgtaattagtaatttgtcttctgttcgattttagctggatatagtactgttagaaattactttcttgcttaaagggtaggtgtatttccctttgttgtttgggaaattgttgctgtttagtattttgcattatgataactttaaaaatgtttactataatcacttctaatttatttgcaaaactgttagtgctttattaaaatgtgatcaggaagaaaaagcaatttatatgttcatttcttatgcgtggataacactggagaaaaatttggtaaatgtgacatttaatggtaaaacgagtatgtggtcaactctatgtacgtgtttttaagtattacccatttctttctatgaatacttctgagttatctgcataaatagtggtagttttgagtaacaatataaacgagtttagtggttgctttggtttaagatgtattcttcggttagcatttaaaagtacagttctaagtttaatttacttttgtattacttttgaaaaacagatacgtatgtacttaccttagtgtgcaagagagggatcccagagctcacagatttctgggtcttctttatgaattggaagaaaacacagagaaagccgttgaatgttacagggtaagttataggattcaaatatagcctttgcatagccaaacacatgatgcccagagaaatttatataagtaagtcaaatatattttatgaatatcataaaacaggcattggtatcatagtacaattatgtgacacagcttggaacagatttagaattgtttaacacctataaattgtaagtctaacatggtcagaaatggtgttcttttgtgttcttttgcattcaaatgacacaaatataatttttatttgattcatttccagaaaattccaagacacttttattttaacacctttgaagtaacatgttttctctagaagtagaattttttaagggttggagtgataatttttaacctttatatataagtatataagtatatatactcctacatacatacatacaatttatttactaatctttaatttcttttctgatattagcgttcactggaattaaacccaccacaaaaagatcttgtgttgaagattgcagaattgctttgtaaaaatgatgttactgatggaagagcaaaatactgggttgaaagggcagcgaaacttttcccaggaagtcctgcaatttataaactaaaggtaaacatacaaaacataaagggagaaaacttaagacataaccatttctaatatttggagtttaaattacttttcaatagcaaaccttaagcccaggtgtttgtgtttcctttaacatttttcttttaaaaagtgtattaaaacctttctgagcatctgctgtcttattaggcattgttatactttataagtgacatctcatttacccttctggaataattaatattttagggattttacagtttagtagctgtaaactaagtagagctaagatttacattaagttctgtctggtatacaatttttgcttcattaagtgaaaattacctacaggatgacaatttagggatattttaaagaagagttttctaataactatggtctgaaagtagaagggattgtattttgagatagtaaagttttcaaggaaaagataaaaggtggtttctctagtatataagatgtaattactaaaaatggtaggaagttcttgctagtgtattgactggtcctgatattctttatagagcaaaatatagtttactaagtaactgttctggagaaaatctacacaaatatgtttggcaaacatttaaaatgtatattgtaatattttatatattaatgtatactttattgtgtatgtacaatataaaattataaatgtatatttgcctttagcctcctcctacccccattgtatatgtttctgatagaaatttaaaaaattttaattttgaaataattatagatttttttgcacaggaagttgcaaagattgcacagaaagatcctatatgctacttcatttttccccaatgcttatacaggttgagcatttaaaatctgaaatcctaaatgctccaaaatctgaaattttttgagcactgacatgatgctcaaagaaatgctcattggaaaattttggatttcagattttcagatttgggatgctctgcctgctaagtatcctgcaaatattccaaagtctgaaaaaattcaaaatctgaaatacttctggtctcaagcattttggataggggatactcaacctgtttaacccgaccaaagcacaatatcaaaatcaggaattttgacattggtacaatgtgtatgtatagttttctttcattttatcatgtgtagattcataccaccactactgtcaagatacagagctactctattaccacagagatcttcctcatgctgccccttttgtagtcatgctatttacttctcttcactatgcctgacctctggcaaccattaatctgttctccatctttatactttggtgatttcaaaatgttatgtaaatgtcatcatgaaatgtgtgacttttttttttcttttttcgttgtttttgagacggagtctcgctctgttgcccaggttggagttcactggcgcaatctcggctcactgccacctgtgcctcccaggttcaagcaattctcctgcctcagccttccgggtagctgggactacaggcacatgttaccgtgtcccgcttatttttgtatttttgcagaaacggggtttcaccatgttggcctggctggtctcgaactcctgacctcatgtgatctgcccaccccagcctcccaaagtgctaggattacaggcgtgagccaccgcgcccagccaagcatgtgaccttttgaggttggcttgttcagtcagcataataccatttgtgatccatattaagttttgtatatccatagttggttcctttacttctgagtagcatttcatggtccacaatttaaccattcactttttttatttttatttttttgagacagagtcttgctctgtcgcccatgctggagtgcagtggtgctatctcggctcactgcaacttctgcctcccgggttctcaggtgatccacccactttggcctcccaaagtgctgggattacaggtgtgagccactgtgcccagccttaaccattcacttttgaggggcattttggttatttctaggttttggctgttgttcaactgctatgaacaatcatgtccagatttttgaagctgaaaaagcattgaagatgcttccaaagataaatattactgataagtttttctccccagtaataagcagctggattttaaatattagtctaaaacatgaggtctaattgtgcagatttctttactctcttaggtgttatgcctcaaacataactcccatattgggcgtggcaatccagttaatctggtgtcagtagtgttaaagaacatatgtaatggcaggagattgttttcttgcagtgtaacaagtaagatactttgaagcactctttaaagattttctttaataacttgaaggcactgttaacacctttcctgtatcagattttttttttttttggaattgaaatccatgagatttataattgtcatgcaaagtaattccatttctcctaaaatttaaggcttgctaaggtaaacagtttctgacatttgtttaatgaatgagagtattactgttgagaaggctttttctctcaagtatgagatagaactttttaaaagcactcatagtggttttttaaaaaatgtttaacatagagtcaaagactagggcttttgcaatagggagagaccagggtatcatccatctcatccagaagaggagaaattgataaaggagagaggggaatgaaatacagagtagtaatggacggcttggtcttgagagctggggaaagacgagtttaagtaggtaaggtaaaatggaatttatatgtgatagcatcaggtttctcagtgaaggatgaatctaggttataagttgaaagtgagggtcaaaggaaggtatggggaagttgaggaaataggaggaggtgtgaagtgtcagggagtggagaaagtgagtctgttagtactaaaatggcattttgttttaggcagcaccagtttgatggttgagataatgcaaatgaaatcagttagcttggggttatgatttcccaaatctaagcacacagaaaccagttgggagggttctgaggaaaagagggaattagttgaagggatctgtaagcaaacagtaattatggatataagggattatagcattttttgcctgacagaagaaagtgtgtgtatatgtgtttacaggtgcttaaaacttgatgatgttattgtcttgaagggaacttgtcatgtggtggagaagtatatttctgaaagtaagggtacgtaggccctcagtgaggtggaagaataagaaggatggtatggtcgtttcggtggtatgaccaaaatgcagattttgaagacctgtgtcagtggcaagtggatggttgaggttggagtagaggataacatgactggagatgaggtgattaaggaactgagtagtcagcctgggcaacacggcaagaccccatctctacagaacgttaaaaaaaaattagccgggcatggtggtgcatgcctatggtcctagcttcttgagaggctgatggaagagcatcgcaaatgagaagcgagtggccacaaaccctacttcctctccttgtatgtaagttcagagagaaaaagccatcatggtagtgggggttatcctgagatgatactgtcttcatttaagatcaggaggtgatgacagtgctttgagatgatgatgaaggtaacagaacagtgggaggagaggggatgtgggattgagtcagatttaaggagatacagagcagtttgagcataaggaccttgttgctgaggattgactggggaggtctaggcttctggtggtgactcagatggacagggatgtgtggcaatagtcctggtagtctctgaagagagtatgagctactgcagtaatcacagatgcttttcttcacatacagttcttgaggcttagtttctgggttgtaagcaactctcagaagggacgaataaggtatataggatggtgtttttggtggcatcatcataaaactagacatagtggaatggtgctttttgggagcatgacttgtttaaaattgcacaagtgttactctaataatttttctttttcccctctaaataggaacatcttctagattgtgaaggtgaagatggatggaataaactttttgactggattcagtcagaactttatgtaagacctgatgacgtccatatgaacatccggctagtggagttgtatcgctcaaataaaagattgaaggatgctgtggcccgctgccatgaggcagagaggaacatagctttgcgttcaagtttagagtggaattcgtgtgttgtacagacccttaaggtagataaaagctattgggtctttacatttctatgtaggcaattagcatacatctttttgtactaaagcagcagtgccccgcaggacttaaatttcttttatttaggtagaacagttataaaatgaaatttttaccaggatcagttaaatttataatgggaaagttggggagataactatgataaatgtatatatttttggtgttttcatttataaggttgatgtaaaaatcaatgtagtttcacaaacgtggttagagtgagaaaaggaatttgtaggcataaaatggttaatttcttaacacttgattaagttttgtaacttactattcattccacaaaataggaatatctggagtctttacagtgtttggagtctgataaaagtgactggcgagcaaccaatacagacttactgctggcctatgctaatcttatgcttcttacgctttccactagagatgtgcaggaaagtagagaattactggaaaggtgcgttgactttgaggagaatgctttagtataaattgtagtttttctttttgcagtaagttcattgctctaaatttctttactgcatcattatttctataatgtacctaggagttatagttaatacagtgaaccactaggaggcaatcttatttttcttcttttacggggaagttctaattggttttatatgactttcctttttagagaactcttatagttcaagcttgattaaaattagccttatggttaaatactcaggtttgtcatagtcaagcttaaaatgaatgttctaactgctatttcatattttattttttataatagtataatcttgagtgaaaattaaggttcatctgtcatcagatggctaggttcacatgtactagtataagcacttagcatcactggtatttcagaaaatactgttttagctaagaaacaaaataactcaactatgtgatttaccttttttcctaaattttgattttgaaaaccagtgtctccattttgaaaataaattccattgaacaaaaacatcacttggatttgtataaaaatgttagtttagagcaggggttggttagaacttgtgggccaaatatggcccctgcctaattttgttaatatttattggaatgcaacatgcctctgtttatgtattgtctgtggctgcttacatactacaaggttggaattgagtggttgcagcagagattgtatgcctgtaaagccagattagtaatctcctcctttttgtagaaaaagtttactgattgctagtttaggctgtccatttgtttggaagttaatttatttccccatctggtataaggaaagaagttcatttcactgagtgcagggagtaggtaattttcttgaaaaagtacatagtgtcctaaattggtagggtaagagcagtatctaaaagaactaacataactttaagattattttagaaaacatgtaggatgttttattttgtgttctttgtatactcaaattttttggtcacaagttccttttacatttttcttaaggacatcaaagatctttgtatgtgggttcctttttttctttctttctttcttttttgttttgtttttttttttttttttgagatggagtcttgctctgtcaccaggctggagtgcagtggcatgaccttgactcactgtaacctccgcctcccgggttcaggcgattctcctgcctcagcctcctgagtagctgggaccacaggcgcacaccaccacgcccagctaatttttgtatttttagtagagacggggttcaggatggtctcaatctctctttttttttttttgagactgagtcttgctctcgccaggttggcatgcagtggtgcagtctcggctcactgcaacctctgcctcctgggttcaagtgattctcttgtctctgcctcctgaataggtgggactacaggtgcccgacaccacacctggctaattttttttttttttgagacagagtctcgctctgtcacccagcctggagtagagtggcgcaatctcggctcactgcaagcttcacaatttcctctcaatgctctgaataagagcttatcctcctgcctcaggttgttccccaccaggaagccccaggagggccctgaggacagcccttggccctcagagggggaggctcaggaggggagatgaccatggggatggagtcactcaggggagaatccggaccatgagggggtgactgggggcctgaggggaggaccctgaggaagataaaaagctggtgccaccctaggcagtttcacagtgtggcttagggtggtgggtgacagatggtttgtcagatcagttaatcaggactcatgggccctttgttacccccccttgtgaacctcccaggttcacgccattcttctgcctcagcctcctgagtagctgggactacaggcgcccaccaccacgctcggctaatttttttgtatttttagtagagacggagtgtcaccctgttagccaggatggtctcgatctcctgacctcgtgatctgccctcctcggcctcccaaagtgttgggattacaggcgtgagccaccgcgctcagcccacacctggctaatttttgtatttttagtagaaacagggtttcatcatgttggccaggatggtctcgatctttttttttttttgagacggagtctcgctctgttgcccaggctggagtgcagtggtgccatctcggctcactgcaagctctgtctccagggttcatgccattctcctgcctcagcctcccgagtagctgggcctacaggtgcccgccaccacacccagctaattttttgtatttttagtagagatggggtttcactgtgttagccaggatggtcttgatatcctgaccttgtgatccgcctgcctcagcctcccagagtgctgggattacaggcatgagccaccgcgcccggctggtctcgatctcttgacctcttgatctgtctaccttggcctcccaaagtactggaaggtctcaatctcttgacgtcgtgatccgcctgccttggccttccaaagtgctgggattgcaggtctgagccactgcacctggccgtatgtgggttatttctgtcagtgtttattacattagaaattaaaacaaataaaaaatgtaatccattaaaaatgtaataagccctattgtgtgttaataataatagctttttttttttttttttttttttttatttgagacggagtttgctcttgttgcccaggctagagtgcaacagtgtgatctcggatcactgcaacctctgcttcccaggttcaagcgattctcctgcctcagcctcccaagtagctggaattacaggtgcccaccaccacgcctggctaattttttgtatttttagtagagatggggtttcaccatgttggctaggctggtcttgaactcctgacctcaggtgacccacccgcctcagcctcccaaagtgctggaattacatgtgtgagccaccgcgcagggccaataatagcattttttatgaaaaataattattttccaacagcaaaaaagtagtcagaaaagtgtcattgtttttgcatttttgtaaatctttttaatgtctcgcttaatagaacatagctagattctcatttacttcctctttcagtctgtaaaactattacatgtcatgaagcctctagaaaactcagctcagcgggtcgcggtggctcaggcctgtaatcccagcactttgggaggccgaggcgggtggatcacgaagtcaggagatcgagaccatcccagctaacaatggtgaaaccttgtctctactaaaaatacaaaaaattagccgggcatgttggtacgcgcctatattcccagctgctcgggaggctgaggcagaagaatcgcttgaacctgggagtcagaggttgcattaagccaagattgtgccactgcactccagccttgtgacagagtgagattctgtctccaaaaacaaaaacaaaaaaactcagctctacatacatgagaaaatgagtatgtaatatataaatttttttttggtattattgtaaaagtaattttaacttcatggatcccctgaaggggtttttgagcaccctcagagatctttagacctcatttgctctggttgcgttattgtaagccactttaaaatcatgcttcacgtttaagtgtttgctttttgcttttacttttcttccaaagtgaggatttggagaaacattaggatttagaagaactaatttagaatatagattacaaataataggccaggcatagtggctcatgcctgtaatcccagcacattggtaagctgaggcgggcggatcgtgaggtcaggagttcgagaccagcctggccaacatagtaaaaccctgtctctactaaaaatataaaaaaagtttagcggggcatggtggcaggtgcctgtaatcccagctactcaggaggctgagtcaggagaatcacttgaacctgggaggtggaggttgcagtgagcttagattgtgccattacactccagcccaggcgatagtgagagactctgtctcaaaaaaaaaaaaaaaaaaaaaaaaaagacaatttatttaacgctgtaatgatctatatagtaaaaagagcaattgctgtattgatactcaaatacctgtcagttatttacttataatttggaaatggtatgtctaatttgagaaattacaactgttaattaaataatgaaattatatgatcaggaagaaactacaaaatagtctcccaactttatcctggtttattttgaaatgtgcacctataatcactaatcttatatttatcctgtgattggagggctggaaataactgggaataagacatcatttgagaggttaagcatgaagtataggaagtatgcaggataaaaataagcattagatgattcataatttataacatggggaataagaattattagaagttgaatgtggaagatgaagcttgaaataaaatttttattttgttttgaattaaatgaaccatgattattcacagtgcagtaagtgtgtatcatctgtttgatattttcatattacagttttgatagtgctcttcagtctgcaaaatcttctttgggtggaaatgatgaactgtcagctactttcttagaaatgaaaggacatttctacatgcatgctggttctctgctcttgaagatgggtcagcatggtaataatgttcaatggcaagctctttctgagctggctgcattgtgctatgtcatagcatttcaggtaagtcttccacttgtaggagcaattgacatttcacggagtcttgatgtgttttaaatgaaggtgtgctctggtatgtaatgacaatatgtgaacaaactgtggaattaaaatgaaatagtcaatttgatacagtggaaaataactaagcatacacaatactggtgaggctggtgaaacagggatgttgagtgcactcttgtcgaaagcctgcattgccatgatttgtttgtagacaaatttgaagagtttgatctttttactctgccatttttgggaacatgataaagatgtaatctcgtattatgggtaaagcttgattcaaaaaggtgtgttacttggacaaaatcctaataagtagatgtagggcaatggctttatagcctatgatagaagaatatgattgcaatttaacatgttaattgaaacacatgtatataacatttatggctgtattgtgtatatgtaacagtatatctattaatctttgaaaacataaaaccttttcttattttttatttttttattttttttgagaccaagtctctctctgttgccaggctggagtgcagtggtgtgatctcggctcactgcagcctccacctcctgggttcaagtgattctcctgcctcagcctcccgagtagctgggactacaggcccgtgctaccaagcccagctaattttttgtatttttaatagagatggggtttcaccatgttggccaggatggtcgcaatctcttgacctcgtgatctacctgccttggtctcccaaagtgctgggattacaggcccgaggcactgtgcctggcgtgcctggcctttttttttttttgagacggagtctcgctctgtcgcccaggctggagtgcagtggcacgatctcggctcactgcaagctccacctcctgagttcacaccattttcctgcctcagcctcccgagtagctggaactacaagcgcccaccaccatgcctggctaatttttttgtatttttagtagagacggggtttcactgtgttagccaggatggtctcaatctcctgacctagtcatccacctgcctcggcctcccaaagtgctgggatttacaagcgtgagccaccattcccggacttttttttttaatgagcttgcataacttttgaaaggaaaagaaataagcagtcttccaaaaaaagcattaaaccaggcttagaaaaatgattaattttagagaaggattttttgcttggggagggaaaaaaaaggattcattacttttagagaaggcccctccttctaatataaatctttttttctttttgagacagagttttgctcttgttgcccaggctggagtgcaatggcgccatctggctcactgcaacctccgcctcccgggttcaagcgattgtcctgcttcagcctcccgagtagctgggattacaggcacacgctaccacgcccatctaattttgtattttcagtagagatgaggtttctccatgttggtcaggctggtcttgagctcctgaactcaggtgatctgcgtgtctcggcctctcaaagtgctgggattacaggcagtgagccagcatgccctgcctaatataaatctttttatttttatttgagacggagtctcgctctgtcaccaggctggagtgcagtggcgcaatctcagctcactgcaacctgtgtctcctgggttcaagtgattctcctgcttcagcctgtcacgtatctgggattacaggcacacaccaccatgcctggctaattttttgtattttttaatagagatggggtttcaccatgttagccaggatggtctcgatcttctgacctcgtgatccacccgactcggcctctcaaagtgctgggattacaggcatgagccattgagcctggcctgtaaatcttttaaaaacaccgttgatagacagttcacatgttaaatgctaatattggctcagtagaaacttctgtgttcataaggaatggattagtgaaaattaatggatttagtgaggttcactaggtaatacaaacattaaaaggttcttatagaaattctcaagtaactgatagttcttatttttatttattttatttttttttgagatggagtctcacactctgtcgcccaggctggagcacagtggcacgacctcggctcactgcaagctccgcctcctgggttcacgccattctcctgcctcagcctcccgagtagctgggactacaggcacccaccaccacgcctggctaatttttttgtattttcagtagagatggggtttcaccgtgttagccaggatggtctcgatctcctgacctcatgatccgcccaccttggcctcccaaagtgctggcattacaggtgtgagccaccgcgccctgccaatagttcttatttttaatggaaactttaaaatttatctgtctgtgtgtctattagagtcttgctgtgtcacccaggctggagtgcagttgcgtaatcgtagctcaccgtaacattgaactgggctcgagcttcccagagtgctgggattataggtgtcagctactgcgcacagcctaaaatttttcgatatgtagttttgggaggcagagtctcactcttgctctggctggagtgcagtggcatgatcatagctcactgcatcctcgaactcctgggctcaagtgatcctctcctgcttcagcctcagctcagtagctgggactacaggtgcctgccaccatgcctggctacattgttaaattttttgtaaagacaaggtcttgctatgtttcccaggctggttggtcttgaactcctggcttcaagtgatccttctgccttgccctcccaaagtgctgagattacaggtatgagccaccacacctgactgtgaacttttaatcataataagttagtttccctcttaatccattcactcaggtctcctttcctagatgacagctactgttaggagtttcttgggtgttcagaaatattttttgcatatgcaaatgtgcaatacattctttctctgcttttaaaaaatattgtgcctcaatgtgggtgtgctttacctattgccagatgccttgcttttctgaatgtttcttcattgttccacttcagcacagagatacctacctcagtctttattagctaccacatatttctgtagaatgaatatataatagaaacatcttagatgcttgtattttatttgatcagtttattttaaagcttaatgaacaaatgattataagcataaaatgtaggttatgtgctggcatttgggtatttaagaattggctaacttttatggcaagattttcagactcttaatcagaggaatactgtggttctagtaagtgcatctgcattgcagctaggtagttaacaaagtatcttgaaaccttttagttaagatgaggaaatagccaggcgtggtggctcacacctataatcttagcactttgggaggctgaggcgggcggatcgcttgaggtcaggagtttgagaccatcctgaccaacatggtcaaaccccatctctactaaaaatacaaaaattagccacgcatggtggcaggtgcctgtagtcccagctacttgagaggccgagacaggagaattgcttgaaaccaggaggcggagattgcagtgagccgagatcgtgccactgcagcactccagcctggcgacggagcgagactccatctcaaaaaaaaaagaggaaatagtgaattgagatgatttgattgagtggattcacaactaattaactggtcacagattcaactgttgaataattttgtaaaagaggccgggtttatgaattgaggtcagtttgaaaacaaaaagaatgatgtcaacattttgtttcttactttgtgtgctcttttcaacatatagatgacaaactttgacatgatgtttagaaaacttgtgagtaaaaggataggcgatatgaatatttctaaaattcaaaatcagaagcttttaggttcataaatcatatattttgaaaaatgagcatgtttggaaagaattatatatacatggtttaaaattctggcggctcttaagaatatgctatgaagactcctttctgttccctagttatttactttctccagccccaaagaaactaatgttattgctttcttgtgtgttcttcaggaaatgttttatgcatctccaagtaaacacacatatatcccctgtctttaaaagaaggaggaaaacatttgaacattgcatttactttatttccattaactgtatcttggagatgtttccatgtcagtatatataaagggcattctcattagtttggatgcttgcatattattccattgtatggatgtactgtagttttggagtttttaaaaccagggtcctaaaaccaggacattagcttgcttttacttttttttttaatgctacttcaagtaatttagcaatgattaacttgtgccatgaattcctgaaagaattgcagtatcaaagtatatctgtgcatttataatttttagagctgttgccaaatatctaaccctaaagaggttgtatcaaattacatttccaccaccaattaagaaagtggtgatagaattaaaagccgatgctctagtcacccatatagttacttttggcatgtttctagtaagtgggcattgcctgtgactggacgttttcagtgatgggcattcattacttttcaagatagcccagtgcatctttaggtggtttggctcttggtacttccttatatagaataaaaatattcttcaagccttctacctgttggtcttgtttcttcttttgatgatttcttttataaaataattttaatacctgaaggcagctgtcacgtcttcccttcgccattctattcatcatgctttttttttttccataggttattgcattaggatctctttaatttcctggttgtcccatttattctagtgctatcccctgttatccatactctgaaaatgtgttatctacaatgtggcatttccaagtgtcatttcacctgtactttttaaagtagggtgtcatatctactcaaataggacaacatctgctgttgtcctatttattcagggcagaaaagtaatataattaaattttccatttctctgaatgtaacacgaatgtgcttttagtagaaactaatttctcagagctgctctgtgtatgctttttttttttttttctttttttggagatagggtctcactctgtcacccaagctggagcacagtggcatgatcatggctcactgcagccttgacctcctggatttaagtgatcctcctgcctcagcctcctgagtagctgggaccacagttgtgtgccaccactcctggctaataaaaaaaactttttttagagatagggtctcaccgtgttgttcaggctggtcttgaactctgggctcaagtgatccccccacctcggcctcccaaagtgctgggattacaggtgtgagccaacatgtctggcccctctttttttttttttttgcgatggagtctcgctctttcacccaggctggagtgcaatggcgcagtctcggcgcgctacgacctctgcctcccaggttcaagctatccttgtgcctcagcctcccgtgtagccggaattaacaggtgtgtgccaccacgcctgcctctttgtttttttttttattatttttagtagagactgggtttcaccatgttggccaggctggtctcgaactcctgacctcaagtgatcagcccaccttggcctcccagagtgttgggattacaggtgtgagccaccacgcctgtacctggcctatctttcataggttatataaattccttggttcccagtttttgcagtcttttccaattcagtttaattaatggttaactgtttattcattatcaaaaaaagtacagtgtaatagacaagaccatgttactattagaagtatgggtatcatcaaattaagatttttgattctaaaattattaggttccaagaccaaagattaaattaataaaaggtgaagctggacaaaatctgctggaaatgatggcctgtgaccgactgagccaatcaggtaatagtaatattaaactaatttaatttaaaaagaaaaaggaatttctgttaaggcatatcttatgataaaatcttcatctgtccaggagataatttgtcaaaattatttctttttgccgtatcagttaagagcaataggtatggaagagatgcgaagaaatagcacattctttaaaaaaaatgaatatttgatattgtttgttcctatgtggagaggatttcttaactctttcttcatctggctgctagagcctctagcctgaatatttagtcacttcctgaactaagtataattattgatttgccaaccatttaacaccagctgattctaaaaacactgctgtggggatataaagatgaagaagatacggatctgtcttaaagagctgagagcatagtgaggaagatagaagatatatacttaccttatattaggctcttggaatttgtggatttttttcccccgtttttggcttgggatgaatcctaaaggtctgttgcatattacctgtgattttgctaagatacaaactttaaggtagttagatggccattgaatcaagcagtgaactgaagaaacataatgcttcctataaggagcagttttgatataaaattggatgaattttgtaaagagcaagatgtaatattaaatcaaagttattataagctttggtgtatagttaggctgttggccaaagctcacattgctcttttattccatagcccactttttttgtgggagctaggctttcagtccttaaagtgactttctacttttttccttttctcttttccttctacccttgcagggctctcataagtgcctttgcatggtgtcacagttagatgaaaattgcctgtattttttttttatgtctttgatctgggcatcccgagggtgcctctgtaagtgtgctgagacacaactgtgtagtggtaaccaaacctaattgcccagcagaattaactcaaaggagggtttttaaaaaaagttgaattgaaatataattcatgtaccatacgcttcacccatttaaagtgtacagttcagtggcttttactatgttcatagagtattaccactgtcaccacagtcagttttagaagattttcatcactccatgaggaatttcttacctattagcagttactccccattttacccaaacctctcagccttggcaaccgctaatctgtctctgtaggtttgcctcttctttttttttttttttgagacggagtctcgctctgtcgcccaggctggagtgcagtggcgggatctcggctcactgcaagctccgcctcccggattcacgccattctcctgcctcagcctcccaagtagctgggactacaggcgcccgccactacgcccggctaattttttgtatttttagtagagacggggtttcaccgttttagccgggatggtctcgatctcctgacctcgtgatctgcccgccttggcctcccaaagtgctgggattacaggcgtgagccaccgcgcccggccggtttgcctcttctgaacatttcacataaatggaatcatgtagtatgtggtcttttgtgactggcttctttcatttagcaaggttttcaaggttcatctgtgttatagcatgtatcagtattttatccgaggactatgattttttgattgcttactgtaaacctatggaataaaaatctctgggaacaaggcctggaaataattctttttttttttttcctgagacagtcttactctgtcgcccaggctggagtgcagtggcgtgatctcggctcactgcaagctccgcctcccgggttcacgccattctcctccctcagcctccccagtagctgggactacaggcgcccgccaccagggccggctaattttttttttttttttttttgtatttttagtagagacggagtttcactgtgttagccaggatggtcttgatctcctgacctcattatccacccagcttggcctcccaaagtgctgggattacaggcatgagccaccgtgcccagccggaaataattcttaaaagctgtttaaaggaggattctgatcagccaggttcagaaatcagtgtatcagatcagagaataagagcttgtccctgttctcctatggccacttaaatccagaccttttcatctaaaatgcaaatatgtttggcatttttcatacacattcctgtcttttttcccccttctgctgtcttatgtagatactgagaatattaaacctgtactcttttcatttgctacataagcacccgttttgttgtccagctgtattttttgggttggagggttaggtctgcaataatcatgttatttcccctttgggtatacaaatgagacaacgtgagcaaatacaatctgtatttttaaagtgatggaaataacttaaatttttttttcagggcatatgttgctaaacttaagtcgtggcaagcaagattttttaaaagaggttgttgaaacttttgccaacaaaagcgggcagtctgtgttatataatgctctgttttctagtcagtcatctaaggatacatcttttcttggtagcgatgatattggaaacattgatgtacaagaaccagagcttgaagatttggctagatacgatgttggtaagttatatgtttcagaggaaatggtctccgtcttaattattataaattgcccataatcttattacccagaaataacgacttaatattttcctgtattccttttgtgtgtgggttgggctggggggagtttgaatgtggtgctgtaggggtggcatgtattttttgttgttgttgttgtttttgagaccaagttttgctcttgtcgcccatgctggagtgcagtggtgcgatctcggctcactgtaacctctgcctcccgggttcaagtaattctactgcctcagtctcccaagtagcgggattacaaatgcccaccaccacgcccggctaattttttgtatttttagtagagacggggtttcatcatgttggtcaggctggtctcaaactcctgacctcaggtgatccacctgccttggcctcccaaagtgctgggattacaggagtgagccaccgcgaccagccttgttgtattttgagacagggtctcgctgtgtcacctgggctggagtgtagtggcgtgatcgtaggtcactgctgccttgaacttctgggctcaagggattctcttgcctcagcctcctgagtagctggtaccataggcacatgccactcggcccagataattttttttttaattggtagagacagggtctccctttgttgcccaggctagtctccaactcctaggctcaagtgatcctcctgcctaagccccgcaaagtgttgggattaggcctggcacagtggctcatatctgtaatcccagcactttgggaggccgaggcgggcagatcacctgagatcaggagttcgagaccatcctggccaacatggtgaaaccccatctctactaaaaatacaaaaattatccgggggtggtggcatgtgcctgtagtccctactcaggaggctgaggcaggagaatcgctccaacccgggaggtggaggttgcagtgagccaagatcacactgctgcactacagcctgggcgacagagcgagacttcgtctcaaaaacaaaagtgttggaattataggcatgagccactgcatctgaccatatttttcatctaaatggttgtttatgtatgatttatcttgcttccttcatgaattctctcccatagtctctgtattaaaactataaatatcacttttattggcaatataatcttttttatgaagtagtcataatttgcttgcaactttctgttattgggcatccaagttttctcaacttttccactgttaataatcatactctgataaaaacttcaacaaaaagtgtcttcattgcaagttatttccatagagatacctaaaaacagaattactgagacaaaggacatgaacatctttaagtcttgcaaattgccaaaatgacagaaagattatacctcttcatgcttccagaagcgcataaccttttcttttcttttcttttcttttttttgagacagagtctcgctccgtcacccaggctggagcgcagtggtgcaatctcggctcactgcaacttccgcctgccaggttcaagcaattgtcttgcctcagcctcccaagtagctgggactataggcatgtgacaccatgctcggctaattttttgtatttttagtagagacggagtttcaccatgctggccaggctggtctcgaactcctgactgcacataaccttttcaatattgactttcttgtagaaaaacagatttctttactgtaccgatggattaatatagtggtgttccattgctttaatgacttaaaggaaaacccattgttttggggtttcttattaggttaggtgttctttatttggcttttgtcagttgattttggtttattgagttctagtcagtgtcattttttaagatggacttaaacattcttcatcactactatttttattaaaatttctagaaataatcaagtgagaatgcatttaataagaacatgagattttgcctaacatagaattccctccagctttgatatagaaaagcagttatataattaagatatatataatgtgaattgtttatgttggcaaaactaatggcacaaagaaaaatttcaaacccttaagccaatttttttattttatttcaggtgctattcaagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtaagcaaagattttaacaaattaaatattctgaattttgtttaatttttttttctaacttaacttttccttaaataaaacaggtatttctccttggagtagtatataccagccacttacaattaaaggagaaatgtaattctcaccacagctcctatcagccgttatgcctgccccttcctgtgtgtaaacggctttgtacagagagacaaaaatcttggtgggatgcggtttgtactctgattcacagaaaagcagtgtaagtagtaaaacaaaaatattgctttcacttagtgcgtaggttttaccggggatttaatcctcatgtgaagatttaatttgtcatgtgacccattaacatatatgtatgtaagcgctgaactgtgtatttagaaaacaattttagtaaattgaagtattttttagacctggaaactcagcagaattgagacttgtagttcagcatgaaataaacactctaagagcccaggaaaaacatggccttcaacctgctctgcttgtacattgggcaaaatgccttcagaaaatggtgagttttaaagtataagcatttttaaagaacattaccttaattttttaaaatcatgcactttttattgaaagtttttttgttcagaaaacagcagcttggtcatattatgacagatgtgttttttattgctgcaaaatagttaatgtagttaaatataagcacttagaggagcaatgcctggcacacagtgaatgttacatattagctgagctgttactgttattccttaataattaagttctgataattattcagcctgaaaattaaaaaaaaaaattagcacaaggctttgtaggtaagaccattatagatctttctaaatatttaaggtttgttttgtgtcaccattaggtgaagatggtcagccttttgaacaaactgacactacagaagaggcaggtttcagctatctaaaaatggcaactgttaaaaagtagttgggattgctacattagggtggtatcattagaagtgtttaaaagttgagtgtagaggccgggtgcggtggctcacatctgtaatcccagcacgttaggaggccgaggcgggcagatcacaagatcaggagatcgagatcattcctggctaacacggtgaaaccccgtctctactaaaaatacaaaaaaaaactctactaaaactacaaaattagccagacatggtggcaggtgcctgtaatcccagctacttgggaagctgaggcaggagaattgcttgaacctgcacggcagaggttgcagtgagttcactggtattaaggtggtttagttattacagtatttggaagttgaacaaatgactattgaggtaccatttggttttgacttgaaattttagccagttcttacaacctgtaaatgaactttagatctaatcatgcgtgttccttaaagttgtgtgcttttaactttcttttttagggcaggggtcttaattcttcttatgatcaacaagaatacatagggagaagtgttcattattggaagaaagttttgccattgttgaagataataaagaagaacagtattcctgaacctattgatcctctgtttaaacattttcatagtgtagacattcaggtaacagagttcctttatgaatttattggagatgggaatttccagtttataaacaaagacgtggagctataaactgcttaaattaattgccttgttatttaacggtaatcttgttttctaaattcactagctctcacagataagatatgacagagaagagtaatgagatgtttgtctcttaagatcatataaaatctttggaaaatcatttgggttttatattctgagtataaacaatttgactaaaaactattctgtgtgtttaggcatcagaaattgttgagtatgaagaagatgcacacataacttttgctatattggatgcagtacatggaaatatagaagatgctgtgactgcttttgaatctataaaaagtgttgtttcttattggaatcttgcactggtaagtagatgcagtacttgagctaaaagttttatttatttatttattatttcttttaaaagacggggtttctctgttggccaggctagagtgcagtggcacaatcttggctcactgcaacctctgcttcccaggctcaagcgattcttgtgcctcagctcccgagtagctgggattacaggcatgagccaccatgcgtggccaagctgaaagttttttgttttaaaaagctaatgatttcataaaagcactatttgtatagatttttcacaggaaagcagaagacattgaaaatgatgccgtttttcctgaagaacaagaagaatgcaaaaattatctgagaaagaccagggactacctaataaagattatagatgacagtgattcaaatctttcagtggtcaagaaagtaagtagcaggttgttgtatgtacgttcttactgataacccactggtcagtgtttttgcgttggtcttatattttggtaatttcaaaaatactcagtaatatgttgttattaatgcacagaagggatgtgtgtgtctaaatgcttatatttgcttgctttgtcttaggtttggtgtgtctttttaaacttgggaatctaggtgttatcttagcagtgtaatcaaaacaaatattataacctcaggactaattcttaatgaactttgctgaaattgaaagttgttgctgacaacttaagagcatttcttctcatcctcatcagccattatgaacgcccttgttttcttgctgtcagctgtttgagattgtcatgatgatgttaaattatgttcagtcttctgagtgttttgttgattaatttgtgttactactcttttattaggatttatgttgtctggtgtattgtagcatctgtatttctgtcaccattgaaaatcagttagaaaacatcagtaacttattttgttcacttggaaaagctttccaagttaacattcctctacaattatcatggttaacagaagtaatagaaagagcatggactttagaatcagaagatgttagattgtacaacacttttctgtgttcatgaagaaaaaaatagaataaagacaaaaaaataaaaataataatacaaaacagcagaaaaacaaagaaaaaagataattaaaaaacactttcacgtgtattattatttaaagtgtaaagtgcttattaaaatgacaaaaatgtaaataagataaaatatatcattttagagtttttacttttggaattttttgcaaatgaaagcccttaattaatgtcttttatttttagttgcctgtgcccctggagtctgtaaaagagatgcttaagtcagtcatgcaggaactcgaagactatagtgaaggaggtcctctctataaaaatggttctttgcgaaatgcagattcagaaataaaacattctacaccatctcctaccaaatattcactatcaccaagtaaaagttacaaggtaaacaggaaagaatggaatcatttcattgtgaaattgtttctaagtgttttaaatgctcttttgttatttttatttttttttttagtattctcccaaaacaccacctcgatgggcagaagatcagaattctttacggaaaatgatttgccaagaagtaaaggccattacggtaagtcacttaatttctctagctgtactttttattccaagattccttccctggccactctctcactttttttctgaagctggtcagaatgtccccttgccatccaaatagtatggcaaggggacattttggtctttttttttttttttttttaaggcagggtcttgttgtgcaggctgcagtacagtggtatgatcacagcttactgtggcttcgacctcctagctcaagagagcctcttggcttagcctgccacgaagccaggactacagagagtcacacgccactaggcccagctaattgtattttttgtagagatgggatttttccatgttgcccagggtggccttgaactcctggctcaaacaatcctcctgcttcagcctcccaaagtgctgggattgcaggtgtgagccactgtgcccagcctacataccttggtcttgaccctttaccatattttgttttgttttgttttgagatggagtctcactctgttgcccagtctggagtgcaatggtgcgatcttggctcactgcaacctccacctcccaggttcaagcgactctcctgcctcagcctcctgagtagctgggattacaggcacccgccaccaggaccagctaatttttgtatttttagtagacacagagtttcaccatgttggccaggctggttttgaacttctgacctcaggcgatctgcccaccttggcctcccaaagtgctgggattacaggtgtaaaccaccacacccagccctttactatatttttgaaagtactttatgtgtctctctcctcatcttccacaaaatttgagaccttcaaaggtagaaactgttttatttaaaatataagagttcctgacacagagaaggttcccgagtgattgaactgctacagtgtactaatcatactctggtctatgagttcattctcagattagctgtggattacatgtgtttcaaatgtatagctaggaattgaaaagtggtctgagcttcaaaaagtcttgctatattttaatacttccatatgaatttgacttaattatgtaaggaaatagttatgtatatatatcttattttaacaatagggttcaaaggagcttgacttttttggaattggaaataaaagtaggttctttcatgtttatcaggcaagaactaaattatactgctaaagttacatcaaggatatgctgatgtgtggcgattattacagtgtgatcagcagtatttgcaaattgagagaatactatttggtggggaagacatttttgaatttgcacaaaaatcttgaatgttaattctgtgtagtcatggcctatgacaattacatacaattttgacttaacatacaggtttcaggctcccaacattgtattctgtggaagtatagtggagcactagtccatgagcttgaaaagcttggtactagtactgactctgccattaattaatgatcttgggccagtcacttccttcgtgactggcttcttatctttaaaatgagagaattattgaagccagttctcattacactgaatgttaaaaattacagttacagcagtgattgcaaattcaaagctctggtgcggataccaacagtgaccataaagttttctaggtgattccactagtttcttatttcttggatgtgtatgtgtagcatctggactaggcactgtagatggatgagtgggggaaattttatttagcttgaaaattgagatagttttggacctcatggttaggtctttctgggaaatttttatttgaaacacttgtagaaaaagaaagcagacatgctagatctgtccctgacctcacttgttagaactggtcggattcctgggctgatacagagaagtttgaaacttttcaaaatttacctgttttctgataccactacaatttctttggaaaaagaatttcctgttaagtgtctgttttgtaaggggacattttgtaggttctagggttgggtatggtgctgtcatttagttttcttcagcagagatcaggtagccacatagctacactagatggcattgtatctatctgccatcttgtcaaggcagcagagttgtgttaagagaacatttttggagtcagatgtggttcaaattccagctgttattccctgcatccctttctctcattttaagataggagctaatattgtttacctaacagtgtagatagtataaaaattaagagtttaagtgcattggacgtattattatatacataataaattatctgcagctactgcttttttccctttcctggtggagcatttgaacgtcacctggagaattagttgtattttgtttcagcatggggttaagtgaaaagctaatttggggaggtgatttggaatgtcaggtagtccagattgcagtatagaaagaacacactgaaaggatggtcagtgtaatgttagaggactgtgaaagttggggaaagaagtttagtttgtaggtacttgtttttttgagcagggaattgtcttggctggaggtgaatgtcagaaaggttaatgtaggcaagtgtagaatggaaatgaaggtgtgatcatttaggaggttatttgtttaggtgagagagttaatgaattaggttttgtattaacgaatgaaaatgggagcagataaatttttaacaaattaagaatcatattttaaaatcagcaccaggtacctagaactcattggcaaatagaaactttcaaaagatataatcaggtccgggcgtggtgggtcacacctataatcccagcactttgggaggctgaggtgttggatcacttgaggtcaggagttcaagactagcctggcaaacatggtgaaaccccatctctactattatacaaaaaattagccgggtgtgctggctgacgcctgtaatcccagctactcgggaggctgaggtgggagaattgcttgagcccaggaggtggaggttgcggtgagccaagattgtgccattgcactccagcctggatgacagatcgagacaccatctcaaaaaagaaaaaaagaaaaaatcagttatttaaatttaaaagagtaagtttccccagcactgtttctggcatgatataattaaatgattaaaattatttgatttttttttcttccaatagaaactaaatagcagtaagtcagcatcccgtcatcgttggcccacagagaattatggaccagactcggtgcctgatggatatcaggggtcacagacatttcatggggctccactaacaggtgagctggcaagtgcataatcgcatattttagtaaaactactttacttccctcttttaagtagataacgtgtgaaatcaccttgtttatatatgtttgttaatatacatgtcaacgtctgtttatatgtgacttcaaaagctgtatttggtgttacggagatttttataatcccaagcagaaaaaacgagccgtatgtgatcacgtgtatataaaggcttaaagaacacttaatccacacctcagatgagctgagatgagattattccttaaattgaaaaatgttattgaatagagttatgcactaagaaatgcttaattaagaacctacacctctggggaattattttgatgataatgatgagaggcaggacgttatataggaaatcttacttaatttgaaatattatggttatataaagaaagaaaaggagtttggacctgaatcatacagggtttttaagttctgctctatcacttactataatagctgtgtaagttaacctgtctgaaatgtggagataatacttgccttacataattactatgagcatttgtgtatgtgcaggtgggcgtgggtgtgtatcagacatttattagagtatacagtaaacagttaatgaactaaggttactaatagtgtttactgtgggttggctatgtgcaaaagtgctttgtgaatgtaatttgatttaattacagtaacttagaatggccggtaccattattaatcccttttttataaataaggaaatggataaagaaaggttaggtaacttactcattattatacagctagttattgatagagccgagattcacactccagtggtgtaactccaaagcacttgccagtataatacattgctcccaggcagccagaaataaaaaaattgttccttttacgtacgacagacttctgaaatggtagtagtagtgcccttttttttttctctttttagcccaggaaagatttagaataaaatctagtttagatgagcacatttgtgtgatggttcctatagttaaggcaaccccactagccttttgtgatagtatcttctcaacacaagcaaaataacagaaaatctttgtgaagtcaagcttattaaatgtcgtaagtcatagataagtatatgaaatgtctaacgttcaaaccttgttttcttaaaaccttacacatcatataggtccttgtaagaggataaacaaaccggctagcctttcctggggcttttttagtgacgtgtgcagtcagttatttggtgccttgtgggtcatgatttccatttcttctgtgtacaggcataaaaggtcttctgttcttatacaagcatgtaaatccaacattctcattgtctcattttattcttgcaatgaccctgtgaaatgtgtagaagcagcatatcctcattttacaattgagaaacatggagactccaaatggattatttacaggttcacaaaacagctttgtggcactgaaagggcgagagccaagatctcctgatttctgttcctgtgttcatagattctttttccttaataaaagtaaacatatatcaagatggtccttgtttttttaaaataagatgattaaaattaaagattaatgagctcataggagatactcagaagtactgaacagggtgaagaaaactaaaaactaaccaccttattaacatttcttatatttgagagcatttccttctggttctttctctatacatatagtattttttatgagattgttaccatgttactatgttgtgtgtagatgagctagcctgttttttaaatgttactttagttctgagcatttttaaacttaaatgttttttgaatattaatgagttcatggtgtcccatcacatggaagtactgtaaattctgttcctttatttatgttgtttctggtttatgccattacaaattctaggacactgtcctagttttgtagggtattcaaaatattcagtttatgctcttaccactagtatctgatagtgccattttcgcacttttgctaatgctgacttactagtttataaaatcctttgccaatttgtaggaacaaaagttatatcaatttttaagtttttttaatactagtcatgctcaacaattcatgcaaatggcagttggtagttttgccatcttcaacgtgggtaccttccagttgtttggtttcttggtaaaactcacacaaaacagatggagaagagtttttgtatatcaacatgaatgttaatgtgatttttttaaagccaacgaacacatttgtgttccttgtgagatcctgtgcatgaatttgtcaggtaatttttttgacttgaacattctcataatagcttcaatttgcacaatgcaaccttgtcattttgcagattttcaaggctcacttcaaaaacatgttccttgaggcctattaacatttctttcctaaattgtctattcatatggtgctttaaaaaattagattacttttagtatatttattagagcctcacagtttagagtcagtagtcaattaaagtccctacttaaacttcagactaagattttttttttatttaatattttattttttctttttgctttcatgcagacagacattttgcaagactttaagattcttgggccatttctgtcaggttgttctgtgttctgtgcctgcttcctccccatagtaatttcaaaatagttatcctcacctctgtaaggtttccaaaatcaaacttgggcttctggctagccttttctaggtcttgatttttcagtgctttccagaggcaattgtttggaacctcttcgcacagtttctgtttcttcttccatgtacaggcataaaaggtcttttggttgttttctggtaaaactatcataaaacagttcaagcaaatgactattggtagttttgtcattaacatgggtgccttctagtcgttttgtttcctggtaaaacagaccaaacagagggagcagacagtttgtacatctgtatgagtgttgatgtgctttttattttaagccagggaacacattttatgttatttatgacatcctttccatgaatttgtcaggtgatttttgagctgaacattctcagtaatagctttagtttacaaaatacaacctagtctttctgcagattttctaggcccacttcaaatgcattgaccatcagatggcatcttggttccttacgtcctttctgtgactgaatgtccataattccacatcatactgatctttcttagaaaaggcaacagttactttctcctttattccttttttaatgcttgtgaggtagttcttgttgatcacagcgatgctattctcttattcttcatgtcatatttagcaatttttttctagtttgtcatttgataatcttgattggtatattttgatgtacagaaatttaaaatttatgtagttaaatctttctttaatttctattgcttttgtatttatagctcttgcctagatagtcttaactgtagtatagactttaacagtgttttctttcttttcttttttttttttttagttgcaactactggcccttcagtatattatagtcagtcaccagcatataattcccagtatcttctcagaccagcagctaatgttactcccacaaaggtaacaaaggaataatttatacatttataattattttctttttaaattgtttagggttccttcaaataaattcaagagagcagttcactattaaaacttttatgtcccttaaaatgtagatattttaaatttatctccaaatacagaaattatccttcttagtcaccttatttttgtgttaataagtgtgaatatttagaatattttaaaaatgggagtggtggtggtggatccttcatcgttctgttttaacagaaatagaactgtaatgcccttgctgacccactatgtggtaagtactttcaggcctgatacagctatatatataacaattgattgaagactcaatattacagtggtagttgaatgtgacagctttgaggacagagtgttggggtgcatttagacccttgttcttctgcttattttgaccacaggcaagtttcttaacctctcaatgcatcagttgcctcatatgtgaaatgagggtaataataataccttaattcatagggtttttgaggatattaaaatgagataataatgtaaagtgcttagaacagtgcccagctgacacattaataaatgctcaataaatgttatcatcatcatcatcatcattattgttaacatcatttgataaattgtttaggaatgaagaaggtatttatttcatgactattttgggcatgtggatcaagaaaattcaccttcatttatgtttcagggttcttctaatacagaatttaagtcaaccaaagaaggattttccatcgctgtgtctgctgatggatttaaatttggcatttcggaaccaggaaatcaagaaaagaaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctgtaagactgaggacagcgatgacatccattttgaaccagtagttcaaatgcctgaaaaagtagaacttgtaacaggagaagaaggtgaaaaagttctgtattcacagggggtaaaactatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaagggtaggtactttgttgttaaagttaagcacaatttttctttcttttaatgtttagcttgatgcagactctttgtgggatactaatgttgggatataaacgatgctttgtgaacacccccaaaatatttgagcaattttttttctcccttaataagttcacggtgaggtttcaaagagcaagagaacttagttaaagacatttcagtaactggaagatacttctatcatgctagggcagagcaaaagaacttggtacagtgtatggactcatgcttgaatcatgcgcattaacgtgagtctttttttaaagtgttcattttcatttgttctgtttcttttgtcactcagaaaacatgatattgaggctgggcacggtggctcactcctagaatgccagcactttgggaggttgaggtgggcagatcacttgagctcaggagttcgagaccagcctggccaacgtggtgaaaccctgtttctactgaaaatacaaaaatgagccgggcgtggtggtgcgtgcctataattagcagctactcaggaggttgaggcaggtggatcgcttgagcacaggagatggaggtagcagtgagctgaagtcatgccactgcactccagcctgactgagtgagactttgtctccaaaaaaaaaaaaaaaaaacaaaaaaacaaaaaaaaccatgatattgagatgttctcattttatgtgttgtatgtcagtcttgctcatgtattaaatgagcaaagaatgaaactacagggataaatgaatatgtaagacagtcagattggtggtataaattgagggattctggctttttatgttttaaaagcatattcattttgtttcctaaaatgttaaaaaatgaaatattctttattttctaggatttaattttagcctttttaaatctaatcccatggccttttggactagcaccccttcctcacagcctgagagcaaaggtatagaactagcattctcagtatgagataacagcagtttttagcagctggtagcccttaggaaagtattaataactgtggctgtatgaaatgaagtacttaccactacaacatgaatgttaaagaatgccagtttaagcaaagtaccttttgactggtggcatgacacccttgttggtttgttttttaaaatgtactgggatgctgatttgtaatgtacttcattgctctgctatttcaggtctgctcagtgaagacctatgttttatctaatgtttatctttagccactaacgtctgccagtattcacatgtagtggcaacggcatgtatacagtatggaagagtgtccctgtagggctgttcttttgtgcatggtttagaaaaatgttgtatttgaaaatggaccccatttttaacagccagcattctacagcttgcatattatatatgttgcacagatcatttttagaagtgtggctactagagtggaacaagaagtgggatctgttgaaggccttcaagaacaggttagggaagtgaaacctcacccttagtgaccagtaacacatcttagccatgccaaacaagtacaatgataaaataacaatctctgatttttttttgagtataccagttttattaccagctaaggtagctcttaatcttttattttaaagatacggtctttgagaaatgtgaaaagtgttaacttaaaagtggatgtatacttgcgtacagtttctgtgagctctaggttaggaatccctgacctaagaacgaatgtgcctatacactactgtagaacatagagccttattctgttttgaatctgataatgtcattgtcccaagggaccttagaaatgaagactttagacatgagtaaactgaggccaagagaggctatctgatttacccaagaggtctttactgagtaatagcagaagtggaacaagaatctgtatcttacggtgtactgttatttctcctagctaggaaatgatactaggttttcgtttataatgaaggagagggacaaatttaacattgtaaaaggaagggcactggttctgcagagcagtgtcatccaatagaaataaaatataacctgtgtatgtaatttaaaattgtcatttggtgcaatggcttgtgcctataatcccagttacttgggaggctgaggcagagggatcacttgagcccacaagttccaggcttcagtgaactatgatcacatcactgcactccagctctgggtgacaaagcaagaccgcatctcaaataaatacataaataaataaattttctagtagccatattaaaaagaataaaaagaaacagttaaaaagggaaacagatgaaagtaactttatcgatagatttgatttaactcattatgtccaaaatatcattttaacttctaattaatataaaaattaatgatattttacattattgtttttcaccaagtcttcaaaatccagtgtgtgtgtttacacttactgttagcatgtcttgatttggactagccaccttgtgaggttttaatagaatgtggctaggctaccatattggacaccatagctctcagaatgtttccctgtcaccagttggtatacatggcatgcttcataactggcttactttattaaactcctttagccagaagttgttctttacattaatagatcagaacaggttgcatatagaagttttttctgtttctaattttttgccctttgcattgatggtggctggggatgggttgttttcagccatatgaatggtcttagattttatagtgttagctacccatagagtaacagtttttatttaattttatctagtatcatgcttgaacacaggcaaactagatgcaactctagtcaccttccattcttggcaattgttaactttccttacaggaactaatcacagttggctttggattagtttcatatgtatactaatacttgcttatgttttaagatttttttcaattgctgcaaatgcatggatattttggtaaactattgtatgctaagtatagttaggcaacactttaaaatttttaacctttttaaattctagaaatttgtagtaattcttttcaatgactattaagtaaacacaagatttttttgttttctttcgttttaaatagattctgtgttcacttagggtttttggtagaaaactaaatcaggatgctaattctaattcatgattatcgtacatctctgcatcaaagtatatgtgttttttatcagtatgctgttttaacctatagataggttccatggtttttattttcaggtagagtattaacgtcaatacttaataccttatctttgtcaatttttttgactggtgttacagcaaaagagaagaaaaaacctgaagattctccctcagatagtctcggtctcctgacctcgtgatccacccgcctcggcctcccaaagtgctgggattacaggcatgagccactgcgcctggctgacacatgtcttaattctggtattcaccagatttgtttcgtgttctccgttgttagtcatcaaatttgtctactttttaaatagaaacattagctagagcaaggaacttagaaacactcaagcagcactgaatgtgtagaattgcataaccaatatagcttctttgctttcatatttacaattagttggagttttagttcagccgtacccagtatcttccattctgcttccaggaagaaatggaaaaatgtcagccatgatgatgcagtattttagtagcaagttgatggtgttttggtttcccatgggaaatattgtcactggagcattagcagctatcggtcacttattagggtaaaaaagcaacttcagaagaatttaacatatgccaaagaatcaacaaaggaagtaatcagccagggcaaaggtcgcacaagagattgtaatctagcaatcagcagtggaataagcagtcagcttaccagaaacccaggaaaatgctttagaaagggcagtcaggactaaggcaatttaatgaaatgcaaaataaatgaaatctgaagtttaaaaatctagattacaattctggtttctaactcagttatgagaccttgggcaaagtcattaaatttctctgaacttcagatttttgggagtcaataaaccaatacatgtcaaagggcccgataaactttacagtttagaccaggcgtggtgtctcacccctgcaatctcagcactttgggaggccaaggcgggtggatcacatgaggccaggagtttgagaccagtctgaacaacatggtgaaatcccatctctattaaaagtacaaaaattatctgggcgggatggcatgcacctggaagtcccagctacttgtggggctgaggtgggaggatggcttgagcctgggaggcagaggttgctgtgagccaagatcgtgccactgcactccaacctgtgtgacagagtgagaccctgtttcagaaaaaatatagtttatcagcaaacaggaaagtcttgctaggcaacgtaattgattagttctgtgccctggattctgggctcttaactgtatgagcactgtaggtgtgagcagcaacaattaagaagctgcagaggtaaaggtataagggcagtgattgaggatgtctaccaagcagatttcggcaagtgtgtttcaagaagtatgccgcaatctgaaatacctaatcctgaaaaattgctagaatctagtcttttaattttggccagtatttagcagtagtttggccctctactctaaattaataaaaaataagtagtactatattatgagctgtgttatctaacagtttatcttagctagtagcaattaatttatagctgctattaaaatgactaacgtagttaaaagtttgatgactaagtttttttttgtttgtttgtttgtttttttgagctggagtctcgctctgtcgccaggctggagtgcagtggcatgatcttggctcactgcaacctccgcctcctggcttccagcaattctctgcctcagcctccccagcagctgggattacaggcacctgccaccgtgcctggctaatttttgtatttttagtagagatagggtttcaccatcttggccaggctggtcttgaacttgctgacctcgtgatccacccaccttagcctcccaaactgctaggattacagatttgagccaccacgcctggccttgatgactaaattttaggaaatgttttagcaattcttcatacacctttcacttatagttacttaattcctctactcttatcatttgatattttcattttattgtgtatctctgtaaggccgaatcaatagattttgaacaatctcacacttaacctttaaaaaaaatctaataggcccagtttcctctcagcaatctttgaagaaccttcgagaaaggagaaacacagacctcccgcttctagacatgcacactgtaacccgggaagagggagaaggcatggagacaactgattacggagtctgtgtcttccgccagcacatacacacagtctttagagcagctgcttaattctcccgaaactaaacttggtctgttactctgtctaaatatgttcttcttctttaatttcactgtcttatttaattactattacactaaggtacatatgcttttttgggctgctccaataaaatttctttcaatattccactacctgtttgtattagggttctctagagggacagagctaattggatggttggatggatggatgagatggatggatggatgcttattaagtattaccttacacgatcactaggccatctgcagactgaggagcaacgagagccagtccaagttccaaaactgaagaactaggagtctgatgttcaagggcaggaagcatccagcacaggagaaagatgtaggttgggaggctaggccagtctcgccttttcaggtttttctgcctgctttatattcgctggcagctgattagatggcacctaccaggttaagggtgggtctgccttccccagcccactgactcaaatgttaatctcctttggcaacaccctcacagacaacactcaggattaatactttgcatcctttaatccaatcaagttgacacccagtattaaccatcacactgtccaaatggaaaaattattaaacaaatcttttttaaaataaaatgctagctcttgccctaggcttgaaccataaataagtggtgggaagtttatagtcacaaataggtggtgggtattagaaagcaggataaactatcctctcacccttccaagaaactgacagtttcagtttattcctcttgatgaagtaatgctaaatttttgtagtgatgttttggtatattttattacctgtaattaatattactgttcaaaatttagggggaatctgtcatcttcctgaaacttcagaatcacctggagtaagggtcatttgtattcatggtcactgaccacatggggtagaaactgcaagtcatggttccttcaggcaaagttaatagtggtgacacggaggcatcatgatagagcagcagactccagaagccaatttgactttgtgatttctgaaaaaattacctgtcaactgtgagcctgtttcattgtctgtaaagtttgaataatgatacctaccccgcctgatagaagattcttatgagggaacatgatacgtgaccagtaaatgttaatgctttccttatacgtgaaatgacataaaatcttggaatattaatagatgggaagaagatgtgtaataaaactgtctataaacacaattctgacaaatttcagaactgggactcatagggcttgtattcagttagattacatgctttacaacagagatactgttttatttgtgtcacctacaacatataatctgttgattgaggtatgttgaatagatgaatggcaaagaaagcagacctataaaatatcacatagtaagatatttatatttagatttttcttatttagaatcttcatctgtaatgtatgattttgaaaattaattcttggaacaacatgttgcagagcctccattatggcatgctgaatttaccaaagaagaattggttcagaagctcagttccaccacaaaaagtgcagatcagttaaacggcctgcttcgggaaacagaggcaaccagtgcagtccttatggagcaaattaaggtgagatcagaaacctggccactgtgaaaaccgccagtttggttttctggaccctccatacacatgcacccaagtttaaaaattcacattgcagatgcatctataacgtcttgatctttatattagattattagattcctgatggtgagaaataaatattgccttttttttttttttttttttttttttttgagacagtcttgctctgtcacccaggctggagtgcagtggcacgatctcggctcactgcaagctccacctcccaggttcacgccattctcctgcctcagcctcccgagtagctgggactacaggtgcccgccaacatgcctggctaatttctttgtatttttagtagagacagggtttaccatgttagccaggatggtctcgatctcctgacctcgtgatccacctgccttggcctcccaaagtgtgggtattacaggcaagagccaccgcatccagccaaaatacttcttttacacctattacataaagattatttcttaattcctacttttcctaagaaaccgtaatagatttagaaactagagagatgttcacaaatcattgttcacatatgcttaaataaaaaatgggtgtgagtctttgaattctaaagataaccagtgaatttaaattattcaactgatatttatagtactgaactactaaacagttttcaggtggagatggcaaagtggcatgggaagtttttcctgtttaaagtagacaccagaaacatctaggaatgttgcagaacagttgaggattactcaaatgaggtatttccaccctggctcactgataaatcacccctcagaatatagtcatactgcttattgaggagttcttatgacccaggccctgggctctacatacattatttaatctcatcactggttgagagaaaaattgaagctggtaaatggtggaacaaaattcaaactcatagctgtctgaaaagtacatgcttttcccctgtactttgctgttcctagtagatctgtcctgccactgtgcaaggccactagctatccttgtcagattattttaaagccgaattcagttattttcagtaaattgtatatatcatgacattccaccattaaatacttcagtatgcatctctataaaatagcattttcccactaataaaaacattatcatagctaacaaatcactaactagcccagtaaacctaaatgacttatttaaatgttatattttcttttttttttttttttgagatagtcttgctctgtcaccaggtttggagtgcagtggtgcaatctcagctcactgcaatctccgcctcccaggttcaagcgattcccctgcctcagcctcccgagtagctgggactgcaggcacgcaccaccatgcccggctaattttttttattttactagagacacggtttcaccatgttggccaggacggtctgaatctcctgacctcatgatctgcctgcctcagcctcccaaagtgttgggattacaggcatgagccaccacgcctggccaaatgttatattttcataaatttatactctcttcatgatttctttgtcttctttattgtcacttttttaaatggtcctaggtttgaggacaaagttcgctaactttcttgcctaacctaaaatgaaaatatactaaaagctatggcttggtttcaacctggaaatcttcctcaaagacttgaacatgatactaccttttttatatcgttctttgcctcatttctctgatagtgttttacattgtcttatattcctgaattttcactgtgtctgaactttttaagtgccgttcactgtggacgtcttaactgcctgggacttcaggaacagcgtaggggcagggggttagtggaggctaccgatgttcccctcagcccattttcagagccccatgccatactggcttagtttctatcaaaagtagaaggcagagggaacatcttggtaccaacccatggctccagttagttgctcctcatggagacgttccatcagttccccagctttcaactccatttccatgataccctgtgcttctgagacaagaactccagtatttacacaggatgcatcctctcctcttgtcagtgatacttggtaagctgctggactgactcatttccacctcttcatctgtttctcgtgagaatgtcttgacgttatctcatctactttttctcctcttgtattagcttgttgcttttctacttcacccctcttccttccaaccccaaatagcttaggacaatggagtcatatagcccaacacttggttcatatgcagcaatccactttctaggcaaatgcagctttgaaactatctcatagttggagttccggttttcatgtcaaatggattttatacggtgatgtcataaactcctttgaaatgcttcacatgcagctgctgtagttaactgaattccttcctttattgccatatggagggaagggggaaatttggggggaagagaagaaaaatacatgagttcagtctgccatatttaatcagaagctcctaaagcccatttttaactcatttctctaacaccagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtgggtaaaaggagagtctcagaacttctgacttctaacttaaactaaacagcctggtggttgagaagttgtctgtatgtgtaacttttcaattttgctcatttgaattgggtctgtcatatgagtaggccgtgactagatttgaaaagctgactttttaacatcttgaggcaactgtagtacatttatataattttaacattcagcaaaatacaataagtgcttagcttgatcttctagctctttgaaaattggatttttatcctggtgttgagttctggtgttcagctgaacgtggttttgttttaaattctactttttaaaaaacatttattagcttgttccttttctacttcacccctcttccttcctccaaccccaaatagcctaagacaatggagtcatatagcccaacacttggtctatatacagcagtccactttctaggcaaatgcagttttaaaactgtgccataggccaggcactggtggttcatgcctataatcccaccactttgggaggccgaggcaggcggatcacaagatcaagatactgagactatcctggccaacatggtgaaatctcgtctctactaaaaatacaaaaattagctggacgtggtggcatgtgcctgtagtcccagctactcaggaggctgaggcaggagagtcgcttgaactcacgaggtggaggttgcagtgatctgtcacgccactgtactccagcctgacggcagagcgagactcccatctcaaaaaaaaaaaaaaaaaaaaaaaaaaaaaaaaaaaaaaaaaaaaaaaaaaaaactatgatgtagttagagttggtttccatgtcagatggatttaatactgtgatgtcattaacttctttgaaatgcttcatatacaactgctatagttaactgaattcaagctgcatcttaagaattatggtttcatttttgttttagttttaaattacttttatttttgacatttacaagcacaaggaagacgctataatctctcttgagttgtcacccatctctaacggttttcaactcatggacaatcttttggcgtaaataggggagagttagagacttaaatcccacacatcatttctttccccagtgaataattcaatgtttattggatttctctgtcacctatacctagtttatgttcattttgcctgtgttattgtgaatgtctttttatagtatcctaaatagggctcatatattgcatttggttgatgttccttaagctttattttgttgttgtgtttttgtttgtttgagacgtagtgttgctctgtcaccctggctggagtgcagtggtccgatcatggctcactgcaacctccgcctcccggattcaagcgattctcctgcgtcagcctcccaagtagctgggactacagatgcacgccagctaatttttctatttttagtagagacgaggtttcaccatgttggccaggatggtctcaatctcctgaccttgtcatctgcccgccttggcctcccaaagtgctgggattacaggtgtgagccaccacgcccggccattttgttttttttatctataacaattacatatataaatatatttttaatgtgccacttattaattgaagaaagtggtcatttatgctatagcagtcctatatttggtttttaatcattacagggtaacactgagcttgttctaattgcctataaataggaagatccaggtgcaattgggtgggatggtggacaaaaatacaccatagatggtattgtgtgctttctaagacatcaggaggcccagaatgtccagacatcttacttttgactgattgaccttatctagttggtgctctttaacatgttccccatcccctgtaaatcctaataactaaactgataagagtcatcctcaaaattgagcaggcatctgaatcatctggtatacttactaaaattccaattgctggtccccaatttctgacccaagattctgcatttttagcaattcgttgctgatacttctggtctggggcccataccttgagaatccctggtctagaggcctgataagattcaggcttaattttttttacagacatacttcataagtagtattgatagtttctttgaatctggtttttaataatctttctaatgatgaaggaggaatgttctcaatactgacagtaatctcagttcttcaaactataggataggtttctatagccacaatagtatttttgtcacaagggcccaaataagaatacatcatgtatatttttagtagttattcaaattacaggttcactgtctttaatttattctaacaaaagtaaacctaattttatagttataaaaaagaagaaatctacttctagtcacctaagagtaaaactgcccctataaaaaacaagacagaaatctcaaaattataactaattttatagttataaaattaaccaggactttaagaatgtttgcattttaaaattaaagttttcaatacaacaatgatattatctcaaaatactcagcatgtctaacaggtctcttttaaaagctcagcatgtttaatgtagacgttgctaacgtccaggtggctcctataagttaagggtccattgatttagaagttctaaaagagactaacctaagggataccaagaacagatatttttaaagaatttcatagaggagatacacattagaaacccagaactctaagatgtgcatttggtaagtcctgtaaacagacaggaaaacacatttaaattagtttgccctttaaagattatttcctacttgtctcttatcaatgtgagtacataaaagagaccttattacaattaaaaactgatggtttagcagcagatttagataccttacattttctctttaagagagagaatgtaaggcctggcacggtggctcacacctgtaatccagcactttgggaggctgaggagggtagatcacctgaggtcaggagttcgagaccagcctggccaacatggtgaaaccccgtctctactcagaatacaaaaattagctgggcgtggtggtgcatgcctgtaatcccagctacttgggaggctgaggtaggagaactgcttgaacccaggaggcagaggttgcagtgagccaagatggtgccattgcactccagcccgagcaacaagagcaaaactcttatctcaaaaaaaaaaaaaaaaaaaaaaaaatgtaaactacaagatagttcaaaagaaattacacagaattcagcatgggagaaacaaaaaacaagagtgggaaaagacatcaaacatgtttttactaatcgaagttctaaaaggagagacaagaatacagcacagataatatatgaagagaatggctggaaatctttcagaactgttgaaggatatctatccacagattcaaaaacccaataaaatctcaagcaatattaaaaaaaaaagaagaaatctacttctagtcacataagagtaaaactgcccctaaaaaagacagagagaaatctcaaaagcagccagagaaagaagacacattgcctcacaatagacttctcaacagcattggtgtaatactatctcatgtactaaaagaaataactgccaaccttttatattttccaagatctcttctggaaaacaaaaactttaagaatctgccttcactgaaaattcttaatgatgtacttcaagcaaaaagaaaatttcctaggtaaaagttctaagatgccagaaagaaagacatgcaaaggaaacttaccaccatattacagatatggactgtcagtctgactggtcacactaggggcatttggttaccaaggccttgaaaataataaccaacactgcatacatgagggatgccagaagaaaggtctgagagccactcttcctggcactgaaggaaacagggcccatcagagcaaacaagtaccttttacctctctccttggaagcaaatgtttataatctctggttttgtgtaaagtttataacagtatttttcattcaggttgctacctattagtggatggtgaaattaatttggtggatcacattcagaatatttttttaaaatcaaaagaatacaagctggggtcagtgactcacagctgtaagcccaaaagtttgggaagaccaggcaggaggattgcttgagaacaggagttcagaatcagcgtgggcaacatggcgagaccctatgtctacaaaaattttaaaatataccagatctggtggcatgtgcccatagtcctagctactcgggaggctaaggcagcaggattctttgttataaggagtttgaggctgcagtcaaacttctggtcgaaatcctggtcatgccactgcatttcagcctgggcaacagagtaaaaccccatctttaaaaaaaaaattaagaaataaaaataatatgtgaaacattagaatatgttgaatctagtaaggataagcaattatttcttgaaactctacatatatacatgagtgttggtaaatacctgactgtatcatcagctctagatataaaatgtttatgatgttggctgtgagttaatgaggaatagttttcctttctgtgggtttgggtgtatttgggaaacattagctaagggggtaaagtaggttacccaactctgaaaagcagcatcaaaatctttataataaacacatactaggggcccaacttaaatttcaagcagatgtcatgagctgctcagagtagcatgttacaactctgcgttataaggtaaaatgacacattgcctcacaatagcctgccagatctgagaacacagcaaaatttttattttgtcaaaaatctcatattcagcttacaccattcatttcaggtgaacatacaacagtgcatttcagtttagggaaatgtttacagtcatctggttctctttattcctgggaacaaggttacctcacttggaacacataaccagtgccaagttgtccatccctaagcaatattgcttccttctactttctagaagttcttcagattgtggaagagaaacttttcagagttctttgccctcattccctcctccagaaattcatgcctttgtataatctcttccccctgagagccagtaggctaacctaatgagttatttttaaccagtagaatacagcaaaaatgatagattacaagagattgtggcttctatcttgctagcggactctctctgtcttctctgcttgcacactttgttgaagcaagctaccatcccagaggcaaggaacacaggccatcagtttagcagccttgaggaactaaattcttccaactaccacataagtttggaagtagattcttctccagtccagccttcagatgagaccccagccatgccaacatcttgattgcagccctgtgagagaccttgaaatagaaccatttctgatctcctgacccacagaaactgtgaaataaatatgtgttaaggtactaagtttgtagtaatttgttacacagcagattgtaaataacacgtagataaaaccagacagaacagaaaaataaaatggctttaaacctagaaagtttccccatgtaaaattttgaaaatgctactctgcctaaggtcaaaccgtcatacatatatacgtatgaaaacacagaaaggtgtctggaagggtaataccaaattaaatctttatccaagaggaatgaaaaccagtattcacacaaaaacctatgcacaaaccttgtgaatatattaaaaaccagtgacttatgcactttaaaaaggtgaattatgtggtatatgaattatatctccaaaacatttaattaaaaacctgtacacaattattcatagaaactttctttaaaattgctaaaaacgaggaagatctcagttatccttcaactggcaaatgaataaacaaactggtacagccatgcaattgaatactgctcagcaataaaaaagaatgcactgccagtacagcaacatggataattctcaaatgcattatgccagttgacagaggtcagactcaaaatactatgtacagtgtgattctacttatatgacactgaaaaaagcagtactataaggacagaaaacaggttagtggttgccaaggagtgggagaagcagccagggagaactttgaggaggtaaaaatgtgccaggccttggtcggtggtggtacataactgtgcatttgtcaagactcagtgctatacgctgaaaagggcaggttttactataagttgtacctcaataaacatgatttttaaatgattaaaactttggtttttgtttgttttggttcagttttaaggtttaccataaatctattggttttagattctaagttgtatataagcttctgttttaaaagaacttttttaaaaatcctcttatcatcaacaatatttagttgtgctggaaattttattttggaattgtttaatagagaaagacaataaataatgttcaagaacagacattgattcataacatcaaagtatattgtgagaagatggtatttcagaatagaggaagaatttcttatgtgctggtaagattgtagataatcatttctgcataattttcatagctggattgctttaataaagccacttaaaggttaagttctagattgcttcatgttgcttatcaatgttttaaagctaaaatagaaaattagctgttaagttggctcaaccggaaattcagtatatcctttaaaaagagaaatttagtaagcagtgtgtctaaagaatgacatatggttgggtacagtggctcgtgactgtaatcccaacactgtgaggctgaagtgggaggatcacttaagcccaggaatttgagaccagcctggaaaacagcccagcccagcccatgcctggctaatttttttttttttttttggattttagtagagacaaggtttcaccatgttgcccagctggtcttgaactcctgagtgcaggcaatccacccacctcaccctcccaaagtgctaggattacaggtatttggttttttgtttggttttcaagcaacctttctcaattttgctatgctcactctttcttcacatgttggtactggctagatacagattttgctttcctattggagactcttttgagagctggctattccctcttgctccttttcttttttctcttccctactttcaagtttcttgctctttttcttaccccataagttaccagaaattcatacccccttgagagggctttttctttgaacttcagtctttagtttcatcaacttttctaaggaaattgatctgttaatgaaagttggcttgcttgacttcagaatatctgtattattcaatgatgtgtttttctggttgctttgtttgagcatagtgtaaatatcacccattgcatagctatggcagtgacataaatctagcagcgtaagatcgagaaaagctagaagtcccaccacagattgtatttcagtgaaagggattcattttaactgcttataaaactaaagaaaacttataaacatggaaaacaattattaaacccaccatatgctcatactgatattaaatggtgtgccagattctagaaagagttaccttttggtaagagcactgcttgttaactatggttggttgctttagatgtctagtgtgtacacaaaagcatgaattttattccttataaccaaagtagaaacctactctgagcaatttgacaaaaggtttacattatttattttagtgtagtttaagattacagtaagatgcaattcccaaagagtgaaatataaggctgggcatggtggatcacgcctgtaatcctaacactttgggaggctgaggcaggtgcatcacctgagatcaggagttcgagaccagcctggccaacatgacgaaaccccatctctactaaaaatacaacaattagccagatgtggtggtgcccacctgtaatcccagctactagggaggctgaggcaggagaatcccttgaacctgggggggtggaggctggagtgagctgagatcatgccattgcactccagcctgggcacactctcaaaaaaaaaaaaagtgcaatataacttttcacaaaatatggaactgtggtagtctagaacaatgtctcaatatacctcctacacgaagtataatagtaaatatctgtatttggtggcataatatgctcttagtataaaccaaaaacacatgctgagcattggacattgtccaatgtttaattcatatgattcattctgagtttctgactgagatcattctttcagactgtgtatttctcctgggatccataaaatatgcagccctaacatgatttcatttttgtttcctttcctggaaaaggagaaatcattcagatcagctttcatattgccttatagacgatgacttcaaaatagttttaaagggactcctttgttctagaactgctctaacacagtagccactagccacatgtggctattgaaagattgaaatgtggttattccaaatcaggatgtacagtaaatataaaatacacaccagatttcaaaggcttacatgaaaaaagtaatgtgaaatatctcactagtagtttttatagtgattacatgttgaaattttaacattgtgaacatattagtttaaataaaatgtattgtgaaaattaatttcatgtttctatttacttttgataaaagtactactagaggctgggtgtggtggctcactcctgtaatcccagcactttgggaggctgaggtgggaggatcacgaggtcaggagaccgagaccatcctggctaacacggtgaaaccccgtctctactaaaaacacaaaaaattagccaggcgtgttggcaggcgcctgtagtcccagctactagggaggctgaggcaggagaatggcgcgaacccgggaggcggagcttgcagtgagctgagatcgtgccactgcactccagcctgggcttcagagcgagactccgtctcagaaaaaaaaacactactagcacatttttaaattacttgtagtgatctcatttgtaacacattacatttcaatcgtatactgcttttctaaagagtcactgctaagccctgaaattaactccaaatacctccctgggatacagtgccaaggaaggggcttccttgaacttcaacctctaaaagtaagcaagaattgagaaatatcttctgctttgaaaaatattcactccccaacgctaatacatcaattacatattatttgggggctaactaagctcctattttaaaatgtaaactgaagaaatcaggccagagtcattcccatcttagtgccaatcatataatcagataattagattgctctttccctaaagcctgtttagtttttttgtttgctggttttgttgttgttgggttttttaatttgtttttgttgttgttgttgttgttgttgttttgagatggatactcactgtgtcacccaggctagagtgcagcggcatgatctctgctcagtgcaacctccaactcctgggttcaagcgattctcctgcctcagcctcctgagtagctgggactgtaggtgcatgccaccacgcccgtctaatttttttgttttttggtttttttgtttgttttgagacagtctcgctgtttcccaggctggagtgcagtggcacgatctcggctcactgcaacctccacttccgaggttcaagcgattctcctgcctcagcctcccaagtagctgggactacaggtgcatggcattatgcctggctaattttttgtatttttagcagagatggggtttcgccatgttggcaaaactggtctcaaacttctggcctcaggtgatccagccgtctcagatcaaagtgctgggattacaggcatgagccaccactcacagctcgctaaggccttttgccaagacaaattagctcttagagaaccacaggattccttttgtaatgtattacaaactaaagtcttacctactcttgaagagtagaaaacatggaaaagttctatgttagcccttagaataattaaaaattcataagctctgaaataaagacaggtaataaaatcattgcgtatgacaaaacaaaagtttaaattggcgtttgtaaactctgcatgaaagccaggtttctcactactagaaaaaaagttataaataaaccaaggagaattccagaatgaatcctgtggtgccaaatatatgttaactacaaggaataacagtgaccttacactggaaacaccttaaccatgggccaaggttaaagatataacagcattctcacaccccttgcatagctacccccaatgttaacataactgttaacaaattatcaaaactaagaaattcgtcttggtatagtatcactaactaaactccagacctcagtcaggttttcccagtctttccttcagtgtccttcctctgtttcaggattcaatccatgatccttgacacttggtactttgtcagatgtcccgctgtatgggtttgtttgatgttttcccatgattagggatagacactgcaagactcagagctactttacaaagaagcctctagggagctccccagagaagacaggggagacaacacaaggacactagaggaaattttagcctctgacatccatgactatatagcaaagagtaaacaaagcctaactcctagccagagaaacacaaaatctcatactaaagccttatttaactcagttcgtttcacccagtacatcatatacagcctcaaacaaaaaattacaaagcatactaaaagacaagaaaccccacagtttgaagagacagagcaagcatcagaaccagactcagatatgaaagaaatatcggaagtatccaaccaggaatttaaaataactaagattaacatgctaggggctctaatgtaaaaatggcataacatgcaagaacagatgggtaatgtaagcaaagagataaaaacactaagaagaaataaagatgaaatactagaaataaaaaacaccataacagaaatgaagaatgcctttgatgggttcatcaaaagaatggatatggccaatgaaagaatcagtgagctcaaagagatgtcaatagatacttcaaaagctgacacacaatgagagaaaagaatgaaaaagaaaaaacagaacaagagtcaagaactgtgagacaattacaaaaggtggaacatggagactttttggaaataccagaaagagaagaaaaagagaaagaaagccaggcatggtggcttacgcctataatgccagcaatttgggaggccgaggcgggcagatcgcaaggtcaggagatcgagaccatcctggctaacacggtgaaaccctgtctctactaaaaatacaaaaaattagcggggcgtggtggcaggcgcctgtagtcccagctactcgggagactgaggcaggagaatggcatgaacctgggaggaggagcttgcagtgagctgagatcgtgccactgcactccagcctgggcaacagagcaagactctgtctcaaaaaaaaaaaaaaaaaagagaaagaaacagaagaaacatttgaagcaacagtgactgaaaattcccccaaattcatgatagataaagctatggtctgaatgtttgtgtctcctcaaaagttatattgaaacttaatcctcaatgtgatagtactgaggtggggcttttgggagtcaatcaggttacgagggctctaccctcaggacagagattagtgcacttatgaaagaagccccagggaattagctagcccctgacaccatgtgaggacaaagccagaatgtgtcatctatgaggaagcagggcctcaccagacactgctagtgccttggtcttggacatcacagcccctagaacggtgagaaataaatttctgttgtttataaactctccagtttatgatatttttgtcacagcagcccaaatgaactaaggtagacataaaggaacagatccaggaagctcaaaatacatcatttcaataatgatctttaaaactttgtttgaaattatactgatcattccgctgactgctgaatgacctggcaccgtctcagggttttagtctggagtttttgtttatgctcatggcctcacggagaacaatattcacctgaagtgacggcgcttctctttttatgttgttgagaagcatgattggctctttttttgcaaaattattcacaaacttaaactttgattcagaattattgaagtaacatggtgaggcagagtaatatgtgacttaaattttatggagtactaaggaaaacgggcagacttaatataaaagtggtgcattggtggtgcttaagggcaaataccgataacatggtgtacaaataaaggatcccgatgattcaaacaggtggaagtgatgggagaactgagttgtcacacagtaccatatccacactgtcacacaaatctcacctttatttattcccttttgcactaacgtagccagaaatgtgaaacgatgacagttttttcagtaggtattttttttttttagtttttatcattgacctttgaggtgcactattaaattgctcagtccattaaaataacggattgctgatttaaaaactggttccttgcttagcttcagcaaaacagcaaagtctaccacattaaatgtatattgtttatttgatttttattgactttgttgtcttattttaactacttaattgcaaatctgtcttggggttaacactgtgtaagagttttaagcataagaagtctgtacttagagtttagatgtagttttatatttgtacatgttgatgtaacattttaataataataattcaggtctgctgggcatggtggctcatgcctgtaatcccagcactttgggaggctgaggcgggcggctcacctgaggtcgagagttcaagaccagcctgaccaacatggagaaaccctgtctctactaaaaatgtaaaattagccaggcatggtggcacatgcatgtaattccagctacttgggaggctgaggtaggagaatcgcttgaacccggaggcggaggttgtggtgagctgagatcgcaccattgcactctagcctgggcaatgagagcaaaattctgtctcagaaaaaaaaaaaaaatcaggttaattctgggatctgagcaaagttttgctcctttccgagaggtgaacacgttacgcaattattaataatatccctgtgggaaggggctttacaacaaattattttacaggtgaagggcagaaatgaaaacattttctagagccactcctgcccttcacactcaggaatgtcgcagtagtcatctctctgttctggatcagtagtatagcaccagggcccctgcgcatcgttgtctggattcctccagtccctctgaggggtgtgtagcaggtgagaatctggggaggatggaagagaagcacttagactatattctaaaaatcagcttgctattagcaaggcagaaggagatgctctcgattcccatctgagattgtcatccaaatgcatttcagctgggtgctgcagcatttgtgtggtcagattttcaatttctctattgataggctgcttctggcacagtagctaatattaccattgctactgtgacagccaagtcttagacagagagccaaaatatttttattgcacagtcaggagaaatataaaggcctcaaaagcctgccatggtcttaattcattccaaacacctgcttttgtcagttgcccttttctctgtaaaaattttcgtagttaacaccattttgtccatgtgaactatgtgccaggaattccactaacatctttccacacattctctcttttagtcctaataaaaaaaaccatttgaggaaggtgttattatccctgttttacagatgagaagactgagtggcaacgtaaaacaaaacaaaacaaaacttgcctaagcataaatagctatgaagaagcagatcaagaagtcaaagttgatctgtctgattccaaagtcctggttttctctgaaatgcagcttgaattattggggatggaggagggatttaaacttattttcagttctagagatgagttgctgtatagagacaaccatttagatgacaatcacaagacttacagtctagaaaggcaggttttatttctggttcttctgtgaacctatttgggtaacccccaccccccaagacctcagttccctcatgaagatgagcctagactacctcataaaaatggcccagagtgtctccatggcccccgatagtctctgacttcgccatttggttgaatcagttttcattaactcacggggaatatttgatctgctcatctcatagggatatagcaaaggcaatttgttgagtgttgggggaatggataaaggtgagtaacactaagttcctatttgataagtgtcattactgagaacttaaggccacctaacaccaaactgggaaaagcacaaaaaaatgcactaaaataaataataggcaagttgtgacatttgaatttcacgtatcttcattttcatttttatattttatttactattttgctccacaatttgagtcaaacatgtgatgagagttctaacttgatatgtttacttcagtcccaaacatagtcatctttggtcttttctcagatttggcctaaaactcgtagtttcattgatttttttttttaactaggcattcttctatgttctaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaagatgagagaaaataacaatatgacaataaaacataatacaaataaaaacaatacagtataacaacgattacatagcatttacattatattagggattgcacaagagaaggtatgtaggttatatgcaaatactgcaccattttacataagggacttgagaagcatggattttggtagccacaggggtcctggaaccaatccctcacagacacagacggacactttacagtagatgaacacaaagatgaaaggaaaagtctgacctaggtttgcggggagaagtggaactccatttttgacaggtgatgccattttttgttttggacatcgtccctctgtagttctttccattcccagtcttgcactctgaaagatacactgaaggaaagtccacacagtggtcaaagtctttcacaagacaccacgtgaaggtctgcacagcacagtcacattgagaaaaagatctcatgcaccagaccccctgtttctgctttctaaaagatcatcttttgcacctgcaaaaaggctgcagtaaactgggccattccatactttgattcatgtattcaaatgctacttatgagctctctgtgtattgagccccaccaggatgctggggacacacggggcacagtgcagccagaggcttggccatcatagagctcacattctagtggaatcagacaggggggttacaggaaatattcaagtaaacaatataaaatgagatcacttgatgatacatggatacatgttacatacatgatgagacagagtaagagaatggggaaagggtttttagatgggggaatggcaggcttttccgaggctgaaagagatccaacccacttctatttcttcaggctcccagtgatatgaaaaagtgccaaacaggactataaaattgtggtctactgtaaatggtttgcagtaaaagttctcaaccagcttccactcaaccaactcaccagttagacaatgggccctctcctgtgtttaaaacagtccggtgcccacctgggtccacatgcagctggcaggtgtttgctagtgtgcccacccatgtctgttccccccacgtgagttatgtgcttacaacgagtcgtttctttgcattttccaactttcttacatttatatttaattaaagatgatctaaactgagaaatgaatgtgaaaagaaacaaagctcttttttgtttggtttttaactaaattaaatgtttttaacaagttgaaacgtgaatcatttaaaaaattgctatcagatccacagagggcaatccactcatatagttgactataaagcttgaggaggaattcataaaaatctaaaggttttacacatgcagattgattaataaatgtcgagatatggtccacttcaaaaataaggaaagtaattattgtagatgttgcactagagcatagtttatgcaggaaatgcaccagagaccttctactggtgaccccatattcgaagaaaaaaagcctctgctctacatcaagaggtgtcaagtacacttgtgttttcaatgaaaatataaaatgtttaaggtatatttgcaccatcatttaaggttacccactttagccatttttaaattcactgatcaatcacatggggagtactcctaacgtacctacagcaaactaatgcttttaacccaatactacgtattatgattgccagtacatcttcattgggacatagtattacagtagacataagacactcatcaaagtgtaaactcaaggtactttgtgaaagggaggtctaggggtcaaggaagatttgcaaaggaggtgatgattgagctgacacctaggcgataagaaggagctggcacagcaggacaaaggtgaagagggtcccaggcaggagggcgtgtgcttggggtggtgaaggaacagaagtaaggccagaaactttgtagaaaagtttagcaagccaagcaaacagcagccgggggttacgtaaataatgccgggccctggcacatttgggaagtctttgggtcttattttaagggcactaggaagggctttaaacagggaagttatatttcttcgagatcaggtgtacagctacaagtagccccaaccagtggtgatagggtcttggactcggtgaaggcagtgtggctggtggcaagtggcagaagtaaacgtgatctaacactgactgttcctggcaaaaccctggcaggtaagttagcagcaggtcaatatcccacagcaactgtatgtacccaccggagtttatataaccttttgctcccttctgtcactttgaaaacaagcaaactaagccttcaaacttcacacttcaaactcaacctacagtcattcccatgttccttctggttaacaatttacaaatgacatatttaaatgttagcattttgtagagagaatcaggagaatcagggttttttgtttttgtttttaaatctggtacaattaggtcatcctatttagtttaccgtttgcttgctacttgtaagaactaataactttaccagataaagtttagatttcatctgtactttaatctcaagaattcgagataaatagtggtaaggaagaaagtacaatgcgtacagctaatgaaacccaggaagatgagtcaatgcatagaaataattccaacccaaataaatactatttaaaatgctacttggagttttgccgtgatactagacacaatatggcaaatcatcctcaagaatacaagaactaaggtgtttccagtcctctttaacacctgtgatgcaggatatttggagagctaaattgttattattaacagtcttaatacctggccaccaacacagtagaggaaacagtttttaaagtgtcatacatctcttcaaatattcatacgcttaatgaaacattcgcacatctaaaaaggcatgcaatttctattgaaatcctgtgtgcctcttattctaagcagtgggactattgacccacattttaaaataaactatagaaaaggaactgtaacttttacacatttttaaaagacaacatatcagaaatctgagaaaaatatagaccatgtcccccaaaatgtgaaaaatttaagagtaaaaaataagatttgtgtcccaatctaaatgtttctgaggattaaaacacctcagtatttctgttttacaaggcttcgtccagatgttagggcccaaggaccatggtcaccctgcagaataagaagccaagaccaaaaggaatgcttagacttcccatctccttgttaaatataaaataatattttaaaaatcttattttcagggtcatagaggtagaagtgattttgtaaatctaatcctttcattttttgaacaaaaaaaaattaaatctaggaggtgaagtaatatactcaagctgacatggttagttagtaatcaaatcctgtcctaactcagaattcaattttacaacaccatagcaccttcctcctctggtctcataaattaaagatagaatagagaaagaggaagagtgggaggatggggaggacagtaggaggaggaggaagaaaatgtactcactttacttttcaaataaaactgcatctctcatcctaatgattatggaggacttcctgttttcagccattatcacacattgttgctctttactgtgatattggaatgccctgcagaacgaagcaggaaatccaataagtatttttctttatttaaagaaaacaaatgtttattaataaatgagaaatgctaaagatcattgactatcttgagggaccagagagctcagaattgctgcctctttcagttatttgggcatggcattgatgaagtactgaacaaaatacaccaacgtggcagtaaatcttatctgcccttaccttccctccctcataattttctctttctttctgtttcaactgttttacttcttcttcactcatcttcttaatttttgtttttgggtcagaaagaagcaactctggttgctttgaacccattccccaagatagtccatctccatgacctcccaactctgatcagttcccctgaacctctgtcccacattccaccccaccctggcccctgacccctcccatctccatcccgtggtcctgctatgggtgctcagtctggcatccatagctactttcccaggctcatcacctacacaaagtctctgctttagtcaacttgatctcttaatggtccccctcagaaagtgcagggccgcatcttcccctgccttcctggtgcttttcaagagctctctcaactccaaacccagctcggttcccacctcctccctgagccttctctagctgcctcaaccttaggcactgttctttcttctggatctgggtagaacatgcattgattatgcctgtagctcacttaggctgtcttttttttttttaacattatatccagtcaccttaaatactgaagggcaggcactggatcttgtagctataagtcattgctcagatctatctaggacactttcattcatatgatcctcaacaaacatttactgatgatgatgttaaaaactggagctcagaacaataactgctaatgtttatgtccggtgtaaaaacaaataacttccttttagggtatttttctaatgaagactccagtaaaccttaacaagaagctgttagtatggcttcacatgctatgagcaaatatagttccaaactctggctccataaatttctctttcctcttaaatcgttaataaatttgtgagtaaattacttgccatctgaattacagatttctgggtaggtgcaacgacgatgaaaatacctgcaggtgaattctttgtcctcttcacattttgctgcacattcttctctgcttcctgcccccagctgcttcttagtgacactgaacagtgaaggcccctgggtattcacatagtcatccaggggctctccttgacctagaggtgggagatccaagtggaataaatggtcagtaaatcaatgccaatgtctaattgtcatgacttccttttaatctatttggttagcattaaccaaataaaacttgctgtttactggaagtagaatgggtagctatgaatcaaaatgtttagttaagaacacacagttgggcatgtggacataaataaagatggcaactaaagacactggggactaccagagaagggagagagggagcgaggcaagggctgaaaaactacctatttagtaggtatttagctcactacctgggtgatgggaatcatttgtaccccaaagctcagtgtcacgcaatttagtgatgtaacaaacctgcacatgtacccctgactctaaaagttgaaattataaaacaaagaaaaacagtttcattaacagattgcaagatagtaaaagattaactggattgataaacaggttagaactatggaaccactactatgttaccatattagtggatataaatccttaaacaagaacaaattttatgtttgctatcaattgtgccatgtcatgagagaagagtaaggcaccatcagtggcagttgtgttaccaagattgatgttgatttgttcatccctgggtagaaatggaacttggaggccattgtttgatttcctacaatatgcgctttggttctgacactgtcacttgaactggtgggaagcatcctctgaatggtccctccttgaggcacataaattttggtgcatagatgatggtggaaataaacaagaactgaactaaattatgttgccaccttggacaaaaattgggcaaaacactggagggtaagaagctccccaacaaagaaggccatttttgtactgggctgatgacagtcacacaacactactaactggggagaaatcagtttttccaaggtgttgacaggtatctggatttcggaggaaattgtaaaaaagcagaacctgggacaaatactggtcttggtttttctttgagatcaaatctgagacaacgaatctgtccgaaagctgctttctgcctggtcgtggcagagggtggccaagggggcctcagctgtgctcccaccacaaggctacagggtgttcccttgtcctgaggctcttccggacatctggctgagctttggtaggtctattccaagcctggagatgccagctccatccttcgcacagaatgctagtgattttcacaggggtaagaggccaaaagaggctaataaaatgaagatagccaagctccatggaattagacaacaggacaaccttgaccactttgaggggcgtggtgggggctgcaggcagagggagtgggttatagagtgacgaggagagcagtggaggcggcagcgggagacaagcctggctctgaagacagcgagccctccagggaagatgcggtcaggggaggttctgaaagatgacacactgcagagcacactggtttgtatgctgatgacaaatatccagtaggaaggcaaatgaacagattctcattctcagaaaggcccgtcctgacctcctgagggtacacagagcacagggaggaggatgcacgctcatcaattcatgcaaagtcctcggccaaagtccccctgctccccacctctgggacttcgtccttcctcaatttaagacattccgggctggaaaaatggattattgagcaggagttggctgatgcattctaaacctaatccactaaaaagcacttgagagatgtatcaaaagatcacaaagaaatagatgctttaggcccatatccatgtctttaccccgcactttctgccaacttgaactctcatttccaagaagagttgtgttttggttaattctatagctcgcagtgtgacttcaaaacacacaataaatccacaaagtgtgtcctacggtgagttcagttaaactttctgaagagtttttttgaagtatagcagagcaggctacaattgatattcaaaaaaagaaaacttccatttatttcccccttcaattaagttctctgtgtcatgttattatacttcatagcacatcgctgctgagatcccctccccagctcctgtccctaggaaatatcccaaaacagaatcaaactgttttctttttaatttgaaataattttcccccattttttttttctcttattcacctctaggactcatatggcaataggatttgatagggcttatttgctggcaaggaaacatcaaatcttttagtggaaaaatacatttatattataggcaaaatgcagatgtatattgctactgatgcaaatgtattttattaatggtgtgagaatttcttcctcactgtggtgtgtgaatgtgtatgcatatttgcatgtgtaaaagacttaatttgtgaaatggaagatgtttctccacttcccactaagcatggctgtaaaagaaactttttcctctccccgggcattgcagcacactggaaagatgatacatccacagaaagcctggctttccaaaagagcttatgagagaatgttccccccaggttggttaaaacattggtaatcctgtggcggagaagtttgttctagcctttgggtgtagcccactgaataagttcacagtgatctatgtcatagtttccatgcattgaaatataatattcacacccccaacatacaccaatttcttacaaaaatttctttaattttctcctgctctgtattttgtttgatagctccttgaatggcttccactaaattcaaatgtatttgactctaaagtgcaacttgtaaaattttatctggtaatttatagattgaatttcaagtatacattatttacaggaagaactactagcaaatcgtatgattccgttcgtatgaaatgttcaaaatggcaaagatataaatacagaaagtagattagtggttgccagaagctgcagatcgggggtaacagctaaggagagtggagtgcgtttttgggggtatgaatagttttaaaatttattctgatggtggctgcacaactctcaatatattgaaatccattggattgtatgcctaaatgggtgaattctatacattaattatatctcaataaagcttttttttaaaaaaagaaaaagaaaaagaactactaggacatgtttagaatattatttcaaaggcttaaacaaagctgaaaagtgagaagagccctagattccttctgggaaacctggcttaaatccagttttctttatttcccagatttgagaatttggtcactgagcaaataacatgattttcctaagtctagatttctttgtttataaaatgagggtgaatatgctaccctacctataccgcgagctaaataagctagtatttgtaaaggacacacactcacactcacattcacacacaggtatgtatgtatgtgtaaaaatgtagcgacctaacccaagcactaagtgagtatttgttgaatcactgtctgcacacagcatctggcaaatggatgcgtgtgatttttccggggattagaggcaaacgtatactgatggaaagccttcctcaggccataacaaagggagaaatgctgaatccctgacgctgccaccaccatgaactggtgagagaacagaatatattcaaagagaaatttcattgttttaacttgcaagtgaggggagcatgacaccgtaagagagattatataaattagtcaaactgagaaccaggcgaagagcttagccgtcctttgcatagttagctacattggctctttttcaattagactggccattatgtgggtgcactcatttagatttgaaaaaccacccattattttctctgcgcattcattccagcacgctgacaatcttcacaggaaaactaaacttatttcttgaagaattcctcaatcttatacaagattttcaactgggagtttcatgaatcaaaaattaaatgaattgcacataaagccatggcatatgtatttgtactgcattgtgggagaaaaaataattattataatttaaaaaaactatgtcttacctgatttcagaaataaaagaagtagaagaaccacttccttatgttccattttgggactggccagcagtgcccagaaagtgtgtcccaatcccaggatgttgttgacttacatgagagtaaacgcatccacagaccagatagtcaaattaagttaatgattctctcagacacccacgccactggctcagcagggttcaaacacgaccttgaataaagggtccttacaaaatgattgagggtggaatctgcaatagatgctgggaagtggtgaaagcaatctcccccctcagctgctccatgctgccttcatgtctccttactccttccctcacctttgtactttatctctcacaattagtcttatttcctcccctcttcttttattccctttcttttggagaaaatgaaatcagaaaagtatctcacatttgctggaaccttccatgacgagaccctctgccaagcgctgcacgtccatagcctccctcaagcttcccaacaggcagtgctgttctcattcctgctgtacgagggatggggctgaggccttccccaaggttgtgtcgctacccaggggtgcagctgatagacaaaaccctttcaggtcctggatgacaaacttaagttaggtgtaaatgttaatatctccacatcctacaccaaatgacatagaaattacgacataagtgaaagtatcttattatcttcaaaatttctttattcccagtgaactcacatgttttctgtaattataaattataagacatcaatctttcccccaaatgaacgtatggcatattattatattctcattctcatgaaataaagcaagactggtagcactaagtggaaagcgtctatctcaattttaaatgttgaatctgtacttttccctggcttaagtctagagcaaccaggtagtatatatgttgtaaaacttctattttagtgttcaaagatatttagcaataaatcaattgacctctctattttagatgtgaaataaggaccagaaagcattgttcctctttccaggcagtgaaattcctgcctattcattaactggcaaaagagtagaggtgggagcccaatggtcttgggtggaacgtcctgtggaattccctgggattgaggaatcatgcagaaccctcaagaagaaaccacactgggcaacaagagggtggccccatgtgaggaacagggggaccgaatcgcatttcctgatttcctattctagcctcactctcttctctcctcaaattcttaccactccctttatcctctctgactcacctcgtggcccagttcattaaaggggacagaaggtggaggcaaattgagaaaccagcagtgggcagacgttttatttttaatgtgaaatgtctcttagggggcttatgttgatgtgcttgagaaagtactttgggggaaaaaaaaactaactctactaatatataatgcttccagcatgtatttatttccacttaaaatattattgtagcagttcctcttggataaggcatcttgggaatgatgttatcagaaattctacatccacataattttcttttcctgtttttttggttttgacttgggtagtgttggtatagcttttgcccacctttcccctggtaggtgttagatgcattaaattctacaaatgcgattttataaattagttgccctcctaatggcctcctggctgtacattcttccctaccttcataatccatcagcatcgtgaaagcacagagggacattgagcagagttctgtgctggcgccaccgcactctgtagcctgtaagagagcagcaaagaggaatgagttgctcaggtatagacaggggtggatgcatagagacttccactgtggcacggcccttcatgtccagggtaggcatgaagcaatggactattccagattgtgcataggaaaccacactgcactcttagacggatttttgctctaaagacaactaattcaaaataaggtgctttctacctgaaataatggcatgaactgagaaaagagatatagagagagatctctgtgtactacgatcaggttgcacatattctgagatttatgtattcttatttagttcaattccttatttactgaccacttactgtgtacaatattgtattagattcttttaggattacagttgacccttgaacaacttgggggcttggcacactgaccgtacacagtagaaaatccaggtataattctgattcccccaaacttaactactgatagcctgctgttgaccagcaacagttaataacatgtattttgtatgctatatgtattatatactgtattcttacaataaagtaagctagagaaaaggaaacgtttctaaggagaaaatacatctatggtactgttatgtatttatccatacagtaagtttacaccgcctgtttacaagatgaatcatctgtctgaaatggaagcaaccccagctacagacctcagtctctgttacatatcaagcaaatcaagtttttcttgtaatgtcaaatgtcatgacttttctctgcttcttgggagcacttccagcatcactagtgccacttcatgtggatcccatggtgttattcaaggtttacagtacagcacgaaacaggacgaaaaatacatgtgaacagggagagggcactttttactgggatgcgcaattcactggggatgacctgctcatgatggaatgttgagtatcacagaacgttttaagtggatacttgcaacacctgagctcattgcaacagcaacaggaggaggctatgaacttattaccgtactgtggtatgcactacggttaaatttatgcagttacaatttaatactgcatcttgatgtttgtatacacttctctcaactgagaatagcaccatatacgatctgtgagtgtgtacataagttttactaaattttaacttttgcaatagttttgttatattttatggtagtaaataataaaatagactaggtatctacatacattttatgcattcatgacatacttaactttttctatttttgttgatatttctagctgcatggtttgtctttgagttttttcaaattgttgcaaaactccaaaacattttctaacacatttattgaaaaaaatctgtgtgtaacagttcagacgtgtgttgttcaatgatcaactatatgtctaaagagtacaaatcagtctgtaaccttccccagcctctccatgctaaaggaactacaggaaactttcgcactcaagatgtgtggagattctgctgctgcacttgtagcaggcataagaacgttcaaataggccgggcgcggtggctaatgcccgtaatcccagcattttgggaggccaagacgggtggatcacgaggtcaggagttcgagaccagcctggccagcatggtgaaaccccatctctactaaaaatacaaaaaattagccgggcatggtggcatgctcctgtagtcccagatactggggaggctgaggcaggagaattgcttgaacccagcaggcagaggttgcagtgagccgagatcgtgccattgcactccagcctgggtgagagagcaagactctgtctcaaaaaaaaaaaaaaaaaaaaagaacattcaaataagattggagacaaattgaatttccttagctctgcccagcataaggcctgcaatcaagatccactcaggtcctcttatgaaggaatagacgtctcttccagcattaaaatggtaaattccttgcaagtatttacaaagaaagttataaacaccaggaaacatcaacctcaccaggaggtgaggtagagttcacccttccatctcacctgaagtggaaaatgcagccaagtcacaacttcctaggtgatgcacgtccatgcaagctggactgcattgctggcctgacatttgcacctggcagctcctcgccaccccctctttccaccttccttgagcccaggctctgctgcccgggaactgccattctaggacagctcatttcatcaagatgaacttctctgaatagccctaagaggacagtatcatttccaactggaaatagcaagaacttaattaatctactaaggattcatataaagcatccctctgtcgtggtaagggtcctcggcaagtttatctgtgccctcgatgccaatgtgcaggttgtttttactgctgttttagtgtattagagcatatcagcgaggagacttctactaattaacctggaggtggctcttctttctttagttgctcttttccacatgttagcctttgttcatcagtccccaggaccatgcaatgaggtgcttatcagccctcatgtcccgtaaagagatagcaggctatctctcaagttagcacagtggttaaaacgtaatccactagggggcattttcctttcctttctttctttctttctttttttttttttggaaacagaggctggctctgtcacccaggctggagtgcggtggtacaaacacagctcactgtagccttaacctcctggattcaagcgattctcccacctcagactccagagtagctgggaccacaggtgcacgccaccatgcacagctatttttttttttttttttgtattttctgtagggacagggttttgccatgttacccaggctggtcttgaactcctgggctcatgagatcctcctatctcagtctccagaagtgctgggattacaaatatgaggcactttgcctggcactaggagacactttctcagtgagacctaactcatttggggctcagtgaggtgatattttcttaattgagttgtgcttgaaaaaatctagatatctattcatctttgaaaaaattaattttcattggctgtctcctcatcattaataagcatggctgtgttacatgcttaagacaaatattagcagagaagaagaaagtcagacccggataacttagcagcctgcactgaggtggcaccaggactccccagaggagagacgagggtccttctgctctgaggtccagactcaccatggataaaacagagttgcaccaaatcatccttcccatctctcacattgattgttctctaagctcattcagagaaaaaaaaaatcttatctcacagtatgtcagggagataagtcatgtagaaaaaccttaaaatattttcaggaaagcaaatgagtgcacaaaaaacctggtgaaatctgagcaaggtctgcagactagtttctgatattgtgccaatggcaactttccagttgtaatcatgaactatagttatgtaagatactgcctgagggaggcggggccataggcacaaggatctctcagtactatatttgtaacttgttgtgtttatacttatttcaaaacaaaaattatatgtatatatttatatatgtatacatgttatgtttgcaacacatgtgcctatatttggatacatgtgtctattttaggaggacctaggatgatgtaactgctttcatactagttaagagaattcccaaatttcagggaaagtctaaagttatagagttcctaactcagggtgcagaactcggactttggctgattctcgtgagctcctgggatgagtgggtgggacagagaggcttctccaccaccacactccttccctggctggagaccagatggttaaggactgatgggtgccagagagcagcagccctccatgtgggtccagaacccagaggctggagtagttcatgcctgctcctgcctcccaggtattcaagggaaacccaccatctccacacaccagcaaaacaccagcaaaacagaggccccaagtaatgacttctcctttctcatcttatcttgccacctgaccagctcctgggctcctcaatccaaagttggggaagagagaagggaatgtcagtggaaaccacttttgctataaactctcatccttcagatgttctttcagtgggtacagtgtttagtgctgtgctaggtgctggggaatcaagagtaaataagaggccatctttgccctcagggagtttttggtctcatgggtttggggcaatgcaggtctgtaaactggaattgtaaaagtgaagtggcccaggtcccatttgttgtagtggtgcacagagagacagtcttgagaggtgaggagacatttcccagaggaagtaacatccaagttgagacttagaagacagctggaaggatgagaaaggagaataattctgtggagtcctaattaggcaaaaggaatcaggctggtgacactgaggaaaaaagaaagagaaagcagataagctgtaagtttgcctttcttcatggtccaggaccatagccctcctgcacaaatagctcacaatcttcctgtgcccagctaccatcaggccctcagctgatggaaaaatgcaggttatcccactgcaaccttggtgttatcagtactgcacaaagctctcttcagcacgcagcaaaagcaacatcctataaaacccccagcaagcctttgtctcttggcattcagttcctctcttgctggcctgcctgttgctgccttgcaacatattttcatactttcttcaataaatctgcctttatctacaactgtcttggtaaattcttcttactgcccatggtatactggcctcagatagttgcttcacctgctacacattctttaagcagaagaaatatatgtgcagggtcccagaggcaggaggagcagacagatgagaggaatttggctaacatggggaaatggtccaattgcgcaggcttctcactctgtttcaagaagtttagacttcagccaaagaaaggcagggactactgttactgaaggcttttaaaatccaagggtggcttgatccctctgattgcagcacagtgaggaggtcataggaggtgagagatgagagggggtgaaagaaggcagtggagaaagagaaaaaagaatggattagggggatgttgagaaagtagaattgacatgattttgtgactcattgaatgtggggaatgaaatcaagtatgctgcctgaatttctggcttggacatctggtggacagtggatcattcattaagaaggaatgcataggagggaataagatgaaattggctggggacaatgttatgtttaggaacttgagaaaacccaagtggaaatttccagaagggagttgaatattctggtttagaacaggagttggcaaactatagcccatgaagcaggcttatttttataaatcaagttttattggaacatggccacacccattcttttactattttctgtggctatatttgcaccaccttagcagagttgagcagatgtgacagagacagtacaatgaccagcaagccgataaaatatttgttatcatcgctttacagaaaaagtttgccaattcctggtgtagagcctaggaaagaggtctgagctggagatgtggaatcagcagttgtcagcagataggtgggactgaagcaatgggggtggacaagcttgctcagagagaaaaaaataagccctaggataaagccctcaacaacacaaggacccagaagaagagaattctgtagagatgactgagaacagttagccagaggggaaaattgacagtgtgagtccagagaagccagcaaaagtgaaaattgtaaaaaggtgggagtggtcatgggtaccaaagacttgtgagaaatcaagtgagatgtatcctgtgtatgccagaaggtaagagcaaatgaggccaacataaccttaataataccaatctcaatggcccagactccagcaaagtctactctagctaccgctaccactaaacatatgtaaaactcagtaaaatagcaattttaattaaacaaattcctgacctatctctgtaatactcctttcccaacatttttgcctgcatattctttgattgcctcttcaataatgttgtaatatcatagtctatgagagaagagaataataaactattttggctctagtattttattattgatagatttaaatttttcttctggcttcatagctcaggatcgataatggaagataagttttcaggattcttggcacacttaggaaaatctttatcaaactatttttatgtatgaactgtaagatttggaataattcccagatgggatgagctacactcttttctagctttgtacatttctatttttcttattcaacttttattttaagttcagggataaaagtgcagggttgttacataggtaaacatgtgtcatgggggtttgttgtgcagattatttcatcacccaggtattaagcctagtactcattagttatttttcctgatgctgtctctcttcccatcctccaaccctgatgggccccagtgtgtgttgttcccctcgatgtgtccatgtgttctcatcatttagctcccacttataagtgagaacatgcgatatttggttttctgttcttgtgttagtttgctgagaataatggcctccagctccatccatgttcctgcaaatgcacatgtcatgtgacacaatcgtgatgtaatctatggtcttgcatatttacattacaccaccaggtaaatcagcacgagggaggtgaagactattctgaatctgttttacacagggacagctagcaataaaatacacagaaatgactccataccacataaataaatcccatggaacccaaactcaatgactcaattcttcttttgctggatcctcaaaatgcccacatccactccaccaccacccaacatgagggcagaaagagatcagaattttagccaattacagctaaaatgtctgcttttgtcaaaagcaaatgaccaaatggatacattgccagggcccctccagagcctcagaaagggcctgctgaagttgccttttgctatgggatgaatcaaaccaaaacacagtggcttaaaataagatgaattattttatttctgaattctgaaggtctgctgggcttggccaggtgattctcattcttgtggtctcttatgaggtcagtggtggctagggctgaaaccatctcaaagccttcctcactcacatctcatgggtgatcccagctgttgctggaacctcatctgggactatcggccaaaacactcagaacttctccatgtgtctgggcttcctagaagacactgttcaagtagagggcaagacaatcaagaatctcaagctctatttcaaaacatttcttcccactccactactgctctatatatttttcacaatactttataccttctaacgtaatagttattatagaggtacacgtatgtcttactataacataaactccatgagggaagatatttttagttttgctcaatgaaatatccccagtgccaaggaagcactgccctacacattcatccaaatagtaaaataataaatatctatttttaaacactttgttaattctgcacacatttactttttctaaagggagaaatgtggaacactgaaaagctccttgaatcttagaatttgtttttaattaatagacttaatacatggcataacatgttgtactcaacttactcttcatgcaacgtgtaagcataaatgccaaagatcttactttcaagcatcagcattaatatagcaagttaggaaggtagacggtttggtaattacaaaagctcttgaagtaggcaaaaaccattgttttacatggtagccaagatcacactaatgataagtatttctggcttaaccagtcctcacagcaatatgctaaattaatgaaaacaaacatgggcattgtttgggtgttactgacatcaactacaaaacagaaatgaacagaaattgaaaactatattgtcaaatacaattaaaatagccaaatacatttctaggtaaaatctttataacttcaaatactgccagttttctttcaaaaacttacagtacttgaaagaacgaaaatcagcttaatccagcacaggggaaagaaacacatgagataactgaattttacaaccaaggtcagagaggatatcacactatcaccgtgggaggaagggtgagtgggtagaaatacctgttattggtttttaagtagatcatagccaaagctagagtagcacctggacaagtcacatccacatttatggtatctccttcctattgaaagaagagtttatgcatgtaaaagagttctaaatttttataaaattcctctgataagtatgcttaaaattaacatatttaccaatgtcaggatgaacactagtattttccaattaacttcccagcttccagacttttgatctattactttgctgtgtacttactttgatttgataacttggtgatttatgtttctccctatgcattcctgtttgaaagcgcctatgtcctccaaccatgtactgatagagctgctcaggcacattgagatcagacatacctatcaaattgctgccgtgctggaaaagacaataacagacgagtgaaaagaaattttatggaggaagatccataacacatacccataacaaatataaaaatgaactaacttcaaagcaggttatttcgggttttgttttttttatttccaacttaaagcaaacattaatcatgagttaataaatattaataattctcataaaagttttaatacatgaatgttcaactttaagtactgtcttaaaatacataagagctttagagttagttacatttaacaataaagaaaaatattagttatataattgaaacctgaactgtaaatatctgaatactttcattattgtacttaagaacttttccaacaataactatgataataatagtaatttattaaatgcatgctctgtgtcaggcactattctgtgtgtttaacatgaatgaacagccatatcaaatagctactattaaaaccctattttataaataaggaaagtgtggcaaagagggattaagcccaaggttatacagctattatagtaagttgcagggctatatataaaacacggccatctggttcaacaatccatgaagctgattaagcaatagacaataatgtagttaaatgacttgactcactagttaggaccagaattcaagttgcaattccctgtgtgattcctttcttttttttttgagacggagtctcgccttcttgcccaggctggagtgcagtggcacgatctcgactctctgcaagctccgcctcctgggttcacaccattctcctgcctcagcctcccgagtagctggaactacaagcgcccaccaccatgcctggctaattttttttgtatttttagtagagacggggtttcaccgtgttagacaggatggtctggatctcctgacctcgtgatccgcccatctcggcctcccaaagtgctgggattacaggcatgagccaccacacccagctgattattttccattataccaccagcctctttagctcacgtgccaatgtgaattcaaggccctaatagatggtcaaccacgaggtggattttcagaacacacatgagaaaaaattccttccactacaacttttttttttaagatggagtctcactcttgttgcccaggctggagtgcaatggtgtgatcttgattcatcacaacctctgcctcctgggttcaagcgattgtcctgcctcagcctcccgagtagctgggattacaggcatgcgccaccacacctggctaattctgtatttttagtagagatggggtttctccatgttggtcaggttggtctcgaacccctgatctcaggtgatccgatcaccttgccttataactttctttatatcatttagtttgaccataagaatgtattggtggtttttcaaggggaaccacatttcaagtgaaacaatcatttaatgaaacatttctggtaattctgtacacatctcttggatggagttaaagatgggtcaatctgatactgcattttgtcacaaggaagatgctactgggacaacattctgggatacacagtgaacatcactatggcaaaagggggttagggtttgtttcaagcagctactatagactcttaaggctcctgatcatatacattttcactattctctgttttcagtcatagtgggctgtcacttattcattctatgtcttgaacactttaaaaaaaaaactttattccctttagtttgttcatgaacactgtaagctggaggaaaagaaatcttaaagtctcactcttgaccacagtttctctcaatttgcaaatctggtaccttgaaaaatatccaaaaagacaagagagctgggcagaagattaagtcgtagtaagggacaatattcaggtttaggtgtcaacgttatttgtctcaacatgtagatgtcctaactgaagcatgggaaggcataggctatgcttacccccaagcagaccatgcccagggccaagccagcagctaaggagtatgactttctgtcagtgcagtattccatttcaggaccaggaggccgtcctgtaaaaacaaaagcaacacagttcaaactagcttctcaaaatctcatctcataaaaatcttagagttaactttctagcaagttgcactggagatacgaatgggatataactattcagaaagttatgacactataataaatgatgtccacaactgtaggtttacctaccaaaaaaaaagggcccaaaatagttctttttaaattgccaatttaagtctttataagcaatgatattcaaatactgtgaaactttgagtcttatcaaaaaaattaccaagtagtagaaaaaaattttaaaggaaaaaaggtaagagtattcaaaaaaaagttttattattttttttaaaacatctcggccaggtgtgctggctcatgcctgtaatcccagcactttgggaggctgaggcaggtggatcacttgaggtcaggagttggagaccagatggccaacatggtgaaaccctgtctctactaaaaatacaaaaattagccagggtggcaggtgcctgtaatcccagctactcgggaggctgaggcaggagaatcgcttgaacctgggaggcggaggttgcagtgagccaaaatcaggtcactgcactccagcctgggcgacagagtgagacaccatctcagcaacaacaacaacaaaatatcttacattttgttttcattactttcaaatccacacatcacatgtggtgaaacatgttcgaatgatgataatgaataaggaggtcacttacttacgttgttaagctgttaaatactatgtttagacatttatttcgagtgtatataataatgagccctactatggtagaatttctgtgtactgatcctagaagtctgactggatacaaaattcacacttttaaaagcaccctataactctaacactaccttgttgaaaacgacaaaatgtactatgtattaaaacccttccctctgaaaaaatgttcacattcctgaaattttatccctataggaaaaaaatgcaatttaaaaaaaaagaaaaaaggctgggcgtggtggcccttgcctgtaatcccagcactttgggaggccaaggcaggtggatcacttgaggtcaacgagttcgagaccagcctgtctgacatggagaaatcccatctctactaaaactacaaaaattagccaggcatgctgacagacacctgtaatcccagctacttggtaggctgaggcaggagaattgcttgaacctgggaggcagaggctgcagtgaaccgagatcgcgccactccgctccagcctgggtgacagagcgagactctgtctctaaataaataaataaataataaaaattaaagaaaaaatcacacacaaaggtaatcagtgtaatgtttatacataacaacaaaggattattagaaacaatctaaaaggttctaaaagttaaaaaaaggcattttacagaccatcaactcaatgaatattatacaaaatgtgttttaaaacccatttataacaatgatctataaaaacaatttttaggctgggcacggtggctcacgcctgcaatcccagcactttgggaggctgagacaggcggatcacaaggtcaggagatccagactatcctggctaacaccatgaaaccctgtctctactaaaaatacacaataattagccaggcgtagtggcgggcgcctgtagtcccagctactcggaaggctgaggcaggagaatggcgtgaacccgggaggcggagcttgcaatgagccaagattgcaccactatactccaggctgggcaacagagcaagactctctcaaaaaaaaaaaaaattttttttaatgtacattctgacagtaattatataaaaaggcatatacatatgaattaaagatgaaatcttctatatacagtgtgaaagaggtatgccgcagctgtgagactgtgcaatgacaccattagacatcatcatgatatagccaaagaagggtagactactttgcagatgaacatgctttaacaaccagtgttgaatattttcagaataagcgtttttcagatctctgacttatgctaccatgtattgtgatagccaaaacatttcaactttgggaataatttcatttatcattatagtagactaaattatgggtcccaatcttcactggttctctcctaggtttctatcaacaccacgagagaaacacaccctccagcctgggtcccagaatgaggcaggtgaggcagaacggcagcagaacagccggctacacatctacagcctaaagcagagctgcctgggccaatgctatgcctgtatgtatgtagcatcactgtggcaatagctatctgatacaatgatactaaagaataatacatctttaacaatatattcacaaatccatatagaaaagatcttgaataggacatataagtatgtaactaaattgttgagcatattaataatgccaatagcatttccatttggcagaaaaagatgacaacacattaagatttccaaaaagtttggacccaataaaaaacagagacaatgttcactaaagtgagtgtgtggaccttaccatttccaggttcatcaccaacatacccaccagcatgtaaaggaggaaagcaggagtccattacttgacttctattggaagtgctgttatccaacacagtaaacactgtgatgtgtttagtttagtgtctctcagggaccaaaacaatctactctgagttttaagtgcaggccactgctagacactgctggtaaagccggataaacagcatactcatagctgattaaaaccacaggtacctcattaaatgtgaccactggaattcagtaatgagctagcaaataaacatggaggttaataacctgcagttacattagccttggataacattacttagagttttgttgttttttttaattagtactagatcattctttgctcacaaaagctaccattgtctttccttaatttttataattttactatttaattgggttaatgtggagtggagagtacatgcctatgaagattcagcactattaatcccatacctatctcagccaacaggacttctgcagtatgtctgtgagctgtcccttgatatacaaggccaatgccaaccactgcagccacttggacattgtgaggaacatccagctctgtggacgttgggggtaagagagcaggaatgcgaatgctaagaagccgagtaatagacatatccatggtgcctagttttgcagcagaaacaccaagtagcagtccaatgcttgtcatttcatggccctaagatagaaacaaaacaaatacatagtttaaaataaaatactgcctgccactttcaagaagtacttttatgttgacaggcaaggtgagaggcactgagaatacagcagtaaactaaacaaacatggtccttgctctcatggacctaatgacttaataggaaaaaaagtgttaaattaaaaaacataaacaaatatattattaaaaagtagtacaataagaaagtacaaagtattatgaaagagtattttaaaatagcttaatttagattgggagggactagaggattattagggatgaaatctctaaagattatacaaagaaatttatattaggacctgaaggatgaaaacaaattagccaggaacagtggcaggaaagaggacactcaagtttagaaggtgaggaagactgtttcaggtgataaaacagcatgtaaataaatggctctgaggcgattcagaaatgaaccctcacattaacatcaactgaccacaagggtgccaagacaattcaacaggtaaagggcagtcttcaaaaaacagtgctgggacaagtggaaggacacattcaaaagaatgaggctggactcaacacaatataacaagtgttggcaaaaatatggagagattggaactctcatgtattgctgatggggttgtataatggtgcagtcattatggaaaacagtttacagttcctcaaaaagtttaacagagttaccatataacccagcaattccactcctaagtatgtaccactacttaccattacttcattactcttgagtaatgaaaacatacatccgcacaaaaacatgtatacaaatgttcatagcagtattattcgtaatagctaaaaagtacaaataacccaaatgttcatcaacttatgaataaaatgtacattcataaaataaaacatttattcaacaataaaaaggaatgtattgctgatagatggtacaacatggatgaaccctaaaattatcaggctaagtgaaagaagcccatcctaaaataccatattttgtatgactccgttcatatgaaaggtccagaaaaggcaaacccatagacacggaaagtagattagtggttggcaggaagtgaagtgaaggtgggggggtgaggtagaggaatggggagtcaccactagtgggtacaaggttcctttatggggtgaaaagatgttctaaaattaacagtggtgatggatgcacaactctgtgaatgtactaaaaaccactgtaccacacactttaaacagtgaattgtatggtatgtgaattttatatatttatataaataaagattccttaaaaaaaaaataacgctgtgaagtgaaagagtttagtttgccagagagctaaaatagccaatctgtatggttagagtgtgggggagcaagaagagtggggctgggtgcagaggctcacgcctataatcccagcactttgggaggctgaagcgggcagatcacctgagatcaggagttcaagaccagcctggccaacatggtgaaaccctgtttccatcaaaaatacaaaaattacgcaggtgtggtagtgtgcacctgtaatcccagctactcagaaggctgaggcaggagaattgcttgaacctgggaggtagaggttgcagtgagacgagatcacaccactgcactccagcctaggtgacagggtgagactccacatcaaaaaaaaaaaaaaaaaaaaaaaaaaaacgaagaacagtggtaccacctagggctggagaagtgaacaggatcacaccagctcctagaatgtatattaagagcaatggtcgatccccctttgccctctggtgttgggaattttggccttgttctaaaccagtttcccttcacagaagttcagccatcgtgtgggatcagaataaggtcctggggcaactaaaggtatctggccaagggtacatccgaaggaccctacaccggcccccagtccccaacagcctgttcaggtgtcggacaaagacttccaatctttcctatcatgtttttcctactgctcttctgagaaatgttacttagttatgtgtctctttgagaaattgcttcttttcagggcaggatgctgggttatgcttgatgaagctaaataaactgccagccagatgagaattatagacaaataatatgcagggacccccccggattcatcttagtcttgagctcatatagaattcagagaaatcaaaggcagttgacaaggagggtcaaggctgagtgcaagtgaacgcaactactcctgctggcttgatccccccctggtcatgaatggtggctgcgcgcacatccacgaccaaggtaagcctgagagacgccttggactctagcacagcagagggaaagactaaggatgcctttttctcccctctctctttctaaatgggtagcctgcactcctctcaagtgcgagacattgggactcctttgatcctcagactctgaagaaaaaatacctggtatttatcagtagcaaggcttggcccagctagaagttggaagatggggagacctagtcagctggggaaaataacaactataatactatcctatagctagatctcttcaaccacagagaaggaaaatggtccaaaattccatatgtataggccttttttgccctgcagaataaccgcaagctctgtcagcaatgtataatagaccttgcacttatagcagtgatatccagccagacttaatccagacagaagggaaaaaacagtctgcctccttagaagaggagacagaggcccctgcaccagcccaggtcccagctcctcttggatcatctcgtcccccttatccaggcccccttttgaacctcatcctgttagaagagttcgacctggatgcgctccagcatcacttcttcctttacaggaaatgcatagtgaatatggtcctatcaaagtacaagtccccttttctttacaagatttgaggcagataaaaagaaatctaggacaattgtgtcgacctggataggtatattgaagcctttcagaaccttaatcaaatgtctgagctttcatggaagggtatcatgttacttctcaactagactcttagagcttcagagaagcaggcggctttacaggtcactgagacatttggagatgaaatgtttatcttattatggcacctaccaaaagggggaagaaattagggagccctttctgacagccaagcaggcagcatccaccaataatcctcaatgggactcagacactgctctaggaaagtggccgagaaaacatttttagggatgcacagtggaagatctgaaaactagaggcaaatctctcaattacattaagttatcaaccataaaccaagggtctgaagagaacccttctgttttcctggaaaaaactgagagaggctttaattaaacacacatctctctcctgactctataaaaggatagttaattttgaaagacaagtttataacccaagcagccccaaatattggaagaatgctgcaaaaagttagctattgcaccagacagtactctaaagaaaatcctgaaagtcaccaccttggtcttttataatcgggaccatgaggaagcccaagaaaaagggagaaaaggaacgagaaaaaggcagaggcactaatagctgccatacaggcatataaacctctcgatcccagggagcttctcattctatgaccgactgttatcagtgtgggagcactaaaagagagtctgcccccgaaatcagaagcagcccccacggccctgtccaatctgtaagggagactactggaagacaaactgcctccagaaacatacgtcccaaggttcagagccggcttctcaaatggtccagcaggactgatgggtcccagggctctcctccccagctctgacagcccaggctgcattaccatccaggagtcccgggtgagtctggaggtcaaaggactcagaggacagacttcctactcaacaccagagcagccattcctgttctcctctccattctgggcctcccctcctcccttagcacaactgtgaggggcgtctcaggaaagcctctgactcgatatttttctcaatcccttagctgtacctagggagacctttcgtttacctatgcctttttaatcatacctgaaagcccgactcctctgaggtagggatattttagctcacatgggaaccaccatccttatggctccaggacagactctttgcctccctctggtggagactgatattaatccaggtgtttgggcaattcaggaaaatactggctgagctacaacagtctcaccagtccaaatccatctcagggatctcatctccttccctaattaaagacaatatcccctaaaaccagaagctaggaaacaactagaagccatcattaataacctaaggatgcagggccttgttaaaccctgtgacagtccttgtaatatcctaatattggaagtacagaaagaaacccaacagggaatggagactggtccaggatctccacctccttaatgagtaactggtgtaattaaccaatttacccagtggttcccaatccctatactttgttaacttagatacctgaaggaactaaatggtttgcattcttggaattaaaagatgctttttttctgcataccattataccccaactcccaaaacttgtttgcattcagggatccctccaaccagactacccagctaacctggatggtgttaccacagggattccaagacagcccccacctgtttgggcaggcaatctcaaaaagatctctctgagttctttcaaactcaagttagtcttaatatgtagattacactctactctgtgccccaactgaggaaatttctcagaaaagcaataaggctcttcttaattttctaactgacagaggacataaagtttcaaagtccaaggctcaactccgtcagacttcagtgaagtacctatgcctggtcttgtcagaagggaccaggacactgggcgaggagagaattggatccattttctccttccttctccccaagaccctcagctaactaaagggattatcaggcattactggattctgcagcctatggatcagaaatctaattaaaagcattgcaatgcctaattataacatatctaataatctagggggacatgcccatgacaaccctattttgcaaaatcctggaatagaacagtccattttcagaggttttcttcctgtcctttctaggtgtccctaatatatgggcatggattttcccccttttagttcctctttgtgttctcattgtaatactcatatttggtccatgtgtacttaacctccttgtaaaatttgttttttctcgcctagaggccatcaaactccaagtggtcatgcaaatggaacctcggttgatggctctcttttaccaggggacacttagataggcctctaagagagacctgactgctgtttcccaaaacaacaccctctgtcagcatgaagcagaacagtcatcacccctatccgaacagcagttagatatacctcttcagagcggggattgatggcggtaggaggcaggtaaattctcagatgaaactcaaccttcaagccaaggacagtcgaaagcctgaaaaccaagctacaagttctggataaatccatggactagagagctctcattcctgtttggcatgctctctcctgattggtccttatccttcacctactttacatatacctgcccttccccagttggtcctctacactatcgtgcctatttctaaatggtgctttttcaagcatacccacagaccaatcagcatgcacttcccccatttcaagcccataaaaacctctagactcagcctcgtggctggcaacccaccttcgggtcccctctcgctgttgagagctttcttgtcactcattaaattctactctgccttactcagggaaaaaaaaaaaaaaaaaaagcaatgggagatcattaattaaatggctttgaccagggaagtgacatactctgatttatgctttagaaagattattccatgtactatgagacaaatggacttagaagtacaagaatgaagaaagaagagcaaatagagcaattaggagctactacaatagccagccaaggcacaaagccaggcactgggagcacaggtctcaccttggtcaagtagtcatggatattgagagtcgccagcttggtaaggtgcccattcaaacccagagccatgagaaagccagcatactcattggccaactcagcatgcttgggcttattgtaaacaatccaagctgagtcgatctgggaggcaggagctatcttcaggccagcagccacaccattatgaaagctggcccagcttgtcatgttgggaggcacatcgatgtttccactattaaggtctactgttgtgttccgaggaggggcacgccctatccagccaaacgaagaacattgagagaataaaaatccacaaaaccaagattgttaaatttagatctttgagactaagattacttacgttttctacattcaaaaccattaaccccataatgcctggaacgttaggtctctatgaccacttaaaacttttgtacatgtgagtcaaacttaatggaactggaaaaaccttcactgtctaaacagttcattgtcctttttgttaaaatgtatgaggctatataatgagataactgataccaatttaacattatacagagatgactgggataatcactcattttttctttcaaacagagagcttaaaaaccaaagtgaagactaacatcactgttaaactatacaagttataaatcccaacatctgatgacactgatgttaatttcaaatgttctatcctatattttcccctagacattaaggaaaaatgacatcttaagaaaagacaaaagccaggcctggtggtgcgtgcctgtcccagctacttgggaggctaaggcatgagaatcacttgaacctgggaggcagaggttgcagtgagccaagatcatgccattgcactcccacctgggcagcagacagagactgcatctcaaaaaagaaaaaaaaaaaggaaacaagaaccttaataaatctgctacaggtcttacctatatatgcccccttctctctctttttttctctctctctctatatatacatacagatatagatatctaattatatgctatcgtttaaaatgcttagagatagttttgtaaaaagcatccttttatagacttgagtcacccagggaacttcaaaagggcattcaccagattatacttttacggtccatttatttaagaacaatgtaaattatatgttcacaatgctatatgttccctacgaattttttcttgattcttttctttttgatctacattatacacagcaaacattgaatctttttaaatatattttgaatattgtcttaagtcatggataaaataattaacataaatattttaattactgcataaagttatccatttcactgcagctttaaaaataccatttttaaagagttctaagatgttatgtaaaataaattttaagtagatgcaaagtgtcttatttgtagcatgtacacatacacacacaaagcacaaagtaagacttatttgtctttactatatgctttttgtacctaaaagctaactcaactgctagtgttagcaccacaatgagtaataagttcataagttacacttgtactttctcaaaaaaggcagacatatcaatatgaaaaaactgagtgacctttctgaaacattcattcatcatatgcaagagacataatatttatacacgagagaaaataaaatgcaaagggtaaggtaaattttcttcaatgagaataacaacatacaaaagtacaacaggccacatcagtgtgggttaagcaactatttaagaaaatattctttcctaaattaagaggataacctttctttttggcctaccagaatgactaaaagaataaaatgttggattaatgtcataaacacattttaaatcatgcaaattcaattaaatgtattcagaaaaaaagatgcatgtatatattttttaaacccacccaagtatcacttgagtgctaaatcacccagattgaatacattttaacatttgccaattttgcattagattttctttttaatctgcacttagtatatgaaatctttcatataaacagttggaaagactactaaaatgaacatctatataccatgccttccatcaagaatcaataattgttaaaattttgccataggtgctttacctctgagacaatttaaatattaaaagccactctgctcactatgtccctcagtgagattagggctcagaataagcatggtatggagatgggaatgtgttctttcacttagtcaatctcatttcctgcatgctgctcaaagcacaagcttttcacaaatctgagtggaactctggattttttaaagtatgcaatttaaaatactgtataattatgtttgcatatattatgtactatttatcatatattaaattatacattatatgctaccacatatactatacactactacaacatacattatacatacattttgtataggtttcacaaaaccatatatactataatagagtttcagtgataatttcaactatgtaattgtcacctttagaacacattcaaatcagcattagggggacatgcactataaaattcattgtaatcaagattataactacagttatatatggcagaaataaaaacttgtgccagccagaaaggcaatttgacatgttccttaaaaccattcatcttgctgtcctaagagttctacttctaagcatttagcctaaatacacaggacgaatacgccccaacaatgtttataataccaaaaaactgtaatttccaacaataccaggctgcttctataaactatggtatatccgctgaatgaaatactctgaagcaaataaaaatgaatgtattgattaaaaacacgtgtatacaatacatacacataattataaacacatacatttatttgctagatataaaaggatgttcactgtaaatttttaaaaaaatctaaaatagatataaattttctgataattaaacaaatataaaattataaatatgtggaaataaacttagtaaacatatatactaaaatgttaaaaggagtgatgcagaagagtgggagtactgcaagtgaccattgtttctctttttgcttagtacatttcttgatttatacaatgatcatctgtttaaactatgacgtaagacattttaaaactaaatatttttacatattaaacttaagattatttaaaattcaagtctcatcgttatcaataatatctttctgaacttctccaagtgactttttagatcttgaaatcacctcattaaaaagcaaaaatgagtaatgaactatattctgcttctctcaaagtttagtttcacatggcatttgagctttgataaccactacagcagctattaggaaaattttaaatcactggggatagagggagcatttcttttgttttaactaatttaaagaactacacttaatgcatgtacttaatcattttcctttctcattgagcccagaatttaacataccagtcagattcaatttaggaataggcaatggctctgttggaacaggatggtacgaaaacaaggtaaacattcctcgtcctacaggaagagccatagttcgctgacacaattggagcaatctgtaattaaagtaaaaaccaacatgtgaaaatgtttaaagcaaagagcaattgaaatatcatctgtaagtatttcaaaagaaggtgtactgtataagatgaagttgtctcaaagtaaattcatacacagatgtgagtgaactacccaaacatgattattttcattttaatattcttgttcctattacactcttagggagagacatatttcctctgttttgtttcatatttacattgaatgaaaaccacctggcctataaaccaagccgactctctctaggcattcaaaaaaaaaaaagaaatttaaaattccactccgatggatgctaaccttctcaaaggaaaatacagtacttttggggtttttatcactgtgttaatttcagtctagctgtcctcagtacatgtgggatcctcctcccatcccttttgccaatacagcctcagaagtaccatttctgtggcctgtacacaagaaaagaaacaaggtccttgtgttagaggtgaatggatttcatggtgtctccaagggaaatacagattggtttcacttacatgatggctagatttataggactaataccattatgtatcaggtatgttcaaggttaaaatggtttctgttggctctactgtgaaattaatacaccactcttcaacttcttcctatgttaaaatagcttaacattccatatagccacttaaaaaaaactaacagaaattttggaagtagggcatttataactaagaaacgcctatacaagctatatctgaagacacagaaatatcccttcagaggctgacaactgacaaacattttctctgcagacaaagctattcataagcatacaccctccttaactggacacacataactgcttttctagctaactggaaagaaaaattttgctgtcttaaagattctctgggaacacaaccgcaacattaatttgggatcaggaaaattcaaagccaagagtctgttgcaacccatagaatttttttagaggaaatcttacacataattcacttcaactttgcacaagtaacaaaattataatgagaacaatattatatcccctgaatataagatgccactcataagatgtatcattatttcatgagaaactaagaaagaaaaagcactgccaattaaactatgacgcctgttcactgaaatacacaactgatttcagagatattaaaaagtgaaaaaacttgcatcttagaatcaatgaactctactactaataatggctgactgcactgagctttactatgtattgagcagtattctaagtgctatgtaaaaataattcacttgatacacagcaccatcccatgaagtatgcctacttttacaaatgaagaaactgaggcaacaagaggtaaagtaatttaaccaaagtcacccagcacagcatggccatgcctggctctagaggccatgctcataaatcctatgctctaaactcaacttctgtcactccatctttttattcacaggtgactaataactgggtacatgtggagaggaaacagttaatagggaaatcacaactaattcagatcttcagcagcctgtggctaagtgtgggtgatggttcccctcaaaacagtaccataaaaaaagtaaagagaactagaaaacagtggcagatgaatgatagatgatagagacaagcagataaaagaacaggagagaattttaaaacagaagtgtcccaagagaatagctctggaatgtcataggcatgtgagtcttataatgtatcaagggatgtatcctgtgcaggggagtggcagaagaaaggcttatctatttttatttggagtatcatctatcatatccaaaaaaaaaaaaatactcatataagtttaaactacactaaaaaccccactaacctcaaaatctattcctgatcaagacacagaaaaacaagtccagtgttttctttgtttgtaaattcttaaggtaactatcaggcaaaatagttttacattcaccttttctaaagagtaaagtgttatatgtatttcaagaggaggacgatatgaaatacaacaattacgtcctcaaaagccaaagacattttgctaacacacgtggtttgttgaagttggatgaaaacttaaaacacagggcatattttcacttgaaagtatcttttaaatctctttagggttttaagtgctaaaaacttgaaggaaaaacaaatatacacaagacacaaatgtaacaatgaaacatgacaagagatagtgcacgtgttttctttcacctgttttccttttcctcgatgaactcgtggtcactgagctctgggtactgcactacattgacacggacaggatgcgcactctgaagaagccttcgcacatcctgcacccttaaatcttcactccatattaatgacatgacctcgtgattcatgtcattcatgccgtcatcttcctcctcagtttctgttcctgaaggaacatctgatgagagcacctgagtaacagactttattgtaataataatttcaaaagcagttaacatgcacttgctgaacatgaggatatataggctgatgtgtcatgactatactagcacagagaaaatatgttttccaaagcaggcatgggttggagccgcaatgtatactgggactctaatctacaaatctttctaaaaagtactatattgctggccgggtgtggtggctcacactctgtaatcccagcactttgggaggccgaggtgggcggatcacccgaggccaggggttccagaccagcctggccaacatggtgaaacccggtctctactaaaaatacaaaaattagctagccagacacagtggcgcacgcctgtagtcccagctactggggaggctgaggctggagaatcacttgaacgcgggaggcaaaggttgcagtgagccgagatcgtgccactgtactccagcctgggtgacagagtgagattctgtctcaaacaaacaaacaaacaaaacaaacaaacaaacaaaagtactacattgcctacttggaaatatttggaaatgacggggagagtttaaatttaggacaacagtcaaggggctggatacaaacagagaaatattctgaataaactataaaaaaaaatctaactcatcctgatcattttaaaaaagaaattattgcaagtagaatatgaatactagtcactgctaataatgctaatttaaatattgtctgttcattaatagaaggagaaggaaaaaagcctgaaaggatatacaccaagggttgggggaagtcacacaatgaaatactttcttactttactacttttaatagacaggatcatggttggatttcattattaagtttttttttttttttgagacagggtcttactctgtcactcaggctggagtacagtggtgtgatcatggctccctgcaacctccacctcttggactcaagcgatctttcaaccttagcctcccgagtagctgggactacatatgtgcactggccacccagctaattttttttattttttgtagagacagagtcttgccctgttggccaggctggtcttgaactcatgacctcaaggagatccacccacctcagcctcccaaatagctaggactacaggcacataccaccacacctggctaaattttttaaaaaattgtttaagtagagatgaggtctcactatgttgcctaggctggtctcaaactcctgggctcaagcagtcctccgccttggccaccccaaagtgctgagattacaggcatgcgccaccacacccagccagttttcactattttttaaaaaatgtgtttccaataaaaatttcttagaaggaaaagtactgaactgcagcgaaacaagtaagagggtaaattccttgattgtcatcatgttctaagcccagcatgtgctttaatatggggcttcccagtccaaataattaaatctaactgcaacacagatgtgaattgcatggaatcatatcatattctctcaaaaacagtattatactcttttaacaaaagaataactccaagttgaaatgttaaagttttgcaacatttaatgtgaaaccaacaaggtcagcctgaaaaaaaagtagatacgaccaaataatcacttttagttcctaaaaattcatttttagttcctacaaaatatctaatttaaaaaaaaaactgtattctaatgggtgagttagctataaaacatagtctcaaacagtgacaaaataaatttagatgggattaattataaaatgtagcctcaaataactgaacaaactgtatttagacataattacttaaaatcacgttcaaatacagattaatgttttaatgctaatggtgctgaactgctctctctcacaggaaaatcattttataagcaaaaagatttgttttctgtttaaaacaggatgtaaatactaattcaacgaagagctgtgatagaggcgcagattaaaggagagagatgctgggatgaccctgctggagatcagatgcccatggaaactgactccggcatgggtacacattaggcaactctgaggttaggaataagttttgatataggctctgaagaagtagtaataagacctaaggtgactcgtagttacaatgtactgattattatgtattgattcaaaagctactaagaggcaaggccaaattcccactgtcttctcagggacatgaacataaaagagtcaccaggagtggaattattattcctgaatcctccttgatgagattctactgttcattttttaaagttacctagaattctagaataagttttaaaagtttcattttcaagttttgaggatgatttaaaaagataattggagagtaatgaaataatttaactttctacttgcaggattcctagaactcatttaaaaaaaaaaacagacttgatgactgatgaaagacagtatttcgggagggatagcttaagacatgtttttaaacaactctactgaaaaaaacacattttttccctggggctgcagttttatgtgattaaacaaatatgtttacacctatttaaaaggttaaattcaaaaaattcaacacatcaaaaaatatgcagtagaaaatacttatatataattactcatccaaattcaggatatatgtgctctcccttttcctatgtaataattacaaagtggttaattactaatatggtacaagtagggaaatagccatggtagtttccatgactaccctcaggacttgtcctgattcaaggcaaagaaagatccaggcacaagacagaacattcacaaaatctcctgctcctaatgctcatcttaacaattaataagacgcgtacaattacaaaccccgtctggcatataatataaaagacaagctaatatatatacttagaaaaagccttaaaggaaaatgaagaacatttctactttatgattttatttaaggctaaaattggaactctgaactttctatgttgatactcacagacttccctttgggtaagtttccttcgcaggcctgcttggaaagatcctgacgtccaatcaagagacagacagcttctggccagtctgaggcaggctgttcacgacagtgataaattgcatctctgatgggaagagcaattccaaagggaagagtttccaaatctcttaaagtgaatcctaatggttaaaggaagagagaaaaattttaatttagactcgccactgtcccaattatcctgactgaagttggcaacaatatctatcctgacaaataagttcattttattcatcttactaccagactaatgtcttgacatcaaggactagtataggaagtctctttgaaagaacttgtaaaaacctgaagaaaaaaagacaatctaatagaaaaatataaaggacaaaaagacatttcctagaaggggaaacataaatgggcaacatgcatatgaaaagatgctctacctaattagtgatcaggaaaatgcaaattaaagctactgagaaatataaatgtcaaagccaatcaatactaaatgttggcaactatgtagagcaataataattctttttattcttttttttttttttttttttgagatggagtctcgctctgtcgcccaggatggagtgcagtggcgcgatcttggctcactgcaagctcctcctcccgggttcacgccattctcctgcctcagcctcccgagtagctgggactacaggcgcccgccaccatgcccggctaattttttttgtaattttttttaagtagagacagggtttcaccgtattagccaggatggtctccatctcctgaccttgtgatccacaagagcagaagaagattctgatcatcatgacaggacaaaaaacataaactaggaaacagggacatacatggcatatatggtcaccctaccagctgcagaaagcataattggtgaattatttgcccaactgctccagatcctggtcagtagcccacacactagaattatagttgctgagcccatccccccttattccaagaatctctgattggctgccttggaagctttagctcttctcactgtcataccacctttggttctactgtccaaatgctgaccttctgttataactgcaggcagcctggtggtcaagcagatgtccccaagaacttcctggggttctctctgaactttgagccatttagaatcaccaggatgccttggtcactgtcaacatcaaaatgtgaatcttcttagacaccaccggtagttaccgtacctctagaggaactgagggttcttcacccacaaatgaagaccatctctaaagtgccccatcacattctagaaggatacagctgctggaagaaaataaagtgtcccaccaccactcccacagttcttaagctcatacacaccaacaaccactccaggaaccaactgaagacttcaaatatcatagtaccagagagggttgatgccaaacccacttctaaaactgtgttcactctcttggagttaccaaacaggcttcacaacctcaaagccatttcacaatctccccaaagtctcaatctccccacagtctccccagtcacaatctccccaaagtctgccttcccagactttgctggtgactgccatcactgacataacaacgtggctggaaccctgctgctgccaaaaccaccctccgactctctggccaagtcaaacccctcacaccactatgggagtagtgagaactctctgaaaggccactaacacttctgtaagccacaactaccaaaacaagtcctctgagcccatgccactcacagtcttgtcataccacacctaccagtgaacagtattgccttataagcatatagttctgactcaagcagcgtcaagcctagccttttcacaggataatttctaacagttgggtctacccatgagttacacgaaccactctccagattcaatgagcttctattacctctgttacaactatcactcttgtgagtacagactaagttaactcataagactgtttagaagatgcctttgctacaaagggcactcctcgaaagttcttcctaccctcccagacatttacgatgtgtgaagagaaatgccccaaccagtcacaatctccccaatgtttgaagtagtcagaggtatcacacagtaaccttgaactacttctcttaggtgccaataggactatgaactccatgaataaaatcagctggtactaaaaatggtaactgcttataagtcaaccaccaggtcaaagatggcttactcaaaaaatgtcacaagaaaaaaaacatcaaatcaaagtgaccagcctcactgcctagcaaccaacccactcactcattcacacagaaggcaaaattgaaaggtagctgggacgcccataggaagaaaacagttaggatgatgcaggggagactgatacaaggctgttattctaatcatcccataacagagacagagtcacagctagggaattattcaggaattaggaaaagttatttctggtaaacaaactcccacatactgggttaaaatttctttggaactttatttatcatgaccctaggagctctagtcatatatgcaaatggataaacaacaaagctataaaagcagagggttttaattttgcttttattttttaaataatagcaacaaggaactttagtaagaataacatagtaaaactagacctgtaaaagtcatcaaaagcaaacatgacaggaatagcataaagtaatttgtgaaagctagtattatcaaagcactgacagaagaaaaagaatgatgctaaaaaatacaaaacacttctttcaataccataccttatcaatggcttttccaacccgagaaacactgctgtggatgtctttgtggtcggaggccaatttttgaacagtatcctttattcttttacagcactgtgtcaaaacaagtcaaagtgtccctgataattcagcatcttggcctataaaaaaacaaaggaaggattggttactcacttaagcaaacccaaagatggcaagtttctaatgggccttttggaccatgaaagatggaagaaaagtgaagaaaaaccagtatctgctttgaagctgatggtcacattcatagatgtgatttttcaaatggatactcagaaagatataatttttttattttttggaaataagaaaattttactgtgaaaggaatcatttttatcattacaacaaccagcacaggctgtgaataatactgtcaaggcagtattatttttgagaaaatatgtctaagtgaataaactcacttattaaacccagttacactgttcaagtcattctcaaaacgttctggttgttactaaatttcctcaagagagatgatttagtgcaaatgcttcatattccatataaagaggtagaagaaaacaaacttccctgggtaccacgatgtgcagaaaggagttaacacagcaggtcatagactactacccttagaaagtcctgcttacaaagtcacctcttggctggcatatagaaacctgggagtttgggagtgttcccatcactccctaactcagtgttccccaacctttttggcactagggaccagtttcgtggaagacatttcttccacggacgagggctggggggaatggtttcaggatgaaactgttccacctcagatcaggcgttagttagattctcctaaggagcacgtgagccagatccctcgaatgtgcagttcacaacagggttcatgcccctatgagaatctaatgctgccgctgatctgacagtgggtggagctcaggcggcaatgctcgttcaccgctgcttgcctcctgctgtgcacggcctggttcctaacaggccacagaggggtactggtccatacccgggggtttggagacccctgccctagctgaaaagaatggctcattgtgcctaaactgttgtacagtgtgatttatggtgaacatctgctttccttctgggaatctagaatgttgatacatgctaggcagtgagtacctggctttctcctggcttggagaaagcttccaatagtcctctcccagtgaagtcacatggaatatgcttaattcctgcagccatggtttgtgagaagtgttaagtgttgcctaccagggaagctcattagaagctcagtgcccagggtttttattgggggctggtcaccagggcacccactgcctaactctggactgcctaactttggactttggacttctgccccatgagtcttttccctttggtgattttgctttacacccttttgctgtaataaattctagctaagagtatgattatatgctgaattgtgtgactccttttaatgaatcactggaacctaaaggtggttttgaagacccctgacacacatgagatcaaccaaaagttactacagtttacatcctttccctgagctacctccctccaaattttgttcctatagcaggaaaaaaaggaggagaagggagaaaaacagacagataaaacaaacccagttatggtatttgtcatttctctctctatctacgtattcccacctgtaagcaacaggcctggtttctgaaatcctaaccaacattatatagaagagcttcttgaattttaatttacatcagaatcacttaaagttaaaacaaagtagctggaccccatccccagagtttctcattcaataggtccgggatggaacctgagaatttaaacaaggagcccaagagtaaaacagccctaggatgcctgctcatttaaccaatatttattgagcactcactatatatgacaggtacagcagtgaaacaaaataaccaaaaatcccttcccaacaacttaacttctggcaagagacgtaacacacaaaataagcaaattatatactacgacaaaagatgatacatgctacctgggaaagaaaagcagggtaagagagatggggagtgtgtgtgggtggagcagccgcaacttcaaaacagtgctggcatggtaggcttcactgagtagatgacactggaggcaagacttgaaaaaagtgaaggaattaccatgtggctggctactttggggtaagcatgccaggctgcggggagaaaagccctactgcaaaaatacacctagactattcaaacaacaaagaggtcagcatgtcaaaagtggatttctggccaaggaaaatagaagaagaggtccaagagataatggtcctggtttggtaggatctctttggcattgtaaagacttatgcttttactttgactgaaagggaccactgcaaggttttgagcagagaaggcatgtaaactaattaaaaaaaaaacccacaaaaaacatttttttttttgagacagggtctcgctctgttgcccacactggagtgcagtggcacaatctgggctcactgcaacctctgcttcccgtgcttaagcaatcctcctacctcagcctcccaagtagcttggatgacaggcgcccaccaccacaccggataatttttgtattttttgcagagacagggcttcattatgttgcccaggctggtctcaaacttctgtgctgaagcaatcctcctgcctcggcctcccaaagtactcggattacaggcgtgagccaccatgcctggccgataaaacatttcaatatggtcagtctaactggcaacgggagtaccagaactgagcaggaaaataagaggctgtggcagcaatccagatgagaaatgacactggctcagtccaggatttcatgactggacatgagtgaagaaaaggactcacagatgtctccaagatttctagcctgggtcaactagaaagatggagttgtcttcagttaaaacaaaaacaatctcagcacttcaggaggccaaggcaggaggatcacttgagcacaggagtttgaaaccaaccttgggcaacagagtcagaccctgtctctacaaaacatacaaaaattagctgggcatggtggcacacgactgtggtcccagctacttgggaagctgaggtgcgaggatcacttcagcctgggacgtctcggctgcagggagctacagcactgcactccagcctgagtgacagagcgagacctcaactccccatcctgccaaaaaagaataaaggctaagcaggtatgaggggagaggagagagagaaagttcagtttggggcttgttaagtttgagacattgagtaggcaccgcagtgcataagtggaggagttggtgagatatacaaacctggagttcaacagcagtgttagtgctggagatacaaatttgtgagtcactgacattatatatatatatatatatatatatgatacttaatgcatgggactatatgaaatcaccaggggagtcagtacagacacagagaagtgataaaagaactgagtcttgagaactccaagtttatgaggctgggaagaaatagaactggaaaaggaggctaacaaagactactgaagcactaactgtgatggaggaggaaactcaagaaaagtataatgttggggaaaccaagagaagaaaatgtgtcaaggaaggaggagtaaccagctgtgttgatgtgctactaggtcaagtaagatggggactgagaattggccactggatttacaatgtggaagtaatcagtgacgatgacaagaatagtgtctctaaaattctatgaaaagaaatcctaaaaggttacagggaactgtgaagagggactatattaagtctggttcaatgacaactactgagataaatgaaaagataagaaaaaagctttccttatctctaaatacagttgcacaaagtttctatcaagtgtttccaacttccaataacacaattaggcttccaacttctaataacataatttaggctaaggcaagacttggtacttcaagaaaatttcaaaatctgtttaaaaggtgttccacagatttcttggaccaaaagcatctaattgcttcagcagctctgttctggccatttctgatctttctgtacctaaagcacacctaacctcaacagcctcatcttctctatgaacccatctgaccacagacttactccctcttctgaattcctggtaacttctgatctctcccctactcccccagcacttaattataacccattttaacaatttcatgtatatataccgtcatcagtctctactaaacataagcccccaagggaagaccaagtccttattataaattgtatactccagttttatattaatagtgcctgcaaatgtgcaagacatataagtatctgaattgatggtaaataaagtgaggaaaaaatagtttttgtttttgcttttgttagagccatattcaacaaatggtgctgagacaacaagatatccacatgcaaaagaatcacataatatataaaaactaattcaaatgagccaaatgcagtggctcaagcctgtaatacaagcactttgggagcccgaggtgggtggattgcttgagcccaggagtttgagactaacttgggcaacatggcagaactccatccctacaaagaatacaaaaattagcagggtgtggtggtgcacgcccacagtccaagcttctagggaggctgaggtgggaggactgcttgagcccagaaggtagaggctgcagtgaaccgtaagcatgtcactacactccagcctgggcaacagagtgagaccctgtctcaaaaaaataaaatcaaaaataaaaattaactcaaatggaataaagacctaaatgtaagagctgaaactatcaaattcttaaaagaaaacagatgcatttctgaccttgaattaggcaatggtttttcagctatgacaccacaagcacaagcaaccaaagaaaaaataattaaaatggacttcatcaaaattaaaaacttgtgttgcaaacactatcaataaagtgaaaagacaattcatagaaggggagcaaatatttgcaaatcacattctgataagggtttagtatccagaataatataaagaactcttaaagctcaacaataacaagacaaacaatgcaatttaaaaatgggcaaagcacaaggcacagttcacgcctgtaatcccagcactctgggaggccaaggcaggtgaaccacttgagcccaggagtttgagactagcctggacaacaaggcgagactctgtctctacaaaaaaaatacaaaaatgtggctgggcacagtggctcatgccagtagtcatagcaactagggaggccgaggcaagtggatcccttgagcccaggaggctgaggctgcagtgagctatgattgcgccactgcattccagcctggatgaaaaacaagaccctaactcaaaaaaaaaaggtcaaggatttgaatagacatttttcaaaagaagatatacaaatagccaacaggcacacaaaaagatgctcaatattattggtcattatgagatgaaaatcaaaactacaatgagatactacttcatgcccacaagattggctatcaggaaaacacaataataactgttggaaaggatgtggagaaattcaaagccttatccattgctagtggaatataaaatggtgcagacaccatagaaaacaatttggcagttcctcagaacgttaaacagttactatatgacccagaaattccactcctagttatatcctagttatatacccaaaagaacaacatgtccacacaaaaacctgaatcagaatgttcacagtagcattattcataagacaaaaactggtaagaaaccaaacctccaaagaatgaatggataaacaacggattatccagtcattaaaggaaatgaggtactgatacatactatgacatagatgaaccttgaaaatattacattaagtattcaataagccagacacaaaaggccacatattgtgtcatttcatttgcatggaaggtacagaatagacaaatctatagagacagacatagattaatggtatttggagtgggaggagacagggtgggaatggagagtgactgttaatgagtactggatttctttcagaaataaagaaaatgtttttaaaaagaagtcatacctcctatccatccagacacatttatttctacaaccagcagacaacaaggtaggaaaaacacaaaaaataaaaagggtgccaggtacgatggctcacgcctgtaattccagcactaaggaaggccgaggcaggcggatcacttgaggtcaggagtctgagaccagcctggccaatatggtgaaatcccatctctcctaaaaatacaaaaattagctgggcgtggtggtgagcacctgcaatcccagctactaaggaggctgaggcaagagaatagcttgaaccctggaggcagaggctgcagtaagccgagattgcgccactgcactgcagcctcggtgacagagcgagactcggtctcgaaaacaataataataaaaataaaaaaggatgaagccaagctggaggaaagaggtcacctagaatttaccactgaacttccacgcaccaaccttgaaatccaatgatattttcaaatcgtagtaacttacatatctggagtttggtgctatttgttacctccttttcttcctttaccatctacaaattcctctaatttttggttttcaattttatgaatgacagatacaagcagtttatggccaattaattaatactgagagttctcagaatgctccaaggaaaaataatttctgtaaggtatttggaaactcaagaaaagcagaatggaataatctgaaagagaaccctgggaaagccctgttaagagagaaagagttcactaatgcattttcaaatggactcagtggaaagcagccaaaggtttaaaacaggtttgaaaattgctataatgaccagactgacagtcaaccaaacttctataagtcctactgggagagttctaacgttcttttgatttctctgtatgaaaacacaacctgcttctaggagaacctttatgtgaaagaaactggattcagttcctagaagaaaagctggggaattactgtgacagccatctccaccataactacatccaggttggccactgcggtggtcacttgtcacccagaagaaagtcctgcactaactgtgtcttccaatgtagtaaacccagggaacccaggcccaatgcatgagcctgaaagaaacaactctgacgcaatgctcactcatcactggagggtcacaagtactttttaaagtcagttttatgattaaacaagtgtaagaattagcatgttcaatataagcaaagaacgaacatatgtagaccatctacgtgtgttgctttattaagttaaaattttcaataaaatagaacagcaccttttatcatataaacagattttaagcacgacactcaaaattttcaagttctgcccttgagcctcactgctttgccattttaggatgtatgcccactagtttcacagaaacaataaataagaaaaatgtttgtttccatagcatcctatacttccctatcagagtttcacactttgttgtaaatagttatttgtccattactcccacaaaattaactttagtaggaaatatgaccaatccccaacgtttagtatagtaactggcaaatactacacgttcagtaactagttaccaaaagaataaatatgaaaataattaattatgtattacataatctcaatttcaaacccagcattgaagactgtctggtactaccaacaccctctgaaattgccagcagtttcactcagcagttcactgacccctcactctctcacagaatgtttagcatctgctacacagtaacactgcagcctaagttctgcaaataccaagtaagttaggaaataatactgttcctgtctgtcaataacattattgcctaagtagaaaatcccaaagaatctacacacaaacacaatccaagaatagatgagagttcaacaaggtcacagtacccaagatcaacacaaacatacaaacacacatatgcacacatattttcaaataagacacattcacaaaagagtcccctggcatcagttataagttccttctctcttccaaataatgacctctcccaccaaccccaggaattaatgggcttgtgctctgactcaagtcacttttgagacagtttcttttttacaaaactatttccacatttgtcaaagatgcaatgaaacatctctaatatataatgtgaccctataaaagtatattctaagtcagatataggaaggtataacaaacgtacacattaaaagggtgactggtttgcacaaagctaaaaactataaaatccctactaataccttggttacaccttcaatacacttttagcattttgtacatacatttgttttactttcttccctactgatcacaagcctcaaaaaaaagcacgtctcgtgtccagctccgtgacaagatttacccactattttggctcaccttaatacaatctagacaaatatatcattaatattgacaagtacgtttctcatccctactcagtatctgcacttttaattttctgtctgccacttatttttatgatatggggggagggggttcaactctgcacaaacacactgttaaagatagcattgctaaaactaaacagctggttggtaggcagcacaccatgttgcagcctgaaatgtctgccatcaggagataataaaaagttctaatttggtctataaaaggcagtttaaaggtgtcaattacaccatgaaatacatgctgcccacgagtcaaacacatgagagatgagacccaccatacttgagagcactctataaaaaaatagggaggcacaatataaaaaagtattgttatggtgatgattttcaagaaggttgaaagtatcaccacctaagactggaatatttccacagaaataagattccgcagaaatcactaagacctggcttgacattttaatgaatatcctataggcagtaaaaatttaaaatatccaagtttataaatattacatgtatcgcatttgagctcttctgagttatgaaaagttaactccactttcataagatggacagagatcttaaatttagaattaagtggaaagcaaaatggaacacaagttttgatgcagataaatacaaagaaatccatttaggaaacaaacctaactgtacctaaatgaaaactcagacctcatagagatatactccagaattcattctagattagctatttaaataaaaacactaaaatcagaaagctaaaagagtattaggcatcactaagaaggctggtggggggggaaatctatgatataccactcttataaaagccttgatgccttaaaatacaaaatgaaaccaagaaaaaacagaaaaaaatgtaaaagggagaactatgacatttagagtcaattaacatttattgagtgctgaaggcctgtgtcagcaatgttcaagatacttttcccatgttaccaatttctacacagatttaagaaatttagaatgggaataaagtagataaaggataaaaagatctaagactgactctagaaaagtcactgacaaggtgaccatggatatccttgcgaagtactagaatagaaaaacttgaaacttgaaaaggtaaggttggaattttttaaaaataagggactatttcattttgtctgtagtaaaataaactgcggcccattgaaatttgggattcttgtgagctacttcagcacctaggacacagcggctgcttagaggaaagagaaaaggcacaaatagaacacattcatttttttctggaggaggtaaacactgaaaacaaaatttttccagtatattagtagctggtaaatctgcaaagtaaaagaaagtatggtatttggtgttcaactcctgacctttcagagaacagtagactgacagacacgtgttctgatccagagagattattaaagactgtgcatcaaattagaggcacagtgtgctgcaaaccaaacatgaggggaaaaaaacgaaataaagttaatatttagagtgaaattacatggtacagactaatagtgctcctggagcaaagaacagtatcaatgactatcatagagaagacaggaaaggcttcaaagtatatgaggcaagaattgcagagagaagaaaaaagatacaggcacaagattttaaacatatgtctgtgacagtcacattttagagaacctattcactcccttcaaattccaaatataaagacttaatctctaggcatctcatttatctctgaaatgaatggtggaaccacattaggtttcctgtagcattggaatctggatttcatatttaaaaatcaaactcaggccaggtgcagtggctcacgcctataatcccagcactctgggaggccgaggtgggtggatcatttgagttcaggagttcaagaccagcctggccaacatggtgaaaccccatctctactaaaactacaaaaattagccaggcggtagtggcgcatgcctgtaatcccagctattcaggaggctgaggcagaagaaacacttgaacccaggaggcagagattgtggtaagccgagacactgcaatccagtctgggcaacagaatgagaccccccctcccccaccccccaaaaaaacaaaaacaaaaacaaaaaaaaatcaaactcagatttccaccttcccctctcctaaacttcctattttctacctggttccataatgatctacccatcattcatgtttaaaaccttggattaacctttggtttttcctgcccttttctcctactctgccagactccatctgtgcaccaactcctggtcattccttccctcagaaatccctttcatgtgtccctttaaatttctaccaccagtacccaaagacaggtccctatttcatcaaatctaggttgacacttagccttagctaaccttcttgcctctagtcaaacctcactcccaactccaaaccaacctaaatactgctgacaactggtctctgatcgtgtccctgtcccctccctattcaaaatgtccccaccccaccccaaagtaattcaatatcttcccagtctactactttccctggtatccatggctttacaaaacctgattccaatttaattttaatgctcttatcgcctttcccctgcaatctggtccttcacctctcactcctctacacctttgttcttgccatcctcccctccaggcactccatatagctctttctgctatccatattcaatttctgctactaaaacttcccataggtaaaaagagtctctccttgtctcaaatcctacccctttttgtccacaccactcatgtagcatctagcctagatacataaccgtgcattacagggcactgcttttgtttgtgtgtttgttaaaaaatgccagtctcatctccctaactggacacaaagttcttagaggatgaaaatgcttgttctttgtaactcctagaagattttgcttagttctacctataaatggtgattaataactactgatgaggtgatctaaagttcagttgaaataatgcccatctactcccatgcagttctttctaagggctctctctcttcactggtgtctgtactaaccagaagcactgttacacactgtgtgccatggtcttgttttttccccctttcaaatatgagtctggtctctccaactaacttctaagttccttaaagactcttataccttttaagcattctttacaatgttaagcagaccactggacacagagtggtatttaacataaaccagtaataaagacacctaaatattacccaaaatgtctcaattaaacagtgcttgggcccggcgtggtggctcacgcctataatcccagcactttgggaggccaaggcaggcagattacgaggtcaagagatcgagaccatcctggccaacatggtaaaatctcgtctctactacaaaaaaaaaaaaaaaaaaagtcaggcctggtggcatgcgcctgtaatcgcagctactcggggggctgaggcaggggaatcgcttgaacttgggaggcagaggttgcagtgagccaagatcatgccactgcactccagcctgggtgacagagcgagactcagcctcaaaaaaaaaaaagcttaacaccacttaaggcacagactttataaataacacgtctaccctgttttacaaatttcaaagccagttcacgtctattatttatttcactctcataactctgtgatgtcagtttactgaaggaaaaactggctaagcaagattgtaggatcaggccgggcgtggtggctcatgcctgtaatcccagcactttgggaggctgagacgggtggattacttgagcccaggagttcaagatccccctagccaacatagtgaaactccgtcactactaaaaatacaaaaattagccatgcattgtgcacacctgtaatcccagttacttgggagcacaagaatcgcttgaaccctggaggcagaggttgcagtgagctgagatcacacaccactgcactccagcctaggtgacagagtgagactctgtctccaaaaaaaaaaaagattgtagaaccagtaaattggcagtgcaaggattcaaacccagacctcctgggcccagggtcaaaattttaggtactattccacaaatacagattcaacttctcaattagcctccaagttcctggaggaccagggccatgaataatttcttttaaaagattctctcctcaactcctcccaaatgtcttcatgtatcaataagatgaattaaacctatatgaattctgcagatacaacaaactcatcataaataacacacagcctgacactacattgtgcccccataacagacgaaatcaccatccaggcctccatcttaagtggagaaagacttggtaatataagcctatggcctctccaagcgacattcccaaacaaccattttgagctcagccacacaatcaccacacccatataaggtgaaagcatactgtatttctcaaaatcctcgagtcctgccagacagtctagtctttgttctctgaagggttgagttaacatctaatctaaagagaatggccagaagtgtctgctactctcagagctttcaaggaaacgtccagttagagagcatcatctcctggaagtaccacgggtctccaagtacacatagctcagagccagggccctccataattttctccctaaactgcatttttggatcatttttaaagactttggaagccttacagatgaagaagcagggccctaaataaaaataagttagttttaatattccaagtgaacagtttgctaaaacaccattttcatcatcctaaagactaagagactaagacatgaaaacaacagaaacttctctattagctctagtatgacagtatcacagaagtgttggcaagtttctccttaccaatgttattatccagagttagaaactactttagaaataaaataactttaggaaaattactttactatgtcaagcattaaagtaatttcaaaaaagttctagaggaacatgaaccaagttgtattctctagtctatagattaagtcatactaacaactcactacttgaattatatgagcattatagttaggaggccaggcaaaagctgagaaggcgaggctagtcaggaaaacatctcagagaatgttactgatataacatgtagctgttgcactgtaatagacatatattactctgtctgggtttaagtgttcctttctagaactgtctctttacctgatgaacagtgtattataaggccatatacctcctgagggggtgagcacagctcaaggtggccagaagacctcactccctggtcccagttactgattcagggaaaggatccataacggaataataaaggtactccctggagtatctccaacaaaatggccatgttcctgtcttttgagctccattggtcatctctaccccatgtgaagaaaactaccctgaaaatgaagccaacagttgacagaagagaacaagatcagtcctgatgacatgcctggtgcccctggagccagcctagccctaacctcagcctatttatacatcaacaaattccattttaatgaaaactattatgtcacctgccagtctaaatgaatatggtgccaaataaaaaagaattaattatctccagagtacgtctggaaaaagaatggctaacaaagttaaatctacttctaaacccaactggaaacaccaatatactgactttttattcttaccacctaaaatggcctaaataacttgagaaccagtccgttcttctcttagaatgtttgaacaatgtccacccaaacttttatttatgacctactgatatactattttccagactagatgttaaaaacagatatcaaattgtattcaaaacaaagtcactattctctcaagagtgtcttgttagtatttagcaaaagtctgggtaacaaatgggcaacctggctatgaggcctactccatgcacaccaaagaataaggctaaaaaggtaaacaagctacaagtctaccaagccccgatataatacatttactttcattcaaaacaatatattcaacactggtcggctctgaaaaagcacagatcattcatatatacaaataagcatacttttcaacacatgtgtttaatatacacaacccaaattctagattggaagattatacctaacatgcgaccctcaacctctggtttctgtgtactgatgcaatatcataccacagcaatgagttaaaaacgtgacctccacaagtttctttttttgtttttcatgttttacttgcctacttaccttctcatttgttaccttcacatttttaaaaagacagcagttctccaactggtaaccaaagtttcaacagtttctttgattcaccgaagagataagggtaggagttatggtttacatgagttttactactagaagtcacaacatacacacacaccaaaggagttttaggtgctaatacagtatatgttgatcactcccacagatgaagacatctttaccaacttgcaaagtgagataacactaagccttaatcatagtaaatggaaatacatatccgatgcgttaaagaaaaaaggaaaagtgacaaatcgtcatttcactggattcttttaaaattttttctggaggtcgggcgcagtggctcacgcctgtaatccctgcagtttgggaggccgaggcgtgtggactgcttgaggtcaggtgttcaagaccagcctgacccacatgttgaaaccccgtctctactaaaaatacaaaaattagccaggcgtggtggcaggtggtgcctgtaatcccagctactcaggaggctgaggcaggagaattgcctgaagccaggaggcggaggttgcagtgagctaagatcgcaccactgcactccagcctgggtgacagagggaggctgtctcaaaaaacaacaaaaaaattttttttctggagactggcatttatgtctgtgaagtgggcaaccaggtggtccaggaacaagagtagaaagatttttcaatgggtgtcttttttatcatttgagtttataccatttgaatgtactattcactgggttatctttttcattgtttgaatggataccatttgaatgtatgacttactaaaaattaataaataaattttaaatttagaaaattccttgaaagtcactttcagaaaccacattagaactccgttagtctaaaaataatcagaaaagaatactgcatgtcctttactcttacaaaaactgcaattttcccaagtatacttttaaatgtgtcctgaaaccattaccaactgtttctgcctaattttctttcacaaagtatgagtgcagaataccagcaaaacatgataaatagttcttttctgtttttcccttccaccacagaggtgctaatgggaaacaatataaatttgccaataggaaaaaaatgctaaaaggcatatactcacaaatcaaatcactaaaagttaaccatacagtagttaaccctgttaagccagggttatccaaagcaccgctcccataccactgatgcgaatggtaattttagctagtatgtaaactaatattttaattgttatgaatttattttaacatgtagtttattatacctaatacctacataccacatgtaggactacacaaatatcactgcctaagataaatctacttaagtaaaatcgtgaatccatctgaaaaataagagtgcacatgtgtatgagtgaagttttagaagcaccagtgcactatacaaattagatcgaggcacactgggaatgaccaccagcctacattaaccacaatgaacttagaccaaacttcgtgctcacagggaaactctcactgaaaggctggcacaactaaatgacagaagctgtgatctctattcctcttaccttggacacctcactgcaggctctggatcactccccaccctcctatctaccaccctaaggtttctaattccaaaggcatgaagagaagtctagagtcagtctccagggagaggaatgtcttggcctcggcagagctcttcagtattctccctggttcttattgcctcttcatatttctattacacctatgttgtccctgaaccaccaatattccctaactgtctatggcaccaagtcgaagcctgcacttccctctcagagccttatattccattattgttctctgctgcaggcctgataccagtccaaccccatttaaaagaaaaaaaaaaagatattcctgttgtcaggctgatggatttggccagaggtggattaaatggcagagcacaaaccaattcaccaggtatgagagaccagcccatactatcctcatttccccaagtgtatctgcattaacaaacttgcattttaaaaaagattaacgagagaaattttatgtaaaagaatttcaagctacttaaaggtgatttagaccacctgagaaattttagggctcactgcaggactatctcccagccagcaatcaggcagtatttacaatctggaataagggtgctgagactagaaaagggttgtcaatgggcttactaactaaactcttatttatgtatgatcagtttccatcacaaactatcctaacagctcatttagtatatagctgtctgctcacaacttcagagatgaaaaaaaaattttaacataaaacattcatcctcagaaactgaaccaatccctttaggttggctaaaggatgcttctgcaacagtcattcaccagtatgatgcaatgatgtgttctatatagtcctcaaaaattctgttttattcataccagattcttgcaagtattaccacaagtaatctcagagaatgaggtccaaagtcctgacagaggggtcccaattagagcctctcaggttatcagaatcatttgcccagacaggtatattcagaagcccaaaaatcttccctttaaacttgaaaatagagttccaaactcagttttcagtaaaatacctttgagaagggcatatttaagtttcaatgtaatatctaccacatcacctgccgagaactttaatttagaaatcatctgttttcaaaaataccatagcccagatgccaaagcatgatgtttacctttacacaaaaaaacaccaaaagaagaaagattttatttgggaaactagacctggcacttgtggtatttattttctttcatgttttataactacctttagtcacttaatcctattattgaagaattaaaggaaatcaaagagataccaatataagactagcaatttggtagacaagagggaaaaaattaggaggctgaaaaaggaacacacaaactcaccaactcagactgtttttaacagcatagcatactgtgtggccaatacccctcaaaccataaattctgagaaaagttccctagtacccagtggagagtcaaaaacaaattcctgcctcagcaatttctcaccatcattttatccatctgagcctggccctaaattttctaaaacaaagctcacaatcacatcccccttcaacttacatcctctctcatggaagaaaggtactttctgttccatcattttcctctcaaactctgcctatgacctggtccctaaaaacgaaatgttccttccacctctccaagtctaggcccttcattctcttcctccactggttccttggcagggccgggagcacagagggaatacctcccaccgctgtactggatttcccacaccgcggttcacatcgaatttttcttcttaacccccagtaatctggcttgtcttagcaattctatgaaactgcaagcacagagggttactgactcccaatagccaaataaaagctgaccaatctctccttttctaagtcctcgcccttttcgatttctgctggctctatctagccttggctctccactcgccaaggaaaattcaagactgtggttagactctagtctttcttctgtgcaatctaagtgatcccctccactgtcctcctagaaatgacatcagaaaacaatcttagacctatgcatctccagccaccagtaaataggaaagccctcgattctatcttcattaagcccttcaaccttacttcacatgtccaaaaccaaattcaaagtcttcccaggattcctgtcccattccaccttcacttccctgtatctaccaactatatcatcatcgccacgtcagtcaaatttcccttcacaggcagccaccaaggtctgctcgtttttccatactagtattgcaactcctatgagaattaatacggtttttccatattaaaatctcatccactatgactgcaggtttgcttccttcctggagttcaaaaatgactgcagtgtccagaatgagaagctgctgtaagactcctttcccatggaccagcacccatcctcaactgaaacgcagtctgggaaagtgtgaaaaaatgaaggagaaggagagagacactcagctaacgccactgccctcatctcacctgccacaaataatctgcatcttcccccagctaccaaaccgtccttcacataaatttctgttcagcccacaagctgaaaagcctcctcagcctcttattaaagacccactaaataagtcctttacttcttgatcaaaaggaatcatcgctgtgacttctaaactgtaagaaaaccaaacctttaaaagtacctgtcctcagggcttggggcagtaaaaaaaaaaaacaatctaggtgaaacgtcttctataggaaaatttattttttttgaacgaacttaaccaggcaaagcaagtaactagcaacatgtgcaccatttacttgggcaaatgtcgcccgttcctcctcggtgtcatcaaaaggtacactgggagaacagaagggttgaattgagctggtttccaaggaaccatgtcagagccgctgcggagttaagagctgcgtccacacagcagccaaatcatgaagttgcaggagcggctgttgttaacccacagctaagaataacgctcgactttccaaaataaaacgaagaaacgaagtcccctggccaatgattcggggcggcacagaggggaaacggagcttcctgcactgccctcatcactcagaacctggggtcccaggcgattcagtcaccgcccgcagaacagcgccgcgggcaccacgtgaaactcccggggccggctgggggcgggggacgaggggcgcccactcgggggtcggcagtttgcaggtgcgatgggcggccccctcacccacgtttatccggactggagcccgccgctcccggccgggtttccgggtggttcgcgctccttctgaattggcagcgaggtcgcggcaggttcgaggtaaatcggacgaagaggggaaaaagtctcaggggtctgggggcctccgcgcctcaggggaggcaagggccgggccagaggcgcgagggtgggtgagggattcccgccgcggggccgggaccggggctcgggcagtgggccctgccccgcgcgcccacgcgggccgccctaccgtggctctgcaggatctcgtgcttgagaccgccggtgtagtcgatgagctcctccaggccgcgctcgcacagctgcccgtagcccgagaacttgtgcagcaccttctccagctcgcgctccaccgtcacgcactgatccatgccggaggcggcggcgctcggctcctcggcgcccaggtgtccgcagccgttcggcccgggccccgccgaggccgcgtcctgctcctcgttccccaagcgggcggcgcgggaggctgaggcggccgaggcggcgggcgcactagccgcggcgccgggggagccccgcgcagccggagcccgcctgccccatggcgccctagccccctggcgagtcgccgctgctcccgttcgctcgctgcactcggccccgcgtccccaggccccgctcgcgacgttcgggtgcctgcgacggcgcggccgattgtttttgttttcacgggaaccgaccgatgacctggttctcccgggcggcaccaagtgccgccgactggggggagggggatggccacccgggcgaggaaaggaggcggagcgggccgtaccaagtacaccctcggggtggggggtgcgacccggcgagaacgggcggaggaacgcgacgggcgcccacacgcgccgccactctaatggtgtgcgccgtaccacacggaaggcgtgcgagggagagggcgagggtggagcgaggccccaattggcctgaggagctaaatagggaactttggagacagccccagcgctcggagagcgcaacaactacgcgctccataaacaaggaggcggaaaccggccctcaccactccgcccagaagcggggaatcccaaccaatgggcgcggggagtggtaagaagccaatccctggccgaggcgtaagccttcagccaatccgggctgaggggccaaaccaacgggctcgctgttggagggggtgacttggagagcgtaccgagaaacgagtagtttatggaaagccttgggggaaaactagacaaaaatacaaagggctgttttccataggacgtagccctgatcccaatttatttcgtctcctcatcgatcttaagggaaaggggtaccgtcattccgaacttttgggcgacggatccatctcccgggatgaaaaaccaagccaggccgcccgggggctggttctgcgtcggcggggggtccctaatgggaattaaaggcgggggtgattgggcccgggtgaggggagccgcttgctgctcgcgaaaggcccgcgccggctgtcagcgctgccccgggcttgcgacacccaggaggtcatgtccccatcccccgcggaccgtggccctttggccccttggcctggaacctctcctgacggtggcctcgccccagagccatgtgccgggcagcttagccgggtggaaagaacacgcgctggagagccgggcagcctggcccttgctccctaggaagccttatgctatcggatcggatcggctttaccccctcgggtaaatccttcccatcgcttgctatggcgtctgcagccttggcctagacctccttgatcagcatcggctgcactacctttgcatttcttcaggagcccagctagttcgtgcctcagggcctctgcacttgccctttccttggcccagaaaactcttcctcctacctttttcatcctgaagttcttctcagctcacttgtccccttacagagtcctcccctggctgaccacactaatgtacttcctccccaccgttaataccataacacattttattatttccacaccacttaaactctgaaatgatctgatgttttatttttctgtctgcaccacttacataaaaccatgacggcaggccccctgcttgtctaaattttttgcctagaacagcccctggcatgaggtggtaggcaattctttttcttaaattaacgtgataacgtttttgagccttaacttccgtataactgagaaataattggaattaatacttaactaaattgttagataaaggagaatatatgtaaatacccataataggctcatgataaccacatgataaaggtggtagtagtcattattagggcagccccaactggtattatttcagatctcccttctccccaccccatttttcttccctcttggcagatgtctctgattcttcactgagattaaaaaaaaaaaaaaaaatctagctccagcaacttctatcactcttttccaagtattgctgtgtaccacccattttgtgaacattctcatgtacccaaaggaccaggagtcccttctccctttccaagacagccgttggggcctgcgggctgcctctcacccctgtccagatcttccccctctttctctgcagtaggttcttcctttctactttcagcccaaatgggtttgacctacctgggggaggaaacttaatttaaccctcctcaagcactcatttctttcactgccaaactgcctagacaaatctatgtttattcctcccttttcttcaaggatctccttgataagctcagtcacccttttctcagtctttttttttcttctccttcaaagggttgttatagtatgaaatattccatttaaggcactcaacaaaatgcctggcacaaggtaagagccatgataatccactgatcacaaataatcaatgactcctcattacctacagcttcagatcctctctcaaggacatggtctgccctgtgtagcaacacagcacaaacccctatccaggcatgaagcactttctcaccctcagtgtgacttgagtacagcccattcatactttgccttcttctgggacacttttctttattctgtttttcgaatcctccctttcttcaagtaacacgacaagtcttactttaactagtgacaccttctagaacctaggcctgcactcttcaataccataatcaccagccacaagcaggttttttttttgtttgtgtttttttttttttgagatggagtcttactctgtcaccaaggctggagtgcagtggtgggatctcggctgactgcaacctctgcctcccgggttcaagtgattctcctacctcagcctcctgagcagctaggactacaggcacacaccaccacgcccagctaatttttgtatttttggtagagacagggtttcaccatattggcctggctggtctcaaactcctggcctcgtgatccacccgcctcagcctcccaaagtgctgggattataggcgtgagccaccgcacccgacccacgtgtagctatttaaattgaaatataagctagataatttaaaatttagttccccaattgtgctaaccacatatcaaataataaccacatgtagctggtggctactgtattaatcagcgcaaaataaatatttccatcactgtagaaaagttttgttggacagtgctgatctagaccatgaccacagtaaagttaccagccctacctttaactgctgtaagacctctgtgtaagtcatttcatgccttagtgcatactgcccccatatttttagttaacttttccaacatgtgcctttttgactcaactagactatcagttttcagatctgggctgacttctttttatctcccatgatttaatcagcatgaaaaaaagtgtttgttaaaggaaaaagaatacgcagattagaggagaagaggcttcagagttagctgggagagaaaaatagtacttgtaagggcagagatttatgttgcttcttcactttgtattggccctttctacacagtgcctaattgccttaagcctaaactgtgaattgtcaaagaagcacctctagaaacaacagggaaagaaatttagttttcagagcaactgcaaattagtttgtttttttttgttttttttttgagccagcctctcgatctgtcgcccaggctggagtgcagtggcgcgatctcggctcactgcaagctccgcctcctgggttcacgccattctcctgcctcagcctcccgagtagctgggactacaggcgcccgccaccacacccagctaatttttttttgtatttttactagagacggggtttcactgtgttagccaggatgatctcgatctcctgaccccgtgatccacgcgcctcggcctcccaaagtgctgggattacaggcgtgagccaccgcgcgccgcgcaaattagttttctataattgcattttcaccacacaataaggaagaacacacacacacacacacacacacaaaatcccactttagtatcaagtggactcctgcccccacatgctgttcagcctggagaagctttaattgatactcattctggactttgctcttgtcttcccctccactccagatttgactctgtaaaatgtaagtaaacatcaaaaaaagacgggaaaaagaaaaccttttgtctttcagccaaaatacatatttattgtaggaaaattagaaaatacaaacaagtaaacagaaataaaagtcccatgaaagcccaagacccagaaaaagaaaatcagttttaacattcggggtgaatttccacagatttttttcttttttgtgcatacacataaactcatatgcacatttttatgaaagaacgctctcattgtatttactattttgtaaacagcttttgttgtcctcttaacattcctccaacaacaaaaacagtttttagaactgcttttgacatctttttaaaatgcttaatagctgttacactagcttatagcttattcaacatatctcatacatattttcactttgaattattcttagaagactgaaaccagagagagacaagatagaaaaaggaaaaatttcatctcttaaatttgagaaattatatttttaaaaaccttctgcttttatgcaaaacacactttcagataagggtaagaaggactacatttataattctgttaataaaaatgaatcagcgaggttggcaaagaactaactaatttcctgactactctagctcacaactaatataaaagtaaaagtaaactgacaaaatgtgttattaaaagaaattctgaattgcaaaaaatagcatttcttctcatttaaacaaatcaatttttatcttgttttgttttgttttgtgttttaagagttagtgtctcgctgtgtcacccaggccagactgcagtggtgcaattatggctcactgtagtctcaaactcctgggctcaagcgattttcctgcttcagcctcccaagtagttgagattacaggcatgagttacccactgcgcctggcacatttttatcattttcaagtaaaatatatatatctatctgagacatttctgggaattgctgctatgaccagttgaagaaatgggtgaaagcacaactattagcaaaaagtcttaatctgaatattttctacatcttttatgtcacctgtgtggtttggggcccgtttgctggctggattaatgatacttgctcgccattatgactgactcttagggattggatatgcagtattgacagtattgcacttctgtgtccaccatctccgtctttcagctccactgtttgtagaagatagcctctgctcagcggcatagccctcctcactgtggccttcaccactcatgaagtccagggcagttctagtctggttgactaccagttaagttaccccctaatagacttccatgaggacctcattgacttccttgagtatagtttgtaggcactgccctcgtacctgggtgcttagcctatagggggttatttataacttttgaaacctgctctctcaggttttattgtctgagtcttttcctttctggaatctggatgtttttcttaggtttgtttcctgctcactgttggtgtgctttaccagctgtagcaggaagagtgctagcactgtaatcttgtaattcattcaacccctctcagcctcagatgctttatctataaaatgagaagcttggaatagatgacctttaagttccttccagttctaaaattacagagatgccagggcttattaagtaacatgtgaggtgcaacacaaccaaacaggaatagacagaggcatctttcctgttttcgaaagcttggagtctgaatcattacttcctcattatggaaacgtgatgaggtttgtttttttgttttggtttggatttttgatttttgattttggttttaataaatagctacaatttattgagtgcttataacacgctaggcattctgctttaaatgtgggattatctcagtcctcaaagcaaccttttaaagtaaataatgccgggtgtggtggctcatgcctgtaatctcagcactctgggaggccgaggctggcagatcacctgaggttgggagtttgagaccagcttgaccaacgtggagaaaccctgtctctactaaaaatacaaaattagccaggcatggtggcgcatgcctgtaatcccagctactcgggagcctggggcgggagaattgcttgaaccccggaggcagaggttgcggtgagccgaaatcgtgccatttcactctaggttggacaacgagagcaaaactctgtctcaaaataaataaataaataaataaataaataaataataaaatttaaaaataaatagtatttggattattatccctgtgttaacagatgaagaaattgaggcacagaggggattagtaatttatccaagattacacagctgataaagtggtagagctggaatttgaattcaaatctttctgactctataacttgtaagtcattgtacttcaaaaggcgaaattatgctccatgattacttgttaagcatgctatgtccagtagaataaaggaagctttaaccaaacttcattgttttgttttgttttgttttcaataacaaagtctactccacctaccttgcaacattgttgagagaatatatattaatgttgcaaggtaggtgaagtaaacattgttaaatatgtatttttaaattacacatatatttaaaaatatacacatatttttatatatatgatttttttaagtgctcataaaccatgaagccccacagaagtgcagggtgctattatttcctcttatgatttcactttctgtctttcatttcttagcatatgaattgtacttcttttttcaactttttttagtagttgccctaaagttgcaatatacatttacaactaatccaagtccactttcaaatagcactgtaccacttcatgggtagtgcaaatactttataataatgaaatatccctaattattccctccagtataactgctgtcattctttgcatttatatataaactataatcattcaatacatcattgctatcattttgaataaactatcatctgttagatcaacaagaaaaagttaagttttttactttattttcaactattctttctctattgctcttcctttctccatgtagatcagaatttctgacctacatcattttccttctctctgaagaacttcttttaacatttcttgcaaggcaggtctactggcaacaaattccctcaattttcatttgtctgagagagtgcttatttctccttcgtttttgaaggataattccacaggatacagaattctacgttggagggttttttctcaacagttgaaatacttcattctactcccttcttgcttgcatagtttctgagaagtcctgatataattcttacctttgttcttctataggtaaggtacttttctcctctggctcttccaagaattttttctttatcattgaatgctctggcatatttcaaaataactttttcctttctccttccagaagcatggattttttttctctgatattcactgtgagaacctaccaaagctctaagaggtaaaacccacacaagtgtgagaagcttccatgacagcctcgccccactgccccatcctagggtttttaactctcagacttgtccactgtgagtctcagcatttcttcaattacagtttaggttttcctcatgagtactgcttcactcagagatttctgtttctgagatgatgctccagcatgttgcaattctctgtatctgcttatctgaccccccagcttaggaggcagcagtttgccctgtgacctcacttctgtgaagaatctaagaatactggcctcagcaatatggtggaaaacacctctacaaaaaatgagccaggcaaggtgatgtgcgcctatagtcccagctatgcaggaggctgaggcaggaggataacttgagcccaggaggtcgaggctgtagtaagccatgattgtgcccccgcactcagcttaggcaaaaagacaccctgtctcaaaacaaaatctaagaagagtttgttcagtttttgcttgtggttagaatggagtgatgacttccaaactccttacataaactggaaactggaagtcttcctatgtatttgattcaacctgtttatatatcttatgcatctgtgcagggtaaggtttgggttgtaaattgataaagtacacgattcatggcttttgacaacctggaggagactctaggcggtaaactaaagcaagtgtttaaaaatggccttttgaggccaggcactgtggctcacacctgtaatcccagcagtttgggaggccaaggtgggcagattgcttgaaccgaggagttcaagaccagcctgggcaccacggcgaaacgccatctctacaaaaaatataaaaaattagcagggcatggtggcatgtgcctgtagtcccagctacttgggaggctgaggtagaaggatagcttgagcccaggaggtagaggttgcagtcagcctaaatcacaacactgcattccagcctaggcaacagagccacaccctgtttcaaaaaataaaataaaataaaaatggccttttgagacttctggttccaccaagatagagtagtcccatttttcctaggccctctcagaaaaacctggatataacacaaaaaacaagcataggaagactttgaaagttggaaagaagtcagactgcctagggatcccaagacttgaggaatgacatgtggtaaattccctagtttcctcatttcctcctaaatgtcggacaaggcactacagaattctgcagccctgcaccatgaataggcacagacaaaacaaagacccatggaaagcctgttttcctgagtcaaagaatagaaaaaagtgtggcccaacaatgaaaaacctcatcagcttcttccctagtccaaccaaacactgatggaacaactgcattccccaaacctcaacccccagcacagtttcagcagagccaaccaggaagttgatattccactctaccccttaacctatggaagtgggaggcagctctccagttccctgtgggtgactttggtaggtctgactgggagctgaccttttattccctaccttatagaagcagacaatgctccagttcccccagcagattgagcaaggagacaagcttacatccccaatcagaggcatcaaggtggtcgaagttggtgccacactttcactgggatgttgtcagtggagcaataggagagctgaacttccagcccaccatttgcaataagaccatgtgagtcagtacttcagttttgccaagttactgtcagtggggcccagagggaaactaaacatgcctgtgaagaagaagaaggaagaaggaagaagaagaagaagaattattaaataggatacaaatccaaactcttataatatgctatccaaaatatccaggatacaataaaaaatcattcatccaagaaccagaaaaatcacaacacggatgagaaaagcaatcaacggctgtcaaatgatgagataaatcaagtgttcaaattatctaacaatgatattaaaatagcatcataaaatgcttcaacaatcattcaaattctcttgaaacaaaaatttaaaacccagcaaaaaaaaagagaatttattaaagaattaaatgaaaattatagaacagaaaacaagtacaagtaaaattttaaaacttgctgtatgggctcgatagtagattgaagataccataggatagaatcagtgattgaggacagacagatagaacttacccaatctgaacaatagagataggggaaataatgaacagggtctcaaggatctgcatgatatttaaaaggaaaaaaaaattcaaagaatagctgaaaattccccttacttggcaaaagagatgaaacttcagattcaggaaactgaacaaatcccaagtaggataaactgaaagaaatctatgatgctaagacatgtgataattaagcttctgaaggttgaagataaagaaaaaatattgatactgaaaacagccagagagaaatggtgcattattgataggggagaaccaattcaagtgacagcagatttttaacctgaaaccatggagaccagagggaaatggcataacattcttcaagtactgaactaaaagaattgtctacctagaatccaatgtccagtgaaaatgtccttcagtaatgaaagggaaatggagacatctcagatgaaggaaaggtaagagaatttgtcaccagcagacctaccaaaaagaatggctaaagaaatttcctaaacagaaaggaaattataaaagaaggaaacttggaacacgaaggaaaaccacagcaaaaaaatatgggtatatacaataaactttcctcctcttgagtttttaaaatttctaaattgatagtggaagcaaaaattatagcattgtttgatgtagttctaaatgcatgtagagaaaatatttaagactattataaacagggtgataatgtaaagggaggtaaggtttctatatttaaactggtaaaaagatgacaccagtagactctgatgaatatatataatgtaaaacctagagcaaccactaaaaagatatacaaaggggtgcaataaaaacgttgtagataaaggggaaggggtgttattgtttaatgggtagagagtttctgtttggggtgatgaaaagattctggagatgaatagtggtgattgaacaaataacccacaggctcgcaggatacaggaaatcagataaatgaaaacaaagagaacacacagaaacaaaaaaatggcatacataagccctaacatgtaattacattaaatgtaaatgtacatttgcaaatataacaattaaaaatgagattggcagagtggattaaaagccaggtgctgtggtgcatacctgtaatcccagctactcaggaggctgaggcaggaggatcacttcagcccaggagtttgagaccagcctgggcagcatagcaagacccttactcaaaagaaaaagaaaaatgtcccaactctatgatgtctgcaataagttcatttcaaacataatgatacagacaggttaaatgtaaaaagatatacaaacataatcaaaagaaaacataaatggctatattaataccacctaaagaagacttcagagcaaagaaaattaccagtgacagaattggacattatatagtgataagagggtcaagaagacatggcaattcaaaatatataagcactagacaacagaacagcaagatatgtgaaataaaaaactgatagaactggaaggagaaatagatcaattcaaaataatagttggagacttcaacacccatctatcaatgattgatagaacaactagacaaaatcagcagggatttgaaaaaactcagcatcaccaccaacagacatgatttaatcaacattatagaatactccacccaataacaccaagaatacacattctttttcagtgcccatgaaacatataccaacatagatcatatcctgagccatagaacaaaactcaacaaattataaaaaattgaaatttgttcaatttgttcaattgaaattgaagttatgttctgtgagcacaatggaattgaaccagaaatacataatacaaaagtattatggggctcaggacagttcagaaggagaggagccctgggagaaggctgagctcagatggttggggcagttgggggaaagaagtgagctggctctggagggccaggctactccatatggcaccctgctgggcagaggcagctccatgccagggcacaggacttggtgaggggaacaggagctggacctcagtcccattggccccctggctgggtgccctcttacaggggcccaactgtacatggtgaccctggatgttggcctgggaacctgtgatcttctactacatctggggctgacagaggactcgggggctgagaaggagacatggtctcacgatttggagtagagagaaggcttgaccagaagggactggctgtgcagcaggatagctggaggcctattggctgggcatcctgtctactgggtcctgggccggtcttggcagcaaagtcagggcagatagcaccagcaagccacaaccgtcctgctccacagagcgctagaacagccactcatcagttacagcaggactataacgatgaccaagaagagaagacaaaacagaagagggtaggtagaccagaaagagtgttcagaaagaagcttgaaagaggagaggagagacactcctgagtagtagcaccaacctaccagctagatttgtaacctccaactactactttctggcctcagttttgtcacctgactaagagggttggaataaaacgaatttaagtctcttttacctttgactaggactgacccaggctggcctttcaccagctcctgtccccatttccaagggaagctgggtggggggtagagggtgtggatgacttagtgtggtccatcctcagaccaaaaacccagctaggggcccacacattactgtctgaaacaccatgctcaggtgtgaacaaagatgcttggttactgtggacttttagttccaaggagggctgtgtctttcttaactcaatggaagaatcaaattaggagcctggctgggcatggtgactcacacctgtaatccagcactttgggaggctgagacaagaggatcacttgaaatcaggagttcaagaccagcctgggcaacacagcgagaccccatctcttaaaaaaaaaataggagcccacatcttcagattcccagggctgagattctgggaaactcagccaaactccagagctgatgcaagtagcaaaggaccttttttttggtcactggagcctggaggacagacaagggcaagaggcagagaattccagcctttacaggtcacagagaaagtggaggaggaggaggtagctgatgcctccacacccaggagggagggggaaatgatgagcaagatttttcaccctttcagtaaaacaaaaaaaattatttctcctatttccttctctgagattaatgataaactgtctatcccctaaaagaaaatgataaagactctaattttacttggaggcttagaaatgccatttctacgcaaaacagggagcccataatcagacttgagcggggcagagctttgatagaaaatgttttcctctctccctctatttcttcccctccttccccttgcaaaccaagatgcccgacagctaagaacaatgctcaataaaatgaaataatattttagtcaaaataggccaagactgctcccagccaactgtaaattagcattttgagggcaaatatgcagacaatttgagataatgaagcctgattattcaatccaatgaatgttaactagggagcagaggctccactgccttatctcactcccttcgatttatttttttaatcgtttcacatttgaactctttatttgtttctgttttatgcgccccctcccttcctctgtcacacacacacacacacacacacacacacacacacacacacacacacacacacacagagtctccctcccttctctcctccattcctgcccaggctgcagaaggggaccgttgcaggggccatcagtctttccacccagcctggccttcgggatggggtcagcacgcctcatggagcccctactgtgtgcatggtcctttgtagagttgcagggatttgggggtcaatgtgcactaaacagatgacacacaccctgcttcttagaacaggcctgggtgcaggagctggagaatggcaggtttataaaggaacatgccaggtacatgtggggctcagggaagtgggggtggaaggacattgcctttcatgtccttcaatccaccctccatgaaaggtcaatgtggagcacgccctgtccccaggagtcatggaaaactttcttaaattatcctttgtcccaggcaggactcactgcataatttgcaggacccagtggaaaatgaaatgcaggggaacttgcccaaaaatcattgagaatttcaagatagtcatggcagagcattaggacaccaagcaggggaccttctgagctcggggcctgggcaactgcgcacgccacacacccatgcagctggcctgcctccagcagctaaggggcagcctcaggccagtgggaggtaacataatgaggccttctgaaggagggttgaagcccttctcaagtgaagagagaggtttctgagacgctggggagggtcccagctgactggggctagcccctggggttgcgggttgccataggcaggagccccaatgcctgaacagctgtcagcatggtggtttccccttggaggtacccatccttcagcctagagatgatgtttacttggtggcggaaagaacagctcccaactgggcgaggctccccgctgttacggtgctcacctggcctcaacctcctccttgggtcctggccctgctttttccctcacgagtgtggcctcccagtccctgccctgtccccatgagctcctgcctgggtccagcccctgcagctgcccttccctcggggcccccttaccactcctttcagtgtgtgtagcaggaagtccccgcctgagcatggcctcccaccttgtctgctctgctcctcagcttgccctctccccaccagacctcctgcttgtcgagtgccctgtccatcactctcatcttcccgctgcctctgctcatgctgggccctcacctggggggtcttcagcccccttccacctcctatctcctctccacccatttcttcacacccagccaaagaaggcagctctgccttttaccggatgtgctcttgagtgggtgatttcacctccttgagctttagtttccctgtgggtaaatgggattgtagtggggcctgtctcgtgaggtgagtgagaagaccaaccaagctggtgtaagtaaagccccgaccccgggctggcccacctgaatgtgcatacctgttagcttgcactctggggagcctctgggaagcttcagaatgctacagccagttggaacagctgccctcctagaacttccgtagcctttggaatcctggtcacgcagtgtagcctgcattcttacactgtttcctccacctgatagaagtttcccaagagtagtgtggtgagcacttaggacgtgctccctcagcctcctgtgccaccctccttttgtctggagaggctggaaaattaagagctgcatctcccagattcccttgcagctaggcttctggaagtgaattgggtgatactgatcagttagactcctgaaactcagaaggtggacatgagactctttcctgccctgggtttctaatggctatcaagatagtagaaacacaattgcctttttctgcaccagattcccattgtccatcctctagcttctgggtgtcaagagtcaaaaactgttgttttggtttcagtaatggcttgattctggtccttcctacccttccttccttctttccttccttccttccttctttcctccctctctccctccctttctttctctttctttcttcctttcctttctttctctctccctctttctctttctttctttccccttccttccttctttccttcctttccttcctgtcccttccttcccttcccttttcttccctcccctcccttccccttccttccttccttctttccttccttccttttccttccttccttccttttccttttcctttcttcttttcttttttctttcaagatagagtctcgctctgttgcccaggctggagtgcagtggtgcaatcatgactcactgcagcctcaacctcctgggttcaagcgatcctcccacctcagcttcctaagtagctgggactataggtgccaccacgcccagctaatttttacgttttttgtagagagggggtctcagccttctgcttcagattactagtataagccactgtgtccagctgattctgggtttcttgatctctgtattgcagctacagtggtttcaaactcaattcaaggggtggtctcagaggttgtagtgccactgggagttagttcagaattctggaattccttcctggatgttcaggttagaacctaccattctggcttttccaaaaattttgaaagtatctaattctctgttaagtctctctttggtgggtcagtgcagtggatcatgcctggaatcccagtattttgggaggctgaggtaggaggatcacttgagcccagaagtttgagaccagcctgggcaatataggaagacctcccatttctacaaaaaataagtttaaaaaattagctggggccaggcatggtggctcatgcctgtaatcccagcactttgggaggcccaggtgggcagattgccaggtcaagagattgagaccatcctggccaacatggtgaaaccccgtctctactaaaaatacaaaaattagctgggtatggtggcacctgcctgtagtcccagctactcgggaggccgaggcaggagaatcatttgagccctggaggcggaggttgcagtgagccaagatcgagccattgtattccagcctggtgacagagcgagactctgtctcaaaaaaaaaaaaaaaaaaaaaaaaattagctgggtgtggtggtgtgtgcctgtagtctcagcttcttgggaggctgaggtgggaggatagcttgagcccaggagattgaggctgcagtgagctatgattgtgccactgcactctagcctgtctcaaaaaaaaaaaaaaaaaaaacaaattagctgggtttggtggtgtgtgcctgtagtcccagcttcttgggaggctgaggtgggaggatggcttgagtgcaggagattgaggctgcagtgagctgtgatcatgccactgcactctagcctgtctcaaaaaaaaaaaaaatctctctttggttaaaaatgcccagatgggctttctacattaaatcctgacaggcacaagaataaactaagccatctctttctcctgcacccccactgcacagcacctagtgtaggtctccctcttcctaagaaagccgcatgtcccataccagctgacccggcaccatggctggcctctgagctgcccgagcacatgctggacatttgcctctttgtgcatcgttcatttcctgccgttgccctgctctgtcctgtaagcaggaagctgactcctgcaaattacatttcccttgtccacatgcacagtgccttgtccactggtttcttgttgggttcaaccaatgcaaagcactggtgagaaaccggagggtgagagacggggaaggccagagtatttcctgtcctctctctgcttccagtggcatctattttgtggagccagcttctgccaggcaacacctgcaccacggcctcccagctcccagccattggcccctccacagttaaagctctgccctggcaccccagctcctggagtcatgtaaatactatctccctgctctgactgtctagatctatgggtagtagcagcttcctgaaattgctaatcttcgagttgcctcaccctcccctgttttcagcttttccaacactgtcgtaactgggttctcaaatgaaatcacctctctagtgagctacctggtgagctgggttttcctgacagtgtggttcctcctatctgctacaagtggggttcggggccttgagccacgtcttccctccttgtggacacagtctgtctcccctgcggcctccctggccattttgtcctggcccagcctgaagaaacatctgggcaaaatccttcggggtccctttccccagctgaggagtgggggggcgcaggggaggagccagggcgaacggcagctttcgccaacacctcactgttctcttctcgacatgtttactcacaggctgtctgggaagtgagaatcctccctaatggatgtttcacccaattaaataattaactccaagtgttgctaagcatcctcgcctctcaccttccagtcctggaggcgtcctcatgccaggctgcggctgctgctgagacaaggagcctagtgggaggagccaggagtgggggacagtgcccctgatgcttctgtacaggatgagggagataaatgcacctgagagggaaggtaaggagggctgttcagataggaggctgaggggaggctgagactcacaggaagtggcattagaaccttctggagcctttctattgaatattaagtccttgaaggtttccctctcccccaattcttcccatacgccacagcagggtccttgttccttcaaagaaggggaaaggaagggacacaggcttcttcctaatgggtagtcttgcgttatgaggagttacagagctgagctgctctactaaccagacagtcacataaggaaccccgaggggagaggctaaatacattcatactgtggaatatcactcaaccgttaaaaagaacaagatacattttcctgtatagataggaaaagatctgtaagatactataaagtgaaaaaatgcagataccagtacatgcagtttaatttaagtaaaaataatgtgcacatgtatgcatatacttgtctacctgtggaaggaggactggaactagggacaccaaactattccgaggggtgatatatagaacaaagctcctttcatgaaaaattgaactcacatttctgcagtgtaatcacacattctatctggatttattgtttaattgttttctattgtcaaacatgtctaagttattgacattagaacagagaaactccaacagagaaagggagcacagctacattttttttcttaaagattatatactatttctttacatggatgtcttgattgatttagttattgattcatattacaatggaaggctgaatcaacttatacggctttgaattaattgtataccttctattgatgagtgaataaatagttttttaacattcaccacaaaacatataaacattaacaattttgtgatattttacataaaacgtgcaagaaattctaaatttgaaattagtatttattttatagaacatattatgaaatactttttaaattagtaatcagaaaaaagatgattaaatagtaaaaacaatcatttgtatttttaccagatatcatcacttttaaaagtttggtttatattcttccagatagaacaatatactaaaataatataaataggttattatgtcaacaaacatttatatatatttttacagctggttacccccatgcaaaaacgtgccatatgtaatttttctatctaatatatttgaaaatgtatgttatttaaaagttttcctattgtaaacaatactataatgaatattattaaagacagtcttaagttagcaaagactgaaaggacatgttctctagtttagagtgtatgacattcaatcaagacctagaagacttatgccatcccccaagaatgtactaaaaatcatctgggattatagaaggaattcagggaaccctatctgcaagattatttacatgccagatccagtaatttatgatcttcttggtgtctgtaaagtcataaaagtcacaggattacaccatagtcatttgcttgaaattgcattcaagatatctgcattccattccttagatgctttccaaaataataaaatacctggcaggattctgtgtggaatctcagtcttcctatgtgggatgatcacatgtagcatccttagtgccaaacctaataaaacaagcttattgtttttggttttggcttttttttttttttttttttttttggagcatggttgaaaaaacttatgatacccagaacaggtttaataaatttttctaaactggatattgattatcaaagccaattatatgcctctaatatattgatttggagaatttagaaaatcaaatatttcaaatatatcagaaatctacatactaataaatttaaatgaaaaaatttctattaactaatgtatgtcagcagcttttattgacaaactcattttatttttccaaaggcatacaaagtagtttctataataaacctggcaaaaatagatatctagctagcattagcccaataatacaaataaaatcaaatcttgaaagaaatggaactttttaccattccagatagtataataaatgtaatagtataataaattcgcatagctctataacgcagatttggctaaatatgactctataaaatgacatttaaaagaacagtgttgtatacagcatatggatgacatagtttcttacaattttatagtaaaataataattacctgaataaggtaacatcaatcacattcatttaaaatagttgatttataaactagcttgattttaaaacaaataaaagaaactatctactaaggtaacaatgagtatcaattagagtgtcacttcacaaactttaatgttcatacatatgatggcatcttgttaaaacagagcctctgtttcagtagttctgcaccgacctgagaagctatgcttctcacaaacttcaagatgagattgatgttgttcttctatgaactatactttgagtaacaccagattatgagattattaataattcaaaaaataagcttattttttaggaaaaagtataaaaaaatcaggcattcaaactccacaaaaatactttttaagccatattacaaatagaagctttaaaatacatttcttttctctgcatggtttatgaatcttcatttataggactggctaacattgacacaaagttcacagtgggtattatatccatatatctacataagatgttcagcttctctcattctcagcaggtatggtctcattaacacctgtgattttaaaagcctgagtttctcccagcaagatgtagttttattaatatgtgttatatttatatatctctcactttgctatgttataatgtggaaccaaacctatagctattgctctagtatctgtttacttcataaatattgactgctagaggtgtgaatcctactagggtcttttgcataattatatgagggtaagcagtaaacaaaaatgactgaagaataaatgaaaataataacttagcttaaatgtaaagtaagatgacaagaataccatgaaataagagtcacagaaagaatgtttgctgctgttatttaaatataaatgttattatttttgaagaaataaatgtgtatacatctatctctttcagaagaattgtgaattgtttacaaatatattttctgaaatatcttttttttcttagtactgaggtctgatggtaaatgtttagtaactagctttgtataataaaaagccagatttatggtgttttcagattttcatggtgtaaaaattcccagtggccaatttcaaactactgacatgagatctcggaacatagcattaggaaaagatgcagaaatgggcttttttagaagccagtgcataatacttccaacacaacagtgacttagcagactgagcgtcactttactttaatgattaatcacaataattgtcaactgacattttttatttaatgacttataacatggttccaattataaaatgtggaaaatataagtaaaataaagacaaaattaacaataaatctaacacccccaaaatgattgttacacatatgtatatatcctttgagagcttttattaaaatatttatacttgtatttgttacaaaattgaaaatgtgttttatttcactttggcattctacccaaactgacaatatactataattttctacaattattacttattcctttaaaagtacatacaaaactgaatgaaactctatgctcccaatatactaaaatcaaatgattttattctctatagtttatagtttatattctataaaatctatagaatgattttattctctaaatatacatatttagaatgttttgaaaattattggtcaatgaacattctgacgcagaaatccttgtaaatattacctctgcttctttagggtaaatacctaaaagaggaattattgagccaaaaagtgcaattactttgagggtttctgataagtgtccctaaattgcactcaggaaaatttgtgtaagtttaaactcttaagtggagttgctggagaccctctttcacctgattcataaaacaatcttaattagaaagaagaaacaatccaaatgtctttgaggttcaagtacaccacatactatcgcatttaatttttatagtctttaattttattagttcaatttttcatatttgaattgcctgttagcattctttttcttttaatttatgtaggactatttacataataatgccatcaatcatttttatatgtgtgtcaagtttatcttctattgaataatttatcttcataattttgttcataatatttattgaaattagaatgcataaatattaaacttaaaattatgttatatagtataccatgcatgattataaatattatgtcaaatgtataaagtggtttttgctgtcagtttctgatttctccacccgatataattattttatattacctctaatacaacagattcaattctggataatttggggaacaacataagaacagtagtaatcaaaactaaataaaataactacatgcagtttacaaaaaaagttcacatcctatgaatatatttaaattatacttcacttaaatgtatcatttcactatgcattttctattgatttcataatcatattcctttattccatttttccccctctgctggcagaaagtttctattttctgttggcatttagagtatcctaacatttacaacatgcattcatgatgtattaaactataacatgaattaatatttgcctcaatttacagcaaaatgaagaccttctaaaattgtaactccatttatttttcccttccaacttccatgctatttttataatacattttagtatatgctatgactcccaaaaacattgttattgctattattatgctacattgtaaatattcatttaaatttacccactggaatacaactttgtgtttcttattacttcctgaatctataaactaccacttaataccatttcatttttgtttcaaaggtaaccatgagtgtgggttctgtcttagtgaattacttcagttttcagtgatctaaaaaggtttttgtattatcttcacttgtgaagttttaactgtatatgggattgaagattagaaattattttctttaggccgggcgcggtggctcacgcctgtaatcccagcactttgggaggctgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggaaggagaatggcgtgaacccgggaggcggagcttgcagtgagccgagatcccgccactgcactccagcctgggtgatagagcgagactccgtctcaaaaaaaaaaaaaaaaaaaaaaaaaaaaaaaaaaaaaaagaaattattttctttcagtgcatagaggttataattctattgtcttttcacttacattgtttcatttagcaagttaagagtctaaaggtgttcttttaaaggaaacgtgtttttcccctgactgtccatgatatttttctcttttactctatgtttctgcaattcctctctgtgtcatcaggttttgaattgctttctgtgtttttctgctttggattcatgtttccctttcaattaatagtttaattcatttagaagcatatcttccttgttcttgctctactttcttgagcccgtaattatatgtaagacttttcattaacctttgcactctacaatattttctatccttttctttactatgtttgattctacatattttattctaacatacctgctagatcattaatttccttatcaactgctctcaaacctatcttttgtgttttttatattgtttccttttcacatctgaaatgccaattttaagcattccaattatttaataaaatgtttatattttgttttttatcttcagaataattctactacctgggataattctactagtgatgcacaatttttgttccttagctcagctagttcagattcttgtctcacaaccaggaagaattagacaagtggacatcaaagagtgagtggagtagaatttattaagtgaaaggaaagctctcaggaaaaaagagaggatgtgggggttggttctcctacccaaagacaggaaagttccccaatatggctgagcccagggttttttgtgggctgaatagggagtgtgtgctgattggtttgtgagtatgcagaaaaggttaaagcaaagacaccactcaaaggtgggcatgacaacatagaaaaccaattaggcggctgggtgcagtggctcatgcctgtaatcccagcattttgagaggccaaggatagtgggtcacctgaggtcaggagttcgaggccaccctggcaaacacggtgaaacttcatctctactaaaaatacaaaaaattagctaggcatgttggcacgtgcctgtaatcccagctactcggaaggctgaggcatgagaaacgcttgtacccgggaagtggaggttgcagtgagccgaggtcccaccaccgcactccaacctgggccacacagcgagtcactatctgaaaagaaaaaaaaaaaataggtaaaataggtgaaaaagggggatcaatcagaggaaagcacacaaaacaggaaggtgggtcctcaatccaatccaaagatttacccagcacagtttccagcttgaatgttggatttcacggggaactcatccctatctgccttgggatttgtctgcctcctgtctctatcaatcactagctggccttttctgttattttgctctttttccttgttttctttcattttgttttgcctccttctgtgctaggttatcttttattttatgctggatttatatttgaaaaatttattttgttcacttgcaatactcattacagatacaaagaatggcattgttttatatttttataatttatttaatgcctgacttaatataagacatgctgatttattagatctacttctgctttcggtatgttgtgatatcatacattatgtagtctctggaaaactctacttactttacacatgagagagaaagagagagagaatgaaaaaatcaaataagatcttaatattgttatattatctcaggacctcatccctttgcctcttgagagtgggatgttaatggcttcacattgctcctgattcactattttttgtttgtgccattaagtttgtcaaaactattgaaaacagtagagacctcacttatacagccattgacatttattcctctttttgtaacattatgaatgctaatctcaaaagcacaaagtttgaaaaatcgttgcttttatctttaaattacctgggtcttcaatctttcatccctttggacaagtggaaaattccatacttgtagtttttgctggtaaagtatctgaaactaccctgtggtaggcaccctctgagataaaccctaataattcccgcctcctagtattcacagccttaggtcatcccatctttaccttaagtgtgacgtagactggcttcaaaataattctgagaaactatttcactttcaaaattataggctatgaaaagactgtgatttacatcttgggtactctctctcagatggtctcttgaatggctcactctgtggatagccagctttcatgatgtgaggcagtctcagatggtctcttgaatggctcactctgcagatagccagctttcatgatgtgaggcagagtcttgtggagtaatccacagggtggtggtgttgaggtccaccaaaaagcacatgagtgagtttagaagaaggtccctccaccacctcctttgaaatgaatcttcagataagatcacaaccccaactggcaactgcacagcaaattcaggagagcctttgagccaaaggtgcccaaaagccatgcctgaattcctgatcctcagaaattgagataataaatgcttgtttctttaagatacaaagacttgtgctaataagctatgcagtagtagatagttaacacagtcttctctttcctggtttatcacatttgtgccaaatattctctttgctcaaactcaagcccctacttctaaaaatacaaaacattgcatctcttctctgaatctttcttgaggcaggttcttaaatttctatacctccatatgcacacaaaacacatattcctcctgacatctttctatctttcagaaccgttgctggtgaaaagagtgaaggtcctctgcgtacttttttcctgaattctcatggacctctctgccttttccaaataagggcaatctcctttccttgagtcattgttttcccacaaatcttctacttgactgaagtgttcagggcacataggatgacttcaatatgcctgaatttacaaaagacctttatcttgttttttatttttgattctattacagtatctgaggaaaggagtcaagagattgcctttctgtgttatatgaattgagagaaagttctgttacacacacataaattaataatttaatttttcacctcaaatcttttcttaaaaccaactaactataattttctaattacagaacaacttcttacatcagaaaatggctctacatttctactcagaactctctcagtttaggactaatcttactaactcattaaaagcttactaattcattattaaaatgctctggtttccctttttataagttgttcattacagtccatgtccaaatggaatggacctttctttgtaattctttacacactgtcttaggccagttgggctgctataacaaaaatggcatatactggatggtttataagaaacacatatttatttctcacagttctgaaggatgagaagtcaaagactgaggcactggcagattcagtgtctgggagcacccatttctcatagatgacatcttcttactgcacacttacatggtgaaagggtctagttaattctctgtgttctcttttataggggcactaatcacagtcatgaggatttgacccttatgacctaatatccacccaaagtcttcacctcctattatcatcacactgggggttcaaatttcagaatatgaatttggtggcgggggcacaaatgtgttatgggggacagaccataacacatatatctgtaattgttttattttttcagaaagtgatcgtattatttctgtgacatgttatgccagaaaataatactacctttacgcttgaatcacaatgtagctatcaaatataccttttcctataaaactccattacatagcatttaatatttaaaagtgatatttgaggcaaattattgcctcacagcttaatcctttcattccacattcaaagcatctcccatgattgtcctcatacaacaacaatctgtctgtgcacaagtggattaattcttatctattttatactttaaacacttacacttctaagtgttctctacatacttccgattagactgcaattacttctgcaccaacctaatacaaaataacttgtttttttttaattttgatcccacaggccttaatttgtatcaatcacttttaataaaagtgaggttaagtaatattttttgagtctctacaatttatttagtggcatatacactgcagatctcattctcttatctttcacattagtgatgcagttatatattagaacaggaccttattaagataataatgaagatatttttcactgctccagtggtcacgattggattttcatcattcagatacctaagaacagtggtccacagcctttttggcaccagggaccagctttgtggaagacaatttttccacagatggggcacggagtacagtttggggatgaaactgttccacctcagatcaacaggaattatattctcataaggagcacccaacctagatacctcacatgcatggttcacaatagggttcatgctcctgtgagactctgatgccaccactgatctaagaggagacagagctcaggcagtaatgcttgctccccactgctcacctccggctttgcggccccattcctaacaggccatggactggtacaggtccctggcccaggggttggggaccgctgcctaagaacataaatatggaaatatttttgctcaaatgcacctaaccttcagatggctaaaaaccttttagcacccggggtgtaggattgagagtggagattactggctgagagaaacagcaaaaaacattcctcccattgaaattaaatcactctacaattgggtttaattgctggacctacctggtaactaacaaaaatactaaacataattgattgcctcatcatttgaaaacaagaggtcactgaatcaaataaatggtaggaaaatttagaaccaataaaacaaaacattttggataaaagttatttctctcttagacctgttgccatgagagtcccataaatgaaccagatttatagttagcagactttctcagtcacttataaataatgaccactgacacataaaatgcattcacaagtagatgcttagattaccacaaaggccttaagacctaaaacatcaataatgtaatgagctttgttttttgctacagacaaacaaaaaatacaccctgcaattttataaaaaattcaggattaaagatttatgtacgcttatgactcaaatgtaaccattattgtaagaatgcatggtaagcatgacattgtttcactagtcttgctacatcttaaaattaattcgttcattcatctgtccatccagaaaggatgttactatgatatacagcttctaaatggcccccaaccaatccccaaatcttgtcattgtggaatcccttcctcttgagcatggactagaccatgtaactcacttcaaatgaatgcaatatgaaaaaagagatgttacttccaagactgattataaagggattgtgactttttctctactaggccctattttactctctctcttttttctttttctctccctttctctctttctgtctgtctctctctctgttcatctgtctctcactctttctctctgtcaaaaccctgattctaaggaaaacaggaaggtatgttttagtgaattctcataattttattttggcccagcatccattttgaatataaatctaactttctcatactagaagcaggactcagtcacacttgacagtttccagttctttaaccacatccaccctcagttcccaaatgtgattggtccacatatttgcctgatacaactgctccctggtgaccacttctacttccctatgggacagctagacatagcctacctgactgaccccactgaccctcagacctcacatggactgtacagatatgtcacagtgactacctgtcagtcacagcactacgtcctggaactctaaaacttatgtttgcttgctttaaacccaccacttagaactccctgtgggtaacctatttagataaggtcctggatccaataaaggcattggctgatagggttctctctctctctctctctctctctctctctctctctctctctctctctctctctctcctctctctctctctctctccctccctccctccacactccctgatctcttcgagtggcctccagcatgcagtgtaaatctcaagacctctaagtaataaaatttttattttcatcttgtgtcttgccaaatcgttgaaagaatactctctatcttaaggatcctaaattaaaatacatgctataaacagccctacagagagaggcacatgtgccaaaaagcttatctttctggctaactgccagtaacaaccggagggcagccaacagccaaacaagtgaccttataagagaattccacccccagtggagactttaaataatcacaaccctggcaaagaccttaactgtagctttatgagaattctgaatcacaggtgcacagctaaatagtgcctggattcttaattcagacaaattgtgatataacaaatgcttgttgaataagttcttaagattgggggttattttttatgaaacaatacataaataaagcagttaagtattaatacatagactctataatcaaatgacctgtgatgaatttctggctccataattcttagcttctttatcttagtcaatttatacattttttatatatcaatgtccttgtttataaagcaggtataataatagtacctctcacatcaagttctttcaagtttaaaacccaaatgtacatacagagatcttagagcagtgcctgattcacagtaggcacttaaattttagctactgaagctcatttatttgaacaataatattaagactataaaaagttactaatacactttgcgaaattgagcaggtgacataatcaccttgggtctcggtattctttcattcattcaaaaatatttaataagcaccaattctgcatcaacctgcgtatatatttataataagagggagagaaagcaacaggaataatagtgctgccactaagtgaaagaggaagactgcaggagaaacagatttcagggagaatatacggggcagtcaaataccaagagtgaagttgtatgagctgtcaatgcttgtgcagttaatatgttatcattatctaaggagcattatctaaggagcagtcattctcaaacatttatgagcatctgatatagggcccaagaagttgcatttcaacaaaatgacaaataatactacagctgctgctccaggaatcacactacagtccattaatgtggaatatgttaaaacaataaaaaaagtgagtttgattattattatcatttataataatcggggaaaaaatgcttgtccccctaaatgtaaaaccgttcttggtttaattgagaaataattgctatggttgctgtggaatttagtaaattttataagtataaaatataaccttccaatcaacacatttttcctacataaatttaataaacattgcattgcacgtggaaattaataagtggaaatcttagttacactgtcagttccaaaataaacagacttagcttaaacatttgtttcaggtttaagttactagcgacatagaagttatccctatctatttaatgttgtgcaatgttaattaaaattgtatttaaaaattttttttcaaaggtttattcctactatgtattgactttgtattggaggccgtattaaatttccatatttgctcttacatttttaatatctttcttaggattttctacataaatagtcatttgtaaacaaatgtgttacgctcctttatttccaatcagtatatttttaaacgttttttcttgcttaaatatattagctacggtctctagtagaatgttaattggaagtactgaaggcaaatgtattttcgttcttcaaaaattaggaaggaataatcaattttctaccattatgtatgatccttactgtggaatttttatagatagcctttataaagctatttatatttttctgaaaatatttataacgaataaatttttaattttgtcaaaagctttttctgcacttcttaagatgaccatagatttttttaaattatagcaatgtggagaaaataccttaattgattttgaatgctaaaccaatatttcattcctggaataaaatcttttttatgttgccagatttgatcgttaaacttctataaaaaaatctttgcattatgtttaaggggtactcctctgtatttttaaagttttgacataatatggtctacaatgatgaattcctaaaatgagttttaggtattttccactaattttttggaaaaattttgtgtaaaagtattattttttcttgaaatattttatataatttaccaatgaaggtaattagcccaggatttttcttttttggaagatttttatttattaatttaatttatttaacagacatggtgttattctggttttatgtttcttcagttatactgtagtttatattatttaaagcctttgcacatttcatcaagaatgtcaaatttgacaaagatttattgacactttttcctttttattgttgtaatacttgtagtagagggtagcaaacttttcttctgtaagaggccagattggaaatattttaggcttctcagttagtgtagtctctgacataactcttcaaatctgttgtaatgtgaaagtagccatagagaacacaaaaataaacggatgtggctatgttctagtacaattttttttttcacaaaaacaggctataggcaatacttggttttgagaacttaatatgctgattctaatttagagatatctagatgtataaataggatcaactacaatgtgccctgttgtattacagatattgtcaatttgtgttttttcttttttcctcatccgattgtctagtggcttttccttttcatttatctatccaaagagcaaaattttggtttgatacattttctctatctatttttttggatataactttcttttctaaaagtttgggtgaatatttaaggcatgcgttttaaaccttccttcttttctaatacaagcactcaagatttataatttttctaagcatatagaaggaatttgtaccccacacgttttaataagatatttaaaaatctttttcagtttgaaatattttctaaatatccttctgacttcctctttgattagttagttatgtaaaagtgtgtttcttatttttcaaattgttctgaaattttccagatatatttttgttattggtttctatttaaattcctggtaatgagaaaccaaactctatataacttcaaatctttgatatttcctgagacttttaaaagaatcactcaacatatgttccatctcattaaatgatccatgtatgcttgaaaaaaatgtttatctattgcaccaccataattcagcctggacgacagagcaaaattctgtctccaaaaaaaaaaaaaacaaacccttgatcttatcctttttgagtatagtttttataaatatctgttaggttataaagttgtttaaatcagttttgtctttatttttgtctattatatcaattactgagaaatagatgttaaaaatctctaaatatatttatgagtttctgcatcatggattctgaatatctttattggttttgtcttcattggcattgtcatatcttttaaacaaatttactatttttaaattatgaagcactactttaagacggtgagtggcagcactcaccgtcttaaagtgtattttgtcggatattaatgtgaagacattagctttctataagtggtgtttgcatagtgcatcttaaattttaattttaactataaagtgaatattttatgatcagcatataattgtcttatcatcctgataagctctcattttaattggattgtttggtatctttatattttgtgtgatttgttatatgttttctattatgcctaccatattgttatttgacttccactgttttctggttcataacttttctaaaaggaagtcagtaataattcataatgctgttttctttatttaatgtcatatttttctagctgcttatacgattttttcaacataccttaaatgttccattatattatatgtgcttgaggttctctaaacttattatgtctataaattaatatcttttagcatatttggaaatttttgcctttttaagtcttctaaaaaaaagtcatcaaatatgttgttattccacaaatatctcttctctttctctaggatatcaagtacactgctcttaaattgatatgataaacctcttaaacccttaaaatgatatgataaacttcttgatatagtcccacagatcacaaagattcatcatttttctccctaatggtccctctatgctcttaaatcagatatttctattaatttgtctttacatttgctgactcttgtttctatcatgtttattatgacaatcagttcattcagtatttgtttttaattttagaaattttgttttttaaatataatttgcttttggtttaaaaaatcttattttggctaaattatatattttcatttattatgaacatgttttcatttatgtcatttatcattactatagtagctactttataattttttctgttaagccaatatttaattcatctcaatgtatattgcagttgattgcccctattttttgcaatgtaggtctgctatggtctagatatttatgattcccaaaactcatatgttgcaattctaaccccagggtgatagtattaggaggtgggaccttggcatgtgattaggtcatgataatggagccctaaagaatgggattgctctgcctgtaaaggagacctcagggagatttcttgctccttcacccagtgaagtcgcagaaataaaatttagctctgaaccaaaagcaggccttctccagatactgattctgctggtatgatgacattggacttcctagcctttagatatgtgagaaagacatttcttttgtttataagctacccagttgatggtcttttgctatagcaacacaaatggactaagatagggttatatgtgtttttaaaatcacacatagcctaactatgaaagaatgaaaaaatatatattcagtaaacaaaaacagccagaatggccataatgatatcagacaaaaaagactttaagccaaaacatgtcacaagagacaagaagaacattatataatgataaatgggccaattcacaagaaagatataactattataaatatacatgcatccaacatcagagcacaaaaatatataaagcaaacattgataaaactaaaaaaagaaatagcaagacaacagtagtagcatatttcaatattccattcttaataatggataaaacaactagacagaaaaacaaaaaagtaacatttaacttgaacaaaactctagatcaaattaaccaaagacacatatagagaacatgccacccaacaacagcagaatacacattcttttcaaatgcacatagaacattatttagaatatatcacatttggcaacaaaatatgttttaacacatttaagaagatagtaatcataccaagtaaattttctaatacatatggaatgaaactagagattgatagcagaagaaagactggaagattcacaaatacgttgcaattgacaacacattcttgaacaaccagagtcaaaaataaatccaatgggaaattaaaaaacatcttgagaccaactaaaactgaaacacaattcaccaaaacttatgagatgcagcaaaagtagtagtaagagaaatgtttatggtaataaatctctatgttaaaaacgaagagagttatcaaaccagtaacctaactttacacctcaaggacccagaaaaacaaaataagtccaagacaaatgaagaaggaaatattaaagcttagtatagcaataaataaaatagagacaaataaaatgataaaaaaatgaaaattagttttttttaaaagaccaacaaaattgacaaacctttggctagactaaaaaaaatagataaggctcaaatgaataaaagcagagttgaaagagaagacataattgatgccacagaaataaaaaatgacagtaagagactgctatgaaaaattatatgccaacaaattgagtaaccgaaaaagaaaatggaataaaattctgaagcaaaaaacctaccatttgtaatagcattaaaacctgaaatataagaaaccagatttatcaaaatatgtgcaagatatttacattaaaaactacacaatattgctcatagatattaaagaagaccaaagtaaatagagaccatgctccttggttgaaacagaatattcttaatattccaattctccccaaaatgatctatagagctaaggcaatcccaatcaaaatctaagctggctttaaaatagaaactgaaaagccattaagaagttcttgtgagtgtggctggttggtctagggctatgattctcacttagggtgcaaaaggtcctgggttcaaatcccagaggagcccaacttttagttcaaaagttcttgtgaaaacaaaaataatctagccaaaaatattcttgaaagaggaagaaatttggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaagaaagaggaagaaatttgaagatatacacagtctgcagccagacacaaaaaaattacatattggatttttcctttttatgaaatgtccagaaaagagaaatatataaagaatacataggcctgtgatttcctggtctgggagtagaaaggatactgactgtaaataggcattaaggtatttgtttaaagtgaagaaagtactctaaaactggattgtagttatcattgtgtaacaaatatttgtgaaaacaattgagctgtttgcttataataggtgaattttatagtatttacattatacatttataaaactttttaaagtatttttaataaagctgtgtcattaaaaagaccaataatctgccattcctaacatgtttagtaaaaaaacatgaaacacgcagcataaggattttaaaaagatacttttttgccaggttaattattttattttaaaagcgaagactatttttttcaaattaagttagagaatcacccaacattataattctctgggaaaatgtgaagttgtgacttataagtaaaaaaacctgaagaccatgactccagaaaaagaaaatctaatgcaaagaaattctccttactccaaattttgagtcccacacattttaaagattttttttcaaatccttttatattaactaatttatgatacttaatgggtcccagattatataaaaattcttattctatttgattccaaaatctgatggagcacagaaaacaaccaccacaatatcgatgagaagaaaacacaacaagatgttatttaggaatatcgggggaaactttattacaaagctgggaaattgaattcattttatattaagaatttaataagctcttctgaagatgaattcatttcatgaacatttcagcttataaatataaatacaattattctgtgaatggtacagagtgaaaaatttaatgattgtcttgatagtgatttaaaaattatataaaagtatataaacatctctatatatacgtataccacacaagcgttgagttgattttactgtgaggcatccacattaacatttaaaattcaaaaaacaattttttcaggcatataaatggtttaacatttgtttccggaaattctaacaagtgaaacttgacaagaaaacaaaaataagtgttgtgattattgaaagaaaatcaacatatacttctatttgctggtgatatgattattctattgaaaagaactgttcacgtttaaatgaatagcattaatgtgatacgcacaaaatagtaagcttatggcacagaacttttttgagaggccaatgtagaaaacaaattgttattaccctgatgatatttttataagagaaaacccactaatgtgttgattgaacagaatttctatcaaaatctcaatatacattttgatttaataattcaaaaaatatttacaaatactcaattagaggagataaaaatagattattcactgaatgaatgactttgatgcaactttctaacgattcagggaaatttaaagttagattcctcccccacatttactgaaaactaaatttatttcatagcaagtatatatatatatgtggtaagagaattattacaaatatagaatattatatgtaaatatgtataaaagtttggctggagaagaactgcctagttgtgacactaaaagtggagacaatttaggaacctatttaaatatgtaacaattaatattaaaaagcaaataattttttaaaaattataataaatgcaaataaaaagcattactatttcataaagagctcttacaagtcaataaaaatttaaccggtagaaaaatggataaaagttcactgaaagtaatctctaaaataaataatttgaataattaataagcatctaaagaagcattgcacatcaatacattgtcaaattaatacattttttaaaatgacaagctgtcacatttttctgttcaataatcaaaactaaaaatatgttgcaatatccagcagtgactacaatgaactgatataggcactatcctacatatttttaagaaataaaaactcgcaaattttctggatgtctacttgctaacttttaaaaacatttagcaaatggaatgtgcatttgttttactaaactattcctttcaatgaattaatcctaaataaataataaaagtatgacacagttacagggatctttataagttatgtttataggagcaaaaattagaactatacaagatgctaaccctctattaaagagtcatatttcctccatacaatggagaactgtgagcccattaaaacctgataatgtcatgatctctaatacatagtcaagtgtaaaaataggtagcaaatcaaaattatcttctctcaatgtacatctgtgcaagtctgtatatgctcacatgtgtgtgcataaatcagtatttcatattaatataaaatatctaggtgaaccacatgttgaccgtggctttgcattgggtttatttttatttttgtgtgtgttgttacaatagaatttgtataacaagaaagaaaaaagtaaatatgttaaagttaaaatatctacaaagtacaagaaatatgaattaaggaaaagtagagaaatggaatcctgagtcttataaagaataacaagaataatatctattgtgacccaaacttaaaaatttccctcttttgaccaatttctcaccctgtgtgttattagtcttcttttgatatctacctctaatttatgttggattaactgaggtaaagacacagacacatttctctgtgtcatttgtattctggcacctctctctatttggctcaacattagactgtcattttcattttctcaggtaattagtgataaccgtgtaccaaatattaaatatataattcatgacaattacagaacaatttcctggggatacaaaatatctgaaatataatttaccctctctgagtgttgccagttgaataaaagagtttaaagttattatgttgccttggctatgtccttatttctgtcttgcaatgcaattcacttttggattcttgcctgtattcctccaacagatcaagcaacacctaactaatagcgtaagaatctggccctctaattcaattcttgtacattttctggaaattaaacttgagaaattgacttctattgtagacttgatcttagattactgtccatgatctctggagtttttactcttgccactgggatcctaaatttgtccccttcctagtctatcagaaaagtacacccagcacattggggaataataacaattaattaaagacagaggataaagcctattgagacataatacttcctctatattaatgacttgggaaatgtatttttatgtaatcaacagaagcattgagtctctattacctaaattatctttatttgattagagacattactaagaaccttaagctttgtaataattgaacccaatattttcaatatgtgaaaagtgactttagtccttgaatattatttatttttgttatggctacacaaatgtatgcccaaactgtattctaacagatattgtggtaattatttgataacaattacaaattgaatggttttcatttaggaattttaaagccagttggagtgaaaatgtcctcatcttctctgggacaggtaaggaagtaaccagtaagtttgaaaaatatttggaaagttacatttaatttcgtaatcagtgtattatttcctttatgtttagcaaaatttgttggttcttgtaataagtttggggtcttcccccaactgcataaagatacataaattgggatttttgctgactcaagaaaccttagccaaatttcattgatatttcttcaccattcctctattaacaaagtttaaaaaaagataagaaatatgaactcaaagtatacttttatgattactattttttaaaatcacctatttttgtgactgctttattgaaacactgaatcacttcatgtatctgcctagtgactcaaaaagtgttattacaattcactttaaatgaaagtgccactcacaatcttgataattaatgcaggtaaccggctgtgtgagaaagttaacatcagccttaacctcatgcactgaactgtttttcacatgtcagataggcatttcattttgaggaaagccatgtttttgttccttttgtggttggaatttataattaattatacaacatggagatgctgtattttaattataaaacattttaatgtggaacacatgagacctaggatacagaatgtagcaatcaagttgtacaacaaataatcaaacctctaattatgaaagctacagtggttcctgaaatctaaaagcaaaagtcacaggatggtttatttaacaatagaatttattatattttatatcttcttcaaagcttactttgtttttcctcttataggaaatcctttttacctacatagaaaagttacgttattggaatttacatccctcctccataagaaaaaagacatcttctcttccaaatgtccaccatgctaattttatctctttcttattatatttaactttaaaaatcttgatcattataattgctgtgggtcgtatattcactgtgaatattctgtgagagatgacagttttattcttaataacctgcatattaagaatcgccatgcctttttcatggttagtgttcaatccacatgttaaaagaatgaaaaatgcattactgaattatcttatattacccttttttgcagaatcattctttgtagtgttagtgaaatatgccgaatattaaaataggaaccaaactttttataaaatgctgcctctgctgtctcacaatgcctaatgctacctctaaacgatagttattattcttttctgtcatataaagaaacatagtcatgccaattggttttttgccactatatatccagtgggaatcacacagagaatcaattcattacaatgataaattacaccattaaatagtatattatgccagaataatctagaaggtcatgaaagaaagattaagagatgacaagagaatctacaatgtgtaagaaagtgcatgatacatgaaaaaataggttttggtttgatatctaccaaatatgttaaatgaatatataaccctgtaaaaattgaaaaattacatacttgtaaaatcagaataaaacttgagatactcatcttttgtataacttacatgaaattgtaccaagtgatgactttttaaatacagttctagttatttcatatttctactcaagtaatgtggtttgctccataggagttatttgaaaataaacctcttttcaaatgctcaaatctattattgttctgtcagttgtgcaactcataaatactctttcctattctcttcaaaacacagaagtaatattaaaatcagtgggaaatattcttagacaagtcattgatacaaaatattaaacatatataaaaagtaaactttaatattcaccatgtatgttattattttatattcaattttataatttgttaacacacaaaagtattatgtcctgaccatatcacactatcaccgcgggaggaagggtgagtgggtagaaatacctgttattggtttttaagtagatcatagccaaagctagagtagcacctggacaagtcacatccacatttatggtatctccttcctattgaaagaagagtttatgcatgtaaaagagttctaaattattataaaattcctctgaataataactatgcttaaaattaacacatttaccaatgtcagtatgaacactagtattttccaattaacttcccagcttccagacttttgatctattactttgctgtgtacttactttgatttgataacttggtgatttatgtttctccctatgcattcctgtttgaaagcgcctacgtcctccaaccatgtactgatagagctgctcaggcacattgagatcagacatacctatcaaattgctgccatgctggaaaagacaataacagacgagtgaaaagaaattttatgaaggaagatccacaacacatacccataacaaatataaaaatgaactaacttcaaagcaggttattttgggttttgttttttttatttccaatttaaagcaaacattaatcatgagttaataaatattaataattctcataaaagttttaatacatgaatgttcaactttaagtactgtcttaaaatacataagagctttagagttagtgacatttaacaataaagaaaaatattagttatataattgaaactggaactgtaaatacctgaatactgtcattattgtacttaagaacttttccaacaataactatgataataatagtaatttattaaatgcatgctctgtgtcaggcactattctgtgtgtttaacatgaatgaacagccatatcaaatagctactattaaaaccctattttataaataaggaaagtgtggcacagagggattaagcccaaggttatacagctattatagttaagttgcagggctatatataaaacacggccatctggctcaacaatccatgaagctgattaagcaatacacaataatgtagttaaatgacttgactcactagttaggaccagaattcaagttgcaattccctgtgtgattcttttcttttttttttttttttttgagacggagtctcgccttcttgcccaggctggagtgcagtggcacgatctcgactctctgcaagctccgcctcctgggttcacaccattctcctgcctcagcatcctgagtagctgggactacaagcacccaccaccatgcccagctaatttttttgtatttttagtagagacggggtttcaccgtgttagccaggatggtctggatctcctgacctcgtgatccgcccatctcagcctcccaaagtgctgggattacaggcatgagccaccacacccagctgattattttccattataccaccagcctctttagctcacgtgccaatgtgaattcaaggccctaacagatggtcaaccacaaggtggattttcagaacacacatgaaaaaaattccttccactataactttttttttttttaagatggagtctcactcttgttgcccaggctggagtgcaatggtgtgatctcgattcaccacaacctccgcctcctgggttcaagcgattgtcctgcctcagcctcccgagtagctgggattacaggcatgcgccaccacacctggctaattttgtatttttagtagagatggggtttctccatgttggtcaggttggtcttgaacccccaatctcaggtgatccgatcacctcggccttataactttctttatatcatttagtttgaccataagaatgtattggtggtttttcaaggggaaccacatttcaagtgaaacaatcatttaatgaaacatttctggtaattctgtacacatctcttggatggagttaaagatgggtcaatctgatactgcattttgtcacaaggaagatgctactgggacaacattctgggatacacagtgaacatcactatggcaaaagggggttagggtttgtttcaagcagctactatagactcttaaggctcccgatcatatacgttttcactattctctgttttcagtcatagtgggctgtcacttattcattctatgtcttgaacgctttaaaaaaaaaaaactttattcccttcagtttgttcatgaacactgcaagctggaggaaaagaaatcttaaagtcccactcttgaccacagtttctctcaatttgcaaatctggtactttgaaaaatatccaaaaagacaatagagctgggcagcagattaagtcatagtaagggacaatattcaggtttaggtgtcaacgttatttgtctcaacatgtagatgtcctaactgaagcatgggaaggcataggctatgcttacccccaagcagaccatgcccagggccaagccagcagctaaggagtatgactctctgtcagtgcagtattccatttcaggaccaggaggccgtcctgtaaaaacaaaagcaacacagttcaaactagcttctcaaaatctcatctcataaaaatcttagagttaactttctagcaagttgcactggagatacgaatgggatataactattcagaaagttatgacactataataaatggtgtccacaactgtaggtttacctaccaaaaaaaaagggcccaaaatagttctttttaaattgccaatttaagtctttataagcaatgatattcaaatactgtgaaactttgagtcttaccaaaaaaattaccaagtagtagaaaaaaattttaaagggaaaaaggtaagagtattcaaaaaaaaagttttatttttttgttaaaacatctgggccgggtgtgctggctcatgcctgtaatcccagcattttgggaggccgaggcaggtggatcacttgacgtcaggagttggagaccagatggccaacatggtgaaaccctgtctctactaaaaatacaaaaactagccagggtgccaggtgcctgtaatatcagctactggggaggctgaggcaggaaaatcgcttgaacctgggaggcagaggttgcagtgagccaaaatcaggtcgctgcactccagcctgggtgacagagtgagacaccatctcagcaacaacaacaacgaaatatcttacattttgttttcattactttcaaatccacacatcacatgtggtgaaacatgttcgaatgatgataatgaataaggaggtcacttacttatgttgttaagctgttaaatattatgtttagacatttatttcgagtgtatataataatgagccctactatggtagaatttctgtgtactgatcctagaagtctgactggatacaaaattcacacttttaaaagcaccctataactctaacactaccttgttgaaaacgataaaatgtactatgtattaaaacccttccctctgaaaaaatgttcacattcctgaaattttatccctataggaaaaaaatgcaatttaaaaaaaaagaaaaaaggctggacgtgctggcccttgcctgtaatcccagcactttgggaggccaaggcaggaggatcacttgaggtcaacgagttcgagaccagcctgtccgacatggagaaatcccatctctactaaaactacaaaaattagccaggcatgctgacagacacccgtaatcccagctacttggtaggctgaggcaggagaattgcttgaacctgggaggcagaggctgcagtgaaccgagatcgccccactccactccagcctgggtgacagagcgagactctgtctctaaataaataaataaataataaaaattaaagaaaaaaatcacacaaaggtaatcagtgtaatgtttatatataacaacaaaggattattagaaacaatctaaaaagttctaaaagttaaaaaaaggcattttacagaccatcgactcaatgaatattacacaaaatttgttttaaaacccatttataacaatgatctataaaaacaatttttaggcggggcacagtggttcatgcctgcaatcccagcactttgggaggctgagacaggcagatcacaaggtcaggagatccagactatcctggctaacaccatgaaaccctgtctctactaaaaatacacaataattagccaggcgtagtggcgggcgcctgtagtcccagctactcggaaggctgaggcaggagaatgacgtgaacccgggaggcggagcttgcaatgagccaagattgcaccactgtactccaggctgggcagcagagcaagactctctcaaaaaaaaaaaatttttttaatgtacattctgacagtaattatataaaaaggcatatacatatgaattaaagatgaaatcttctatatacagtgtgaaagaggtatgccgcagctgtgagactgtgcaatgacaccattagacatcatcatgatatagccaaagaagggtagactactttgcagatgaacatgctttaacaaccagtgttgaatattttcagaataagcgtttttcagatctctgacttatgctaccatgtattgtgatagccaaaacatttcaactttgggaataatttcatttatcattatagtagactaaattatgggtcccaatcttcactggttctctcctaggtttctatcaacaccacgagagaaacacaccctccagcctgggtcccagaatgaggcaggtgaggcagaacggcagcagaacagccggctacacatctacagcctaaagcagagctgcctgggccaatgctatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacaggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatcaacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaaagtccaacaatgatagactggattaagaaaatgtggcacatatacaccatggaatactatgcagccataaaaaatgatgagttcatgtcctttgtagggacatggatgaaattggaaaccatcattctcagtaaactatcgcaaggacaaaaaaccaaacaccgcatattctcactcataggtgggaattgaacaatgagatcgcatggacacaggaaggggaatatcacactctggggactgtggtggggaggggggaggggggagggatagcattgggagatatacctaatgctagatgacgagttagtgggtgcagcgcaccagcatggcacatgtatgcatatgtaactaacctgcacaatgtgcacatgtaccctaaaacttaaagtataattaaaaaaaaaaaatttcaaaaaaaaaaaattttgtctataaaacaggtaacaatttgaatgaagaaaacaaaaatttaatgaatggcataaaaataaatttcaagaaaatgaaaggtgtgtatgatgacttaattaaaagaatgtaaaggaaaaaaaaaaaaaaagattttccagagtagctacttgtctctgccatagaattgttagatagtttactgtaggtggactgtaaataaatgtttgcttagttctaacatttgactgatattgggttgatcctttgagacttggtatattgtggatatgcctaaagtttctttttctaccaaagatgtgttgtaatctatgtcattacagaagtaggagagggaaggaaactaccattaaaatcagtacttaggagcccaggcactgttctagatgtttgcatatattaatatgatttcatttcatctttacagtaacctagaagaaagatatttaaataatgactttccagatcaaaaaatgagttttgatggcttttctcagttttcataattggcagaactgatttccgaatcctttaagttgatcagttgacaggaatgcatttatgatttttatcttttcttttggggttacctttcagtttgactttgaaggatcactttcccctgtcattgcgcccaaaaaagcaaggccttctgagactggatctgatgatgtaagcattattatttcttgctaatataaattaatttatggatattcatactattcttccacttctgtggtattcctatcaattcctctatctttccaacacctttcactttatttattttaatactgaatagcaattattttgaagagtaggatctgttacattttctatggtctttaatgattatccaaaaattaatgtatgtattactgcatgatttcagtttgggtttgtagacattttattatcaactgatcacctgaaatgacagcatttaccttttttatgcagtgttttttaaattaaggttctcaatcgtatcaggttccatggtatattccttttttttttttttttttttgagacggagtatcgctcttgttgcccgggatggagtgcagtggcacgatctgagctcactgcaatctccgcctcccaggttcaagcagttctgtctcagcctcctgaatagctgggattacaggcgcccgccaccatgcctggctaatttttgtagttttggtagagacagggtttcaccatgttggccaggctggtctcgaactcctgacctcaagtgaccttcctgaccttggcgtcccaaagtgctgggattacaggcatgagccactgcacctggcctccatggtattattcttaagtggtccaaatatgtttttttaaattgtggtgtaatttacaaaaatgaaatacatcttgagtttacagtttgatcagttttaatatatgcacactcatgtaacctacactcctataaagacacagaatatttttataactccgtaaaatttccccgtgcggtttttttttttttttttgagacggagtcttgccttattgcccaggctggagtgcagtggcacgatgtcggctcttcacctcctgggttgaagctattctcctgcctcaacctcctgaatagctgggattataggcatgcgccaccacgcctggccaatttttgtatttttagtagagatagggtttcaccatgttggtcaggctggtcttgaactcctgacctcgtgatctgcccacctcggcctcccaaagttctgggattacaggcatgagccactgggcctggcccctcttgctgtttttaatcagctttattctcttcttctagcaatcactgatctgaattctgtcaccatatcttagttatgcctgttctagaacttgatgtaaataaaataatatagtatgtaatctttggtataagatttattcagcataatgcttttgagattcattcatgttgttacagatacccgtagtttgtgcttttttattgctgagtagtatgaatataccatagtttgtttatccatccttcttctgctggtagatatctaggctatttccattttttttttaagtcttatgaataaagcaagctactgccaaaattcactggcaagtctttgtggatatatattttctttttttggggggggggaggacagagtcttgctgtgtcatccaggctggaatgcagtggcacgatctcggctcactgcaacctctgactcctgagttcaggcagttctcatgcctcagcctccccagtagctagaattacaggtatgcgccaccatgcctggctaatttttgtattttcagtagagactggattttgccatgttggccagcctggtctcaaactcctggcctcaataatccacccatgttggcctcccaaagtgctgagattacaggtgtgagccaccatgcctggcccgtggacatacattttcatttctttttttttttttttttttaagagacagggtgtcactcttttgcctacgctggactgcagtgatgctatcgtggttgactgtaatctcgaactcctaggctcaagccatcctcctacctcagcctccaagtggctaggactaccggtatgctccatcatgcctggctaatttttaagtaagaccagttgtctaccaaaaaaatttgaaaattagccaggcatgatggcacataacctgtagtcctagctacttggaggctgagtttggaggatgttaaacactctttcatgtgctcattagctgcttatgtatctttttgtgaagtttctgttcaaatctttatcaacttgtaaattagattttaaaaaatatgtaagctggtgaagttcttacatgttctagacatgaattcttgaccatattttcccttagaatgtggctttaacagtgtctttgatgagcagaattttttattttagttatccaatatatcagttttttattttattttattttatttttgagatggagtctcgctctgttgcccaggctggagtgcagtggcatgatctcagctcactgcaagctccgcctcccaggttcatgccattctcctgcctaagcctccccaatagctgggactaacaggtgcccgccaccacacccagctaatttttttgtattttttttagaagagatggggttccaccgtgttagccaggatggtctcgatctcctgacctcgtgatccacccgcctcggcatcccaaagtgctgggattacaggcatgagccagtgcacccggcccagttttttcttttatggttagttctttctgtatctagtccaataatttttaatttagaataacacactgtattaagccttataaaaacaccagtaaattccaagatctggaaatagcataaaccacattctctgaaccaaatgcagtaaatcacaagtagaaccaaaatagactgaacatttggaaaatgtagtccaatcagtctgaatataaaaatcagttgattattagattatattagtagccctggcatcttatacatgtggaaagatgaatacaccagatgaatgcaggtggaccttccttcttaccaaaacacagttcagtgtagtggccactaacttgccatctacttttcctataaaacctagcctgagataatcttaaattttctctctcaatctctacctaaatagtataattcttctcccaatgtctttcctaaaagggcatgaaaagattttttttaatggtttttaaaggtggcttgccttaacgtttataactggcttgctattttatagttacttcattcttagcattgtcttttttttaacatactcttagatcaacttaatgtgaaaatgaaacttgaattgttttaagtgaattaattttcttatgatattataaggaggtattatttttaaaaattaatattctttttattcttctcaggactgggaatatttactaaattcagactaccaccagagtgttgagtctcatcttttgaacagatctttatgtctgagtccttcagaagcttcacagatgaaggatgaggatttttcacagaatctcagtctggattcttctacacttctctttactcacatacctgcaattttttttgttcttcaccttgtgtatgaggagcttaagttgaatactctaatgggagaaggaatttgttcactcgttgaacttctcgttcagttggcaaggtaaatttgtttgtaggttagaaactgccaggaagtcctgagatgactgtcttttccatgatatcatatagggaccttgtaaatacgtttctgaaatctgccttctcagaaaactaggacatctctgtaaaccacagagttgtttgaagatactggttttgtaagggcctgtgagccatgcagggatttttagtctttgtcctgagattagtggaaggtcacgaaaaaatggagatgacctgctcagattttcattttgacaggatgactgactgactatactgtggtgggagttctagaataacatctgctgttttgtaatatccacattcaaatagtgctttatagttgacaaaatcatagtttacatataaagtctcaaacaaggtaagtttcctattttagtgatgaggaaacttgcctaaatttgtttcctgggatatgagtgtttgatagttgtggactcattttgctatgctatccttgttgcagtctgaggttgtccctgtctttgaggcactcatagtagatccacaataagatagttctaataatacgtttcaacacctttcaagagctttgaagcaccttgtgtatggctcagaattctagggtcatacttgtgtgttgtttgacctttatgacctttggtgataaagaagttgaatttgaattgaaatgtcagcctctgagttaagacatagtacattttctaatttctgttgtcttttttgagatcttgaaattcaatcctgagacatggcagttttaatcaatggtaaatatctcttaggatgtcattactatcatcaaaattattttgtaattaaataatttccaaaccataatcatggctgtctgaaataagtaatgtgtatgatgttttacattttatcaggttttttttttttttacatattttatcttatttactctttaaaacttcagagtaagtgagctgatattgccccatttcctagaagaaaatactgaggtttatagacatgacttatggaagatcacacagctaatgaatagcagaggaggaactagatcatggtgcttttactgtagttttacttccacaaaatttagcaaaaagaggttgggttccatttgtcacactgggcactttaaagtccaaaaatacaatagagagactctagatttggttatctttctcataagtaagtttttaaatttaaagattcaactaattaatccttccaattctgttgggagaaagtgctgtaataccttcttttttgcatgcccttactgttttagggacttaaaattggggccttatgtagatcattactatagagactacccaacgcttgtcagaactactggacaagtgtgcacaattgatccaggtaagtagtcgtgcttttaaatattttctaaacagtgtagtgatatttccttgtatctttctcaatgaatagcagaggatgtatttcttaccattagcttctaagtcaggggcaatgcctttccaccaggcagattttagttcgtagtgcttgttttctgacacgtagtaagccataatatcttcagtgtatagggaaaattttacccatccctaaggttctgacttgcaaaagtcagagaaagagcttccagtgtcaaggatgctttttttttttgagacggagtcttgctctgtcacccaggctggggtgcagtggcgcgatctcggctcactgcaaactctgcctcctgggttcacgccattctcctgcctcagcctcctgagtagctgggactacaggtgcccgccaccacgcctggctaatttttctgtatttttattagagacgaggtttaatcgtgttacataggatggtcttgatctcctgacctcatgatccacccacctcggcctcccaaagtgctgggattacggcgtgagccactgcgccaggccaccaacttagacttgtagagtacagttagtaccactaaccatatgctacttaaattcaattaaaataaaacatatatttcctcagtgtactagccgcattttgagaactcagtagccacatggggctagtgctaccatattggacagtgcagatacagacacagaacatttccatcactactgtactgtcctagaccctgagctaaaggtactgaaatttggggcccagttgttggaacagagctgaatcctggatgtttcttttgtttttttcacctttagggttagggcaaaatttttggttagattcttcttcttctttttttttttttttttttttttttgagacagggtctcactctgtcacccagacgggagtgcagtggtacgatcttggctcactgcatcctctgccttccaggctcaagcgattctcctgcctcagcctcccaagtgcctgggattgcctggggttataggtgtgtgccaccacgcctggctaatttttgtatttttagtagtgatggggtttcaccatgttggccaggctggccttgaactcctgacctcaagtgatccacctgactcagcctcccaaggggctgggattacaggtgttagccaccacatccagcctttggttagattctttatatgccttgggaacaagaatttgctaaatttccatccagggtgggataaaatagaagtcatttaaattctacatttaataacatagttccttatgtgctgtggcagaaaacatgaagcattttggagaatatggaaaaacgttattccttttttttttttttttttttttttgagacagagtctcgctctgtctcttaggcatgatctgggctcactgcaacctccacctcccgggttcaagtgattcttctgcctcagtctcccaagtaggtgggactacgggtgcgcaccaccaggcccagctaatttttttcgtatttttagtagagacggggtttcaccatattggccaggctgttctttaactcctgacctcgtgatccacctgcttgggcctcccaaagtactggggttacaggcgtgagccactgcacccagctggaaaaatattattctagttgtttcaaaatgacaagtaactgttgatcatcttccgtttaaaataaaataatgttgtcttaatgtattttcgtgtctttttgaatatttatctaattttaaaggtcaaacaggatttatgcatcatccatcattttttacgtctgagccaccaagtatttatcagtgggtgagttcttgtctgaagggcgaaggaatgccgccttatccttacctccctggaatctgtgaaagaagcagacttgtagtcttggtatgtatgtggagtgttactacctatctcctttttcttttaaaatttagttttaaaaagtacacctaatattaagtttttctttctgtgtatagttctgtgaatttcagtacatgtatagattcatgtaattactacaatgaggatatagaacatttacatcaccctcaaaaatttctctcatgattttgagactcatccaagttgtttcctgtatcgacagttcattgcattctatggctaattagtagtttattgcatgaatgtgccatagttggtttttcattcaagataattgggttgatttcagttgttagcaattgtaaatatagatgctgtcagcattcatgcttagcgttttatgtgaacataagttttgctttctctaggacaggtacctaggagtaggattgatgggtcatacagttaagtttatattttgtttttaaagaaactgtcatctgttttccagagtggctcttccattttacatttttaccagcaatatttaagagatcatttacctgcattcttgttggtatttggtattgtcactcttttttatttttgtctttctgagagatgtgtagttatacctcattgtggttttaatttgcattttcctaatggctaatgatgttttcagcgttctaggtatgaggttttgtcagatatgtggtttgcagatattttcttgtggtttctaccttgtcttgtctcgtcattctctaaatacatcaaagaacaaaagtgtttaattttgatgaagctagtttatctgtatttttctttaatggatattgctttcagtgtcatgtctaataattctttgtttaacttcaggttttgaagattttctcctgggtttctttgcatgttttacatttagatctctaatccattttgttaatcttttataacatgtcaggttttaagtcaaggtttttattatttcatttggatatccagttctttcagcactgttttttgaaaagactatccttcctctattgcatttgcacttttgtcaaaagttaatttggccacattcttgtgtgtctgtttctggactttctattctgtttcattgatctttgtggctgtctacgctgtcattactgtagctttatagtaagtctttaaaattgattagcgttactcctcccttcattactcttcttgccttttcatattgattttatttttatttttatttttgagacagagtctcactctgttgcctaggctagagtgcagtggagtgatctcagctcactgcaacctccaccttctgggttcaggcgattctcctgcctcagcctcccaaatagctgggattacaggatcccaccaccacgcccggctaattttttgtatttttagtagagacgggatttcaccatattggccaggctggtcttgaactttcaacctcaagtgatccgcctggctcagcctcccaaagtgctgggattaccggtgtgagccaccgcgcccgtcccctactgattttataatccgcttgtctatagctacaaagaaaaatcttgctgaaatttttttcaaagaaacacttctttatttatttttattattttttatttacctctagctgcaaatctcatgatttatttatttttagaaattagtttgttattactggttaatacatgtccaagatcaaaccttcatatagaaccatagggctgtaacggtgaatgaggtaagtttcttggcatacctgttcctcagtccccccatcctggagcagcctgctcataggccccttgtgggccttttcaggtggggtcttcccaggcttgcaggagaaccatatgcttttgtcccttctctcaaatgttggcagactgcaaatgtcttttcctcctgcccttctttttctttactttacgttttgctccgcttcatggtgagaagtgcttcagagtccccccatggctccaaaacagacatacagaatgaagattctgtttaaaaaacacagatttttttaatgatagcaaaatatatataacataatatttgtcattgaaattgttattattattatttcttgagatggagtcactctgttgcccaggctggagtgcagtggcacgatctcggctcactgcaacctccgccacctaggttcaagcgattctcctgcctcagcctcccgagtagctgggattacaggcatgagtcaccaagtctggctaatttttgtatttttagtagagatggggttcaccatgttggccaggctggtcttgaactcctgacatcaagtgatctgcccaccttggcctcccaaagtgcaggggttacaggcgtgagccactgcgcccggcctgaagttatttttgagtgtacaatccagtggcattgaatacgttcacattgttatgttgccatcaccactgtccgtacccaagacttcttcatcatccccaacataaactctgtacctattagagtgactccccattccccttccttccaggccctggtaattccgttctctttcttatgaatttgtctcttgtaagtacctcatattatgggaatcaagcaatatttatctctgtgtctggcttatttcacttagcataatgtttccaatgttcacccatattgtagcatgtatcaaaattacattgttttaaaggcagtattctatatagtattccattgtatggatataccacaatttatcatttcacctgatgatggacatttgggttgtttccaccttttgactgtggaatagtgctgctgtgaaccatgggtatgcaaatatctgttcaagtctctgctttcagttctttttaatatatacctggtggtggaattgttgggtcatatggtaggtaattcgatgtttaactttttgagaaactgctaaactcattttcatagtggctataccattttacatccttatcagcaatgcaagaggaagggttccaatttctccacagtcttgccaacacatattattattttctatttgtttttttaaaaattatagccatcctagtatttatgaagtgatatctcattgttttgatttgcctccttaatgattagtgatattgagcatattttcatgtgtttattggccatttacgtatcttctttgaagaaatatctatgcagatcttttgtgtatttgaaaattggatttttatttttgagtttaggcatttttatgctctagatattaatgtgtcagatacatgatttgcaaatattttctcccattctataggtttttctgtgaatgtcttttcagtaaaactggcatgagtgctcagtttacctctctggcctttcatcttagttttatcctcttggtattcctttataacttgtcagctcagagatctatttataaaaatatgaatttatttttatttataaaaatattctgaaaaatatcaacagaagcccttattgataggtttttggtttcgtcattataagttttattggactttttttattttttattttttttatttgagacaaggtcttactctgtcacccaggctggtgtgcagtggtgcaatcatggctcactgcagcctcaacctcccggggctcaagcagtccttccacctcagcctcctgagtagctgggaccacaggtgcacaccatcacacccggctaatttttgtatttttagtagagatggggttttgccatgttgcccaggttggtcttgaactcctgaccgcaagtgataaattttttttatgtgatgttagctaatgagacatttgtagtaaccttctagcttatggtggctctttttctattgactcacttgtatatgcggagatggcattgtctgtgtaccatttgttgaaatgagggaaaggaaggaagtgagataacatttattgggagcctgttgtcttcaaggaacttcatgtatgttttctcatttaatacagagatcttatgtacttttgtgtttgtgttatatgttgaatattttaactcttttgagagactttttccttggtcttatctttttcttttcctcctcaaagcaaataccactacagctctgtactactagatacttcttagatagtgagagagcactattcgatacctgttggaatgactgaaaataacttttggtgaggatatggagcaaccgaaactctcatacattactggtgggactgcaaaagtggcacagcactttggaaaactgtttggcagtttcttgtgaagttaaacatacacttatataagacaaattccaactgcttggtatttacttaagagaaatgaaaacatatgcctacataaagacccgcatgtatgtgaatgtctttggggccaggcgcggtggcataatctcagcactttgggagaccgaggagggcggatcacgaggtcaggagatcgagaccaacctggccaacatggtgaaaccctgtctctactaaaaatacaaaaattagctgggcgtggtggcgcatgcctgtaatcccagccactctggaggctgaggtgggagaatcgcttgaacccaggaggtggaggttgcagtgagccaagattgtgccactgcactccagcctggcgacatagcgagactccgtctcaaaaaaaataaacaaataaaaaataaagcagctttggtcatagtgaccacaaactggaaccaaatgttcatcagtttttgagtaggtaaacaaagtttggtatgtctgtataatggaatactactcagcatgaaaaggaagaaactagtgatccttggagagacgtgaatgaatctcaaagacgtatgctaagttaaagaagtagcacgaaaaagactacatatcatatgattcattcacatgatattgtaggatagacaaaactgtagagcaagaaaacagatgaattgtttccagtgctgggtgtaggaggaaaggattgactacaaaaggaacgagggaactttttggtatgatgaaagtatactatatgtgagtgtggtagtggttatgtgatataacatttgtcgaaactcacagagctgtacacctaaaatggacgaattattctatgttataattattttctagttacacttcaattatgtagctaggtgtggtggctcatacctataatcccagcagtttgggaggctgaggcagaaggattgctcgaggtcatgagtttgagcccagcctgggcaacacagcgagactctgtctttacaaaaaataaaaataatataaaagaattagctgggcatggtggtgtgtgcttgtagtcctagctactctggagactgaagcaggaagattgcttgagccaaggagtttgaggctgcagtgagctgtgattgtgtcactgcactccatcctgggtgacaaagtgagatgctgtctctggaaagagaaaaataatgttaattttcttcttttgcagagtattgcactgtacatacttggtgatgagagctcggtttctgatgaatcctcacagtatttaaccagaataactgtaggtaagttggtgcaatgttgcctctggaaacaaatttttgtagatgtcagtatcagaattgaaaaaagaattgaatttttcttgtttgctttggcggccatgtcttacctttttagtactgttctggtctgttgcggtctgttgtccacaactaattttcaggtatcaggattacttaaaatctaataaatcttgtattttcagtgcgggtaaaaaggactattttagcctgaaggaaattattgtaccattgactcttgaacaacatgagtttgagttgtgtgggtccacttacaatgaaattcttttcagccaaatgcagatagaaaatgcagtattctctgatgtgaaatccatatgcaggttctgcagggccaattgcaggacttgagcatgcagggatttgggtacacatcgggtgtcctaaccaatcccctgagtattctgagggccttgactgtacttttcagcctgccacagtattgcttattttattatttttttagatgttgtttgctaatggattcttattttcaaatgtcttctacatgttacatgttttctttaccaggatgactatcaaaattaagtttcattttgttgccttttagccccccagaagttgcaagcagaacaagtggaaaacaggtgacttttatttagactgtgcttttatgtcagacacttaaaacaatattatttactgttctgcttaattactttatgttttattctcttataggtttagtttcaggcattctacgtctgtttctagtctagctgaaagattggttggctggatgactaatgtaggtgagagcttctttgttacctgctaactaggccgtgcttcctccagactagctagaagtggaaggcatgaggagagaggggctctggctttgtgaaaaggcctcacaagattgagattatggttcatcaagccatattcttttttctcgacaatctcacaactttcatataataatatgtgggataccagctttttatcttggtgcataaggaatctttatttgccattacattggaacatttgaggctatggctatgtaagctggtctctgagaatggagaactctaatcaccctacatatacacctgaaatcattgtgatactcagatatcagaaatgggtggttttggcaaagtctaaaagcaataatataaacatttcagggtatacttttgaaggataaatgcacttttgaagggatttcaggcaccaagatgaacattgaactgggaagaggaagaggaaggaaaagcgttctatattccctattccccaaacctatgctcctaggttttaaattaagtaaaataccaaagaaattttttttcacaaagaactgaaaaacaaaattaaaaattactgccacgaagacatgattttaaaaatgaggatattatatgggatgtatgttaaaaagtaaagttttaatgaatattaaaagatgtttttgaagtcttatctaaagtatgttctaaatgaagtttctgacaggtttttttttttttttttttgcattttaccttaaaaatgacaataactgttgcgtagtatacatacaggatacctatgctgaaaaatattggattagttctatccatttgtatattgcataatatttaataagtgttattctcatataaggaaacattttttgcctcaatagttaatcgactttttatattataaataatgcatagtattataaaatttagaaaatcatgataagaaaaacatgatttaattaacctgaggataaaaaaatttaaatatgaaatatggtatacttacaaaataatatgtcaaacgtatatgtttagtttagagaatggtactaaagtgagtattgatgtactggtcacccacccctagaaatagaacattacccgcatagtagaaggcccttacatatctgttcttggatggtcccctcctgtcacacaccccaatgttatagtgaaccactgccctacctacatttgtgttaccttactcttgtttttctttatagttttacatctttataaattgctaggttttatgtagttttgaaaatatatagatgtaaatatatgttcctttttcttcactcaactttgttttttaaagattcatccatgtcgactcacgtagcagtagcagtgggtcattcattttctctgatatagagattactttgtttgaacatatcacaatttaattacccattctgttaatgatagacaatcggacttacccctttctccatctctttttttttttccatagcaaaccagtattgctaatgaatatttttatacctgtgtcttggtgtacctgggtgtaagtttctatatggctgttgatggatcaaatgggtggactgacctatacataccaactgttttccaaagtggttgtaccagtttacactaccattggctatggataagaattattgttgctcgggccgggcacggtggctcatgcctgtaatcccagcactttgggaggccaaggcgggtggatcacgaggtcaggagatcaagaccatcctggctaacacggtgaaaccctgtctctactaaaaaaaaactacaaaaaaaattagccgggcatggtggtgggcgcctgtagtcccagctactcgggaagctgaggcaggagaatggcgtgaacccgggaggaggagcttgcagtgagccgagattacaccactgcagtccatcctgggtgacagagcaagactccatttcaaaaaaaaaaaaaaaagaataaaaagaattattatcgctctacatagttgccaacacttggtattgattggctttgacatttacatttctcagtggctttaatttgcattttcctgatcactaattaggtagagcatcttttcatatgcatattgcccatttatgtttccccttctaggaaatgtctttttgtcttttatatttttctattagattgtctttttttcttcaggtttttacaagttctttcaaagagacttcctatactagtccctgatgttaagacattagtctggtagtaagaggaataaaatgaatttatttgtcaggatagatattgttgccaacttcagctaggataattgggacagtggcaagtctaaattaaaatgtttctctcttcctttaaccattaggattcactttaagagatttggaaactcttccctttggaattgctcttcccatcagagatgcaatttatcactgtcgtgagcagcctgcctcagactggccagaagctgtctgtctcttgattggacgtcaggatctttccaagcaggcctgcgaaggaaacttacccaaagggaagtctgtgagtatcaacatagaaagttcagagttccaattttagccttaaataaaatcataaagtagaaatgttcttcattttcctttaaggctttttctaagtatatatattagcttgtcttttatattatatgccagacggggtttgtaattgtatgcgtcttattaattgttaagttgagcataggagcaggagattttgtgaatgttctgtcttgtgcctggatctttctttgccttgaatcaggacaagtcctgagtgtagtcatggaaactaccatggctatttccctacttgtaccatattagtaattaaccacttcgtaattattacataggaaaagggagagcacatatatcctgaatttggatgagtaattatatataaatattttctactgcatatttttcgatgtgttgaattttttgaatttaaccttttaaataggtgtaaacatatttatttaatcacataaaactgcagccccagggaaaaaatgtgtttttttagtagagttgtttaaaaagatgtcttaagctatccctcccgaaatactgtctttcatcaatcatcaagtctgtttttttttttaaatgagttctaggaatcctgcaagtagaaagtaaaattatttcattactctccaattatctttttatatcatcctctcttaaaacttgaaaatgaaacttttaaaacttattctagaattctaggtaactttaaaaaatgaacagtagaatctcatcaaggaggattcaggaataataattccactcctggtgactcttttatgttcatgtccctgagaagacagtgggaatttggtcttacctcttagtagcttttgaatcaatacataataatcagtgcattgtaactatgagtcaccttaggtcttattactacttcttcagagcctatatcaaaacttattcctaacctcagagttgcctaatgtgtacccatgccggagtcagtttccatgggcatctgatctccagcacggtcatcccagcacgtctctcctttaatctgcgcctcaatcacagctcttcgttgaattagtatttacatcctgttttaaacagaaaacaaatctttttgcttataaaatgattttcctgtgagagagagcagttcagcaccattagcattaaaatattaatctgtatttgaatgtcattttaagtaattatgtctaaatacagtttgttcagttgaggctacattttataactaatcccatctaaatttattttgtcactgtttgagactatgttttatagctaactcacccattagaatatagtttttttttttaaattagatattttataggagctaaaaatgaatttttaggaactaaaagtgattatttggtcgtatctacttttttttcaggctgaccttgttggtttcacattaaatgttgcaaaactttaacatttcaacttggagttattcttttgttaaaagagtataatactgtttttgagagaatatgatatgattccacgcaattcacatctgtgttgcagttagatttaattatttggactgggaagccccatattaaagcacatgctgggcttagaacatgatgacaatcaaggaatttaccctcttacttgttttgctgtagttcagtacttttccttctaagaaatttttattggaaacacattttttaaaaatagtgaaaactggctgggtgtggtggcacatgcctgtaatctcagcactttggggtggccaaggcggaggactgcttgagcccaggagtttgagaccagcctaggcaacatagtgagacctcatctctacttaaacaattttttaaaaaatttagccaggtgtggtggtatgtgcctgtagtcctagctatttgggaggctgaggtgggtggatctccttgaggtcaggagttcaagaccagcctggtcaacagggcaagactctgtctctacaaaaaataaaaaaaattatctgggtgggcggtgcacatatgtagtcccagctactcgggaggctaaggttgaaagcctgcttgagcccaagaggtggaggttgcagggagccaggatcacaccactgcactccagcctgagtgacagagtaagaccctgtctcaaaaaaaaaacaaaaaaaaacttactaatggaatccaaccatgatcctgtctatttaaagtagtaaagtaaaaggtatttcattgtgtgacttcccccaacccttggggtatatcctttcaggcttttttccttctccttctattaatgaacagacaatatttaaattagcattattagcagtgactagtattcatattctacttgcaataatttttttttaagaaatgatcaggatgtagttagatttttttttatagtttattcagaatatttctctgttcgtatccagccccttgactgttgccctaaatttaaactctccccgtcatttccaaatatttccaagtaggcaatgtagtacttttgtttgtttgtttgtttggtttgtttggttgtttgagacagaatctcactctgtcacccaggctggagtacagtggcacgatttcggctcactgcaacctctgcctcccgcattcaagtgattctccagcctcagcctccccagtagctgggactacaggtgtgcaccactgcgtctggctaggtaatttttgtatttttagtagagaccgggtttcaccatgttggccaggctggtctggaacccctggcctcgggtgatccacccacctcggcctcccaaagtgctgggattacagagtgtgagccaccacacccagccagcaatatagtactttttagaaagatttgtagattagagtcccagtatacattgcggccccaacccaggcctgctttggaaaacatattttctctgtgctagtatagtcatgacacatcagcctatatatcctcatgttcagcaaatgcacgttaactgcttttgaaattattattataataaatctgttactcaggtgctctcatcagatgttccttcaggtacagaaactgaggagaaagatgatggcatgaatgacatgaatcacgaggtcatgtcattaatatggagtgaagatttaagggtgcaggatgtgcgaaggcttcttcagagtgcgcatcctgtccgtgtcaacgtagtgcagtacccagagctcagtgaccacgagttcatcgaggaaaaggaaaacaggtgaaagaaaacacgtgtactatctcttgtcacgtttcattgttacatttgtgtcttgtttatatttgtttttccttcaagtttttagcatttaaaaccctaaagagatttaaaagatactttcaagtgaaaatatgccctgtgttttaagttttcatccaacttcaacaaaccacgtgtgttagcaaaatgtctttggcttttgaggacgtaattgttgtatttcataccgtcctcctcttgaaatacatataacagtttactctttagaaaaggtgaatgtaaaactattttgcctgatagttaccttaagaatttacaaacaaagaaaacactggacttgtttttctgtgtcttgatcaggaatagattttgaggttagtggggtttttagtgtagtttaaacttatatcagtattttttttttggatatgatagataatactccaaataaaaatagataagcctttcttctgccactcccctgcacaggatacatcccctgatacattgtaagactcacatgcctgtgacattccagagctattctcttgggacacttctattttaaaattctctcctgttcttttatctgcttgtctctatcatctatcattcatctgtcactgttttctagttctctttactttttttatggtactgttttgaggggaaccgtcacccacacttagccacaggctgctgaagatctgaattagttgtgatttccctattaactgtttcctctccacaagtacccagttattagtcacctgtgaataaaaagatggagtgacagaagttgagtttagagcataggatttatgagcatggcctctagagccaggcatggccatgctgtgctgggtgactggttaaattactttacctcttgttgcctcagttgcttcatctgtaaaaataggcatacttcatgggatggtgctgtgtatcaagtgaattatttttacatagcacttagaatactgctcaatacatagtaaagctcagtgcagtcagccattattagtagtagagttcattgattctaagatgcaagttttttcactttttaatatctctgaaatcagatgtgtatttcagtgaacaggtgtcatagtttaactggcagtgctttctctttcttagtttctcatgaaataatgatacatcttatgagtggcatcttatattcaggggatataatattgttctcattataattttgttacttgtgcaaagttgaagtgaattatgtgtaagatttcctctaaaaaaattctatgggttgcaacagactcttggctttgaattttcctgatcccaaattaatgtggcggtcatgttcccagagaatctttaagacagcaaaatttttctctccagttagctagaaaagcagttatgtgtgtccagttaaggagggagtatgcttatgaatagctttgtctgcagagaaaatgttcgtcagttgtcagcctctgaagggatatttctgtgtcttcagatataacttgtataagcgtttcttagttataaatgccttacttccaaaatttctgttagttttttttaagtggatatatggaatgttaagctattttaacagaggaacaagttgaagagtggtatattaatttcacagtagagccgacagaaaccattttaaccttgaacatacctgatacataatggtattagtcctataaacctagccatcatgtaagtgaaaccaatctgtatttcccttggagacaccatgaaatccattcacctctaacatagggaccttgtttcttttcttgtgtacaggccacagaaatggtacttctgaggctgtattggcaaaagggatgggaggaggatcccacatgtactgaggacagctagactgaaattaacacagtgataaaaaccccaaaagtactgtattttcctttgagaaggttagcatccatcggagtggaattttaaatttcttttgtttttttgaatgcctagagagagtcggcttggtttataggccaggtggttttcattcaatgtaaatatgaaacaaaacagaggaaatatgtctctccctaagagtgtaataggaacaagaatattaaaatgaaaataatcatgtttgggtagttcactcacatctgtgtatgaatttactttgagacaacttcatcttacacagtacaccttcttttgaaatacttacagatgatatttcaattgcgctttgctttaaacattttcacatgttggtttttactttaattacagattactccaattgtgtcagcaaactatggctcttcctgtaggacgaggaatgtttacctttttttcgtaccatcctgttccaacagagccattgcctattcctaaattgaatctgactggtatgttaaattctgggctcaatgagaaaggaaagtgattaagtacatgcattaagtgtagttctttaaattagttaaaacaaaagaaatgctccctctatccccagtgattttaaattttcctaatagctgctatagtggttatcaaagctcaaataccatgtcaaactaaaccttgagagaagcagaatatagttcgttactcatttttgctttttaatgaggtgatttcaagatatacaaagtcacttggagaagttcagaaagatataattgataatgatgagactattgaattttaaataatcttgagtataatatgtaaaaatatttagttttaaaatgtcttatgtcatagtttaaacagatgatcattgtataaatcaagaaatgtcctaagcaaaaagagaaaaaatggtcacttgcagtactcccactcttctgcatcactccttttaacattttaatatatatgtttactaagtttatttccacatatttataattttatatttgtttaattatcagaaaatttaaatctattttagatattttttaaaatttacagtgaacatccttttatatctagcaaataaatgtatgtgtttataattatgtgtatgtattgtatacacgtgtttttaatcgatacattcatttttatttgcttcagagtatttcattcagtggatataccatagtttatagaagcagcctggtattgttggaaattacagttttttggtattataaacattgttggggcgtattcgtcctatgtatttaggctaaatgcttagaagtagaactcttaggacagcaagatgaatggttttaaggaacatgtcaaattgcctttctggttggtgcaagtttttatttctgctatgtataactgtagttatagtcttgattacaatgagttttttagtgtatgtccgcctaatgctgatttgaatgtgttctaaaggtgacaattacatagttgaaattatcattgaaactctattatagtatatatggttttgtgaaacctatacaaaatgtatgtgtaatgtatgttgtagtagtgtatagtatatgtagtagtatataatgtataatttaatatatgataaatagtacataatatatgcaaacataattgtacagtattttaaattgcatactttaaaaaatccagagttccactcagatttgtgaacagcttgtgctttgagcagcatgcaggaaatgagattgactaagtgaagaacacattcccatctccatatcatgcttattctgagccctaatctcactgagggacatagtgagcagagttgcttttaatatttaaattgtctcagaggtaaagcacctatggcaaaattttaacaattattgattcttgatggaaggcatggtatatagatgttcattttagtagtctttccaactgtttatatgaaagatttcatataatgagtgcgggttaaaaaggaaatctaatgcaaaattggcaaatgttaaaatgtattcaatctgggtgatttagcactcaagcgatacttgggtgggtttaaaaaatatatacatgcatctttttttctgaatacatttaattgaatttgcatgatttaaaatgtgtttatgacattaatccaacattttattcttttagtcattctggtaggccaaaaagaaaggttatcctcttaatttaggaaagaatattttcttaaatagttgcttaacccacactgatgtggcctgttgtacttttgtatgttgttattctcattgaagaaaatttaccttaccctttgcattttattttctctcgtgtataaatattatgtcttttgcatatgatgaatgaaagtttcagaaagttcactcagttttttcatattgatatgtctgccttttttgagaaagtgcaagtgtaacttatgaacttattactcattgtggtgctaacactagcagttgagttagcttttaggtacaaaaagcatatagtaaagacaaataagtcttactttgtgctttgtgtgtgtatgtgtacatgctacaaataagacactctgcatctacttaaaatttattttacataacatcttagaactctttaaaaatggtacttttaaagctgcagtgaaatggataactttatgcagtaattaaaatatttatgttaattattttatctgtgacttaagacagtattcaaaatatatttaaaaagattcagtgtttgctgtgtataatgtagatcaaaaagaaaagaatcaagaaaaaattcgtagggaacatatagcattgtgaacatataatttacattgttcttaaatggaccataaaagtaaatctagtgaatgcccttttgaagttcactgggtgactcaagtctataaaaggatgctttttacaaaactatctctaagcattttaaacaatagcatataattagatatctatatctgtatgtatatagagagagagaaaaaaaagagagaagggggcatatataggtaagagctgtagcagatttattaaggttcttgtgtctttttttttttttttttttttgagatgcagtctctgtctgctgcccaggtgggagtgcagtggcatgatcttggctcactgcaacctctgcctcccaggttcaaatgattctcatgcctcagcctcccaagtagctgggataggcacgcaccaccaggcctggcttttgtcttttcttaagatgtcatttttccttaatgtccaggggaaaatataggatagaacatttgaaattaacatcaatgtcatcagatgttgggatttataacttgtatagtttaacagtgatgttagtcttcattttggtttctaagctctctactgtttgaaagaaagatttcaaagcagtgattatcccagtcatctctgtataatgttaaattggtatcagttatctcattatatagcctcatacattttagcaaaaaggacaatgaactgtttagacagtgatggtttttccagttccattaagtttgactcacatgtacaaaagttttaagtggtcatagagacctaacattccaggcattatggggttaatggttttgaatgtagaaaatgtaagtaatcttagtctcaaagatctaaatttaacaatcttggttttgtgaatttttattctctcagtgttcttcgtttggctggatagggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttagccaatgagtatgctggctttctcgtggctctgggtttgaatgggtaccttaccaagctggcgactttcaatatccatgactacttgaccaaggtgagacctgtgctcccagtgcctggctttgtgccttgcctggctattgtagtagctcctaattgctctatttgctcttctttcttcattcttgtacttctaagtccatttgtctcatagtacgtggaataatctttctaaagcataaatcagagtatgtcacttctctggtcaaagccatttaattaatgatctcccattgcttttttttttttgagtaaggcagggtagaatttaatgagtgacaggaaagctctcaacagcgagaggggacccgaaggtgggttgccagccacgaggctgagtctagaggtttttatgggcttgaaatgggggaagtgcatgctgattggtctgtgggtatgcttgaaaaagcaccatttagaaataggcacgatagtgtagaggaccaactggggaagggcaggtatatgtaaagtaggtgaaggataaggaccaatcaggagagagcatgccaaacaggaatgagagctctctagtccatggatttatccagaacttgtagcttggttttcaggctttcgactgtccttggcttgaaggttgagtttcatctgagaatttacctgcctcctaccgccatcaatccccgctctgaagaggtatatctaactgctgttcggataggggtgatgactgttctgcttcatgctgacagagggtgttgttttgggaaacagcagtcaggtctctcttagaggcctatctaagtgtcccctggtaaaagagagccatcaaccgaggttccatttgcatgaccacttggagtttgatggcctctaggcgagaaaaaacaaattttacaaggaggttaagtacacatggaccaaatatgagtattacaatgagaacacaaagaggaactaaaagggggaaaatccatgcccatatattagggacacctagaaaggacaggaagaaaacctctgaaaatggactgttctattccaggattttgcaaaatagggttgtcatgggcatgtccccctagattattagatatgttataattaggcattgcaatgcttttaattagatttctgatccataggctgcagaatccagtaatgcctgataatccctttagttagctgagggtcttggggagaaggaaggagaaaatggatccaattctctcctcgcccagtgtcctggtcccttctgacaagaccaggcataggtacttcactgaagtctgacggagttgagccttggactttgaaactttatgtcctctgtcagttagaaaattaagaagagccttattgcttttctgagaaatttcctcagttggggcacagagtagagtgtaatctacatattaagactaacttgagtttgaaagaactcagagagatctttttgagattgcctgcccaaacaggtgggggctgtcttggaatccctgtggtaacaccatccaggttagctgggtagtctggttggagggatccctgaatgcaaacaagttttgggagttggggtataatggtatgcagaaaaaaagcatcttttaattccaagaatgcaaaccatttagttccttcaggtatctaagttaacaaagtatagggattgggaaccactgggtaaattggttaattacaccagttactcattaaggaggtggagatcctggaccagtctccattccctgttgggtttctttctgtacttccaatattaggatattacaaggactgtcgcagggtttaacaaggccctgcatccttaggttattaatgatggcttctagttgtttcctagcttctggttttaggggatattgtctttaattagggaaggagatgagatccctgagatggatttggactggtgagactgttgtagctcagccagtattttcctgaattgcccaaacatctggattaatatcagtctccaccagagggaggcaaagagtctgtcctggagccataaggatggtggttcccatgtgagctaaaatatccctacctcagaggagtcgggctttcaggtatgattaaaaaggcataggtaaacgaaaggtctccctaggtacagctaagggattgagaaaaatatcgagtcagaggctttcctgagacgcccctcacagttgtgctaagggaggaggggaggcccagaatggagaggagaacaggaatggctgctctggtgttgagtaggaagtctgtcctctgagtcctttgacctccagactcacccgggactcctggatggtaatgcagcctgggctgtcagagctggggaggagagccctgggacccatcagtcctgctggaccatttgagaagccggctctgaaccttgggacgtatgtttctggaggcagtttgtcttccagtagtctcccttacagattggacagggccgtgggggctgcttctgatttcgggggcagactctcttttagtgctcccacactgataacagtcggtcatagaatgagaagctccctgggatcgagaggtttatatgcctgtatggcagctattagtgcctctgcctttttctcgttccttttctccctttttcttgggcttcctcatggtcccgattataaaagaccaaggtggtgactttcaggattttctttagagtactgtctggtgcaatagctaactttttgcagcattcttccaatatttggggctgcttgggttataaacttgtctttcaaaattaactatccttttatagagtcaggagagagatgtgtgtttaattaaagcctctctcagttttttccaggaaaacagaagggttctcttcagacccttggtttatggttgataacttaatgtaattgagagatttgcctctagttttcagatcttccactgtgcatccctaaaaatgttttctcggccactttcctagagcagtgtctgagtcccattgaggattattggtggatgctgcctgcttggctgtcagaaagggctccctaatttcttcccccttttggtaggtgccataataagataaacatttcatctccaaatgtctcagtgacctgtaaagccgcctgcttctctgaagctctaagagtctagttgagaagtaacatgatacccttccatgaaagctcagacatttgattaaggttctgaaaggcttcaatatacctatccaggtcgacacaattgtcctagatttctttttatctgcctcaaatcttgtaaagaaaaggggacttgtactttgataggaccatattcactatgcatttcctgtaaaggaagaagtgatgctggagcgcatccaggtcgaactcttctaacaggatgaggttcaaaagggggcctggataagggggacgagatgatccaagaggagctgggacctgggctggtgcaggggcctctgtctcctcttctaaggaggcagactgttttttcccttctgtctggattaagtctggctggatatcactgctataagtgcaaggtctattatacattgctgacagagcttgcggttattctgcagggcaaaaaaggcctatacatatggaattttggaccattttccttctctgtggttgaagagatctagctataggatagtattatagttgttattttccccagctgactaggtctccccatcttccaacttctagctgggccaagccttgctactgataaataccaggtattttttcttcagagtctgaggatcaaaggagtcccaatgtctcgcacttgagaggagtgcaggctacccatttagaaagagagaggggagaaaaaggcatccttagtctttccctctgctgtgctagagtccaaggcgtctctcaggcttgccttggtcgtggatgtgcgcgcagccaccattcatgaccagggggggatcaagccagcaggagtagttgcgttcacttgcactcagccttgaccctccttgtcaactgcctttgatttctctgaattctatatgagctcaagactaagatgaatccgggggggtccctgcatattatttgtctataattctcatctggctggcagtttatttagcttcatcaagcataacccagcatcctgccctgaaaagaagcaatttctcaaagagacacataactaagtaacatttctcagaagagcagtaggaaaaacatgataggaaagattggaagtctttgtccgacacctgaacaggctgttggggactgggggccggtgtagggtccttcggatgtacccttggccagatacctttagttgccccaggaccttattctgatcccacacgatggctgaacttctgtgaagggaaactggtttagaacaaggccaaaattcccaacaccagagggcaaagggggatcgaccattgctcttaatatacattctaggagctggtgtgatcctgttcacttctccagccctaggtggtaccactgttcttcgttttttttttttttttttttttttttttgatgtggagtctcaccctgtcacctaggctggagtgcagtggtgtgatctcgtctcactgcaacctctacctcccaggttcaagcaattctcctgcctcagccttctgagtagctgggattacaggtgcacactaccacacctgcgtaatttttgtatttttgatggaaacagggtttcaccatgttggccaggctggtcttgaactcctgatctcaggtgatctgcccgcttcagcctcccaaagtgctgggattataggcgtgagcctctgcacccagccccactcttcttgctcccccacactctaaccatacagattggctattttagctctctggcaaactaaactctttcacttcacagcgttattttttttttaaggaatctttatttatataaatatataaaattcacataccatacaattcactgtttaaagtgtgtggtacagtggtttttagtacattcacagagttgtgcatccatcaccactgttaattttagaacatcttttcaccccataaaggaaccttgtacccactagtggtgactccccattcctctacctcacccccccaccttcacttcacttcctgccaaccactaatctactttccgtgtctatgggtttgccttttctggacctttcatatgaacggagtcatacaaaatatggtattttaggatgggcttctttcacttagcctgataattttagggttcatccatgttgtaccatctatcagcaatacattcctttttattgttgaataaatgttttattttatgaatgtacattttattcataagttgatgaacatttgggttatttgtactttttagctattacgaataatactgctatgaacatttgtatacatgtttttgtgcggatgtatgttttcattactcaagagtaatgaagtaatggtaagtagtggtacatacttaggagtggaattgctgggttatatggtaactctgttaaactttttgaggaactgtaaactgttttccataatgactgcaccattatacaaccccatcagcaatacatgagagttccaatctctccatatttttgccaacacttgttatattgtgttgagtccagcctcattcttttgaatgtgtccttccacttgtcccagcactgttttttgaagactgccctttacctgttgaattgtcttggcacccttgtggtcagttgatgttaatgtgagggttcatttctgaatcgcctcagagccatttatttacatgctgttttatcacctgaaacagtcttcctcaccttctaaacttgagtgtcctctttcctgccactgttcctggctaatttgttttcatccttcaggtcctaatataaatttctttgtataatctttagagatttcatccctaataatcctctagtccctcccaatctaaattaagctattttaaaatactctttcataatactttgtactttcttattgtactactttttaataatatatttgtttatgttttttaatttaacactttttttcctattaagtcattaggtccatgagagcaaggaccatgtttgtttagtttactgctgtattctcagtgcctctcaccttgcctgtcaacataaaagtacttcttgaaagtggcaggcagtattttattttaaactatgtatttgttttgtttctatcttagggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttggctgagataggtatgggattaatagtgctgaatcttcataggcatgtactctccactccacattaacccaattaaatagtaaaattataaaaattaaggaaagacaatggtagcttttgtgagcaaagaatgatctagtactaattaaaaaaaacaacaaaactctaagtaatgttatccaaggctaatgtaactgcaggttattaacctccatgtttatttgctagctcattactgaattccagtggtcacatttaatgaggtacctgtggttttaatcagctatgagtatgctgtttatccggctttaccagcagtgtctagcagtggcctgcacttaaaactcagagtagattgttttggtccctgagagacactaaactaaacacatcacagtgtttactgtgttggataacagcacttccaatagaagtcaagtaatggactcctgctttcctcctttacatgctggtgggtatgttggtgatgaacctggaaatggtaaggtccacacactcactttagtgaacattgtctctgttttttattgggtccaaactttttggaaatcttaatgtgttgtcatctttttctgccaaatggaaatgctattggcattattaatatgctcaacaatttagttacatacttatatgtcctattcaagatcttttctatatggatttgtgaatatattgttaaagatgtattattctttagtatcattgtatcagatagctattgccacagtgatgctacatacatacaggcatagcattggcccaggcagctctgctttaggctgtagatgtgtagccggctgttctgctgccgttctgcctcacctgcctcattctgggacccaggctggagggtgtgtttctctcgtggtgttgatagaaacctaggagagaaccagtgaagattgggacccataatttagtctactataatgataaatgaaattattcccaaagttgaaatgttttggctatcacaatacatggtagcataagtcagagatctgaaaaacgcttattctgaaaatattcaacactggttgttaaagcatgttcatctgcaaagtagtctacccttctttggctatatcatgatgatgtctaatggtgtcattgcacagtctcacagctgcggcatacctctttcacactgtatatagaagatttcatctttaattcatatgtatatgcctttttatataattactgtcagaatgtacattaaaaaaattttttttttttgagagagtcttgctctgctgcccagcctggagtacagtggtgcaatcttggctcattgcaagctccgcctcccgggttcacgtcattctcctgcctcagccttccgagtagctgggactacaggcgcccgccactacgcctggctaattattgtgtatttttagtagagacagggtttcatggtgttagccaggatagtctggatctcctgaccttgtgatctgcctgtctcagcctcccaaagtgctgggattgcaggcatgaaccactgtgccccgcctaaaaattgtttttatagatcattgttataaatgggttttaaaacaaattttgtgtaatattcattgagtcgatggtctgtaaaatgcctttttttaacttttagaactttttagattgtttctaataatcctttgttgttatatataaacattacactgattacctttgtgtgatttttttctttaatttttattatttatttatttatttagagacagagtctcgctctgtcacccaggctggagtggagtggggcgatctcggttcactgcagcctctgcctcccaggttcaagcaattctcctgcctcagcctaccaagtagctgggattacgggtgtctgtcagcatgcctggctaatttttgtagttttagtagagatgggatttctccatgtcggacaggctggtctcgaactcgttgacctcaagtgatcctcctgccttggcctcccaaagtgctgggattacaggcaagggccagcacgtccagccttttttctttttttttaaattgcatttttttcctatagggataaaatttcaggaatgtgaacattttttcagagggaagggttttaatacatagtacattttatcgttttcaacaaggtagtgttagagttatagggtgcttttaaaagtatgaattttgtatccagtcagacttctaggatcagtacacagaaattctaccatagtagggctcattattatatacactcgaaataaatgtctaaacataatatttaacagcttaacaacataagtaagtgacctccttattcattatcatcattcgaacatgtttcaccacatgtgatgtgtggatttgaaagtaatgaaaacaaaatgtaagatatttcgttgttgttgttgctgagatggtgtctcactctgtcacccaggctggagtgcagcgacctgattttggctcactgcaacctctgcctcccaggttcaagcgattttcctgcctcagcctccccagtagctgatattacaggcacctggcaccctggctagtttttgtatttttagtagagacagggtttcaccatgttggccatctggtctccaactcctgacgtcaagtgatccacctgcctcggcctcccaaaatgctgggattacaggcatgagccagcacacccggcccagatgttttaacaaaaaaataaaactttttttttgaatactctttcctttttccctttaaaatttttttctactacttggtaatttttttggtaagactcaaagtttcacagtatttgaatatcattgcttataaagacttaaattggcaatttaaaaagaactattttgggccctttttttttggtaggtaaacctacagttgtggacaccatttattatagtgtcataactttctgaatggagttatattccattcgtatgtccagtgcaacttgctagaaagttaactctaagatttttatgagatgagattttgagaagctagtttgaactgtgttgcttttgtttttacaggacggcctcctggtcctgaaatggaatactgcactgacagagagtcatactccttagctgctggcttggccctgggcatggtctgcttgggggtaagcatagcctatgccttcccatgcttcagttaggacatctacatgttgagacaaataacgttgacacctaaacctgaatattgtcccttactatgacttaatctgctgcccagctctattgtctttttggatatttttcaaagtaccagatttgcaaattgagagaaactgtggtcaagagtgggactttaagatttcttttcctccagcttgcagtgttcatgaacaaactgaagggaataaagttttttttttttaaagcgttcaagacatagaatgaataagtgacagcccactatgactgaaaacagagaatagtgaaaacgtatatgatcgggagccttaagagtctatagtagctgcttgaaacaaaccctaacccccttttgccatagtgatgttcactgtgtatcccagaatgttgtcccagtagcatcttccttgtgacaaaatgcagtatcagattgacccatctttaactccatccaagagatgtgtacagaattaccagaaatgtttcattaaatgattgtttcacttgaaatgtggttccccttgaaaaaccaccaatacattcttatggtcaaactaaatgatataaagaaagttataaggccgaggtgatcggatcacctgagattgggggttcaagaccaacctgaccaacatggagaaaccccatctctactaaaaatacaaaattagccaggtgtggtggcgcatgcctgtaatcccagctactcgggaggctgaggcaggacaatcgcttgaacccaggaggcggaggttgtggtgaatcgagatcacaccattgcactccagcctgggcaacaagagtgagactccatcttaaaaaaaaaaaaagttatagtggaaggaatttttttcatgtgtgttctgaaaatccaccttgtggttgaccatctgttagggccttgaattcacattggcacgtgagctaaagaggctggtggtataatggaaaataatcagctgggtgtggtggctcatgcctgtaatcccagcactttgggaggctgagatgggcggatcacgaggtcaggagatccagaccatcctggctaacacggtgaaaccccgtctctactaaaaatacaaaaaaattagctgggcatggtggtgggtgcttgtagtcccagctactcaggatgctgaggcaggagaatggtgtgaacccaggaggcggagcttgcagagagtcgagatcgtgccactgcactccagcctgggcaagaaggcgagactccgtctcaaaaaaaaaaaaaaaaaaagaaaagaatcacacagggaattgcaacttgaattctggtcctaactagtgagtcaagtcatttaactacattattgtgtattgcttaatcagcttcatggattgttgagccagatggccgtgttttatatatagccctgcaacttaactataatagctgtataaccttgggcttaatccctctgtgccacactttccttatttataaaatagggttttaatagtagctatttgatatggctgttcattcatgttaaacacacagaatagtgcctgacacagagcatgcatttaataaattactattattatcatagttattgttggaaaagttcttaagtacaataatgacagtattcaggtatttacagttccagtttcaattatataactaatatttttctttattgttaaatgtcactaactctaaagctcttatgtattttaagacagtacttaaagttgaacattcatgtattaaaacttttatgagaattattaatatttattaactcatgattaatgtttgctttaaattggaaataaaaaaaacaaaacccaaaataacctgctttgaagttagttcatttttatatttgttatgggtatgtgttgtggatcttccttcataaaatttcttttcactcgtctgttattgtcttttccagcatggcagcaatttgataggtatgtctgatctcaatgtgcctgagcagctctatcagtacatggttggaggacgtaggcgctttcaaacaggaatgcatagggagaaacataaatcaccaagttatcaaatcaaagtaagtacacagcaaagtaatagatcaaaagtctggaagctgggaagttaattggaaaatactagtgttcatactgacattggtaaatgtgttaattttaagcatagttattattcagaggaattttataataatttagaactcttttacatgcataaactcttctttcaataggaaggagataccataaatgtggatgtgacttgtccaggtgctactctagctttggctatgatctacttaaaaaccaataacaggtatttctacccactcacccttcctcccgcggtgatagtgtgatatcctccctgaccttggttgtaaaattcagttatctcatgtgtttctttcccctgtgctggattaagctgattttttgttctttcaagtactgtaagtttttgaaagaaaacttgcagtatttgaagttataaagattttacctggaaataatgtatttggctattttaatggtatttgacaatatagttttcaatttctgttcatttctgttttgtagttgatgtcagtaacacccaaacaatgcccatgtttgttttcattaatttagcatattgctgtgaggactggttaagccagaaatacttatcatttagtgtgatcttggttaccatgtaaaacaatggtttttgcctacttcaggagcttttgtaattaccaaaccgtctaccttcctaacttgctatattaatgctgacgcttgaaagtaagatctttggcatttatgcttacactttgcatgaggaataagttgagtacaagacgttatgtcatgtcttaagtctattaattaaaaacaaattctaagattcaaggagttttcagtgttccacatttctccctttagaaaaagtaaatgtgtgcagaattaacaaagtgtttaaaaatagatatttattactttactatttggatgaatgtgtagggcagtgcttccttggcactggggatatttcattgagcaaaactaaaaatatcttccctcatggagtttatgttatagtaagacatacatgtacatctataataactattacattagaaggtgtgaagtattgtgaaaaatatgtagagctgtagtggagcgggaagaaatgttttgaaatagagcttgagattcttgattgtcttgccctctacttgaacagtgtgccttactgttttcctccaccaccagatctattgcagattggctccgagcccctgacaccatgtatttgttggactttgtgaagccagaatttctcttgcttagggtatgctttgtcttcatttgtgttaacatgagaagtctatttgtggttcttaaacttagcttgtaagccgggcacagtggctcacgcctgtaatcccagcacttcagaaggttgaggcaggaggattgcttgagtccaggagtttgagaccagcctgggcaacacaggctgttctccatgactgaatgaatggcaaacataaatgtctttacaagagagccttttatttttaatttgtcatgcatatctaattggcagtgttcatttgaaatttcacaaataggactttgggaatcccaagaaaggtaaccacgttgatatttaatacttggagtgacatttcactgtctcacattattattcaaaacttcctaaaaagcaacaagtgattaggacttttttactgctttgttttacatttttggattactatcagggatgtgataatactgttaaggttgaatctaaagaaagtaacaattcacttaattgtctaaaattttccctctaattcttttttttctgatgtttaaacgtagcatatagaagcttttaaattatgtgtagatagagctatgattctttcctttgtgatttttttcttttccagagtacattttaaaaagtacccgcacaagccctctaaactttggtgatattcaactcaattttagtttttctttgttaaaatttaaatctttattttaatgagtagtttaatgagtaagacggttcccaacttaggttttttaacttaaccatagtgtgaaagcggtactcattcagaagaaactacttccaattttaattttaatttttttcttgtactcctggcagtatgatgctctcatggtgttgggtaatggcagcaagctgcagctcccagtcagccatgcagtcatgagggtaaatgacccatactctacagtttactatgctgacagagaatttcactcaattataggctaatttgagtgttcggagcatgtttaaggtaggctaggccaagctgtgttgtttggcaggcaaggtgtattaaatgtattttctttttctttttttttttttatgagatggagtctcactctgttgcccaggctggagtgcagtgacaccatcttggctcactgcaacctttgcctcctgggttcaagctattcttgttcctcagcctcctgagtagctaggactacaggcgtgtgtcaccatgcctggctaatttttgtatttttagtagagatggggtttcaccatgttggccaggctggtctcaaactcctggccttcagtgatctgcccgccttggtctcccaaagtgctgggattatagacatgagccactgagcctggcctaagtgtattttcagcttaaggtattttcaacttacaataggtttatcagtacataaccttactgcatttgcatatacttatttttcaaaattctcaacagttgggaactgattcttaaattgttctgtttattattatcattgttataaaatgtatgaactttacttgctctaattaattttatctctgttgcatttttaagacacttgctcgatgcctgattttgtgggatgatattttaccaaattccaagtgggttgacagcaatgttcctcaagtaagtacatataataaatattatatctttagtagcataaaattatgatttcttatgggatttttcaaaattctgtaaaatattttttcttatgaaggcaatattgatcattaggatacctcttaaagacctaagaacttccattttaagattctgtgctgcacagaccaccgccttctcttttagcctcaggtccctagaaattgtagtttttaaaaattaaatatgaatatcggtgttgcgtgggagttaaaaaatgaaaggaaaaaactaaatatgtttgccagaatactctaaaaaagtgttgatatttttgtcataattaagtgcacatttctaagatgctattttacttcgtgacaattttagatctcctaataactcttttaattactttatatcatatttattcgataagccaagtatactagttaaaaatgaacagatttttttggtaaaaactgaaaaccgaatattgtaactagccactgcccttagacaactgtccatgtctagtggtctcagtttctttatgtagattgtttctttcagtattttcagaggaaaaatctcaaagattgaaagaagttaatatgaacacccacatcaccaatagactctataataatattttactgtataaacatgtttcatcacttatctatccacttatctattcctctatctaatccaacattttttgatgaatttcaatgttagttccaaacagtaatacactccatcccaaaattgtaccatatatattaactggaattggtatttacattttttccttttaagataaaatttatatatcgtgaaatgcacaaatgttaagtatcctattggataagatttgactaacacatagacctgtggaaaccagcctctatcccttgtgccccttccctctttgtgcattcacctgtacccccaggtaaccaatatgtattttgtttatctcccaaaatatgttaatttccagatgtagaactttatattaatgaagccacatatggcatatacccttttgtataagacttctttcagcgttttcaagatattgagtatattaatagttcatcctttttattattaggtggtacagattgagtatttcttatctgaaatgcttgggaccagaagcgtttttggattttggaatactcgaaattatacttactggttgagcatccctcatctgaaactctgacatctgaaatacttcaatgagcatttcctttgggcatcatgttaatgttcaaaaaggtttggattttgagcattttggattttggattttcggattagggatcctcaacttgtgtattccatttgcaatcctattaggtggggctggaattactgaggcatagggtagatggtatatttagttttattagaaatgataaatcttttcccaaagcggctgtaccatttgacacattgaccaacagtgtttgagagtgttggctgttgcccatctaaccgataattaatggtgttagttttttaagttttagtgctgctgatgaatacgtaatgatatctgactgttgtttaaatttgcatttctctgctgactgttaatgttgagaactttttcattggtttattggtcctccgtctatctttttttgtgaagtgtctgtgcatgtcttttgcttattttttaaaaaaatttgtatttttattactgcgttgctggagtttttttaatgcattctagaaacccgttctttgtcagatttctttttttttttttttgagatggagtcttgctctgtcgcccaggctggagtgcagtggtgtgatctcggctcactgcaagctccgcctcccaggttcacgccattctcctgcctcagcctcccgagtagctgggactacaggcacccgccaccatgccctgctaattttttgtatttttagtagagacggggtttcactgtgttagccaagatggtctcgatttcctgacctcgtgatctgcccgcctcggcctcccgaagtgctgggattacaggcgtgagccaccacgcctggcctgtcagatttcttttgcaaatatccctcccaatctgtggcttgcatattcattttcttagtaataattttaatgagcagaagatattagaatgttaaataatgtctgatttgtcagttttttcttatggttattctctattcctatgaaaaaaaccatttgtctaaccccatcatgaagataatcttttctgcttttctctaaaagcttccaaagttttagttttgtgtatacttacataattcatttcaaagtaattttgtatatgatatgaggtacatgttgaggttgtctaccagggaagctcatcagagactcagcacccaagtttttaattgggagctgacatgtaggtaaggtactctctgccttgtatgtacccaagttccagattctcaggagaatgtgtgttagcctaaaccacgctgtttgtagttcaagcacggtaaacacagatatatacattttgttttaaagcaaccggttaatttacttggaatcagattgtcattctttcttggttgctagctctaatcttggtgcacgtctttatcctgtgggctgttggagtctgccctgtgcacacatggttcatggatcaggcagacatttgcacagaatttatatacagagcttggggccctgtctctgtggctctctcctttgtcatattctgtcctcacctcccaatgggtgtggtattttcctgtatcctggttgttaaggccaagaaggttatgagcttttaattgtagcttttgccatctttcttggcgcagatagacctgctttcagagcagaaaccgcagaaaggaaaatgtatctagtggtgttcctctcttccatggatcgactctcccctctagaatctgcttgcgtttgtcctcactccagtgtcttgaggtcaggagttggtgaattaagcccacctgatttttagaaagaaaattttattggaatatggccatgcccatttgtttacttattgtctgtagctgttttttgttacaaatgcatagatcagtagttgctggtatttactatttgacccttttagaaatagtttaccgacccctgccatagatagtttggattttatattttgtctagggtttacacttggtgtatgagttgatctgataggaatttattcatctattatttgaggaagtagaactcctaggtttgtttttatttgtttagttcttccagttttgttaatcactgatatgaaagaggtgaggaagaattgttttaaatgactcgctcatttgttaccataattttaactctagcatattcagatgtcagagattttagtttttttgaaagtgctctttgaaatgtatattgtaggatgaaatactttttctttcactccttcattcagcacatactcatgaatcctctgtaaatgcaaggcacgtgctaaactctgtaatacattaaagatacatcagacatatagagtgttctcaaaaaactttagtttattaaatgcactaagttcagcttactgagattaaacatgtgtacaagtaactgtaattccaaagtggaaagtataaattcatgtcagagagtggtcttttttgcggcctggtgtggtgactcgtgcctgtaatcccagcactttgggaagccaaggtgggcacatcactcgaggtcagagttcgagaccagcctggccagtgtggtgaaaccctgtctctacaaaaaacaaacgaacaaacaaaaaaacacaaaaaacagtggtcgttttttgtttttatgaaaatatggtttttggacttttagtatagaataacatctctctcttttttacttcagactttataatgttatatttggtctttattacatcagggatactgcaaataggagagataacaatttcacagttctcctgattgatatttcctatcagcttccacttttctctgggttctcatctggagctacattgattctggagcagggttccttgtagtgagcaacctagcgttaaaaggaggatttttttttttaaaggtcactttgtaaactgcttgtctgtttgaacttagggcatatgtaaaataacaactagcatcttcatagtactttttctttcataaaaagctttacatacagggtgcggttactcacgcctataatcctagcgctttgggaggccaaggagggtggattgcttaagcccaggagttcaacaccagcctgggcatcatagtgagatcccatctctacagaaaaatacaaaaattagccaagcatggtggtgtgcacctgtagtcctagccacttgggaagctgagatgggaggattgcttgagtccgggaggtagggctgcaatgagccgtgatcgcaccactgcactccaacctgggtgacagagggagaccctgtctcaaggcaaaaaaaaagaagaaagatattttaagtctttgatttggtgatattcagtacataagaagactgtattataagtgccttctaatatttatttattttattttattttatttttgagactgagacagggttttgccctgttgcccaggctggagtgcagtggtgcgatcttggctcactgcaacctccacttagcaggctcaagtgattctcgtgcctcagcctcctgagtagctgggattacaggcccagctaattttttgtttttcagtagatacgggtttcaccatgttggccaggctggtctcgaactccaggcttcaagtgatccgcctgccttggcctcccaaagtgctgggattacaggcgtgtaagccactgtgttcggccaatatttattgttttattgaagaaaacatcctgaaatgttaagaaatcttctaagaaatcttctcagaagattaaaagaataaatcttaaatacattcatatgtttagcaaacattagctttatcttttttggcttttttcttttaggagaaaaggatcaaatgtcttcttggttgttacagctagatattctgtgtatgtttttcggtaaattgttcattacctatactaaaaggaaaaggatgtcttttctaaacaatagttgtaacatagctgataaacatattgacagtttagcttatcttagcctagtgaataacctcacctgtggtaggtatgttggattaatgctggaaacatcccgtaaagaagaagtctgattagagttgtctcctatttctcttttcccacttcttcccctcacccctgccccaattctaaagccatcatctttgtatttcagttgactggtatgcaatattatgaccctgttactgatttagaatatacttacgtcttcctgtttatatttgttcagccctatttaattattattattattattttttttttttgagatggagtctcactctatcacccaggctggagtgcagtggcgtgatcttggctcactgcatcctgcacctcccagattcaagtgattctactgcctcagcctcctaagtagctgggattacaggcgtgcgccaccacgcccagctaatttttgtacttttaatagagatggggtttcaccatgttggtcaggctggtctcgaactcctgacctcgtgatccacctgccttggccttccaaagtgctgggattacagtcgtgagccaccatgcctgcccttaattattattcttacttagcccatcttagatttgaaatttgattacattcaatgagattaaaatataggcttttgagtgaaacggtttggtaaagcttactttgtataaatatagccatgataagcagtatgttattcttcagattattaaatatttgtaatgagaacattgatatctaagtattcttgctttctatattgacagattataagagaaaatagtatctctctcagtgaaatcgaattgccgtgctcagaggatttgaatttggaaactttgtcgtaagtgatgtataatgcaaattagctatcctagcgtctatcagataattaaattgaaatataccatgtgggagtaatattgtccttgatttaagtaattatgaatcccacatgtttctaaccattatttatcagatgttcatgacgttggttaaagctctctgaagtacagagctcttgccctcaaaaagcaatattggagatttaacttgtatgtatttgttttttatcctttccattaaagaaattggcaacaattttaaaaattgtttttgctgcatatgaaactgtaggcaaggggcaaacttcatgagtaaggtgacccgatgcttctgctgaaaaaaaaaatacatagaaatctgctgactgagggcacttcatcattcccagaaagatataaactagcttagagaactggaatatttattgttacttatttcaagttaattttaaagtaaaataatgattattaaatttcttgtcacctgttttcagccaagcacatgtctacataattgcaggagcctgtttgtctctgggtttttgatttgctggctcagaaaacttaccagcatttaactgtttggtaagaagtattttagtttactgtgttctttttttttgtttgttttaacaaagctttaagatgcttcttataacttggaattttttcttttgtttttctagcataaatttgccaaagattttatgacttatttgtctgcacctaatgcttctgttgtaagtctttttatcattctccttgggaataaaattaaacttgaaaaaaatttactgatgatccagttacttatgtgttatcagatatctctgctgtttttttaaatgtagaatgagagatctgaagaaccattagctcatctttttatttttgttttgcgatattaacttaggtgagaatatgattaccctggaaggatgcacaggtatctagttcttgtgacaagagaataaaaaaggccataatattcacgggttgtcatacctcatgtaattctgtctcagtattaaatattgggaatttcctttttaaaaaatattagtacttagtaaggattcagttgcttttgaggcattgcttctctgatgacaagactgagagattttatttcctggtaaaagctacatggatttatgcaacactatttataatatggaaaagttagaaacatcaaaaaagtctaaaagtagttaattaaatttgattatggtttatttatatattcttacacagtggagctaccaaaatcacgttatacaagaattttttgtggctgggtgcagtggctcatgcctataatcctagcaactttgggagaccgaagcaggaggatcatttgagcccaggaggttgagatcagcctgggcaacatagggagaccccatctctacaaaaaataaaaaattagccaggtgtggtgacacacacatgtagtcccagcaacttgggaggctgaggtgggtggatcctttgaccccaggaggttgaggctgttgcatcactgcacttcagcctgggtgacagagtgagagaccctgtctccaaaaacaacaacaacaacaaaaaagaaacaacttttttttgtgagtgaagcttgcttgtaataggtcatttaaaaggttaaaaatattgtgtagagtaacatctccatttcatttggaaaaaatatgtgtaggtaaaggaaaaattcagagaaaaagccaaaacgttaacaccagttatctttgggtgtgacattccaagtgattgttatgtcttgatattcaatatttgaaattatttctgttgaacttatatttcataatcagggaaaatatttgtatttacagatttttttttttctctgagacagcgtctcgctctgtctcccaggctggagtgcagtggcgcgatctcggctcactgcgagctccgcaccccgggttcacgccattctcctgcctcagcctcccgagcagctgggaccacaggcgcccgccaccacgcccggctaactttttgtgttttttagtagagacggggtttcaccatgttagccgggatggtctcgatctcctgacctcgtgatccgcccgccttggcctcccaaagtgctgggattacaggcgtgagccacagtgcccagcccagatttttttttaagttacaaacttttgtagtcttctaatgatggctaagctagttctgataataaagaaatgtaacacaacagttatagtgatgtcatctcttcacctgacagacaggtcctcataacctagaaacttgtctgagcgtggtgctgctgtctctccccatggtcatggctggctcaggaaacctaaaggttttgcagctttgtcgcttcttacacatgaaaacgggtggtgaaatgaactatggttttcacttagcccaccacatggcccttggacttctatttttgggaggaggaaggtaagtgaatatgtatttttccaatgaaaagatctcattggtgagatctataagggtgacttacgttgatcttgaagataacatgaaaaatttaaattctgactagctcttagcttaactagcagcattattcgacttgatgggcttctttgtagtttaaccgtcaacttatggtctactcagtagaattaccatcctctctgacacactgagcatcactgtatttctcagaatagtctgtgctctgttcttcagtgcattactgcttgtgcccacctggttaaaaattttaccattctactaagctactttctcagaaaggtcacaaacaaaatcgtttaccagatcctgtgacattttcttagttttcagctttcttgatctttttccaacatgtgccattcctgactacatcctttataagactgccctggctttagatgaaccaaaaaccatgtacagaaaagtgtataaatcataggtgcacaggtcaaagagctatctaccacagaaaaatctctttgttatcatgtagatcaagattctgtatagcactttcaactcacagcacccgtctctgcttctgccatgcacccctctcaatcactattatcttcctttccccaaagatagccctatctagtcttctaacaccttacgttgattttgcctgtttttgacatttaaattgaattatacacgatgtatccttttgcactttacttttgctcaacattatgtttgtaagattcatgttgtatgtagcaatggattattcaagtttcagtgttgtattacactttcattgtatgactgtaccacattttattgatctcccccattgatggatatgcttcttgcttctagtttggggctgttatgaacagtgctgttagggaaagttgtacatgtcttcgattttgttgtatatagaactgtgtggaattgggtcataggttgtacgtgtgtattcactttcagtgaataataccatcagtgctgcagtgcacttgtaccattttacatactcatgggcaggatgtgaagttccagttgttccatatccttgtcaacccttgttattggtatagtctttttagtagtctttttagttttagccaactagtaggtatataacaggatctcattgtggctttaatttctgtatttctgaataatgttcttgagtaccattttacacttttaatagccaactgcaaaacctcttttgtgatgtccaaatctcttgctacccagtttttgtatttatctatgttaaaatttttatttgtggtaaaatacacataacgtaaaacttatcaatttttaggtatgcaattaagtagtgttaattatattcacactgccgtgcaaccaatctccagaaatttttcatcttgcaaaactgacattctatagccattgaacaactccctgtttgcccctcccaccagcctctggcagccgccattctactttctgttttgatgaggttgactgctccacattggtttagctttgtattgatttctgtggattctttaaactatgtcctaagcccttggtcagctttgtttgttgcagctatctttgccaccctagggcttgtttgccttttcactctctctcagtggtgtcttttgatgacacaattattaatgttcttcttttatagtttttacttctttgtgttgtttatgaaatattttcttacccagagaaaaggagatattctcctatcttatcttctagaagtttttagcttttccattcacatttgaatctaaaatctacctggcacggatttttctccatgtttttttcccgctgctattgaaaagtttctccttctccactactctgcagtaccacatctattatataagttaagtgcctatacacctgtgtttatttctgggctattaggttttgctggtctgtttttctgtacttgcaccaatactccattgtcttatgagtcttggtatccagttgagtaaatccttcaaactcggttttcttcttcaaaagtgtgtttttctcttggctccttgcattttcatataaatattggaatctgttccatactaaataatctgataaaatattgatcagaattgccttgattgtatgtgtctgtgttaaggagattagaatctgttacagtattgtcttccattctgtgaatatggtatacccctgtatatatttagctgtagtgtgtgtgaccttgatcaatggctacagtgtctgtgtaggctaattttcccctcttctttaaggctgagcttaccattggaactcaccttttcagaagtacaaaaagtaaagttgatcagaaaggtgtgtatttcctctcaacatgttttgtggaattgtctttctttaattgtttagaattaataatggtcaaagaaatattactatgaaaattcttatttattttattctatgatttttgaaaattttttcctttcaaaatgagcctctccgtgtctcttaatcccatctttcattgttccaaactgtatgactctcctcgctcttctttcatatcgaattgatttttctaccattctgctactgcttttctagtgatttttggtttttaaatggtcatgtatactctgtaacaacatttaaacttagcatagctacaccattatgtttctacccaaaatttctaacattagtatcttaatatttatctttgaattttggtttatcaaaagggtacaaagaaaatggcttattccatgcacatgccaaaatagatgtatctctttgcttaaattttgaaatctcttctttctaatccattaaatatataagcatatataatgaattataagtccttatttaatactccaattattttaaaagacagggaaagagatttgggtatatgtgtgtgcatgtttgtgtgtaagaaaagtatttatactcaatagttttagaagtggttttatgtgatgtcctacaccatctttatttcaaaatattttttagaaaaactctgggactttagattaatttgcctgtttgctatactaaatttgagcaacaataaagtaatttaaggaaaattttaatagaccctttaccaagagaatatttttaaagtctatgaaactttatcttaaaagtgtatcatattggtgaggaaagaatttatatttagaggaatagttgtttatacagtcattgtaactttttttttttttgagaaggagtctcgctctttcgcccaggctggagtgcagtggtgggatctcggctcactgcaagctccgcctcccgggttcacgccattctcctgcctcagccttccaagtagctgggactataggcgcccgccacggcgcccagctaattttttgtatttttagtagagatggggtttcaccgtgttagccaggatggtctcgatctcctgacctcgtgatccgcccgcctcggcctcccaaagtgctgggattacaggcgtgagccaccgcgcatggcctcgttgtaactttttaatgataacttttgccttttcatttagtcagtcattctaaaggaatcatcatgcttcacagaaacagaaaaaaactgtttaaataccaattacaacattctgtatttttaaaactcagatttataattgtatatttatatacataggcatatacataggcatatacattaataaaattggataagaaggtggcatacttggtacatgactcttcaatatttataatttctaggactgcattcatggtcttcactactctgctattttatgttaaaaccttgcttcaagggttgaaatttaacatttatgggatattactttggctttaaatagtgatgatcttgaaatggcccaaggactaaatgaaaagtggaatgttcacaccactgacactcttgtattatgagggcatcttatcagtatgccttactattataccccagtttcctgattctcaagaatgccttgaaagtatgtgcaatataatcaataacatctgtccccaccgaacttactttgcagttactctttgagcacatcaaattcttccattgccgctcttctctgtgccctttatccgcacttcccagctcacagcactgacaaccggtgagtctagtgattctgtcttcaatgtgatacttattaagttctctaaggggatcatttggttgtattttggtttcatggaattatttccaaattagcattgttttgttcttcaacttagttatattcctggctaaatcttttaagaaaattatctcacaaagtattagaccagaggataactttggacacctgatgactgaccagtcttccaccattctcagatctatagaactgctctaaacccaaaaggagatcaagtaaagttgtctttagggaaaaaatcatcaggtaaaggatagttgccaagggaagttcaggatactttttttgtgctctaattatttaattccaagagaaaagtttgtctgatttagtggcaatgtctgtatgagtttctttttttcctttcacatagatgccgagaaattgtgtataaatgacatagacgggacaagaaaagcaaaatacagcaaaaaaccagagacaatttagaagtggcagtgagcggtagaacttcaaaccatgtagaagcagttaaaagctctgtgttttagggtacgaggaaccaccaacacttaagtttccctagatatagtttgagacatagcagatctcttgcatatgggggcagagaagaaaatagcccctataagacacctgagccctgtgctcaactgaaggcatcccatgttgtctccccagagacaggtcaagagccctttattgtttatgggagaagggtcaggagcacttatcacagtaacctaagccatcattttaaactacactacaatgtataaccaacgacagaagaaagatagctgttttacaaaagtagcctaatctgaagaccacactctgatggtaggtgcagcacaagaatattgttaagttaatacacttctgacatgtggcctcatgcctgtcatttaggaaagattttttgagttgttaaagccaattattggctagggtacagtggagagccacactcacatactgctggtcatagctatttggcttagctattgtaaacgaagccattttccattggtgacaagaatctttttttttttttttcgagatagagtctcgctctgtcgcccaggctgaagtgcagtggcgtgatctcgggtcactgcaagctccgcctcccgggttcatgccattctcctgcctcagcctcccatgtagctgggactacaggcacctgccaccacgcccagctaactttttgtatattttagtagagacggggtttctccgtattagccaggatggtctccatctcctgaccttgtgatccgcctgcctcagcctcccaaagtgctgggattacaggcgtgagccactgcgcctggccggtgacaagaatctttatgtaatttgttagtgtcattttttctgatctttattgattttatttttaatagatttatagaaataaatgtatttgagtaagaagagggaagttactgtctataaagctttttaaaattgaagtctcattttatccttctttttttttttttgagacagagtctcactctgttgcccaggctggagtgtagtggtgcgatctcagctcactgcaagctccgcctcccaggttcacgccattctcctgtctcagcctcctgagtagctgggactacaggcgccagccactgcgcctggctaatttttttgtatttttagtagagacggggtttcaccgtgttagccaggatggtctcgatctcctgacctcgtgatccacccatcttggcctcccaaagtgctgggattacaggcgtgagccactgcgcctgggcgatttttttttgttttttcttctgagatggagtcttcctctgttgcccaggctgcagtgcagtggtgtgatctcagctcactgcaacctccatctcctgggttcaagtgattctcctccctcagcctcccgagtagctgggattccaggcatgtgccaccaggcctggctaacttttgtctttttagtagagatggggtttcatcatgttggccaggctcatctcgaactcctgacctcaggtgatccacctgccttggcctcccaaagtgctgggattacaggtgtgagccactgtgcccagcctatttttcttttatgagatcttaaaatatgaaaacttttttgtttttacattctaaaatagaaatcttaaagtttaaaaaactgtttgagaaccccaaagaaaaatattgccatacccacatagatgtttgatgtactgtgtttcaaggacgtgtgtatatgtatgtgcaagtatgtatgtgtagaagaactttgctgtctgagaagaattgacatcctgtcttcccccttcttccctatcaatccttaaggaaaaagaaaaaaaaatctgagaagataaaaacagatgcctatgttgagtagaaagggatttttgagagtgattgattttataagtggtcagtttgatagtaaatattttcatattatgatactttttacctccctgtaaaacctcttcactgtgaagactaaagtaaagaattattgggtcaaaggtcagttatataaaatttttaaaagataatttctccattactttttaatagaatcttatctgcctttaagatttctgttcatttgaagatattacttgagcttctgtcctgtcttagcttataggcaacagcagattgcagagctcatattgtcacagttgtttgttacccactctctgtcttttttgtgaacaggtatcatctccaggctctccggcacctctatgtgctggccgcggagcccaggcttctagtgcctgtggatgtggacacaaacacgccctgctatgccctcttagaagttacctacaaggtatctctccctatcatttacttgtaattttattaccactcatccgtctttgcaggtcataatatttcaaatgtgttgtccagtaaaaggtgataagtaatgaattgaactttcataaaaatggaagcttccaaagttattgtatatcctgccaggccattcatgctcatttatatgatctgggtatcactttttagggatcatcagctactcttttgtccttagagcttataatttgaaaatgtccctgttaactttatgtgactgacagtagtgttttgtataactgattgagttagacccattcttagatttgttagctgaaacttgaaaacccaaaattgtgtatttgatgacagctttcatttagatgcatagattacaagttttatatcctcctttcattcagcaaattattaagtaccttctgtgactcaaaaccgtgctaggctctggggtacaaaatgagatgacattgtcattttccttaaggaacttctatcccctggggagccaggcatggatacaatgggaatagagggtgataattggagatgtctgtggaatgcaggggaagcagagaagcaccctcgcttagctgttagttatggggttgaggctgtcaacagtggacagtgtttggactaggcctggcccactgagtggagctccttcccagcggagaaggcaatgtgcagaaacccagcagcattggagcacggcctttggtgctgctggcctgtgaggagcaaggcttgaagtgatgggaaggacacataccctgtgaggaatttagacatcagtcctttaagatttgagtaccagagaggattttatgccatttaaaggtctctgtatgaactgcggggatagggggaggtatagcgtggagatgtttcttctttgttgtttccactgactacctagtgaattgtggctggacttttacatttgtaaagggcactcagtggtatgaacaaaccaaagaagaattgatggctcctacccttcttccagaactccatcttttaaagcaggtaagctgggtgtgttcgggagttgggtccaaggggtcaattcaacagaatggcatagcgttaaagatagctaaataaaagcctctgctttcttcatgtattgtagcagataagaaagctgcagcaggaggaaaagtcagaaagaatagagcaagtcttttcttagagatctttattgatagcttaggtggcctcagaacatgatttacattcattttttgtctggaaatggagcttgttaccttccagatgcctctttctggctgttattgtttcctctgagaaacataggtttcagtttgtcagatgagcatatttttcagctttgggttgactatgtttacgtttatcttgacagattaaagtaaaaggcccaagatactgggaactgctcatagatttaagcaaaggaacacaacacttgaagtaagtacattaaatttctcaaatttaccttttaggaagtgaatagaagtatataagaaggtataaattatagattattatctggaatgtgactcatcaccctttaatctcattcaagactatatgtagggtatgtcttctgtaaaacagtctgtatctttgaaacaagacttgtgttagaaaatgaaagttttaatttcaaactccaaccctaaatatttatttattgagaaacttgcactgacttccttgtgacagtaatggacttatctcttggtatattaacataagatttagtttaagaaagtgtattagtccattttcacactgctataaagaactacctgagactgggtaatttctaaagaaaagggatttaattgactcacagttctgcctggctggggaggcctcaggaaacttacagtcatggcagaaggcaaaggggaagcaaggcatgtcttgtatggcagcaagagagagagagagaggtgcaacacttttaaaccatcagatctcatgagaactcactcactatcatgagaacagcatgagggaaatctgcccccatgatccaatcacccccaaccaggtccctctcctgacatgtggggattacagtttgacatgagatttgggtggggacacagagcctaaccatgtcagaaagtaaagctgatttgtacacgcacaaaagaactttattaatcagtgtttatcagaccacatcttttgttgcatctctttaccattcttttgctagaaagttctcctaaatttaagattattgtagataatatatactactcagccagtttattttgggtggaaataatcacgtgcagttattttagagtgttgatacatttatacctaaagtagcatgtcagttaagcctttaaatttcaaggaagtttaacaagcatgtaaaagtttttatagtttggtcccaatgtgaatttttccagactgtatattagctgttttctgtattgttctgtccttagatttgcagcattattttcttcttgctgcaaaccaattaatagatatttagtacctcatgtaccctaggcatagagctaggggatatagggaatacaaagaaatgttagacaaaatgttatcttcgaagctcataattgagccaatagtcaaagtgcctcctcatttaacaagttccatgaatctagacaccaaagaaaaacagaactttattctaggctttctcatagggactgatttaatcttagacacagtaaataatcatttaccttagtggaaaatggtaaaagcttcatctcctgtgaacatggtattgggaaaacactgtttccagccaagaactgccagtaataccttatattaaattcattctttttctttcaggtccatcctttccaaggatggggttttatatgttaaactccgggcgggtcagctctcctacaaagaagatccaatgggatggcaaagtttgttggctcagactgttgctaacaggaactctgaagcccgggctttcaaggtagtattattgattggtaaaaacggaaagaaataattctaaattgctggcttcctcgcccattgctataaacttcaaaggtggatctgcttcctttttcattgttgcagattgtaaagactgactgtggctctgtttgctttttatgtgataaaataaataataaaatataatgaatataaaatactgtatataataagtaatatatatataataaagtaaaatactgtaagttaatgtttacatttagcagcaaggacagtcacaccatatcttgacactgtaacaaatagtgattttattattgatcttcaaatcggtgaagatttacttaatttcatagcaaaaatagaaaacgagttttgcaagctagcaattattaactccatttaaaaaccaccatttgtttccttaatctcggtgaggataaactgatgacagattcagacttcttttattagtttgctttattatttgcacagtacttgactgccagtgcagtagtgtttgaaataaggaaatagttacgataaatgagggtaggaagcaatctcattcccttggcggggtcagcacatattttgctctatattcttgactcagataagtttccaacacaagaaatttgtcccataatcaggcattaagacttctgaatttaacttcagtttcctgtaattccatgagcaactgtgtccctgctggtgatacaaagtagagtagtctaaagtagttaggaccctaaggaataattagacggcaaaagtggggcaggcagactggatgagtggcagccagaggactgagttagcatcctttgttcttccaagtacggagacagcagtttattttaattcaactcatatttcattttagtcagttacttatgaccgagcctttataatggttcccaggattgaaatgtataaatagttcccagggttgacattggtgaattttgtttggcagtattcagtaagttgtttatgaaatacttttgaaagatttttggacacagtttaacttaaatttgtagtattgcttcttctaaaaattagagcatattccaaagactctaacccaatttgtgaagaaaatagataagtttagacttgagtttgaacgaagaaagtatataaaaattaaaagctatttctatttcctgcctactggagttcagaaataaaatataaacctcagtggaaaatagtaataccttcatatttcattttcaatcttgaaccttgagtgatactgtttttttcccaagtttaaaaagttgtggtaaaatgcacacaatttattgtcttaaccattgcaagttacagctcagtaatactaagtgcattcacattgttgcgcaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacccctcattctacttcccctagtccctggcaaccaccgttctattttatgtctctgtgattttgattatactaagtacctcatttatgtggtttcatacactgtttatctttttgtggctggcttgagtgatattcttttttccttaccttttcagtaacaattctagtttctggtaggctttttaattagtcagtgaaggagggaaaagccttttttggatgagttgtgtaaacaggaagacctgtttgttattggccttttgataaattagcagctcatgttaacttgtgcaaaagcttcttgtaacttcttagcagaacaggttgatgaggcaagtttgcatcatctgggattttttgggaatgttgggtgacaaaggggaggtagagttgttagaactgtgtgtattacagtttaagcgtaaggaaaataatcttttgttgtcttatactgttgtggttgtttgtttttttagccagaaacaatctcagcattcacttctgatccagcacttctgtcatttgctgaatatttctgcaagccaactgtgaacatgggtcaggtatatattctatggtttgccgagccccaggactagaatttgttattatttctatgcatgggtcacccaaaacatctctactatctatatctatctttgagattgatgacatgcgtcagtcacattggatgacttttgcttggcacgtatagatttgcatagcctaaaactattaaattcagcaactttctaccttgatagaagaaacaacttaaaatttataagacatcagttttgacagatgatagtttctgtcatctacaagaatgatacccatccatattctgctttatgttttcagtgtttaccacctttctcttatttttatgtaatttcattaactgtttcctctgtatattataacccttctttttattgttcatacacctgttaccttcaagattccaagggtgctgagcagatttttctttatttttttgttttttgctttttgagacagggtcggttttttctgttgcccaggctggagtgcagtgacgtgatcatggctcactgcatccttgacctcccggagtgaagccatccttccacctcagcctcctgagtagctgggactacaggcatgtagccaccatgcctggctacttttttaaaaaaattttttgtagagatggagtctcactatattgcccaggctggtcttgaacttctgggctcaaatgatcctcccaccttggactcccaaagtgctgggattataggcatgagccactgtgcctggcccagatctttgacttaatccaccatagagacaaggaaagattggatgcatatatggccttcagaaaatttctcaacctctccaaaatgtagtttcctcatttctaaaagtgattataatagaacctaccttacagtattgttttgaggattaagtgaaataaccttcccctctcttttttattgaatctttactatacatgggacactctgctaatacttaaatgtcatttaattatgaccctgagaataggtattttatcattctgggcttacagatgaggaaactgccactgagagatgtcacatgcccaagatctcacagctagtaagagctgggctgtgcactccaggtcacgggtctctaataaagcccatgcccacccttaaccccagctggacttgactctgccacctcccctaaacttgttctggtcagtgttttttttcttgcagctttgttactcggtttcctttctggatcctactcttcccagcccaacccaaggcatagctctgtgatgtcctatctactcattttgtcctagtttggtccattcctctcttctgtagcacttactatccttaactgtctcttgggacttaatttttttttttttattaatgtttaatgttacatgtgctgtggcttttttaaaagattgtagtgttacttttatgtcattcattataaaacttaagaatgggccatagtagtgctatacaatttgtttttgaattgattttggaatatactttgtgctacaaaacttctgattttctgcagaaacaggaaattctggatctcttttcttcagtactctatgaatgtgttacccaggagacctcagagatgttgcctgcatacatagcaatggatcaggtatggatccaaaaacctataccaattctggtgaaatttgtcctgtagttcaagtaactcactgaatagtgtggtaaggttcctagtgtccttccttttagtttcccatttgcttttggaaatttaagaaaggaaaccatataaaatttgaaagctctcaaaaatccaaaaagcttgggctttatgttgacaggagtgccccttggggggctgtcttcctttaagggttcccattcctcccttttgtctcccctgactaggagaggaggggagcactcccttcctctctcccatcttatttttgcctccctcctggcaatgcctctttgtagaagtctgcatgtgagccgttagtgaacagaaccctagcgatggcagtactgtgaaattagacctatgtgatgaagcttgcaagaggttacagagtccatatgcagttatctaggcattggagttcatttttaaatttctcttgttattgctattttaaaagagcctaaaggggtaatgcagaaaataatgcttaataatgttcttaaaggatcagaccaatttattcactttaggcaaattagtaatacatacaccttttcagtattatcatatctttcagacccagatttggagctaagccaagccagtagttttctaacctggcagaaatttgccttggtatcttaaaaatacagatcctttaattccatgtctcatctattgaatcagaatttctggggtgagatccagaatctagttttaaacagctctttaagtgaatatagtaagttcacagctgagcatctgagactcagtgtctaagagaaataacctttaatgataaaaataatttgctaaaaagctgaatggaaaaatatatttagccagaggataattcccccaaaccagaaaacacacagtgttaagtaacatcattaaaaaccaagttccaatataactaagtaggcccagaatgccattattgtctggaatccacccttttttggttggaaagtatggatatatggtatccacgctggcactgcttctcacagtgcctctttgtatagcagccaaataacaagttgtgttatttgctggatgagaatgttgctggctgagaatgtgtctttttactctctgaaccctcacacctttacagtcatgggtggcaggtctttatgcatgaatatcttctctggttgcagctgtagtgacttgcagatggatctcaagggcagtattattagtagtgttcttcttgccctctaccccctgggatctctgccatgtcattgtacccagcttgagtttcccagaggtgactggctatgaccttttgggtcttggttattcggagctgttgagccaagaatgagctcattcacctttgttacttttccctgcaagctcctcatgtagggccatattgaaggaggtgagccattcacctgtacccagtgacggcgcctctgtgggcagactgcatcaaaacacagaatggaccaccccccgaccctttataattcggagccacatttaaaaaatactcagtctacaactctgatgaagagacagagcactctttgattaaatagattgttgtcctctttcctcttcaaggctataagaagacttgggagaagagaaatgtctgagacttctgaactttggcagataaagttggtgttagagtttttcagctcccgaagccatcaggagcggctgcagaaccaccctaagcgggggctctttatgaactcggaattcctccctgttgtgaagtgcaccattgataataccctggaccagtggctacaaggtaatagtagcattgtagcatagcgctcttgtgcttttgagatacattcggttcaggcttttctgttgtaactttgttttttcattggtaagcaagataaatctgagtataagcaagaatggctatagatttaacgtttccagctagatgaattagactttgattatctactttagcttctttagtaaaatacatctgacccaggcagataatatttatagcattttaaataccacttggtgctcaggaccttgttctctcttccctagcatcagatcacatttcctttccagtgcctctgtctcctgtttcctaggggtgtggcctgttgccttcctgaggccagcagccatcctgtttttgtactggcaccacatgtacatgtagaagttgacgtgtgcttgctgagtgagcttgttgtaccaactcagttttgaaaacctgggaccgcacagctatgtgatgtcacagtggtggctttctatcagcaggatttgtgattgcaaggaaattgtagttactcgttaacagtgtagaagtgattctgacttacatgaggcaagcgatggggcctttagatttatggaaatgtgtctgtgtgttaaatacacctgaaactgattttcaggagtagactccttgatcttttcattctttttagttcattcaaatgctcccagtaaatatctgacagttgcttgctttgggttaatactaaccttagtaatagtagtagaaacaattcttgctttgattagtgaaaactattagtaatcaatagaccctaagcgtttgaatataattcagtttaaaactatccacctgtaacactaggaaataaatttctgaaaaaaattaaattgtaaaccaagttgtgagggatatacttggaaagcctgattgcagactctccatgtttatatttaaaagctgcattgtatttgtcatttcctgttcagattcaaagatcatataacttcataattttttggatagtcatttttatcctcatttttggggaaaaacatgttatttcaaaggttttcgtgtttcgtttttattcaatttaacatttgatcacctatggcagacctttgctattgataataaatacttccttaaatctttgcagattccctgatttgcacatttcatataatgtatggaactttggcagtgattagaacattctctaaaacagggccctgattgccttgttgctctttagcgcatttggtggtttccagcattgctgtcagcctccattgaatttgacttgccacacagatttatcaaaaatgtgtttattttttagtgaaaaactagaatttttttttaaaacaaaacctcttaaatatatagtctcctctcttacaagcactagcagttggcattggggtagagaacaataaattaactgaaaattggaaattgcattcatatttgtgtgtaaaaatcacagatgcatatgtggactttcaggatcactcactaacaactcattagatctgagataacccattgaatcactacactaatctgaaaatgcagccaatttatattatataaatgtcggttttgttttttctttttttgagacagagtctcgctctgtcaccagggtggagtgcagtggcgcgatctcagctcactgcaacctccacctcctgggttcaagcaagtgtcctgcctcagcctcctgagtagctgggattacaggtgcatgccaccacacccagctaatttttgtacttttagttgagacggggtttcaccatgttgttcagtctggtctcgaactcctgacctcatgatctacgtgccttggcctcccaaagtgctgggattacaggcgtgagccatggcgcctggcctatataaatgttttgtacagtatttatctcctcaaattataattttgggcaaagaaagcgggtttcaagtttaagaactttaaaaagttttattaactttttcatattttgttatggaaatttaaagaatatacaaagtaagtagactagtgtaataaaccacaacaccaattttaatagttgccagcattctcctatttttgcgtcatttgtaccttcacccattgccacactcaattttccaaattgtgccattttactttcccaccagcagtggattgcaatgcaatttttggcattgtcctttttttttttttttttttttaagacttgtcaagtgcagtaggaaagcaaagtaaacccaaagcaagcaaataaaagcagaaaccaatgaaaccaaaaacagataagcaatagagaaaatcagtgaaacaaaatgctggtagacatgagaaagtcattgaagagaggctgaaccaccatgctctccttcatgatgagctgttcaaagaagaatctcatctgttctcccttaacctttctccctctgctgcctcccccaaacctaaatgtttccacctcccagtagactgacatcctcacaactgtgttcagtggagtctacagttttcatctcactccatctctacaatggtgaggcttttagctacattttccttcttgaaatgagcctcccttgactttgtcatagcacactttcccaatttttaaaaaaaatcctctttaaaaattctcagtatttgtcaccatttcactgtcactcctttgttgacccttttggaagtcatccttgctcctttccctccttcccttctctgcgatagctgacccattgctgatgcctttcagtcctcatcatagatatttcttgaatttgtccacattttactatttctacctagaacagaatgatgattttgtgcctggaccactgttatagcctcctaaatagcctccttgctttttctcatctccattccaaccatctcaatttaactgacagaacagtcttttaaagaataaactgatgtaacactcctgcttaaagcttttcaatggctcctgattcagctgtgaaagaaatccctactgtgtggcaccaggacctgtgtgacctgcaaggcgcctgttttcctcaacaaagcctcttttataccacttgctccccacaccaccctggccccttccacttgctcaaaaacactgagctccttttcactgtggggccattgaatatgctgttttccctccctagaaccttttcctctcattcttcacctgcccaactcatatttatccatgcagcctcagttttaatggcatttcctcccaggccttccaagaccactctccctcaggcagctttcctgacatctttagcctgcccgctcatgctctctaccttttttctgtatcaaaatgcctttgtttgcaagtaacagaaggcctgacttaacctgcctttaaacagtaaggacacaagtatgcctatgttattagaggtctgcaggtaaggcacgtaaagggtcatctttttccagtgtcttcaactccatttctctgaggttccatcagctacattctgtgccatgactttatcctcagtgcatttttcagatggtaatcaaatggctgtaacatgttcacctctagctcagcatgatactcagaggaagaatagagttgcttctaggagttttgtgatgagaatgagggaatttctttccctggagcctccagcaagcttgtcattaagtacctcctcaggtttctggctcgagttgcatctcatgcacacctctcaatctatccctgtggcagagaatgtctcttattgaaaaaatggcctgggtttgcctgtctctgaactaacactgcatcaggagaatgggattgccttgatcacccaagatcagtgattctcaaagtgtggtttatggagcagcatgacctgggcacttgttagaaatggagtttttctggccccaccccagacctactgaataagaatctctgtgctctgtgcatggagtggggcccactcatctgtggtttaacaagccttccaggtgattctggcacatgttaaagtttgaggacccctggccaagactagtaaggatctagttctggagctgaagtcagtcccatcaaatataatatatggtggagggtagggtgcgacaaggggtatttcggggagacaaccacagtgaccactgcacctttatagcactcatcacaatttgtaattatgcatttgtttgtgtcattatttgtgtaatatctgtctcccccaacaacactctaaactctacaatgacagggactcagtctagcttgtcagagtagcctcaataccggctatagaacctgctttatatatgctgagcgttcaataagttcttgatgaaaaagtaatagaagatatttcttgtgcctctcagttctgtcatcagttggttccgttccatttgtttctctcacagtcgggggtgatatgtgtgtgcacgcctacctcagcgggcagcccttggaggaatcacagctgagcatgctggcctgcttcctcgtctaccactctgtgccagctccacagcacctgccacctataggactagaaggtaattgcatatctaagtcttatcttcagtacctctgttacctacccctttacgttctagtttctcagtagttactgcccctagtttgactttcctcttcattaatgttgcagtgtcattgttagggactgttttggagcaaaaaagaaaaaattatcaactttatatatgaataactttcatttttattcagaaaaggatggattcttcttcacagagccccaaacactgatctatactaataaactaaatattccatattattctttactaattgatttttttattaaagctatttttctttattttctaggttttcagttgggttttttagaatcacatataatcttaatttctaatattacaaagctttacaactaataaatacctaattttgtgtttgaatttttttataatagttttaaaaattaatagtattatcacctgattgtatttttcagaatacagaaacagataaaaaaaatttatccattaagctgaatactaagatatgatgaattctaagcacccaatttttctgagattctcaaaaaaaatattttctgataagggcaaagattgttccatttaatcatttaaacttgaagtttaattacattactagttttttgctgttttgcaagcctctgataaaagtttactatctagagacttctggttatggccatgatggaattgcttgtattggactcacttgccctcaaaaacaaatataaaagctaaaaaaaaaaaaaataagaaaagggaagtacaacagggagagctttatattcaccctagcttctcccccaaaggcatttgccagttcatagtacaagaagtagagtgccagcaaaaagcagcaatgctgcagggctgaggagccagaggttgggtttgtgattgcccaagagcctagaacttgaggaacacagtctcaggcaggagagaacgatagaaatcataactcagactctggatatacctttcccttgagttacttaatgatattttagccttcatatacatgggataagacttcaagagatctagcagaagccacaaggccaaaaatgtaagcaaaaatgtcagcagcagcataggactgaggagacaaagggtggaattcaacgcttgttaaagtgaagtggctctgatcagcatcccagctcctcaggtgaattaatacatggccaagccctaagcctgctctagcctaattttagatctggtctgcttcagtttcactccaagcagacttgacctacaattagcctagagcagaactaaggtgatctgtgtgctttctccccacctgacagaagaaaatgtaaccttcataggagaaagaaaacatacccagagcccccacaatttttagtctacaggattcagtgttgaatcaaaaattatgaaacataataataataaaaaaacagataatagaaacagacttatgtgtgattcagatattggagttatcatactggaacttaaaataactatgtctaatgtttccaggaaaatagaaggaatgatagggaatttcaccagaaacctggggtcaataaaaaagagttaaatggaaattctagaactgaaaaatatagtaactgaaatgaagatctcagtattggattatttgaagtgaactggaagacacttatctgctggaagacaagtagaaagtaaacaaactgaagcacagagggaagaatggttaggaaatacagagaagagtacaagagacatgtggaaaccgtgaaaaaaaaaataaacatgcatggggttggaataagagaataagaggagagaaaaaatgagttagaagcaatatttgaagagacagaagctaagaattttgaaaaatggtgttaaatattaacccacagtgaaccctaagcaggataaatacaaagaaaaccatacctagtcacattaatagtcaaactactaaaaggaaaaggaagacattttaaaagtatagacttcttttcaggccaggctggacaaacagggttgttcaatggtcaactgtattagaaccagtaaaataccacttagatagtatttgaaggtagacaggcacttttgcacattatatttaaagaatttatatatatatatatatatatatatataaaattaaacaatattagtagtttcacatgtagttataggtcactttctgaagtctagaatgggtaaattctatcaaatcatatacaggtttgagtatccttaatctgaaatctgaagtgtttgaaatcgaaaacgttttgagcaccaacatgatgctcagaggaaatgttcattacagcattttggatttgggatttttggattaagaatgctcagccgaggctgggcgcagtggctcatgcctgtaatcccagcactttgggaggccgaggccggcggatcacgaggtcaggagatcgagaccatcctggctaacacgttgaaaccccatctctactaaaaatacaaaaaaaattagctgggcgtggtggtgggcacctgtagtcccagctactcggggggctgaggcaggagaatgggtgaacccaggaggtggagtttgcagtgagccgagagagcgccactgcactccagccccggtggcaaagtgagacttcgtctccaaaaaaaaaaagaattctcagccagtaggtgtaatgcagatattccaaaatctaaaaaaatccagaatccaaaacacctctctcttcggaagcattttggaaaagggatactcaatttacattacagtgtattaaggaatttcataattttaaatattgtctttgcatagtcattttcaaagggaaaaatgcctgttttaaacatgattgtgtttctgaagcttccttgaaaggagaggtatggctgaatttatttagagatgtgaccttcccaccccatttccattttagggagcacaagctttgctgaactgctcttcaaatttaagcagctaaaaatgccagtgcgagctttgctgagattggctcctttgcttcttggaaatccacagccaatggtgatgtgaccgtgtctggcggtgaacctaccctgaaacgtgacttctgcacaaaaaacgtgaccaaacatcaaagctaaagcaatgtttataaagttttatggtataactagggggaaatgagctgcacaaacctcaatgtattttaaatctgttgctgtcatcattaacggtatatgacatataaaagcaagttaaaatttacttttgtaaataaagtttttggtttgtttccaaaactcttgatgattgctttagttttggacttagagaatagagcaggggttgctggagtgaatattgatttttaaagtctttgaactgtggtggtataggtgaagtgactaagcccaaaaatgccaagttttaaaagaagctatgtcataaagttttactttctgtggcaaaagagcgctttagcatttcctcagatgtcacagttgtcctgtctaaaataagtttgtacttctggtgacaatgccagacactcttatgatgtgatcaccttaaacaggagaaggagatttttgccctcagttgctcaacatgaagtactgtggactgaattgtgtcctcccagaattatatattgaggccctaatccctgtgtgactgtattaggcaatagggcatataggagattactaaggttaagtgaggtcatcataagggtggggccttaattcagtagaattggtggcctcctaagcagaggaagagagatttttctttctctctctgccatgtgaagacagtgaggagtcggccgtctgcaagccaagaagagcccttatcaggaacagacttggctagcaccttgatcgtggacctccagcctccaaaattgcgagaaaatacatttccgtcgttgaaaccacccagtctgtggtattttgttatggcagcccaggcagactaatacgtgaagcctgctctaaatagataaaataagaaattactacagagggctctttagaaattgtatttaaaaacaagacaatccatatttacctaagatttacagaacgtatgtctgtaaaaggagggatttctggactagatgatggtgaaaaatgttcatataaaggcacctccagcttcgagttgccaacacaggaggaagaatgctccctgctgttcagatgctgatatgtgtcctgtgcttcctggatggccagtgggatcataagctggtagaagcaagatcttcatccactgacttcatatttcttccacatcctgaactgtggtgtttgactttaaaaataaattaaagcaaatagaaatgtttccattgagattttggcaaaaacccacatgacatttgcgtctgcagagtagacttggaaggcatgcacctggaggccaagtggtattctctggactctctgtccttgcatttgcgtggctgccccgaggactcccttcttcctggatgtgaagcagaggcacggtggggctgactgagaggctgaaatgtgcttctcttcacagttacatagttttcttctaattaaaaataaattttaagtggtagattatgaaaattccatttgaatcaagattttaaaaattcaatatcaaaccagttgttactgtcttcactctccgttgtttacgattgtgtgcttttccctgaataaagaatgactggagagacattagttgtttgcacacatattaactcatacctaagggagaacagcttttagaacattgtcgatgaaagcaaatatcagctttaaaagagagaggacagaaagactgcagatggtctggaagcagcatttttaggccatctgattagctagcagggagcaaaggggaggctgggaagtcagcccttgagtaggcctgctggatcatcaaataaatcaattgcagctatttttggggcctcaaaaaatcctgagggtatggctctcaccatccagaacctgcagcctccttagagccatggctcaaagggaagtgctgcagaaaaacatttggctgttaagtgttttggcccaaaaatagcacacatcatttcctgttaaagcctgttggcccgaagtagtcacactgctctacctcatgtgcccaggactgggaggagaggcagacgctggtgaggatcttatgccagttacatcatggttcctaacttactaattccctgtgcccatcttttctacttagatagatagaaataggtatcatcgcttccatagacataattaaagaaaccatacaatttacacatacactcagagtggtggttctttccccagtagacgctgacatctgcgttcctcccttgcaggtcttctgaaggacctagcaggagactcaggttgaaaccctacagaacctcgccgtgtgccgccgagtcttccttgaataaggccattttctcaccctttgtctagtaactagctgactccacagctcatggtaaggggcatgtctcagctcagggggtctcctgacatcccagaggaagcaataaggtgggggtctttcatctctcagcctgatgatctgtgcacacccacttggtgggaggccagggtgcctgtgggcagatgggtcagagtgtgggccaggatttggagtagaagccagagcatgtgaaaatccaaaccaggaagacttcgttgcctcccgcatgcggggttgaaggcctctcttctgtggtctcccatcctcatgctgatcaaattgggggggaatgtctcactgtgtgaggatcaccccaattaagctgtgggggaggacacagaatctgatcccctctgtatccttagcgcatgctacctccagccaccaggggaaagaagcagaggtgaggtgggagaggtggccactctggacggtgtaactgggctggctgcctctcagcgcccacgagcaccccacagatatccacgctagtgtacaaaggttcccaagtggtggccttttcctgcttccaagggctgcccgggttcccccctctctgaaatagattggttgcttctcattacatcacaagctgcagaaaaaaaatttaaataaaaagcctctacagctgtgtccttaactcttacctgtggataaggatggacttgcctgcccaacatcctctatcttatgtctttgggtgaaagggaagctggaatgggcagtaggggctgcttggggcagtcaggaccttcaggcttcaggcaaggagacccactgatcagacacctgcatcaaatattggtgctgacagatcccttagatggcaccggtcctgcccctcctacagtgagatccctgtggctcagggagggaggttgactgccccaaagcacccatcacaaccctaatgaagctgactttcaaccacacttcctatactccaccctgaaccgggtccagtactgcctgcattcccagtccagcagactcttaggagaaagcagtgattaaatgtaagttaaaaggacttggcaccaggaagagtttatgaacacatttgagaagcagacatactaactcttctttacacctttggaaaagcaaaggctttgtgtaattggaatttgattaactgaattaatctatgtgttgctttcttggtcacattataacaaccaccttaatctacatttttttctcatagctaaaaagatttattcctatttcatatggtacattattatatgaaatcttaaaataagttattgattgattgaagcagagtctccctctgttgcccaggctggcatcagtgacatgaccatagctcactccagctcactgcaggctcaactttctgggttcaagcgatcctcctgcctcagcctcctgagtaaatgggactacaggtgcataccaccacacccagctaaatttttaaaatttttgtagagatgaagtattgctatggtgccgtctggtctcagactcctggcctcaggtgattctcctgccttggcctcccaaagtgctaggattacaggtatgagccactgcacccagcctaaaataaaatttttatactaaattcaataaaatatataaataactggaaagtcttaattctcagtgcttgccttgtctctgtagttaagggacctgtcacactcaggcactcttccttgtgatgctgtaggccatgtgctttaagaactcaggcacactagctcattaggggagcttaacataaggatggaggttggaagctagttggtgccactcgtgtttctttcatttgtcttacgttcgtttttgtgcatatcaagaatattttagaccaggcgtggtggctcacgcctgtaatcccagcactttggaaggccaaggtgggcggatcacctgaggtcaggagtttgggaccagcctggccaacatggcaaaaccccgtctctactaaaatatatatatatatatatatatatatatatatatatatataaattagccaggtgtggtggcacatgcctgtaatcccagctactcgggaggctaaggcaggagaatcacttgaaccagggaggcagagattgcagtgagccgagatcatgccattgcacttcagcctgggtgacagaggaagactccatctcaaaaaataagaatattgtaagtgctgcttactgtaccaattcagaaattagggcagtttcatcagctggaaatgtggataaatgtatgcaactctaaagttgaaggaagatgcgttagcaaatccatcatggttagcatccctagctgccatctgcctgccccgttggatctagagaagatgaggtcaaacctttctcactccatgttctatgcaaatttctgcaaatccacagagcagggtgtaggtgctgtctccaatgtcacttccctccaaactccctgctctgttgcactaattcatttgtggttcatctcactgtgccccatgcgtgggctgaatgtcagtcagcttggcatcttcactgcctccttttgtctctccttagcttccagctgttttccctatgtagtgtcagatgagagtcttccagtgggagatgcccatgcagggcctggaggatagaggaggaggtgaagcctttactctcctgcactggctacagcagacacagggcagatggcatactcctgactgcaggaagctaataccagctgtggcaggtgtcaccactcctgagtttctggaagtttacaggagcttctctgtcctctgcttccttcattttcctgtttggatctctgagcaaaatccatgaccccttgagggatgcaatgctcagatgtaaagtcgtccccatcctcgagtcccaccaaaaccacccactgccactcagggactaggctttgcttctagaatttctagccctctggttacctcctctgagctcccagtgctgttcacttttccattctcaaatcctcagttgttctctaaaatgccagaatttctttgcaatttcctaacccctgaacaaactcacctgggtggcaccaatctcaaagctgcagcagtgggtctcactatgctttcagtacaaccttacataagttcagagaaagcctggactgaggaaatgaaaacctgccctgctgctcatcaggctggtgattctttatccaatccactggtggtgagcccgtgggttgattccatgtctctgctattgtgaatagtgctgggatgaacacgtgagtgcacgtgtctttttgatagaacaatttattttctgttagatagatatactcagtaatgggattgctgggtcacatggcagttctcttttacgttctctgagaaatctccacactgctttccacagtggctgaactaattgacactctcaccagcagtgtgtaagtgatcccttttctctgcagccttcccagcatgtgtcattgttttacttttttaaaaaacaatagccattctaactggggtgagatggtctttcattgtggttttggtttgtatttctctgatgattagtgattagtgatattgagaatattttcgtgtttgttgactgcttgtatgtcttcttttagaagtgtctgtgcgtgtcctttgcccactttttaatggagttgttttttgcttgttgatttaagttcactgcttctttgttgtgggagggggaaggcggggatgggcgggagctacaagaaaagaggcatcccctcagacactgggttaaagaaggaagaggctctattcagctgggagcattggcagacttgcgtctcaagaaccgagctctctgaagaaagagttcctggcccttttaagggcttacaactctaaggggtccacgtgaaagggtcatgatagattaagatctatagatagcacatgtggttagagtgcggggttaatctttttcagcttttacttcctccttctcttcagagacaggagacagtaagagaaatggcctctctcctcattcccccctttgagaacctcactcactagtgggagttctcactttcatcttcactatccaggtcttcctgagagacagctgaggtcttttgatgaactaaggtggtaacggagcctcttagtgactggagaaatatgggtaatgtacaggggagtaacatgcaggttcctaatactattattattcctattataagagttttaaatcctcctagagctggaaaccattttccaaacaggaatccaggatcaagcctatgccaaacctgcacgggcacatgtgccagctttgtcatgtctctaactatcctcatgcttcggctatgcatggaccagtcagcttctgagtgtgactggagcagggcttgtcgtcttcttcagagtcactatgcaggtgttgtccgggcttggtctcgcctcccaagtctcagttggccgggagcgtccgcagacttgtgtctcaagaactgagctctcatcttttccttgaatgacctgagagactttgttaacatttgtggccttctgagctcccttctttaacccttccagaagggcttccctgtatgggtttagcctttgcataccctgtctttcatttgggtcccagtgggggtctgttcctggtaattggatcctcacatacttttgggggttttggtaatcagctggaacatgttcttccacccacttagttgctgcttggagcactctcctttcatctgtgttaaagaggtacatgagcaactggtggcaatcagctcaggtggggttgtgggtctggataatagtttggagcaaaccaattatagcttgaggcttttcagtataggatggggtattgtttttcagtataggatggggtattgtttttccaattgaggagatcgacagaggtgaagggtttgtacacaaaggcatgcctttccactatatgcccatcctcatctacccagtatactgttgctttctcatgggcatttgtatcccagttctaggcctcaaatgggctgccaagggaggggtttctcctgaggtctcacatcctgtcttttctaccctgggtggcctaggggtatgtaggccttgggaagctcaggcgcagtggcctcaggagtgggaggccttcattcttggtgaaacggggggccactggtgccatttcttgccatgaatcttctgatgttgggtcggacaggacttcaggagctgactcccctcagcgggtggagcaggattcttctttggctgtctgtccctttgctactagtactgctgctgcctgtcctcttaacgactgtggggggtctaaaaccagctgtaaccaagtgtctatgtacggaaactggtctgggtgtcctggcttaccagttaccttgtgccatacctttgaaacaaggggccagtctaggcttccttctgatggccaacctacttctaatgctggccagtctatctcacacaaagttctaagttttcctggtgtcatagtaactccatagtccccattaaatcctttcttgaaatttttcaacatagttcctagtggagtgggcttactttgcgttccacccatcttcctcctgagacaaaacaacactcacaccacaagaaggaaagtctgaaggggtcactcactcatcttgcctgtctcaaactcaagcactcattcactttcactttcctttttgcaaacaagttaagccaaatcaaaatcaatattgagatcaaagtgccaattgcaatcaagtcaagtcaaatcaaaatcaatactgagatcaaagtgctgataagggcacattgtgggtgatcaggcgacacttccactcaaatggagcgggcaaattcccaggactggtcctactgtattccagatgtccagactccaagtgccggttccttcccggtgttcagctgctgcattgatcctccatggggccctgccgtgcactgctgtgatgaggcattccaccagggcaaatgcctacccggcagtgctctcaggatctgcattgctcaagctggctggagtcccccacagggatgctccgcagggcaggccaaagctgcctaaggggctccctcaactgtccattaatcacctcacttctgggtcagggaaccaagaaatgtagcaggacaagccgcagacaaaacccctcagacaccgggttaaagaaggaagaggctttattcagccgggagcattggccgacttgtgtctcaagaactgagctctcatcttttccttgaatgacctcaaagactttgttaacatttgtggccgtctgagctcccttctttaaccaggtgtctgaggggttttgtctgcagctcgtcctgctacagtgacacttagcctcagtctcatttccagtagggtcaaactgatgacctgacatacttattttctgtgctctcagctgtgtctaaatatccctgtgaaccactataaattcatgggcaatcaagcgtggcccaaaaatatgaccagagtggcgcaaacctgcctacaatagcccttgaagctgattgaggcagtgcctagatgccctgcaagaaggctggtgacacctacccctgtctgaggcatcttcctcatgtctggtagatgctctcttcctgctcctcccccattgtccctggggctcctcaaggctctcgaggcagccactgatggccaggttctctgtgggagttggctctcctgtcagccctccttccttctctcttttgcccacattccctcctctcctgtcttcccccaaaattcaaaaactgtttttattcctgctgcatccccaatcattcatctggagactcacaggtggtcccttccccatcccctgagactccttgggagaagatagttcaggatccgagacttggtctagtacaggaatgagtgatagccaccctgagtgagtgccttcatggctctctggagttccaggcccttgaagcggagcttacacttacccagagtgcagcccatgacagtgtgaaagagcactggctgtagccaagcgttagggaccaaatgcttccaagattccagagcgttggtctagattcactgatgtcatcacatcattccacgaggaatggctctttggtttataaaaggcactcaaggaaaaggccatgagcctcacagggaagggggttagtgtcccagcccgaatgctggagtcacctgctcttaccccaacatgaccttcacgtggggcctcatcttgtgttcaatcaaatccattaatgatttcaaatgaaaatgttacattcacatagcagaaaattgagaatatgcaaaattaaaagttgattaacctctcatctatactacaaagttacaaatattgtttatttttattgccttatttgtgtttagtatcatattaaaatttaaaaatgtaagctttaatattttgagataatcatagattcacatgtgattgtaagaagtaacacagaggggctctagatacccctcatcaaaatttctccagtggtaacaacttgcataactatagttcaatatcacaataggaaattgagtttggtacaatccattgacattgttcagatttcatcagtcttatatacacttgctagtgtgtgtgcattttgttctatgcaattttatctcatgtatacacttgtgtgaccaccaccaagttacagaacagttgtattataagaatacttcctattactttttttagaacttcatcttccctaatccctggcaaccactaatctttacaaccttataattttgttatttgaacaatattgaccaggcatggtggctcacgcctctaatccgggcactttgggaggtcaaggtgggcggatcacttgagctcaggggtttgaaaccagcctgggcaacatgttgaaaccccatctctacagaaaatacaaaaattagccaggcgtggtggtgtgcacctgtagtccgagctacttgtagagccgagttgggagaatcacttgagcccaggaggtcaagcctgcaatgatctgtgtttgtactattactggtggtgaatccacgtgggtctgcagcaacctcagttcttgcctcctcagaagaaagaattcgactgaagagcataaggcagaagaagagactggggcaaattttagagcaggagtaaaagtttattaaaaagctttagagaaggaacaaaaggaaggaaagaacacttggaagaggcccaagtgggcgacttgaaggacaaaagtgcagggtttgttggggtttggtatgcaggcatacttctggggttttgtgttccttctcccctgattctttctttggggtgggctgtctgcatgcacagtggcctgctagcgcttgtgagaggagcatgtgcagtgtgctgactggagttgtatgcatgctcacctgaggcattcttcccttaccagctgaatgcccctaggaggtcatacaccagttaaactctgccatcttgcctcttagtctgcatgtgtgagcctacttgttcaactcctgagattttactgggaagctactgatcaccaggttcaggtgttttctatttatcaggaaactgcctttctctggcactggctgtaaccaattattattttagagagacagttaacaactgcttgaccatcacctggtggttgcctaacattcctggtttggggttgtgaggggctctctcctgccctgctcagacctgaccagctacctactataacagcaccactgcactccaccctgggtgacaaagcaatcctgtctcaaaacaaaaagaaaacaaaaatgaaaagcccccagtattacctaaatggaaccagccagtatataatctgggattggtgtttttcacttagcgtaattcctgatatccagccaagttgttgcatgaatcaatagttaattcatttttattgcctagtggtgctcccagtcatatgataagggcacattgactttgtaagaagctgccatactttgttctagagtggtcctgccattgtacatgcctgccagcagtgtctgagtgatccattttctccgcattgacagtgtttggtgttatcattattttctagtttaaccatataagactgtggttttaactgaagtatcttttcaataacatcacacagttggcaaataatgtttatcctttgcccatgtcttctcattattgagccataatttttaaagatattttattgggtaaacatatttacataacagtaaatgccttaattgtctttgtatattctaaatataatttctttatcatttatatggcttgcaaatattttctcccattctgtattttttttttttttttgagacggagtctcgctctgtcacccaggctggagtgcagtggtgagatctcggctcgctgtaacctctgcctccggtattcaagcaattctcctgcctcagcctcctgagtagctgggactacaggtgcatgccaccacacttggctaatttttgtattttcagtagagatggggtttcaccatgttggtcaggctggtctcaagttcctgatctcaagtgatctgcctgccttggtctcccagagtgctggtattacaggcgtgagccaccacgcctagccctgtctcttccttccttccttccttccttccttccttccttcctttcttcctttctctttctttctctttctttccttctttctccttccttcctttccttttctttctttcttcttcattctttctttctttctttctttctttctttctttctttctttctttctttctttctgtctctttctttctttgtctgtcttcttttctttctttccatctctctctccttccttccttcctttcctttcttccctccccttccctcccttcccctcctccctcccctcccctcccctctctcctcacttcccctcccctcttctcttctcttcttttttctttctctcactacattgcccaggctggagtgcaggaacctagattcaaagatacaattttagcactctgtaaccttgaactcctggcctcaagtgatcctcccacctcagcctcctgagtagctaggactataggcccatgccacaatgcccagctcaaggagtgatactttgtcttgtgcatcctctgtcttgcctttccacttagctatggcctggctagagttcttaatgagagaagtctgctataatcctttctcccaaagagcctcctttatacactacatggtcactttcttccatatacgagagaagagtaagcttgctctctcacatcatcattaccaaatctcagctgggcaattaaaggaaatacttggatatttacttatccaaatacttggacaatttccaaagtagaattatcacagttttggctttgagaaagaacttggtattattgcaggtattttgggaacacttatataatattttctattatacttcttgagaggggttggttatttagtgacatgaattaaggcattataatattaaagaatggggcatcaatttcattggtaagtttcctcttcagcagaaaagagataagaatgttcatttatgcataaaagaacttgtcaaatgctttttttttcccatcagttaatatgatcatgtaatttttcctccttagtctgttgatatggtgaattacactgattgcttttcaaattttgagtcagccttatatccctggaataacttagtcatggttaagaaaaaatatatattgctgaattttatttgttgacattttgttaaagatttttatatatatcttcatgacaaatattggtctgtaatttttaaaataccgtttttatctggttttggtatgaggttaatattagtttcataaaataaattaggaagtattccctgactttttttttgtaagagattttgtaaacttggtgtttaaacttttaaaaacatttgttagaattctcgagggaagttatctgaatctagagatttcttttatgtcagttttacaattacaaattcaatttcttaaattatctatttcatcttgagtgagttgtggcagtttgtaagtttcaaagaagtagttcatatatctaagttgacaaatttgtttgtagagttgtttatagtattcccttattatcatttaatgttttaaatatctatatcccctctttcattcatgatattgataatttgtctttgttttctttgttagatttgctagaggtttattttattaatcttttaaaataatcaactcgttgtttcattgattctctactgtgtttctggtttcaattatattagtttctgctctttactatttccttccttctttctgttttggttttcttatatttatttattttagagacaaggtttgctctgtcatccaggctggagtgcatgattatagctccctgtaaccttgaactactggactgaagcaatcctcccacctcatcctcctgagtagctaggactacaggtgcatgctgccacacctggctaatgttctttattttttgtagagatggagtcttgctatgttgcccagtctgatcccaaactcctggactcaagcagttgtcccagttctgcctcccaaatcactgggattctaggtgtgaggcaccttgcccggcctgttttggttttattttgatctttttctaatttttaaaggtggaaacttagattattgatttgagacttttcttttcttatgtaagtatttaatgctgtgaattttcctcttagcactgctttgggtacatttcacaaattttatgtgatagtttcattttcattcagttctatgtattttaaaaattttctgagaaattgagaactttctttttgacccatggattacttataattgtgttgtatagttttaaagtgtttgaagatttttcatatgtctttctgttattgatttctagtttgattccattatggtatgaaaatatactctgtatgatttcaattttaattttgttgagatttgttttatggccctggatatggtctatcttgataaatgttttgtgaacatttgaaaagataatgtgtgctgtctgatgtcactggggcaatgttctacaaatctcaattatattcttttcattgacactgtttttgtgttcttctaaatccttgctgattttctgcctagttgttcttttttattatcactttttatttctttatttggtggttttgcctagttgttctatcagttgttgagagagagtgttgaaattttcaactataatgtgatttctctctttctccttttggttctatcagtttttgctttacatattttgcagctctgttatttgatgcatgtacatttaagattgctatgtcttcctggtagattgactcttatcattatgtaatatccctttatgtctctgataatctttttgctctgaagtctgctttatctgatattaatagcaactcctgctttgttttgactgatggttacatggtaacatggtatatatttttctcatccgtgtatgttgaacttacttatattcttatatttgaagttaatttcatatggatagcatatagttgggtcatgatttttaatccactctgccagtttctgttttttaataggtctatttagacaatttacatttaatataagtatgagatattaaggctaagtctgccattttatctatctgtgcttatttgtgtgtttatctcttttttttctctgttttatcttccttgctttcctgtggattgcttgaaaatattttataattccattttgacttatagtgttttttaagtgtatttccttgtatcaattttttagtggttgctctaggtgctacatcctgtacatgtaactcaggaaagtctatttgagttgatgttttatcagttcgaataaagtgtagaaacttcatctccctttagataactttaccctatcacattgataatataattatcttaaatagtttctttctatatctcgagaagtatattagacaatgttataatttttgcatcaaccatcatagtttagaaaacttgagaagctaagtgtagcatatatttacccttattttttctctttttgtcctttcttactttctgctattagaagattctttctatcatcatttcctatccatctcaagaaatttccttagttattcttttagggtaggtctgttggcaataaatcctgtttgttttcctttatttgacaatatgttgattttccctgcattcctaaaggatatttgtgctagatatagaattaggggttgacaggtcttttctttcattacttgaaaaaaatctgtcacctctagtctctgttgtttctgatgagaaacacattgtcatttgaattgttttcctcttataggtaaaatgtcatttcaatgttttcaagatttcttcctttagtttcagaattgtgattataatgtgtcttagcacagattcttttgagtttgggatttggaatttgctcagctactcgaatctgtagctttttgtcaaatttgtcatttttcaaccattgtttctttgaatactttttaagccccatactctttctcctctttttcttggtttttgatcatgcaaatgctagaccttataaaaatagtcccatggatccctgaagctctttccccctgccttagtatatattctttttctggctcagattgggtaccttctatttttctatattcaagtccattgattcttttctctatcctcttgtttctgttcttcagccatattgctaaaatatttattttgtttattgtatttttttcaattctaaaatttctatgtggttcttttcaatatcttttttgctgagacgtttttattctttcatttgtttcaagcattttcataattgctcactgaagcttttctattttagcgagtgttctttgacattgtgttggcagaggggaaaagggcattgccttcttagtgccagatgggagtggaagtccaggttacccatttggcaccattgacacctatgctgggaaggggttccttgttactgctaggtagaggtcagagtctaagatttccatgtagctttcaccaacactactgagggggaagggcatgcttcattaatgccaggcatgaatgaaattcctggatctcatctggttttgtccaacaccattctggctggcgtgggatgggtagggtgctttgttgtagccaggagaggatgcaagtctagattctccactcagcctttgctaacaagtgtggggctggagtcacatttttttcatggtgtttggctgggggtgcttatgttgtagacagaagttttctgccttgttaggctgacttttttctggtcctttggctggggaagcttttcttggggccttttttttttttggctgtgcctgttggtatttctaggttgctgcttctctggcacccagtttgagacataagaagccaaaaagaggccaggcacaatggctcacacctgtaatcccagcactttgggaggccaaggtgggctgatcacttgaggtcaggagttcaagaccagcctggccaacatggtgaaaccccatctctactatagatacaaacattagccaggcatggtggcaggcacctgtaatctcagctatttgggaggctgaggcagaagaattgcttgaattcaggaggtggagattggagtgagctgagatcacaccactgctgtgctccagcctggatgacggagtgagtgagactctgtctaaaaaaaagaagccaatcagagaacttataaccatgtcattcatttcttatgtcctgggatccttattcagtttgtcttctttccatatttcaaagtctttcatgcttcatatataatgtccagtgtttttgcagcacttagaaggaggaatagagagaaatttatctactccatcttgtccataaccagaggttcaagagagtaattttattttgccattaaattttgagtgtctagaggccattactgttagcaaactttcttcaacagagggagtgtttaccctgaaagctgcatttatataaaaaataaggtaccaaaaaattaggaagaaaaatgcaacctgagagtatgtgataacttcatgtacacttcttttctcttttatttgttcactattatacctaaaagttatgagaatagagaataacattaataacgttctgacaatccttggaattctaagagaatataagacatccctctcttattttaagaaagcatggaatactgatcagcaaaaaaagaaacgacttgggtggatatcaagggaattattctgagtaaaaaaatctttgagggttatatgctgcatgattccatttatatagcattattgaagtgacaaatttatggaggtcgagaacagatttgtagctgccagtttagggaagagggtagggagagggatggctgtggctatgaaagaaatagcatgaggattccttgtactgtgttatctgtggtggtggtggtcatacaaatctacacataataaaactgcatagacacacacacatactggagtgcatgtaaaagtggtgaaatatcaatagacgaaaggattgtatcaatggcaattttgtggttgaggccagacactacccagagacttcagtgaccctcccctgctggtgatattgtactatatagtcctgcaagttttcaccattggggaaactgggtgaagggtgtatgggagtctctctagtgtttcttataactgtatgtgtcagtctacaatgaattcaaaagaaaaaagttttaaaaagcaaagcaaagcattttgctattttgtactttcttcctctgcagactgccctactcacttccctggtgcaaagaggaaatggacagtctaatgtggcttctgcttaatagtctcttgtgtgcatagagaacctgttttttcccaattgtgtaagagttggttgttcttttctccatgaactattgtttgggctttgagtgagtgaggggagatttggtcctattctggagttacaagagggagaatctgacttatgtaggcaccattggtttccactgctgtccttaatgcccttctgaataagccaggtgattttctctgcacagtcctgaggctacatccactgagactggctctgtacaaagatgctaaacgccagacactccccagatacctctgtgccccctcccctattgatggagagcagaagagatatgagtctttcacggaggctgacatcacatgcagactttggcctcaagtctttgtcacttgccaaggacagaagaaataccgtgaactagaaagcttttgtgagtataaggaggagaaaaaaattagccagagttgcaagatgctttatgttgtttcaagtttgttctcatctctaaaggtaaactataggacccacctgctggggcaggtagatgagataatcctgcattagtgaactgtagcatctgactttcatagagaatggttttcttagtagaaattggggcgcaaaaaaatgaatgcagttatgggaactttgcgatgagatgcaaaatatctgggtagaaagcagataaattaccctcatgtatgtattttagtataaagtggacatgattactaggtaaaatgcacagaatttctcagttttcattgatggtatgaaatgtctcacactcaaatgtcagtaagggccagaagaaaatgtaaatataaggagttagtggataaacaataatagaaagtatggggcattgtcaataaactggagatcttggattcaatatgaatgttttcaaattcaaatttttaaacattgtgatggctggataatcacatctgaccacagatggtcagcagctgcttcaatataagttgtgcttggcttttctacatcatgaacccggaaattaagcttttctgtatataacaaaagcacaaatatcaatggcgtaaacaagattaggtcacctgcttctcgttaggatgtagaaagacatgaaaactttcctcctgtggtgatgacaagaatgaaccacataagaatcgtacgttcatggggctttcaaagattggaagatgtaaggaagctctgatgaactgaattgtagagggcgcgccctctagatgagccgagaccctggagctctctggggcaagtgcctgaatgagttcaggtgggaaaagtagcagctgcctacaggcaggaggctttgcagggttaagaaggagcatcctgcgtcaggggcaacatgtggctctggaggagttccaaatgcaaatatccatctctcagcccaacaactctcttccttacctggaattttgctgggaaagtggcattggagaaggggttggtagcagggagaatacagacagccttacacatctctgtgaggcttgggttctggagccctgcagaaggtgaacctaaaggtgaatccaaactgtctgaaacagtagccactccccagcttccaaacatgaagaaaaggtaagaatcctttaattatagcaatgcaagaggctggggttgggctaccagagtttcttacattagatgtaaagtggtatgatatgaattcaagatagagattgccagactggataaaaaagcaagaccaaaccatacagtatttacaaagatacactttaaatatgacacagatacattgaaagtaaatggatggaaaaggaaaaacatggtaatgtccagactcaatgtgagagggaactcacacagaggtgtggctgattttggcattgggaggtgtgactcattggcattgggaggcatgggccattggcactgggaggtatggtccattggtactggaaggcatggcccattaggactgggagttattgaacattgggactgggaggtacggctcaatggcactgggaagcatggaccattggtgggaaccatggctcactgcactgggagatgtggaccattggctgggaggtgcagctcattgccctgggaggtgtggaccattgcacgaggaagcatggaccattgcactgggaggtgcagctcattgccctgggaggtgtggaccactgcactgggaggtgtggccactgcactgggaggtgtggactattgccctgggaggtgcggaccatagcactgggaggtgcaggttattgccctgggaggcatggatccttgaactgggatgcgtggaccattgcagtgggaggtgtgggctactgggggccatgtggcatttgagttatggcagaatgggtctgggaaagagaattctgggctaagagagtcttccgttctttcttgtttcctcctctggaaatggctacctcttcttcctcaaaggaagctgaggaatgtctgcagcaggcaggctgtgtggggacttctagaccacaaaggcctgtctctgtgacagcttaggcctggtggggtgttcatggctgtgaacaccccggagagaacatggctgtggtctttaccagccctccattcctcttcccctcatagatctgtgagagaaaaggaaaatggatgtgttccttcgttttaggtagaagggctttgaggactggagaacgcctagggagaaaggggtgatcaaaatataccgttgttccaggatgtaattataaaaaactgggctccaaatatgaattcaggaatacttggtccccgtgccaatgcagccaagcccctgcacggtgtgggagcaactcctggggttggtgggaggcctggctgatgcatgatgggtctgaaaaccgctcaggctttgccaggtatgtgtcaggcactgatggcggcgatcggaccggcctaggttggcttagcgcgccctctagtgggagaaggtctaaagagcaaaatgtgagcatccttgccacagggcagaaatgatgctgaacgtgcacgccacatcaaaggacatacgtgcttaagggacttgtgcttaacaattactgtgattagtccgttctcacgctgctctaaggacacacccgagactgggtaatttataaaggtgttttaatagactcacaattccacatggctggggagccctcacaatcatggctgaaggcgaagaagcaaaggcacgtcttatatggtgtgtgcaggggaactgccctttataaaaccatccgatctcgtgagacttattcactatcacgagaacagcacgggaaaaacccacccccatggttcaattacctcccactgggtccctcccatgacatgtggggattgtgagagcaacaattcaagatgagatttgggtggagatagagcaaaaccatatcagtcaccatcttaaattgttaatacattggaatttgtttatgtctgttgtaaaaaaggccagtcgcttagctatttcatggcggttttgaggaattaccaccataacttatgggagagtgttttggtaaatggttacataagtatgaggaattttaattttttcattagaaataatgtgtggaatttataggacaatttattaagaagcttaaatgtatgtatggtcgttgattaatctaggtccatttctctcctagagagctgtcaatagagattgagtgtgtggtaaggcttcctcctcggtgggccttttagtgataggatggtcaagtgaggaagggctgtgctcctgcggctcctaattctgaattacatttattgggccatgcagtctggtttagtgcctgagtttatgtatgggaaatgaattccatttctacatgctgggtccttatcagagcagaaaaaagaacccacgctatgcagatacataaatgtcacccacatgaacaaggcactgtcttcagtatggcatgaagggggcagtgatgaatgggcagctggagaggggagcgtgttcagatgagacaggctggtgcagacatctggggtcaaccacagcagacactaaaatgcagtggggccgtggtgagggggatggaggggatgtgggaggtgagtgggagctgagggaagaggagtggctcagaatgcagtggggggtctgcgagaggaccagagagggaggaagcctctccttgggaagagttgggggcaggtcaggagaggttccaggtagagtcagaggtggctgggctggggtggtgaaagccacccttatcctccctgtgactcttagggtcattgcactgcttttctgcttccagatgagatggagtagcagggacggcgtttatcctttcacctgacataattaacacaggacaaaatagatgaggaaaaaaacaacaaagcgaaactgttgccatcagacagcgcagagctgtggtccctgagagggagagacagacaagaggagtgctaggatttccccagagggtgtggcctggacactttccaagctgtggcccatggatgtggctgctgtcgtggtggggtccctccggggaaatcactttgtcagtgaacagcaacatccttttctgatttttctagtaccacgcattgttttctcccattgtccaacaaaggaggcaagaatgcagtgtgccgcattcctcctgcagcagcgctccggtggcgtaccttaacctcgcttttgttttttcatgtgttggctgagtcagtgagtgtgctgtggtggacctctgccatttgtagctcctcaaatcttcagcaccctcttcacagtttgatagttccccacagtgtacctcctgccttctaatgagtctccaaatattccatttcacagccatccttgtttttgaggtgcaaacatatgatttaggtccagggatcataggcacccactcaaggctttgatcccaaacagttcccatggctggggcagagtgcggtggaggggcaggggcaggggctgacagctgtggcagaggcttcctgattcagctgcctccagatggggccagagcggctgcccctcactgcattagatctatggtatggcactgggggtctctttcttcagcattcgatttggtatgttatcttttttttttctttgatcagcttttcattatctctattcacaagtcgttataatattgctatttatcagtttaatgtaacacatatgataaaaacagatgataaaaagtatcatattaacaatgagaacattattggctgggtgcagtggttcacgcctgtaatcccagcactttgggaggccgaggagggcggatcacctgaggtcaggagtttgagaccagcctgaccaacatggagaaaccctgtctctactaaaaatacaaaattagccaggtgtggtggcacatgcctgtaattccagctgctagggagggtgaaacaggagaatcgcttgaacctgggaggcggaggttgcggtgagctgagatcgcgccattgcactccagcctgggcaataagagtgaaactccgtctcaaaaaaaaaaaaaaaaaaaaagagaacattattttacacaacccatttactgaatatgcagcctcttgcaacaataacatagtggacccaactctaccctctgaatggaccacttttatgattctcctaaaaagttttgagttggatatagtttcttgttgcttctctctgtgatccgagacttaagaatgagtctctggaaacgcagcaattggaaccagacctccccaggatcaaagaggacaggagtgggagaaaggacgcaggacacgactcccaccgtctccagcgctgcgccgtatgcttgacctcagagcatgcaggcactcaatgtcaagtgtgcagccacgtctatatcctgcatctcaagtgctcacaactgtgacaattagcagatatgggagagaggaggcatatcatggaggaatgagtcagtcccaaaaattacatgaacatttctgaaatttcaataccaagggttaacttctaaagtactagtgtataaacagaagccatatagctagccatgaactgaaatgcatgtaccatacagtgaaggagctcctgtgcatacaaaaccacccacgtctcatttatctctaattttaaaataactcattcccttgctggatatgcaagtgagtggtggagaaagaggtctatctgcaaggctggcgggggttaaggatttcattgcttccaaaagacgtgagcaagagaactttattactcactgaaggggattcttccttctcagccaagatggtcccatttaaatcacttttgaatttcctttcaagcttcaattgtgcaaattctagttgtggttgaggatcgtccccaacagctttttgagttattccttggactcttcctttttctactatgttttcatgaataattctagaatccatatttatatccagcccaaggcttctttcctatagaggtgtcgttgagttgtgagcttcaaagatctgatcatactgtttaaaagcaataggcttgggagtccagatgtcagcttctcagatccattttcacagtctgatggtgtctgctagcaattatcagtgcctgacccagaagcggtctattgcacctcagcttggaggaaaaagtgaaggcacatgcagtctgggaaaaaaagagaaaggaaggaaaaggcaggcaggcaggcaggcaggcaggaaggaaggagagaaaaagaaaggtggtaggtttctatgtactgacttggatttgtgtactgtgttccccaggcaattctaatccggactgcattcccctcaatgtctctaaagctgtcacatttgtaaatgcttactgcagaattttcttttttttcttttctttctttttttttttttttttctgagacggagtctcactctgttgcccaggctggaatgcagtggtgtaatctcagctcactgcaacctccgcccgtgggttcaagtgattcttctgtctcagcctcccgagtagctgggattacaggtacctgccactgcacctggctaatttttgtatttttttaatagagacggggtttcaccatcttggccaggctggtcttgaactcatgacctcgtgatccacctgcctctgcctcctgaagtgttgggattataggcatgagccaccgcgcccggcctgaggaattttcttaaatgaatttttaagttgtttcatatcaaaaaggtcagcatcttcacctggtcctttactcatctgaaaagcatcccaaactttcttgtgctgatgaaattgagtataaactgtgtctcaaagggctgcgtcatagggatttgcatgcttctcacacagcagaaccaagtgctgaatgagagagtcctttctctgccggaaatttaaagtctgcagttgattttcagacaaaaaatcccaggctttaggattgttgtcatttccgtcatggggatcctctttctctcttttctttctttctttctttctttctttctttctttctttctttctttctttctttctttctttctttctttcctttctttctctctctctctcttttctttctctttctctctttatttctctctttctttcctttctctttctttctttctttctctctttcttttctttctctctttctctctttatttctctctctctctttctctctgtctctctctctttctgcctttcttgcctttcttgcctgcctgcctgcctgccagcttgcctgcttgcttgcttgcttgcttgcttgcttgcttgctttctttctttctttctttctttctttctttctttctttctttcttttcttttcttttcttttcttttcttttctttcgacagggtcttgttctgtcactcagcctggagtgcagtggtgtgtgatctcagctcactgcaacctcgaccttccgggctctatcgatcctctcacctcagcctcctgagtagttgggtctacagcatgtgccaccacgcctggctaattttattttttgtagagatggggtctcactatgttgcccagtctggccttgaactcctgggctcaaatgatcttcctgccttggcctcccaaagtgctgggattacaggagtgagccatcacacccagccatgaggatgtttgagatgatcctcttaataaactcaacaacagtctcatccatctctctgtcatggcccacgtcttcagctacctctctcctcctgcatgctatctttgtcctataataaatcgttcactcctgaaacctggtagaggggattctgttgtctataacccccaccagtgcatttctatctaacggttaggaaaacctccttggctgggcacagtagctctcacctataatctcagcactttggaaggccgaggcaggcagatcacctgaggccgggagttcgagacgagtctggccaacatggtgaaaccttgtctctactaaaaatacaaaaaaatttagttggctgtggtggtgtgtgtctgtagtcccagctacttgggaggctgaggcaggagaattgcttgaacctgggaggtggaggttgcagtgagccgagatcacaccattgcactccagcctgggtgacagagtgagactctgtctcaaaaaaaaaaaagaaaagaaaagaaaggaaagctcccaactaaacactcaatggcctgctcataacaggagacacaggggaggtagtccagggtgggcgagtcagccgttcagcagcatcgtgaagaagccagttccttccaccttctactcattgttgtgcggcttcttcccctttgcgatctggtgctgcattccatctctagtcttcgggcatcactacttttccctgtggtgctcaacaggccatacagggcagctctgatgttggccaagtggaactgatgtggtcaggagacacaaatccattgagaggaggcagcttctccttggaagcagaatctccctttttatatccatgagaaacagccaggagagcaggaagccaagggctttctccttttctgttgcatgccagcgccctctttggctatgagcagcaggtctctctcccttcaccactgcatttggatgagactcagaggctgcttttgctgtcatctgtttggcttacttggtaagtttctgtgatttgaggcttgtcaccacttgtagagtttttgcttgatcgtgtgttgtttgtccagctttggttaaggccgcttaaaaccctgacctttggagactttgtgtgcaggattcctatttcatcattgtcgtgttttgtcgcaaagtcaggtttgcatcttggagagctttctggtcccccttcctgagttttgtgcccagttttgtggatgagtccatcataaatcttgtggatgaaatcttccaggtgcttctggacttttctgttcttttgcttcgcctgtgtagtgagagggagaagtccaacattaaatgagccctatttttacccaacgtctctttctccctgaccactctgtgtaaaatgcaatcataactcctccttcctgaccagcacttctagtcctctttatcctattttttctttctccatagcgcttatcaccctttcctatgccatctctgcctccagatctggaatataaagtcctcagtaggaaatacctttatctcttttgttcaatgaggtattctaattgctcagaatggtacctgacacatattaggtgcccaataaatagtttgtgaataaatgagtgaataaatactcaggatttttaacaaaagccaccaaagaaaacatgcttaatttattcaggaggtggaaatcttgggtgggatgaattccttatgagacctgcgagaagcgcaggtgatagtttgtgtgtgtgttcgttgtgcatttttattgatataaaacagaagcactggaaagtgtgggaagtgcgcatgtcatgaggatgcaggcccttggctggcttgtttatttcaggggtggttaggcattgtcgccctgggtggaggggtcagcgacgagccctctgaggccatcctgtgacatcccctgggcacctcctagtgtttgtcattcccgacgccccagggccagtgtccttggccttggagatctcaggctctgctggtttccccacctccctggctgtccctttttagtcctttcccacctcctgaccagacactgaacatccttggggctggtctccttcatttcttgctatattctttttttttaaagacggaatctcgctctgtcacccaggctggagtgcagtggcatgatatcggctcactgcaacctccgcctcctgggttcaagtaagtctcctggctcagcctcccaagtaactgggactacaggcatgagccaccatgcccggcaaatttttgtattttttagtagagacagggtttcgccatattggccagggtggtctcgaactcctgatctcaagtgatcctcctggctcagcctcccaaagtgttgggattatagacgtgagccaccgcgcccggccactatattctctttctattcaatttcattcttccctgtgcctctgcttaccatggggcacccacttgcagaggatgcctgattccatgccctggctccctccttggtggcctcatgcatctcaaactcaatatacccaatgctgtgctcagaccttccagctcaaatgcgctctgtctcagacatgctgcaaccatcctcctgggagttgacacctccccaccgtatcccctcacatccagtccctcagcatgttcccttgatcctaacttctaaagtgtccttgaacctactcacttctacctcccatgtgcccaccagacccagccccaaccacttttcgctggggtaacctcagtagaatttacactggtctcccttcattctctcacgcacacgacaaaccattctgtaccctgaagctggtatggtttttgaaaagctcaaatttgattgtgtctttaatgagttcccattgctctgaggtcagtgtggcatctttcatggggaaggtcatggccagcccccttccccttctcttcctatgttccagccaccatgacctgctgtccagtggtcatgagctgagtccctcatacccaaggcttttccagatgctttttctctgctggaacactgttcttgccttgcgttgctagcaaagatccccatgttcattaagcgcctcttaaatgtgacctctccagggaagcctcctccactcccattgcccattgccctggctcagtcagaccactctgtgtcttccttgttggtgctctctcctcttgtcattaaatcgctccatgtttaatgtctgtatcctccacttgactgtatgctctacaagggcagggtctaggctggcttggatgttatgctgctgaatctacagggcgaagcataggaggtgctcaataaactgaatagattttgaatagatgttcactgagggtaatactgaggagtggggttgttctcaatccttactgtagactccaaatgccagtactgttgggcgttgcttcctctgaaacactccttgaagctctgagtctcctttggatggttttacccaactccactcgtgcctccatcccttgctgcctctccagacatttgccttccttgtcattttcaggccgtcagctacagtgactgggaatgtgtgccacttggctctcacactcgcctctcactgtcgtttttctctcacgggagtttatcatctattcttctcatttccttgcctttctctctgcagcaccgataaatcatcagtttcacctgaacttcagaaagaagccattccttaattttggcagaagcacgatggagtagaaagtgaccaagtagactgacttctgatcatgtctctattgtgacatgccttcatgagctcccattgttcttggggttaaggcctttaatatatgttacaaggttggaatcactctggggaaatggccgaaactccctgagctttgtttcctcaagaggaatgtgaggtggattggattaaattccacctacaaccatttccatctcttacatttccagaatttgtcccagaatcatagaagcaaaccttgttcagagaggccatatccagctttgcaaaataaaaaaaaaagtcactgtgctggtgagatgggcctcaatcctggtcacatttctctcttctctccagatatctatgcttcctccctctcctgcctccccagaatataaacagctccctgagggttgaggatgttccttcgtcccactcccaacctgtcacccccaacttccagatttctttaaaagtcaaagagaaaggaaattttcaggaaggagatcatgtctaagagctttttattagtctcatcttccaatttcctgtagactcaagcttctttctttctgtcgtgcggggtttaatatccagtggctgtttgacaacagcaccaggaaatggaatttccatcctgattctgcctggaaccttgggcaaagtgcccaaaccttctgcctcactctcctcctgggagtaacagtccccaccctacagccttctggggcaagcaacagagacctaatatgaaaatggaaccagagagttctgatggatgtaaagtcctcaataaatgcatgcaggtattatttgttaatttttgccataggcaggctgcagcccccaggcaaactctgagtagaaggagcctataaaaacaagcctcctgcttctctctctctctctcatttttttttttttaattttttttttagacggagtcttcctctgtcgcccaggctggagtgcagtggtgcgatctcggctcactgcaaactccgcctcccgggttcatgccattctcctgcctcagtctcctgagtagctgggactacaggcgcccgccaccatgcccgactaattttttgtatttttagtagagacggggtttcatcgtgttagccaggatggtctcgatctcctaacctcgtgatccgctctcctcagcctcccaaagtgctgggattacaggcatgagccaccacgcccagccgcctcctgcttctctcttgaagcctgggttctgctctggtgtctccccagctcattgccggttgacggcacattgggctccctgtcagtcaggttggccacgtgaggaggagtcaatgaggcactgcttcctgccaagctgaggctgcccttcttataataaggaggtgagcctgtctcagggaaggttcttttcctaaatttcaggtgggattctaaacaggacaccactgatttttttaaaaatgaacctatcaagacatgcattttcatgggtgtaatcctgtttgaagtggtcacatttggggtttttatgtacttgctcctattactggtgaaacttctgtgaatgggcttcagatcatgaacagcctcagtggtggcagagtctcatgatttcaagttaccttatagttgagaaatagccccgcagggtaggtgatggcgtactccccacttgccattctatctggaacccggaaggtggtcaatccatattcactgaaatgaaccaagaaatgagactgtggctataaggttgaggatgttcatttgcttgtgaagcttctaaacaagatcttccaaacagttaagagaacacttggatatctttatgatggtgtgtttgctttgaaaaataaacatgaaagagaaccattatgttatagctccgctttctagtgagtaccccgtcaaggcatcatatccctctgtgtagcaatggaaaggcatttaacccaatgattgaacctctctgtgcctcagtttcctcatctctaaaataataatagaacctagctcatataactgttaagggggatcaaaggaggtaaaatgttgtgacaaaagttgcataacacagtggagtgtatttcattcattcccaagtctgaacttatgtgtagaataatgccacaatctatggccctgtgtcctgaaatgcccttcctccaggcccttttggagcaagagctccaaggggctgttccctcagataataacctaggtgattggaaaccttgactagggagcacagacctggaggtcggttccagtgtgggacagttggtcatatttcccactcaccctctgccatgcaaagtgggtgaggcagtggctctggccagttcattggcaggtggcaaaaccttgtctagtctttggcattgggcatgtgataccatcgatggccagtaggtggcacaagttgtccatcactgccgccagctttgctccattgggtgctttctcagaaggggaagatctatttctaatccagtcctggctttatggcaatgcttaatcacatggaagggaacatgcaataactactggtatttctgtaaacatgcatgctaagaatcagctgccatttggaaatgaggatggagggaacactcagtgagaggtctcctgaggacaatctaaaaaaggaaaaccttgagggttttaaaattttagagccagttaacctttgtgactcatggagagaaacgtttagaacccagaaggacaatgagaatacatcctgtggattgtaacctggtccaaggtccaccttgccctctccaccttccttcagctgtgaagtttaggaaggagagacaagatccccttgcatggagtcagcttacccacttcatgacccccagcagggccgggctgcaccttctgggctgtttgcttaattttttattcttttgtcctggcaagttgcctgcttcttgggtttgtcgtttccctggaggaaagtttatttgaatctcattctacccttaataaaattggcaccagataaatacgaagcggatgaagagacacattgcagcaaaacaaaaagtggaacgtggtcaacaacagggcgatgaggactttaatacatgtgtacactttctaaataaaaaattttcattgtagtaaaatacacataacataaaatttaccatcttagccatttctaagtgtacagttcggtagtgtcaagtacgttcacactgttgggcagctaatctccaggactcttcatcttgtaaaacagaaactctctacccattacacaacagctccctgttcttctctcccccaacccctaacagccaccattctacttcctgtctctatgaacttgattactctagtgtcaaagaaaagaatcaaactctgtaagatatttgaagagatttattctgagccaaatatgagtgactgtggcccccgacacagccctcaggaggtcctgagaacatgtgcccaaggtggtcggggcgcagcttggttttatacattttagagaggcatgagacatcaatcaaatacatttaagaaatacagtggtttggttcagaaaggtgggacaactcaaaactgggtcggggggacttccagcttataggtaggttaaaaaatattctggtttacaattggctgagtttatctaaagacccgggaccaacggaaagaaatgtctgggttaagataaaggattatggagacccaagtttttattttgcagagaaagccttcaagtggtaggcttcagagggaacaggttttaaaatgtttcttatcagacttaaagtctgtgttgatgtcagtgctggagaggtatcatgaggcatgtctgacccctgctttccatcatggcctgaaacagtctctcaggttaaattttaaaagagccctggctgagaaggaagccctttcagatggttgcaggggcatggggggatgcttagaattttatttttggtttactctaggtacctcatataagtggaatcacactattttgtcttttagtgactgggatatttcagcataatgtccacaaagttcatccatgttgtagcatgtgtcagaatttccttcctgtttaagctgaataatattctattgcatgcgtgatggttaattttatgtgtcaacttgactaggttaaggggtgtccagatagctggtacaacattatctttgggtttgtccttgaggacgtttccagaagagatgagcatttgaattagtaggctgagtaaagaaggtccgccttcgccagtgggtgggcatcaacccatctgttgagggcccaagtagaataaaaaaggcagaggagggccgggcttggtggctcatgcctgtaatcccagcactttgggaggccaaggcaggcggatcacgaggtcaggagatcgagaccatcctggctaacacggtgaaaccctgtctctactaaaaatacaaaaaaaattatctgggcgtggtggcgggcgcctgtagtcccagctacttgagaggctgaggcaggagaatgacgtgaacccaggaggtggagcttgcagtgagctgagatcgcgtcactgtactccagcctgggcgacagagtaagactccgtctaaaaaaaaaaacgcagaggaggagcaaattctctctttctcttcttagctggagcatccatcttctcctgccctggggaattggagctcctggttctcgagctttctgacttggggactcatcacccttagccccgcaggttcccaggccttcagctgaacgttggtcactccaatggctcccctggttcccaggccttcagattcagcctgaacgacaccatggctttcctagttttccagcttgcagatggcatagggtgggcctctttggcccccttaattggatgagccaatgcctgtaataaatctcctcttatgtatctgtatatattctactggttttgtttttctggagaaccccgactaatagagtatgtacataccacattttgtttatccacccgttcaccaacagacactcaggctgctgccttctggccattgtgcataacactgccatgaacatggtgtaaaatgcctcttcaagaccctgcttccaactcctttgggtatatgcccagaagttgaattgcttgttcatgcagaatttatttttaattttttttgtgtggaacagccatactattttccatggtggttgcatcattttacatgtccatcaacagtgcacaagggttcccatttgtccacatccttgccaacatttgttattttctgtttttcttttttcttgatggtagccatcctaatgagtgtgagatggtgtgtggacacttcaagtttgctctttctagggctttttctggagtgggcaaggctccctgatcccttcctctgaaagtggtgttactgtaaaggtggcattttcctgctggtcatggtggcacgcgcctggaatcccagctactcgtgagactgaggtggaaggattgcttgagctgaggagtttgaggctgcagtgcactatgattgctcctggaaatagtcactgcactggagcctgggtgacatagtgagaccttgtctcaaaaccaaccaaccaaccaaccaacccacccagacatttccccttctgccctcccctcagagctctgcctagagagcctgctgagtgtgggtacttctgggttggtgtctccaccctaggaacccacttgagagtgactttatttggaacaatcttcagtcacaggaatcttctgggaagtcaccagaccattgctttgaagagtacacagcctcagaccctctggggacaggagcaaggcaggctgatttattaaccacgctgcgtcacccttttgccctagaggttagatggtcccaggagcccccctcgccaagacactcctcagagtgggggtaggagggtgggaagttctagatcctcagtctggccttcaaatattccattacattgccggggacatggcgcacccacatttatccaaaggacaggggtctccagaaatgtctgcccgcaatatcctttggttacctccaaaacattctcttgaagttgtttaactgccatacattgttgtgggccggccttttattcccagattcacttatttaaaaaaaaaaaaaaactctcgagcatctctgaagagagaggttatatggcagatgcaagtcagcagaaggcagagagctgagaatggtggggagagagacacagggctcacggtgtgacaagcttcttggtgagtggtcaagtgcgtaatggccaggtaggcggctggtgggatgtgctcaggcagaccagcgtctgagtcccaggctggtcactaatttgctctgcgtccttgggcaagctccttcctttctctgtgcctcagcttcctcatatactaaatgagggtagtgagagctagctcagagctgttgggaggtttaaatgagtggatgatgtaaatacaagtgtcaggaatagtgtaggtgctctttagtgttcacccactgctgtggtttgagtgtgtccaaagttcgtgtgttggaaacctaattcacaacaccaacagtgtttggatgggggaccttcaggaggtgattaggtcatgagggctctgccatcatcaatggattaatagtgttaccttaggagtgggttaatcattgagggagtggtttcttgattaatggataagttcagtcccctttctctattgctccctcctgctcttttgtccttctaccttcccccatgggatgacacagcaagaaagtccttgccagatgcagtctccttgaccttggacttcccagccttcagagctgtaagaaataattttttttgttttctttttaaaataaaccacctgtatgtggtattctgttacaggctaagatactttctttctccactagccacttgctcagtacaagttgagagaagagtgttgtgaagcccaagtttaggcagagaggagcaggttagggcaagtgagcaggcagggtttgtctctcacccacctgcatttagccaacagctaccagtggcagccactgggctggtggacatgttccctgccacggagagaggggagtggtccagctgcaaggctctagttctgggatctagtcttggtgacggaggatcctggaaccatctaacctctggggcaagagggtgacgccatgtggttaataaatcagcctgccttgctcctgtccccagagggtctgaggctgtctactcttcaaagcaatggtctggtgacatcccagaagattcctgtgactgaatattattccaaataaagtcactccctggcaaagggataagtccctacccaggagctgcccaaatttttttttgaaacggagtctcactctgtcacccaggctgcagtgcagtggtgcgatcttggctcactgcaacctctgcttcccaggttcaagtgattctcctgcttcagcctcccaagtagctgggactataggtgcccgccaccacacccagctaatttttgtatttttagtagagatggggtttccccatgttggccaggctggtctggaactcctgacctcaggtgatgtgcccacctcggcctcccaaagtcctgggattacaggcgtgagccactgtgcccgacctcctgcccagatttctattttattcttgcactcagctaacagcctggctgcccagaggcaggtacaacttattcaagagcaggagaattccaattttattatttaaaaaatcacataattaactgagtattacaagctttgagatgtttgttggttaataaagatgaatgggctatttgaggtaatggcttttaattaaatggaagctaataactttggtaagtttgtccgagtagtaatcttggctaacagtttgaagtttcgtacaataatcttggctaacaatttgtagcttgccttgcactgatttcatagcattcattgtttacaacacgcagaacacccactttacagatgggaaaacggaggctgaggctaagggcacaggaaggctgtggggggattgcagtccacagcagccccgggggtctcaagggcatattccttttaatcatggcttcccacacaacatgcatccctaattctgttcacctgacccctgactaaagctcagctttagggcaggagatttaaaatacaaactcattatatctgcaggtgtgggctgcagggagggcttggagatgtagaatcctcctttgctgccatgtagagagaggaaagactgcatgcaggcccagctctgctactcacggcctatacaaccctgcacactttatcccagagcttaaatcttttcccttcttgcagctcttcttctgttaagggacctagagcaggacataatcatctgttcttcttatggaggggctaaggaacaagaaaaatggtaaggagcaaaaaatggggccaggtcatttgacaaggaaccctgggaaatgcaaaagttgtatattctttgctgagttggagcattagtgacctttctctcttttcttgtgaatttacaggagttgcaaaggcccagcacctccctgtggcttttaaaaccaggtatgtgggcaatgctcagcagagactgaggaccatggccggggtgccctgcagccctttcatgccgggcagctgcagcctttaatttgggggctattgtggtattgttggtattattcagggtttgggcttcaagagaacctgtgatgatttctttgttatttcacagaaattggtctgaacggttggcatgtaatgcggtggcactggttctcctgtgtttgcccaaaaccttgccaggagaaccaggcagtggacgggtgtgtggtcagtgtggtgacctgcaaacaccactgtccacacctcatgctcttgctcaagaattttcccaggctccgtgcatgtgtaaatttgcaaaaataacaaagccaaccttcattgtttgttctctaaataagaagaagcttcgtggtttgtgttcgagtgaaacagcaagggagaattttgatcctgtggaatctggccagaccttacagggttgaggggtctctgcactcacatttgccgtgttcctgtccctctgcctctcacctttgaatgcctccctggggcagatgctcccggctcctactcctcggatcctttgtgtaatttctcacaaatttctagagctcacatggaccttcctttcatagtccaggaacacacagggttgatcctcgaggcctgtgcctctctccgggcacccgtaacaccctgctccatgtttgcttcaccttggagtaatcaccttgcactcaccccattgtctttgggggcttatgttttgtgggtgatagagtgcatcatctatgaggtaaaatcttttatgtgtgtttgcttattccgggatgcactggtggccaggctgtgctcattctggctcactgagggtgtgttatcatcctgccatggaccaccctcttctagaaggaacagaacatcagggtctccctcccagccccctgttccaggtaaccacagcgtactgcaggaacaaaggtgtagactgaaagtaagttaaaggacagggctgaggcctatagactgatttttcggagtaaggaggtgggcccttttgaaaatattgagatataatttatataagataaaatttacggctgggctaggtggctcacacctgtatttctagcactttgggaggtcgaggtgggtggatcacctgaggtcgggagtttgagaccagccccacacaaaaccctgtctctattaaaaatacaaaaattagccgggcgtggtggcacgtgcctgtaatcccagctacttgggaggctgaggcaggagaattgcttgaagccgggaggcagaggttgcagtgagccgagatagcgccattgcactccagcctgggtgacaagtgcgagcgaaactgcgtctccaaaaaaaaaaaaaaaaaaaaaaaaaagataaaatttacctattttaagtgcacacaatgaattttggtaactgtatgcatttgtataaccacccgacaatgagatacagaacacttcatcacccccaatagttccctcaagcctctttgcagtttctcccctccctttggcctcagcaaccagtctgtgagtctagttttgcctttctagtctttcatgttaatggaatcaagaagtgtgtactcttttatgtctggcttcttgcattcagcatattttggagccttgtccgtgtcactgtgtgatttctctttattactgagtagtaatgcattgtacagaggtagcacaatttggtttttcatttaccagttggtgaatattcgagttgtttccagttttgggcaattaggaataaagttgctataaacattaatgtacaggactttgtggggagttctattttcatttctctttggttcatattcaggagtgggtttgctaggtcacaggatagacatatgttaaaactttgtaagatactgcaaaactgttttccaaggtggctataccatttgtattcaaaatcaacacttttagcctagagcatataactggccttcctgaaatccatggatatctatctgtgcaatggttttagagacattttattgcctcccacatgtaattaagttacttggcttttaggcaaaagatgataccatgtctatggatgagatgactctagttttgaactctgggttttgcagaagagtttgcattatcctcctcctgaggaaagcagatacatccgccacgatgcatgtgagtcaggtcttctgcgtgtcctctgaatcaggttcgcatgtgtgcctctaatggcagtttcgagttcatcctgtgttgagataatgcctgaaggcgagaggaaaaaatatctgtggttgtcaaatcgggtggaaagtgattaatcatggagacatttacggcatgctgaactgtttcgtttcctgacctttgtcccacgtgcgttaggggcaggcggggtcaagtttaaatccaagatgacaagtgtctgaggctaaggaaggtttctgctgaatacttggcttagagtcaatggctccatgtttcacacctggtgaaaaccgactcgcaattgaaagaaacagcatgggagtgtcaaacacttgctgacttggccttgggctagagcttcttgcgagggttttagaactgacacaccctttggatgtgctgggggcatctggtttttggtgcctgagtcacaaatcctggaatacatttgcccacagtgtttccataccattggaagtgcattatggctgcttctcttagagtcctttaacctcttcctcaagagccagctttgtcaacttgatgtatctcatggcaggcatggactcatgcctgtgtgtcccattgtatccccagatcatgggatttgtgggattcagccagtgtcatttactaatcactaggtccagggccaagtttaggtgaggttcactccatctaagctgtgttttgggggagggagggtctctattttttcatttagagaagtgactagacactagaaaatgtcacagagtaaacgtatggactacagcttgttttctgaaaaggtttagggatcccgtgttagtattgaaagaccctttgaggcctcatcccctccacccagtgggcacacaggcctctgaccttcagcgccaagtctcccttgaggtcagcttctcttcatctttcacttcttttctcttcctttcacccctgctggttgcagcgacaaggtccctgccaactgcggtgtgcacactggcgggccttcacctcccttaaaatccagctctcgaaatgtctgcaagggagcagcctgcaatattacctaatttgtctttaatctggtattcctagaataatccagagaatagagtggcctactgtacacactggattactcaataaagaacatgatgggaaacggcagtatttttctgttttaaaataagtaggtttggagggagctgggaaactgcgggctttagttacaaaatgactataattgtgggagacgtattttctttgaatgttgaaacacattggacaggatatacaatttagaaataatttacagttagagaaaggccctttcatctgagagggggcacatcttctgattggaaaggatggtcccaggggatgagggatcgggccccaggtgagcttcatctttttctcttccaacttcagtgtggccaaacagagcggaaagtcatcacgtagaaggacaaagtctgtgtttttttgtttttgtttttgttttctctcatgagagaagcaggcaagtgctgcctgagaaggtgaaggctcacctgtggcaggcttgcttcaagctggctgcagactgaaggccacccagaggctttggtcaccaagggtggcatgatgggtggccttctccttgctcatgcagctctcaccagcaaatttctactgaatgcccactctgtgcagggtactgtgccaagcacgagggatgccaggacccggaagaaagaactctgttagagaaccacagctgatagctgccagtcagcagtaaaggttcaaagcttggcctggccaaggagctatcacggagggctctgtggaccagggtcttgtagtgggagtgtgtcagcagagtggaggggttggaggagtgagcccaggtatgcaggggtatggatgggccgagagccttgggcctggcctggctgaaggctgtcctgttgaggcactggcaagtgggcttgggaggcagacggatgaccagacacggccccacagagatcagcccaaagcgcttggacccagggcatctgggatggttcttgaggtgagcgcatgaagccttgttttagacacatacactagaggactccagcctccctgcaagccctcctcctctctctctcctcactgttgaggcgagtgctgtgtctgccttagattccttctgcaggcttctgtctgcctgccagcagatgcctctatgtctgtcagccctcagaatgtcaggcacatgcactacccactgtgtgtgtggggtgtgtgtgtgtgtgaacatgtcagatacccacacaggctctccactgttcagtgtgtctccagtctgggacctgggggtggaaatagtcaccgtctacatccatcttcttctgcttctctcttaggcatttccaattcaacatacaccagcctgaactctttatccacatccctttccagcatgctcttcctccagcccctactgaccccatcacaggaaaaagccattctgttcttccagttactcagggcgacagcctcggagtcatcatcgatgtctttttcctctcacacctgacacctgacctgtggccatcctgttgactctccccttgaaatacatccagaatccagccccttgtccccactccagcactcacagtcacattgcacctggtctggaccccagcaagtgctgccctgtgggactccctgcttctccccttgctccacactgtctattctctgtagcctttaagaacaactcaggtcatttcactgtcctgctcaaaaccatcaaatcgtttcccgtttccttcagaatgacattcacagtcctttccgtcacagctctgcgtggcctgtggtgcctctgtatcctcatctctgacttagtttactccaccccattctcctccttcaccagactcccaggcactccttcacgagcagcatgcacctgccccagagccttggcaccagctgctttccctacccagaacactctccttcccacatcttcacagccagctgtttcattccctccaagtcccttatcagagaggctttttcagtcactttgagtaaaacagaaacctaccttttcatcattcttgaccccttaactaaacttgcttgagtttttgttgttgttgtttgctcgttttttacttattaccacttgacatcacttttgtgggaatccccttgcttttatggaaatatgtaagagtaaagaacttcatcttattttccgattatccccaggtcctagaacagtgctggcatttggaagctgttcagtatttgctgaataaatgaaatgaattatgctgtgattcactgtgtgtttggaggtgtttggagggactggcatgggaggattggattctacggtggtaatagtgacatggcatgatgaaggcatggagtagaggggcggccacagaaatgcaaaggaaggatgactgagggagaggcctctagctcggttgttgcaggacagggatgcttgactggcagtgccttggatgactcgttataagagctgtactccagactcaggatatgctttaaccataggttttcagatttctcctggggtccagtcaactcccatgccagtcccttgttccatgatcccaggccctgctccaattccttaactcttattctgtaaccgtaacccaaatggctaagcctgaggttgcaggctgacctttagagaaaaagttgaactttctctttaaagctaagtgggaaaaaaacaatgacggataaaatgtaaagatgtacaaaggtaccagtttgtacctgggtgtttgaatttctttacattttgctgtcagttgtacatggccatttgaaatgagtaatttaatattctgctgatttttaaatacatagatcattttcatggcactacatagtaaatctgtgctttgcttgtctgctatctgtgtgtttaggttcacaccagttctggtcgtgaagctatagctcaggcattatcatggacttcctagaagctgccttgccagcaaggagcctaagaggtgttcagaaaaattatccaaaacttggaaataaggaaagaggatgactctatgtcctttaaagtccagatcagagcattgtctattagatccactcaaggattatttaaatctcaaggagaatgtaactttgcttcacatactgtttactagtaactggctgcctgtcaacttgtgggagataagctggatacaattttgtccagtacagatgcaaatgattcccttcccttcccttcccttcccttcccttcccttcccttcccttcccttcccttcccttcccttcccttcccttccctcccctcccctcccctcccctccccttcccctccctccctccctcattctctctttcttttcttttctctctttctttctttctttcttctttctttctttccttccttccttccttccttccttctttctttctttctttctttctttctttctttctttctttcttctttctttctttccttcctttctttctttctttctttctttctttctttctttctttctttctttctttctttcttctttccttccttccttccttccttccttctttctttctttctttctttctttctttctttctttctttctttctttctgtctttctttctgtctgtctgtctctctgtctctctctctctctctctcattctgtctctgtctcattctgtctctgtctctctctctctctcattctgtcacccaggctagagtgcagtggcatgatctcagctcattgcaacctctgccttccgggttcaagtgattctcctgcctcagcctcccaagtagctgggaccactggtgtgcaccaccacgcctggctaatttttgtatttttagtagaggtggggttctgttatgttgcccaggttggtcttgaattcctgagttcaagcaatccacccactttggcctcccaaagtgctgggattatagacatgagccaccgcatccagccagctcttttatgtttaaatcggccaagcgtgatcgatttccttcaggttcaaaagattacccaaacattacagttgtattgtgccatagaacattaaccagttttgtatgtaacttagcaaacttttttcagcattctttctgacatacgatacatctgtgttcctcaaatgctttgagaatcagcttttccatcctatgggttccctcagtaatgagttaaagaattgtgcttgctacctgtatgagggtatgagagccaagttcctaatattttgaaaatgatgttttgatggaggagataaaaagtctcctgtgttagctatataaacccaaacctacaaaatgatgtcaagtaccatagaatgtatacaaaagacataacctactcctcccaccaatttctattttattagcatgcatttctcaggaaagactgttcaaaaggtaaggagagaataccattctaccattctgccaattcaagttagaccagctatttctctttgcttattcacttcctgttttctcttaataaatttatttaaagacaatttattagagaaaaagttgtcttacaaatgcgaattgtaagttgtcttactgatgtgatccagcaatccgtcctggccggcaccctgccaggtctgtaattaagactgggggtttgctctgcaaggacacattctccacctttgtctggggggctctgtactcagtcttgcggtttgtctgtggagctgaggtgctggttgggaatcaggagacgtcagttccggtctcagcaaagctgctgcgaggtgcggggcagaggcctggtttacctggtataccacatgcccttgacttccctgtggtaggtgcccctgattccgctccagctcttgctttgcatgtaatttacactgaggttgcaaacaactgcttattcctgtgggacttagttttttccttagggccaatctgaaaaacttacctccttagttacatcctacggatttgcagacaaataggggaaagaaatggaagaaataagggaaaatgttatccaaagttggaaataatagaagattactctatgtgctttcgatgtcatactagaagaagccgctttaagtagcaccattattctgaatggagaaatctgtggttgctttagtcatggagactacatcacaactagggttttccttttatttttgagatgtgtgtgatgggggaggataggggtacagcattctagaaatggcctcattttgcatttccttaggtccaaagttaaaataactttctgttctaagaagctttaaaagtggttcatggaccaggcacggtggctcacgcctgtaatcccagcactttgggaggctgaggtgggcgtatcacctgaggtccagagattgagaccatcctggccaacatggtgaaaccccatctctactaaaaatacaaaaaaatttgctgggcatggtggcgtgtgcctgtagtccctgctacttgggaggctgaggcaggagaattgtttcaacccaggaggcagaggttgtagtgagccaagatcctgccacttcactccagcctggtgacagaactagactcagtctcaaaataaagtggttcatttctttctaaaatcattaattgaacattaaaaaacattggtaagaaaaattgaaccaagaaggttttgggttatactgtaggtcagtgagctttaagtttctgtgtctctgaagctacatggctggacgatagctgaagtcagtgccccgagtgaagcctgaagaggagctgatggatttttctggtggggaaggcctgtgactgcactcagagagagctgggccaggcggggtgaggcacggtcactctgagttcacagacccactctgatccttgaatgggtctgtcctgaaataatggggaatcctggaacatgctgctttgtgtagacgcctttctcctttgcaacttttaaaggtatttgtcccctgggtttcatttgaaatgcttttttcttcttcttcttttttttttttgccagatgctttcactaggagcagtatccagaaagctatgtttctaacctaccttgttgtttgcctcttgggcaaatgggtttgtttaccttattgactcagttcagtggaaaatattaccctgattgggatggagatggggctgctgttctgaaataactacgcaagtttacctgttcaggtgggacacagcttcttgtgttagtcacggatgaattttgaaaatttatacatagtgcaataaatgctggtttctttccccttcctcactccttcctggggcctatatgtgtgtatctctaacacacatacacacacacgcaggcacacacacactcatacacatgcacactcacacacaagaggatacgttgcatatacagctcaatgctacaaagaagcccttttaccagaagagcacacgggaactccgctgaagtttgacagggtgattgtcttgtggctactctaccctgaggccagagcacagtgagggcctccctcctgcccccagccacaccaaagagggggcaggggttcacagggagcaaaagaggagctttttgccatcaccatgagacggtgaccacaggggcctggctcgaaggtgagggtggggctggtgactggtgcctgtggattccagagtggttggcctacacagcctactgagaggtagagcacggtcctttgcgtccctgtggactccgagtgcctgccatggtttggaaggtccactgaaggctgagtgctcagcggcgttgccagccagctggatgcatgtaaacagcattgtgaatggagaacattctttcaccttattcttgcacattcttctcccctacttagcttcttatccttcctatctactcatctagctagcaatccctaaaattaaatcatttataaatgagtccgatgagggtctttttttgaaaactggatttagtgaataaggcagacccctgtttttggatagggctttgcctcttgttattaaggaggaataacttgttcccaacttggttggtgaccccagctgaggaggaacaagtggcagatgagtcccagggaagacccctagggggaatggctggaggtagctgtatcagggatgaaaagggtgggggtggtgatgaggggaacgcagcccttcatgcaaagaagtgggtgtttgaaatcagtgggtgactatttttttggcaatgtgggctccttaggtcatacacagtggccttagaaagccagccctgcctctcttccctcaactgatggtggatttgtgtaatgagatcaccgtcttcttgaaaaacacttccagggtagctcattacaaagcctcgcacagtgttcggagcagggcgagctgcaaggccccgggctttccattctgaaagagctgtgggtgtcggggtggctgccagctgtgagagctccgtgggtggggactctgtccctcaaagccacgcactcaggcttgcccattctagtgtctctgtgggagacaatcaatgtaatttactctattaatggaatgaaggattacaataataaaatctttttcaaggaatgcaaaaaagcatttatcaaaattcaatatccattcatggtaaaaactctcagcaaactaggaacagtaggaaacttccttaaaataataaaggcatttacaaaattcctgcaggttgcatcatgcttaatggtgaaagcctgaactatctcctaaacccatttactcctcctcagggaagacttccctgaccccatgtttaagtcaaacactcattatacattcccttaggaccagcctctcatccaaagaagtgatcataaatgcaatttaaaatgtatttgtggttgggcgcggtggctcatgcctgtaacccagcactttgggaggccgaggcaggtggatttcttgaggtcaggagttcaagaccagcctggacaacatggtgaaaccccatctctactaaaaatacaaaaatcagttgggtatagtggtgcgtgcctgtaatctcagctacctgggaggccaaggtggaaggatcacttgagtctgggaggtggaggctgcagttagccaagatcgtcccactgcactccagcctgggtgacagagtgagacttcgtctaaaaaaaaaaattatttctgccactatttgcttaatgtttgttttctggtgtaggcattcagctctgtgaataaaagcattctgctgatttctgctgccctgtatccagacggaaggaatgggtgagtgaatgacaggcacctgttctgtttacagtcagtaaagtaaacacaacactacacgtatgaactccaccggaaagatgaacacttatggtatatttggtgccactgtcccagggagagtagaagtacagggttttgttcttctgacttgagaaatttttgtgctagaagggccactgagggtcatccaggcctatcactgcccaccccaaatttataggtgaggtcactagggcctgagatctgaagcatgcatgacatcccgaatgaactacaaatcctaggtcagagttaacagtagtggtaactgcacaggatgagttggtgcagggtgacaagctcatgcgtggtagctattttgaatcaataccccgtaactaacctctgctgtttgaaacacctggcagagtgctgcaactcacccttgggcaaagccccactctctgaggctgtggtggggttcagggaatactaccccaaaatatggcagattggcattggagaaaacggcagaagcaggaaggcctctctcaccttctccttgcccttcttttcctgaagcaggccatgaaaccaagctgactttctcctggagcaaggcataaggtccttgtgtgagaggtgcccactctttacctggaggggaggaacatctttatctctgaagacacagggacgcagaagaaaagctgaacaaacaggccttgctgagttcccccttgtatataactaattagatcatactccctttgtccaatcacacttctccactactgtcgacttctccatcaaacttacaataaaaacacacaggtgtccctattccctatttctttatctttttctttctttctttctttctttttttttttttaagatggagtcttgttctgtcacccaggctggagtgcaatggcgtgatcttggctcgctgcaacctctgccttctgggctccagcaattctcccaccatagcctcccgagtagctgggattacaggtgcccgccatcatacccggctaatttttaaatttttgtagagacggtgtttcaccatgttggccaggctggtctcaaattcctgacctcacgtgatccacctgcctcagtctcctaaagtgctgggattgcatgcatgagccactgtgcccagcctctttggatcttttttcctgaggtgtcttatgttacataaaatttaaattaaataagtttgatgtttctcttgttaatctgtattttgccataggtgcctcagctatgaccctcgtaatgggtgaggaaaaaacacattttcttccctgcagctgcttggccacctgccttttgcttggattggcagaaatctggcttaatctggcttctccagtcctccatcacctggccaggaggtagcccttggtctaaccccttctcatgtttggaagcagactttccctttctttctaaggactggtaggcagctcctcatggatggagtgataactccagaatgtcttcgtgtgatggctgttggagtgggaagtgggctgggaggctgtgctggcatagactttgtgtaggattgagaagacaataactgccagtgtgaagatcaggcgggagttgggaagacagctgagagtggccaaggggaagccagagcctcttcaagtcatctctagatgggtgtgaaagggagagaagaggccaagaaaccatgagattaaaaggtggaggtgggggcatagagatcccagctgctctaggggaccctcccaggcaagtgctgtgtgtgtatgctcctccactgttccttctgcaatgcattccatctggctgctagatacggtaaagggaatgaaaggtgggaaaggcaaagggtgcatttaatccactcttcagctgtgaattctctagaggagagctagtccttgtgtttgttgatgcagctgcctctctcctgagacctgtaaaatgacttttttttttaaaggtaaaatcatgactcttacacaaatgtaaaatgaacacatgtcaaagattttatttagttcattaattaatgagggaaccagtaagatgctacaaccagcccaaaggagaattaaaaatgccacgcatagctaggacaataggaatgctgacatagaatttacaaatagatgcaaaattgatgatagccactggacagtctgtccacatgtccatggacaaggatagttggcattccatgggtcttttacaacttgcaaaccgaggaaagtttaggtcctcctttttccttgctgacctttcatgggtcagccctcatctggacatcaacactcctgagacatgtggtcactgcaataattgactgaaatcagtaaagacacaatttctccctctgctgctccgtgttcctgtctagagagttgttttcctctccaagtaaaagttgttaaagagcttaaagacaatgaagggcagagagagccaggatgtgaagacttttctgctgtactgtctttcacagatccatgttgcagctgggagcacggggaaacctggacacgcacttcaccaaaatgagacaactgtggcaggagacaggctaaggcgagtggggacaaatcaatgtgctggatgccctggtgtacctgtgacgaagaagcaggagctgggaagagagaggaaaaggaaatagacaagtgaataaataaataagagttcagaaaccccgtctccaccaaaaatacaagaaattaggtgggcatggtgctggcgcctgtagtcccagctattcgggaggctgaggcaggagaatgacgtgaacccaggaggtggagcttgcagtgagccgagattgtgccactgcactccagcctgggtgacagagcaagactccatctcaaaaaaaagagttcaaaggaagtgtagaagagttgagagaagaactctatttgcacattcactcttcagttcatttcctcattcattttctgaacagtgaatctggctctgtgctggatcctggagcataaagactaaattagctgcacaaagaccctgatcactaacatcctagtgggaaagacacactgtgtattaagctgagtaatcaccaccttcccaccatgtctgtatcctgatccctggaacatgtgaatattatcgtatatggcaaaatggactttgtagatgtgattaagttcaggatcttgagttggagagattactctgcattggcctaatgtaatcacaggggttttcataaggaggaggcaggtgatcagcataggagaaggcaatgtgattatggaagtaaatgtgggagtgatgcagctacaaactgaggaaagctggcagctctggaaactggaagaggcaagggacagattctctgctggagccttccaaaggagccaaccctctgacaccttgctttcagccttgaaagacacattttggacttctgaccaccaggactgtaagagaatagatttgtgttgtttgaagccactgagtttgtggtaattgctataggagtcataggaaactaacatatatgctgaacaattgcatggtcgcatgattgcaatgtagagtgttttgaggaaggaaattaaggcagctggggagctgatgacaggtgtcctggaggaggaggtttcctgtggagagctgagggctttgaaggaggccacccatggtggtggattggggacgtggcagtttcaaagcatacaccatgtgaaggaaggaccctgcagaagtcccaaatcaatgttttcttgcttatccctggtggatgatggaggctggtggcaggggcattaatgtgtggccatggtggtctgtgtgatacggtgaaaatgcaaaggagatgaactcccaagacttttgggagacatttataggaagatgggtgctaaataaatccaaggcagtcttttcagacagagggcttgataccactaattaggcagcttggatgagtggcaccatggaactggctggtggttttcttgtgaaaatagacacaaactcccttctctccatgttcttagaagatgtgaatttagaggtctccacattgcctgacaaagtctgttttaactgggtaaaataaaaaaaaaattaccattgtattgctcctgaaccttgcttaaaattccctttaaagatctacaaagggttttgctcatttgtacaatcttaaaggtcacaaaattagaagcttagcagccacatgccaactgcacacagcatttgaaatctttgacacagaccgttccagaagtcacaactggcaaagctgcacttcttgtgacactcagtagcctgcacacccatctcctggcttgtaagcatatgcctttttgtccagccagctgaggtacttggttcctgattgttttcttgtttgttttttaatgctcagatattctcatgtggtgaatatttgtgagccaaattacttggcaggagcgtttgatgccatggccaaatggggagcccagagtcagcatctttttaaagctaactcttacttgccagctcctctttctgcccacatactcgccccgtaccaggcccagtggctgttgcacagacaaacaccaagcagtcctgcaaaccccatttgcttccttctgggcttgatgctgcctgggagtgggcttctccctgggtggtatgtaggagttttccttacattttcatttcttatcagcttaccatttgcaactgatgcaggacaggcaagaccccaaactggggcttagcccaggaggattcttggctttgcccaggagagaattcaagcacaagtggtggtgttagacagcaacttttattgaggcagcagcagctgtactgctccctgtggagcagggctaccccacaggcagtgtgcccagagtagcagctcagggacagttcagcagtcatatttgtacccacttttaattacatgcaagttaaaaggcagttgatgcaggcatttctaggaaaaaggtggtaacttccgggtcattgggttactgccatagaaaggggtggtaactctcaggtgttgccacggcgatggtaaactgacatggcacactggtgggcatgtcttatggaaagctacttctgccctggccctgtttcagctagctctcaatttggtccagtgtctgagcccagcctctggagttgagtcccgccccctacctcactatcttggttctatttggagatgccctgaaaggctgtgtccagtcccacagtgagtgaggaatctatgctgaggttcctttggaggtgaattttgaatgacgtataacccagtacagaggaaaagtccagaactgagggatgcaggctaatattaaagactcatagttttgggggctgtctgtccaaaggctcatgcatgggcagaaagagttcacctgacctgtgctgtgggaagtttgctgtaaacattctgataaacatttaactttagtccctttcagtaccagtgccatgccctgcagtgttcactaagcgcccacaggcatctgctctctgtgacctgctcatatgacgagctaaagtcgagcatgcttcattcacagccaggcctcctccttctttgttggcctgagtgtgttgctgaccattcatgggtcagccccgacctggacatcaacactcctgagaaatgtggcaactgcaataattgactgaaatcagtctctccctgtttgctggtccatgttcttgtctagagagttgttttcttctccaagaataagaaggtggaatcgatttttccaccttttgttcccctcaccccagtgatgatgaggcaccaggagggaattttctgactttctgcaggcatttatgttctgcttcacatcatcatatttattcctttaatgtaggagaaccttaaatgaagcttgttggaaataggccatcctccataacctgggtttgttggagcccatgtatagaaatgatttcttggcaactctagttctcttgagcatgtgtgctatggttaaagaggcagaagggcacaagaattttagcaccctgaggactgaaaaccttccatagaaccagcatacatattgttttataaataaggagtattcttggggtatagttgtttgcaaagaaagggagctccttaagatttatgacccagctcacaataaccagatgacctgaatcaagggtgtatgtcaggaacaggatcctggaggggtcaatgacagtgtccatctgtggcctcaaagagcccgttcccaactctcctgccttttgacagaaggtctgtctggttatggctttaggaagatagatgacttctgtatagtcacaggaagagtctgcgtgcctggagctgtgggctggaaaggaggtgagagatgctggcctctccaaggcctcgtccacgtgccccatctccagacaggagcagccagggctccgttaggctgcaaacaatggaaaacctgaatagcagaggcttaaaaaacatgtggtttgcttgtctcacctgaaagaagtctgaaattgggaagtccagggctgggtcagaggttcagagatgctggggttgaggcctagatggctttttggccttttccccaggaaaaaacagaatcaatcagaaggtggctgatgtaggtcaggtgggctggggctggaggggatggtaggctgtgagtctggcgctccctcttgctggtgtggggatgggtaccaggagggcttctctcctccaccttgctctgttgctctgttgctctgttgcccaggcacccattgccaagaagccagactggaattcccaatgggatggggcagtcccaaggcacatggaatctttggtgggacttatacaccctgtactcctgtgagctcctcagtcactctggtcaaaaactctaatattgttccttttaacacagtcatcacccaaaaccctgttaaacacccaaatgcacctggggcaacccttgaccttatggagcccactttctttgcaaacaacacagatgttgagatgaagcaggaaggagtggttacataggaggatccagaatccccaaccccagggagttcgatatgggaaaaatgcctctgagtagggcggagggatgctcagagggctgcagggtcctgggaagtggctgtgtctcaaagtgtgctccatattcatacccgtctttccccactgcttttatttgcttcgcttttgaatctgtgattcaccttctttggtctcacctcttcctcgggccctttggttaagggcaggctgattactgcatatggctgtgccccagccctctgctttacccagcgattaaggagaagcccacaccaattcaacaaggcttgcattttaggagcagacaaaaatcttagacccagaagccaggtgtgcagaaaatgcatgttggcttccctttagcgttatctaatttcccaggctcaattctgtctgggtaaaggaacattattcttggttagctgaagtcccctgcttttcctgcagatgtgtctgatgctgggggctggcattgctccccttgggggctgggagatgctctcctttctggtctttggttgtcagagcctgctgttcactgctgttgtctcttgttctgactccaccccagctctgcttcaatcctactctctccaggccacagccacccactgggacctcccatgaagctcttgggagctctcacccatcctggagggagcccatgtaaatttgggcctggcttgttgattctgaatcaccaaataggcatttgcgcagcctgcctctccaagggaacttcagggttttgctgccactctggactttgtctgaggctatctttctgcacaaactgcacaaagtggggatgaagcccacttcatgggcacaggcccttcccaggacactgcagcctctccatacccctcccccctactcaggaggcctctgtgctgctgaggccaaagatttgctttgaaaggccaaatattcttcctgagccctggtcttaacccggggctgaagctttgctctcaaaggtaaaggtgaagacctccattttcctctgctctctgcaaattgcctttggctgaagcagggaacaggaaatgaatgaccaagttatgtggcctgggagagggagaagagcccagtcaacagctcaagaaatcccgccatgtctacttaaggggaagaagagagaaaggaggataaagagagattttttttccttttaatataatgcacattaaattttaggttgtttttttttttttctacatttaggtcccttatgtggcagaaaattccaaaatatattagtaaaaatgaacccaccttacatactcttggggtttcgttgaaatgttgagaagttaagaaactttgttagattattttacttaatttttaaaaaatagcctatcaaggagttttcaaaactttttaggtgtataaacaccctatttcggaaaccaccgtattttacactttcacttcccacctacaccagctcagtgacaagaaagtgtctgaaacaaggtgcaaaatcaaggttctcagaaacacgcttgggacgtcttgttccgcagcttggctgctctttccgcccggagtgtccttagcctgtgcccctttcgaactccggcactttgtctgcggagtagctccagcgcagtctcccagcgttacctggcagcctcctccttcctggagcaggagaagcggctctgtctcctgtgttccatcatcgattatggctgctctcacactgggttaggaaggtttggtcacctgagtgcctccctcctctgtgctgttggactctatggtttacatactcctagatgctattttttacatactcctaagttttcaacctgagaaatctgaaaccatcccctaaccttacctggttacctgttgaaaaatgtgttatcccagaggtagattctttgggtcctaggcatctggacttgcaagagtctcatgtcagtttcatgtgcttacaaaggtgataacagagagggacatagctgtgagtttttcccaacggccagtgagtgcttcgttccctgtatcatgttttatttatttatctatccccagggctagtgcagtttggacatagggtgctatgggttgaattacatacttgtcaaatccatatgttgaaatcttaacccctagtacctcagaatgtgacattatttggagagagggtatttatagaggtaattaggggaaaaggaggtctttagggtgggtcctaattcaatatgaccgatgtccttatatagagggaaaatctggacacagagctgtatacatccagggagaacgtcatctggagatgaaagcagagatcagagtgatgcagctccaagacatggaatgctgaagatggtgagcaacccaccagaagccaggagagaggtataaaaggtttctccctcacagcccttagaagccaccaaccctgctgatgccttgatctctgatcctcaaggatgtggagtagctgtgtgagaggctgtctgagggctcttcaaaaagttcataggaaatgcatattatgaaaaaactatgctggatttcaaattttttgcaccaaaattgatttgtactacctttttataacatgttcatgcacaatctagtttgaggcactaagaaggataatacatcagtttgaaaagagcctctatcagagcaatgtgaatttctgctaaaattgaagtaagaacaaacatcaaatttatagtgaagcttgaggggaagtatagtgaactcattgatgctttgtgaaaagcttatggagacaatacccccttcccccaaatcagcagtttacaaatagataacttcttttaagaagggagaagttgaggctgggcacagtggctaatgcctgtaatcccaacactttgggagcctggggcaggtgaatcacttgaggtcgggaattcaagaccagcctggttaacatgtgaaaccccatctctactaaaaatacaaaaaaaaaaaaaaaatagccaggtgtggtgacaggcacctgtaatcccagctactcgggaggctgaggcaggagaatcacttgaacccaggaggcagaggttgcagtgagccgagatcatgccactgcactgcagcctgggtgacagagcaagactctgtctcaaaaaaaaaaaaaaaaagggagaagttgatgttgaagatgaagcctgtggtggcagaccattcatgtcaatttgcaaggaaaaaattaaccatgccctaattgaaaagacctgatgattaacagacatttcagttggttcagtttatgcaattctgactgaaaaattaaagttaagttttccactcaatgggtgtcaaaaccattgcacccagatcagctgcagacaagaacagatctttcaatgaaaattaaacaagtaggatgaagatcctgaaggatttcttcaaataattgtaataggagacgaaacatagctttaccagtacaatcctgaagacaaagcacaatcaaagcaatggataccaagaggtggacattttccagtcaaagcagaagcagaccagtcaggagcacaggtcacagcaagagttttttgggatactccaggcattttgctgttgactgtctgtagagccaaagaatgataacatctgtttattatgagagtgttttgagaaagttagccaaagctttagcagaaaaatgccactgaagaattcagcagagagtccttctccaccctgacaatgcttctgctcattcctctcattaagtaagggcaattttgtgaatttcaatagaaaatcattgggtatccaacttgcagttctgattttgcttcttctgacttctttttgtttcctaattaaaacaaaataattaaaaggcatccattttcttcagttaataatgtaaaaagactgtattgatatggttaaattctcaggaccctcaatattttaagaatggactaaatgggtggtatcatcacttacaaaattgttttgaacttgatggagcttatattgagtaatacagtttataaagttgatatttttcatttttatcttttgattccattttccatgaacttcctaaagtcctcttgtatttctaggagggtcttggattaaaaaaaacaggaggaaggaacaagtgagaaattactctcatagtttatggcgtgtcttaacatcaagttacttttaagtcttttattcttttaggaagatattttctctttcagggaaaattaagaaacatcagggcctgagttatgttggaaaatctctcccctactctgactgtctggctttattctgagctcccaagctataacagtggcacttgggtgggatgagagtggggtggggctcacatctacatggctgaagaccaaggcagaatctcacacccaagtcttgattctttgtgctgcttagctgttgttcacaccacttttcctgcttgtgtccagatctgaatgaaactgatggctgttggagaggcctttgtcatctgactctatctgttcctctgtcaagtaataccatcaatgatgctattcatagaaacatttcatgtttgagaggtgttaggagttgaattgtcttctagaagctgttgaattcctaaccctttatatctgtgaatgtgactttatttggatataggtagggtctttgcagatgatcaaattaagatgaggtcagtagggtgggccttaatccgtattactactggtcattctaaaaagggaaaatgccgatacagacagatgcattcaggagaattctgtgtgaaaatgaaggtggagatcagtgtgatgcatctccacaccaaggaacactaaaggtcaccagcaaaccaccagaagtgagatgcgaggcattgaataggttttcctcgcagcttcggaaggaaccaaccctgttggcactttgttcctggacttccagcctgcaggtggttgtgtaagcatttctgtggtcgaagccacctggtttgcagtactttgttagggcagccctagcagactaacacaagaggtcattgaaagtgtcatatccagaacagtgtgccttttgggggaggaaagtccagttggccctttcacatacacgaacatctcacatttaaagacacaattccaggctgtctgtggacactcataggtgcccgtgaaagccgcctcagccataaacttcttggagtcacattgtgaagtatttatttttaattacagattttctttgatgatcctcttctcttctctttttgtttccttggcttgtcactcattcgttgtggtaaatagactgcctgctgtttacgatgagaagtagcctgtgctttggtctggtctcctgacgcccggttgccagcagtccttgctgtctctgggttggaagccgtgatgcctgctcatgggctcgctgtctcctcaggcatgaaagtggaggcatccttctggctctattttcaacttaccttggtgaggccacaagaccctattgacacatgaaggggaagcacagagggaaagggggttttacttttcctcttcaacagggctagccctcggggactgagcagagagagttgtgaatgctgggttttgaaactggccccaaacgattgtctcctggaatcagagaaggaacaaccgactgcacctaaaagaaacagagtgtttaccagtcttgctggatggctttaaaaacgcaaatacatacgcattctcattagcccatagcactcagccatcttcacccccattagagaaagccagtctgctgcctgcccccctcaagtcactgctgaactcatagcatgtgtcgggcttctggaacctcacagatgtattgccgcagacaccctttagatgagaggtgtaggttaggggcacaggcaagggagcggtcactcctagacctgaagcatctcttccatagacgtcacagtatatatcttcccagccagctcctccccagcccttcagggaaggtgaacacaattccacactagagtggcttttaaagaaaaataacatgtatgaactcttcccagaattctatgaaatgaatgagtttgcattactttttctagcttatgacctgagtcttttattttttcagatacatttagttgtgtctttcaaaatctatttttgcagaacctaccctttgttagcattgggctggaaccccggaaggataattatgtgtgggacttggtagctgcccttaggtgtacaatcccataaaggagagatgccatatgcagaatgatgaaatgcagcatgaggctaagtgtccagcatgggttatggagggtagatgagagagaggttggtgcccagaagacagccgtcctgcctcgggcctatatgtctgcagaggcccacaggagtggggcagtcctgttcagggagggctgaggggttctccgaatcttatcaggtaggacagggagactttagaaaggattgggcattcagtttgtgggtgtgttataagcaaagtctggagcagctgtgagttggatttcactgggtttcatggagcagatgtctcttgctggggaatgatgggatgtaagactagagacagacacagtcagaggcgatgtctgccttgaggcagacaaacagatttcaacttggtcttctgggcctaggcagtgagaagcctggaaggtgtctgagcttggagatgacctcatagagccaactttttggaagattggttgggtggcagagtacactgtatgaaggcacaggagagagaaaggacaaatgcacaaaggaaggatccagaattccagggcaggctggacatgtgggcctgaaggaaggggaggggtgaagggagacctgaccatggcttctgcctgcttgaccaagcttggcatgtacattagaatatacagagtttgaggcctgaggacccttgttctttttcaataagtaatggtattttaaaaaccatctctgggttttatcatgagcagaggcgaattccatgcacagtgaggactgttttatttatttatacttgttgaatagtaaacagcattgaagaatgtttttaaagaaacccaaacttccttttccatttctcagtattaactttctttttagcaactagggacacaattgaatgctattgtcttaaacctgcctgacagagcagaggtacacgctggggggcgtgggaacctctatttggcaaagggaacttctcctgttattcccatatggaaagagacataaatttggggagagcttgctccttccctacatttctgtgatccatggttaacagtctcctcaagtgaatttcaaattctctttccaataagctgcaaaagtacttaaatcatttatttgttctgctcctgaaatgagagttactcactaaagtcccaaagtgtcccgaaccatgaggtgtccacagtgaaatgacatgtttaaaagttgccataaatgctggtaactggacatgataataaatctgagtcatttcacatggccagttgggtcggtaataacaagacatgcacttaaaatatatatctttttgcctttcgggctataaagattaataaattgtgtaaatttccaagataaagtgtgagacattctgaattttatgtgaatgacttgcatggtgacagtaaccatgttctggcccttggaacaggaggtaatttactgttgatggtttcttggcataatatatatacgtatttggggggtaataatttaaaatcatccagcacatggtctctgataaggtgcataactcaggtactcagagttgttttataggaaaagagatacaggcacaccgtgcgactgcaatcccggcacgttctccttcctcaggaatgacaagggatggaaacctggctccccacggggaataataaagcatgcctgtgaaaaatgaatcctggacctgagctcagggccagagtgctccaaaatttggggctttcccaggacttagtccagatttgcttctgtccaggccagtgaccgcttgaagctgtagagggcaggggagggagggtccccttcctgaaagggaagtgctgtgagacgtggctgtcactgataccagtggggacctctctgcccccagcctctaatcatgcttgaaggtttactctctgagcatggcttgagaagacaagggaaagcaatggagattggccatcacagccaaattctgcctgatatggaggcctgagtccttttgtgcaggtggtgactcactgccctgttgaatgggaggaaggaacagtgatcagacccaaacactctggttttcttcccacctgtttctcagaagtaataagtgcagggctcatgctctgcctgtgtgtgtgtgtgtgtgtgtgtgtgtgtgtctctgtgtgtcctgtgtgtgtgtctctgtgtgtgtgtgtgcctgtgcgtgtatgtctctttgtgtgtctatgtgtgtgcgtgtgtgcctctgtgtgtctctgtgtgtgtctctctgtgtctctttctctgtgtgtgttgtctctgtgtgcacgtgcatacatgtatgtccctctgtgtgcctatgtgtgtgcatgtgtgcctctgtgtgtttctgtatgtgtgtgttgcagaggagctgctaatgtgttctcatgctggttgtactgccccgccttggaacaactttatccttgggtgcaggggctgggtgagcctggaagctgccagatgcagcacatgatggaggagaagggcctggaaacttttgcagttgtcactcaacaaacactcatgcagctcctcctgtgtgccaggccaggtgccaggagctggagggaatacagagagtgagcctgccgctttgggatctcatctcctggaggaggaataagttatctacttaggtattcaattttaactggtatttaattacagccatacaagtggttccattattagtcaagctgaactaagttttgctgcaataacaaattttcccagaatctcagtagcttaacggagcaaaggttggttgcttgtgaatgctgtctgtcctacaaggtggtgctctgctctgtacagtcactcaggattcaaggctgacaggctaccttcttctttaggctgtgcattctggaacatggggtttctttagcctctgtagtggggaagagagacaagagactcactcacaagcttctctatcatactaccttatgatggaggtggtgttattagcctttttacatctgaggaaactgaggcacagaggagttaagtaacatgtccaaagtttcacagcaagtgagtagcagaaccaggattgtgagctccagccatctggctccagaatccctgttcttgtcatgctctgccatctaattaaacagtttcttgggaagggaatgaagagatgtcagacaggccaggagctcaggggactagaaaaagaatttatcagaagaaggaaagtatgtcggggaatgacagggaaggataaatgagcaaggctagaatcccagaaaaatagagagacttcatcttggctggcagaatagcttttgcaaattcgggattagaagcctggtttcatgagtttgggacgaaagctacagaaaatgcagacacagggtggatcttacggattgtgaagtcagggaggtctgaaatgaaatagaaatggcccaaggaaacctttcatattcctttttgtttccacatacatctggccacaaaagctctttggtggtttatcccatctcactgcttccttagggctctttcaaactccttgcatctatgtaagcatggataaggagcacagcagacatgggacacacctgtgttgctttctgggcatgctgtaggatgccactttttggctgtgcacctggagcaagaggcagcagggcagcagcacccagccccctgcagttgaagctaaagactgcagctgcagcgcaggaattccccagtaggacaggaaagcaaacacaggcaagataaggtcagagacagccaactgtttacagcgtccaagctcttcctgggtttggtccaccctattaaaagataataacctcttaaaacatttcaaaggatgtgttggcagtgtttaagaggaaacataattgtcaccacagcctgggtagtgtgcaattgagtaggagaccatcttcaggataggatgggtgatgggcaagattgtgctgggagaggagttcgtttgaactgcagactccagaagctacagtggctgcccaacccatgaaaacacccacagatgctgtaactgctgggtatctgtcatctttggaataaaccactcatgctggggtctcactttctaagccattaccagctgcaagggttggctttgtgaaggcaaagggaagtttactttataacgatgtaggctatgtggagatatagaattataggagcacaaagtgcattactgactcactgttctgctgcccatagagcagctcatcctgctttgtgaggcattgctgtgagttgccttcaggcaacttgggaggaagagctgcctgaaaccctttcttgaatcttctttaaggttgctgatcaggacccatctaccatgggaggactgtggggattcctccatgacctcagtgctgagctgatctggctcattaagagatggttcttacgaccgggttcggtggctcacgcctgtaatcccagcactttgggaggctgaggtgggcagatcacctaaggctgggagtttgagaccagcctgaccaacatggagaaaccctgtctctaccaaaaaaatacaaaattagctgggcgtggtggcacatgcctgtaatcccagctactcgggaggctgaggcaggagaatcacttgaacctgggaagtggaggctgtggtgagccgagattgcgccattgcactccagcctgggcaacaagagcgaaactccatctcaaaaaaaaaaaaaaaaagaaaaaaaaaaaaagaaaaaaaaaagaaagaaagatgcttcttacaaagaactctttctttgcatctcatggataatctgaattgtacatctcactgaactaccttctttgccatggctgctggggtgcccagagcaagtgaccatggcatgcatgctgtcacctaagtggctttctcttatttttcttttccttctctgttatttattctgttgtattgtttatattttgataaactcacttaaattcattttgggacaagatgggatctaaaccaagaagtagataaatatgtgtgctttagagggtagttattgcagagtctatcctgggaagagtggctcctttgttcaggatgcctttctgggtatgaggggtgggttcaattccttccatccctttctagaagtatgtagtctttgatggattcattgagtcactgatttgttctgtggacacttattatgtgccaggccctgtgctaggcctgaggaaagtgacgatgacctcagagttatgttccagtggtgggagataggcaaagactatgtaagtgggcagagacactaattacatgtaagaaccactgccttgaagggagaatgaggatgagggtgtgtcttaggtgggctgccatagcaaaataccatctactgggaggctaaaacaacagacactgatttcacatgctcttggtggctggaggtcagagatcaaggtgtcagcaagttttattctgaagcctcttcttttagcttgtaggcagccacatctcactgtatgctcacatgacctcttctcagtgtttgagcagatagagagagagagagtgctttgatatctcttcttacaaggatgttaatcttattggaccccatccttatgacctcatttgaccttaattatctccacgaaggcttcatctccaaatcacatcacactgaggcttggggcttcaacatatgcattttggggtgggcacagacattcagtcatgacagagagggagaagatctacttcctatggggtgacgcaggaagcccactctgcagagggcaacatgcatgctggaatggaaaggataagaatgaggtggctgtgggagaggagggtggggaggcatgtgagggcgcgaggtggagagaacagccagggcagaggccctgaggctccctgagcagctggtgtggtcgcagcttactcaggagtggagagtagcacaggggaggatgtgagatgagtggggcacgagtgtgcagagccttgtaaaccagctatggtgagggttttgggtttcctactacatccagtgcaacgttactgaaagattgtaagcagagggatgtcatgatctggcttaggcttaaggagctgtgtggacagtgggctggagggattgggaatggaggcaggagactgcttgtcagttttggtaagaggctgggaccatggtgatggccacgttctagaagagagagtggaatctgttgatggaggaaatgtgagagacagggagagggagcacttaagggcaactcctaggctctaggcagaacatttaggtgcatggcgatgctgtttactgagctgaggggatgcggaagggagcagaggcaacgtgtatgtaatgggtaattgcatgtgtcaatttgactgggctaagggatgcccagatagctggtaaacattgctttggggtgtgtctgtgaaggcatttccagaagagactagcatgtgaatcagtagactgagtaaagaagattaccctcaccagtgtgggtgggcattatccaactgagggcctgaatagaacaaaacggcagagacagggcaaattcactctccctgcttgattgcacatcttctcctgccctcggacattggtgctcctggttctctggcctttgggctcagacaaggtgatatggtttggctgtgtccccacccaaatctcatcttgaattatggctcccaagatccccatgtgtcatgggagggacacagtggcaggtaattaaatcatgggggctggttttcccatgctgttctagtgatagtgagtaagtcccacgagatttgatagttttataaaaggcagttccgctgcacatgctctcttgcccgccactgtgtaagacatgcctttcctcctcctttgccttcctccatgactgtgaggcctcctcagccatgtggagctgtgagtccattaaacctctttttctttataagttacccagtctcaggtatttcttcatagcagtatgaaaatggactaacacaacagggcttatacatcacctcccctttagacttgaactgagttacatcagttcactgtctgcaagctggaggttttcctgggcctccagcttgcagacagaagattatggaacttctcagcctgggtaattgggtgaatgaagtcccataataaatctcttatatttctctacatgtcctgttgtttctgtttctctggagaaccctgactaatgtagtatgtaaggcacccagtcataagggcaggctatccttccattaatgacctcattccgggtgtatctgtagcctagaccactcttctaggaaaatcctattcccttcttgtctcttccatgtggaaatctcacagacattgcaacccaacccatccaaatcagatgggaaccaggggtttaatgttaacaggtgatatctgctgctgccggtctgccattgtcctaaagcattttatacacattttcttatcttagaaagtccctgtaagataggtgtgctaacaagaatcattttgcagctgaagaaatggaggtgctactggctcaaggaacctggattcatttagagagtgtgcccaggatgagacgtgtggagagcctggcctgaaccaacactaacagtctcctggacaggaggtgagtaaggaagaagcggcagggaaggagggacaccgggtgaaaggaggtgggtgtaggaggaaggagatcacaactgtgttgaaagtcctagcagcctgagaaagacgggggaagaaggccctgcaatgaaccctgtgaccttgggaaggacaagtcctcttgcccctggggcccactgtctgagtccctaggaagtatatatacaaagggtttcggaatgcagagtttgcagatgtgggctgcagctgcaccctgtgtgtgactggatggaattcacagctagaagtggttttgtccctggctgctgaatgtatcagctgttggtgccgctttagttttattgagtgggaaggatgtagaccctgagtctggagaatgggactgggctggccatggagcctggagaagagaatgagaccatgcaaaacctttattccttgttcttggtttcttgttaaacaggcccagtgccaccagattaaggaggtgagggggcggttgtaagaaagtaagagatcagtctgaagattataaatatgggccagtgcaacaaagggaaattcttgtgtcaatatttttctgagccagcacttgggagatcctgatttccttaacaaaatgataacaaacattttttcatgttaataatgtaagatgaacatttccttcatgtttaagccactgaatgtgcagtgaacaaaagacatttacatacaggcatatttgaggatatggaaggttcaattccacaccactgcaataaagcaaatatcaccatagagcaatttatacaatttctttggttttccagtgcatgtaaaagttatgtacattatactgtagtctattaagtgtgcaataaccactccttatctgtctaagaaacatacataccttaattaaaagataccttattgctaaaagatgctaaaggtcatctgagcctttagtgagtaataatctttttgcttgaaggagagtcctgcctccgtgttaatggctgctgactgaccacggtggcggttactgaagcttggggtggctgtggcaatttcttaaaatgagacaacaatgaagtttgacacatcagttgacttttactgtcaggaaagatttatttgtagcatgcaatgctgtttgggatagcattttacctacagtagaacttctctcaaaaaaatggaatcaagcctctcaaaccctgctgctgctttatcaactaaatttatggaatattctaaatccttttttgtcatttcaacgatgttcacagcatcttcaccaggaggaaattccatcttaagaaaccactttctttgctcactcataagaggctactcctcgtctgttcaagttttaatatgagattgcagcaattcagtcacatcttcaggctccacttctcattctagttctcttgctatttccaacacatctgcagttactacctccaccaaagtcacaaaccccgcaaagccacctatgaaggttggaatcgatttcttccaatcttatgttaatgttgatactttgacctcctcccatgaatcaatgtttttaatgacatatagcatggtgaatcctttccagaaggttttcaattgactttgcccacatccattagaggaatcactatttttggcgctataaccttacaaaatgtattttttaaataataaaactgggaagtcaaaattatgccttgattcatgggctgcagaatggatgttttattagcaggcataaaaacaacattcatctccttgtacatctccctcagagctgatgggtgaccaggcatattatcagtgatgagtgctattttgaaaggaatcttttcttctgagcaacaggtctcaacagtgggcttaaaatattccacaaaccatgctgtaaatagatgctatcatccaggctttgttattccatttttagaacacagccagagtatgtaactcatttatttatttatttaatttatttattttattatactttaagttttagggtacatgtgcacaatgtgcaggttagttacatatgtatacatgtgccatgttggtgtgctgcacccattaactgatcatttaacattaggtatatctcctaatgctatccctcccccctccccccaccccacaacaggccccggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcatccttttttatggctgcatagtattccatggtgtatatgtgccacattttcttaatcccgtctattattgttggacatttgggttggttccaagtctttgctattgtgaacagtgccacaataaacatacgtgtgcatgtatctttatagcagcatgatttataatcctttgggtatatacccagtaatgggatggctgggtcaaatggtatttctagttctagttccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcgtgtgtcttttggctgcataaatgtcttcttttgagaagtgtctgttcatatccttcgcccactttttgatggggttgtttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtcctttcccatgcctatgccctgaatggtattgcctaggttttcttctagggtttttatggtttcaggtctaacatttaagtctttaatccatcttgaattgatttttgtataaggtgtaaggaagggatccagtttcagctttctacatatggctagccagttttcccagcaccatttattaaatagggaatcgtttccccatttcttgttttgtcaggtttgtcaaagatcagatggttgtagatatgcagcattatttctgagggctctgttctgttccattggtctatatctctgttttggtaccagtaccatgctgttttggttactgtagccttgtagtataatgtgaagtcaggtagcgtgatgcctccggctttgttcttttggcttaggattgacttggcaatgtgggctcttttttggttccatatgaactttaaagtagttttttccaattctgtgaagaaagtcattggcagcttgatggggatggcattgaatctataaattaccttgggcagtatggccattttcatgatattgattcttcctacccatgagcatggagtgttcttccatttgtttgtatcctcttttatttcactgagcagtggtttgtagttctccttgaagaggtccttcatatcccttgtaagttggattcctaggtattttattctctttgaagcaattgtgaatgggagttcactcatgatttggctctctgtttgtataagaatgcttgtgatttttgcacattgattttgtatcctgagactttgctgaagttgcctatcagcttaaggagattttgggctgagacgatggggttttctagatatacaatcatgtcatctgcacacagggacaatttgacttccacttttcctaattgaataccctttatttccttgtcctgcctgatttccctggccagaacttccaacactatgttgaataggagtggtgagagagggcatccctgtcttgtgccagttttcaaaggaaatgcttccagtttttgcccattcagtacgatattggctgtgggtttgccatagatagctgttattattttgagatacgtcccatcaatacctaatttactgagagtttttagcatgaagggttgttgaattttgtcaaaggccttttctgcatctattgagataatcatgtggtttttgtcgttggttctgtttatatgctggattacatttattgatttgtgtatgttgaaccagccttgcatcccagggatgaagcccacttgatcatggtggataagctttttgatgtgccgctggatttagtttgtcagtattttattgaggaattttgcatcgatgttcatcagggatattggtctaaaattctctttttgttgtgtctctgccaggctttggtatgctggcctcatagaatgagttagggaggattccctctttttctgttgattggaatagtttcagaaggaatggtaccagctcctccttgtacctctggtagaattcggctgtgaatccatctggtcctggactttttttggttggtaagctattattgcctcaatttcagagcctgttattggtctattcagagattcaacttcttcctggtttagtcttgggagggtgtatgtgttgaggaatttatccatttcttccagattttctagtttatttgcatagaggtgtacagtgcaatcaaactagacctcaggattaagaaactcactcaaaaccgctcaactacacggaaacggaacaacctgctcctgaatgactactgggtacataacgaaatgaaggcagaagaaataaagatgttctttgaaaccaatgagaccaaagacacaacataccagaatctctgggacacattcaaagcagtgtgtagagggaaatttatagcactaaatgcccacaagagaaagcaggaaagatctaaaattgacaccctaacttcacaattaaaagaactagagaagcaagagcaaacacattcaaaagctagcagaaagcaagaaataactaagatcagagcagaactgaagtaaatagagacacaaaaatcccttcaaaaaatcaatgaatccaggagctggttttttgaaaagatcaacaaaattgatagactgctagcaaggctaataaagaagaacagagagaagaatcaaatagacacaataaaaaatgataaaggggatatcaccaccgatcccacagaaatacaaactaccatcagagaatacaataaacagagtatgtaattcttaaaagccctaggagttttggaatgagcgttggcttcaatttaaagtcaccaggtgcattcgccctaataaaagagtcagcttgtcctttggaaacaggcattgacttctcctctccagctatgaaagtcctagatggcatcttcttccaatagaaggctgttttgcttgcattgaaaatctgttgtttagtgtggtcaccttcatcaatgatcttagcaagatcttctggataacttgctgcagcttctatgtcatcacttgctgcttcaccttttttttaattttttttttgacgtttcactcttgttgcctaggctggagtgcaatgctgtgatctcagctcactgcaacctctgcctcccaggttcaagcaattctcctgtctcagccttctaagtagctgggatcataggcgtccaccactacttctggctaatttttggtattttcagtagagacggggtttcaccatgcctggtggccaggctggtttcaaactcctgacctcaggtgatctgcccgcctcggcctcccaaagcgctggaattacaggcatgagccaccacaccaggcccaccttgcatttttatgtgatggggacagctttttttccataagcctcatgaaccatcctctgctagcttcaaccttttcttctgcagcttcttcacctctttcagccttcattgtattgaagagagttagtgtcttgctctggattaggatttggcttaaggcagcatggctggtttgatcttctatccagaccacttacgctttctccatatcagcgataagcctatttcactttcctgttcatgtgttcactggaggagcacttttaactactttcaagaacttttcctttgcattcacaagttggctgtttggtgcaataggcctagctttcagcctgtcttggcttttgacatgccttctactaagcttgatcattttcagcttttgatttaaagtgacagatgtgtgactcctttcacttgaacacttagaggccattgtagggttattatggacctaattttaatattgttgtgtctcaaagaacagtgaggcttgagaagagggagagagatgggagaacagctggtcagtggagcagtcagaacatacgaaacctttatcaattaaatttgccatcttatatgggcatggtaccccaaacagttataatagtaacatcaaagatcaccgatcatatgtcatatgtcaccatacagacataacgatgaaaaagttgaaaatattgtgagaattaccaaaatttaacagagacaggaagcgagcacatgctcttgatacaattgcttgacacagggttatcacaaactttcaatttgtaaaaaatgcaatgtctgggaagtgcgataaaatgaggtatgcctttactgactttaattttagtaaatgacttcataaggaaaaggaaaaaatgtcattgtgagggcactgtgtttgttatagactagctaggtcatcaactgggtggttttgatactagcagagtcctccatgtgctaggacactgtttgaaattcttgttatagctttaaaagtcatggttttatcaactaactccctattagttactgtaattgaatttttatgttagcttccactagtagcaagtttttgagtcaagatggcccttgggttttattgccaaccctgacagcagaatcctagacagggtcgctttgctcttaaagcctctgatgtccagttgcaaagtgagtataattgcttctctctcagatctgtgttgaggagctcaagaaataacgaatgtggaagcactcagatcaattactttttttgtttgtttctaccttatctagtttcctaggtcaaaagtttgcttggctaatggaagaaaggagtcccaacctttccaagtgggacagattccctagctgtgctctgtatattgaatctgcttcttatcatttggctgtggtctgtgtgagtgctgaaaaggaggagataatttcacgcactagggaaatggaaaagactcctgcttggcaggcaccagggtggcaagagaatccaggatgtggccacgcacagcttaaagactacatttcccagctgcctttgcaggtgaatgccatcagtgagacctaattgagagtatagtctggggagtctgggaatgttgcctaagaaaggctgatttagttggtggtgcaactccctttttacctcccctctttctctctttctggaatgtggatatgatggcagaaccacagatgatcttgaatgaggaggtcacttgctgaggatggtgcaacagaaagatggaaggagctcaatccctgatgagcttgtggacctactgtatcagtcctggattactcactttctgtcttttatggagagaataaaccatcctctttttaagttgctcttccccctttgtttgtgatccctcttaccatagaccaaacttaattcctaatgaatagatctgccaaattgtttatatcagagatgacaacaggaacacatctgtttacattttcctttctcctgaagccccacctagtcccagagggtggtgtgtttcttcactgctattttgggcagaagctacccggctgtggtggttaaagtcagcactgctgttagcccttgtggggcctttgtgcaaattgaaaaaaggcattcatatcctaagacaccttcctgttctttgccagaaaaatgtctcaatgcaaattgacaatgtgtggacaggaatggaacatgcccttgagaagcagcccctgcacaggatgccactgctcagctttgggtcaatgtccaggccagtatctgacctcgaacttctctctaggtcttccacctttacttagcacaggcctcagaacagtccagccaggggtctaggagagaaagtggctgagactgtgtgagatggggatggggcagaggacggatagggtagagggtggattacagtgagtttctggctattgactgctttcacatgagcagctcatttctgtgccaaccatttgactagtaagttggcagaagccctgcctgttggtcacattctggcccatgctacaaggccacctggcaggctcaggctgcagcacggcaggctgtgtgcacacggctatctcccctagtctgtccccagagctgtctgtgcagtcctgagctcccatgtaagccaatgctacttttgtgtgaagaaggtggacgaaatcatcagcaactcttgcttatatagaatgtgacccaagcaatggaaagagaaaatccaggtcttggttttgtactggcttgcgagaagtccttcttttcctctctagcaatttccctacatccatccctgcctacccacattggattaaagggaagagagaaaaatgccctaagccccagagagaaaggtggcagaaccatgatattgctgctcttgactttgtaagatggccaacatcagcccagagaaatctgatctgaaatagaatgagctcacctgacttcgaaatttaccacatttgtcatgaggcagtcacttaacctaaaaagtaaacaggctcttactctgtcatagtttacatttgtgtgtgtgtgtccttttctgttttctttctttctttctctttctttctttcttttctttctttcttctttctttctttttagtagctttaacttgttctgcaaacaaagaatatgacagaacaatgtacgttcctttgaaatggcaccattaatcttgatagcaagtttctaattatgaaggatagagagctttggctgcttcatggaactgtgtcctggtgacttttttcagtccctttttcttgctttccctgtctccggtagcttccttgagagctgtggtttctcagtgttagatattcaaaagcacagcagcctacaggccatggctaaatcttctttacaaccagatgcatatgagatcttagcaggaagtaagaaaagtaaacgcattattaataaacacacttaaatgcatacaataaaatgaatgctgtttccttcaaagtaaccctcctttgcagatatagtctaaccaagcctctattgccctgcccagcatggatctgaaactctcctccgtaaattctctagaactctaggaccgccccttctaaatgcccaaaagaatcccaactgactgagggcaaagatgcaccttatttctggctccctttcgcttcaccacttgacttcaaatgacttcaggctgattccagaaagctaatacaccctcaaaggacaatgcaccttcatttagctcactcaggagagaggccacagtcttgaggggaggcactctccaaggcacagctcaaaaattgtttcaagcaatggaatcttcacgtgaatgggcacatggcctcccacagcaaggatgctcgttaatggggaagaatcactgaaaatccgaattcagatgtgtttcagaaagcagcttcaaagtgtgtgactgatcttcctagtcctgggaagagcagaattggcccttagaaccgttaagagtcagattgtgaaacagagagttcttgttccccatatgtttcactctaaatggaacatgaatcagagctgggagaggagcttccaacttctgtcaataataaaagccttcttatgagtcaagtgctttgtaaatactttgattggtagaggaaaaaggaattgcatattgaaagaactgtatttccattaaaatgcatgtgtgtaaagtaaagaagggcaggaaacattgagcccaagactttctgagtttgagtgaaccaacctgctggagtggtttctggccatcactttgtgctgccatgtctcagcctgtgctaagtccagaggatctggggttccgatatttgcaagaaaaagcaaggacaacaggtttgaagtcaagcaatgggagggtctcccagagacctggagcagggaggatgagtgccttagctgcttctgtctatccatcttccatctgtctggcaatcaggatattttctggggcccattcaatgcttctctgttggctgggggctcccatcagctgccaggggttccacctgttttcagtggtccatgtgcagtactcagagaaatgcctcctgagggaatgagtccagcgggtgagcgccttttaagaaatgcggtggctcacacctgtaatccagcactttgggaggccaaggcaggcagatcaccagaggtcaggagtttcaaaccagcctggtcaacatggtgaaaccccatctctactaaaaatacaaaaaatagctgggtgtggtggtgggcacctgtaatcccagctaatcaggaggctgaggtaggagaatcgcttgaacctgggaggcggaggctgcagtgacccaagattgtgccactgcacttcagcctgggcgacagagcgagactccatttcaaaaaacaaggagtatgaaaatgctttccagctctttgcagtagggcctgtctcatggggtgcagcctggaacttgcgcaggcccctacacagaaggacctgtgcttggcccaatgctctgctcctgctgtcttgtcatacttaatactttttttagcaagaggccctgaatgccatttgcattaggcaaattctatagctgatcctgatgaggctcttctgtatggggacctgcacaactgcaggactgcaccctatgacgcaggccctattgcaaatggctggaaagcgtttttgtatttcttaaagggtgttcactccctggattcagtcgcccccaaaataacgtcttgggtgtcttatttaggtggcacctgcttggtctgaaagagctcatgtgacttcaggaaatactgaatttgttctgagaaagcctcttgccctaaaaaaaagtgtatggggggagtgctcctagtctgtcatagttaaagttcaaaggttatttacagtgtgttgcatccactgtggtgactcctggcagatcctgaacttaagcagacgtgtgttacagatcttaatgagtgtgttgatgccgatgggagttgccctggatcacaccaagtgggtgatgggtgggtgagaggagagacattctttttgttaacccctcatttccacggtcagtctcagatggtcattacaaacctcttctaaatctggacctcaacaagcccccctcacaccagggacaaagtaagggtcatgcgatggcctctgagctgaccttcgagttcagagtggccgtgtgctggtgctgtgatcattaaactgactgctttgcaaggtcagcactcaaggctatagatttatatctctcttttattctaaaactagactatgccacaaccaggtgactgtggtgcctcactcaggtggtctgtcttctgcagttgaaggcaggtctttttcctccatccattcagattgaatccagggggtcctccctggaagacctgtgttccacagaagactcccctggagcttctcctctctgcacctcagctttcttgtgggtgcagcaggccacccaggcccagtccctgctcacgacaatgacttcagctttccagggtctttctcatgcattcccaaccattagactccccagtcctctctctattttttccccttatttagtaaatatttattgaagatccattacttgcacaaaagacagcaggccgcagggaaaggggtttatagtgggagatacgatgaaaagatgattaagattgcaagttctcaaaagtttagatgttgaagtattattttccaaagtgagttacacagggtattaatgggtaccgctcaaagaaagggttctagagtgaatatgaaacattggcttaaacaaagttaaacattttaaattactgcacagcttctcaaaagttttaatatgctaatgtgtcatctaacttcccaaaaggagaaacataatatattggacttcttaaaagtatttatgacattttttcttgcattgaactagtcccagatagaagacttagccttaaagggcaaaataaaaagatgagttctttttctttttaactgacaaataaaaattgtatacatttatggcttataatatgatgttttgcaatatgtatactttgtaggatggctaaactgagctactaacatgtgcatcacctcctatttttttgtgtggtgagaacacttaaaatctactctcagtgattctcaaaatacaatacattattaactatagtcagcatgttgtacaatagatctcttgaatttattcctcctgtctaactgaacttctgtatcctttcaccaatatctccccaaccttccccatacccctgactccagcgcctgctatcaccactctacgttctacttctgagtttgactttttataatagattccacatatgaatgagatcatgcagtatttgtcttccgtgcctggctcatttcacttagcataatgtcttcaaatgtcctcagggtctgcccctctttctgcctctgtgggggctccaagtgggaattcgtggttactgtaattggcagggggcggagatttggagctggaacctctagagtctgagctctaccatggaaaggccgtataatgctcagcaagtcatttaactctttggtgtctctgttttctcattgataaatgcaaagataatagtgcaccttcactgagcttcactgggttagccaggtaaaaagccttatggggcaatgcctggctctggcaggcttgaatgctggccgctggctctggttctcccatgtggaaacaaagcctacgtctcacacccagcagcaggagcagcggggtctcggcccagccagtgtgtcctgagtggcacagggtcagacataaccaggtccatgaacatttgtgtctttgtataaggtcagacttttattgatgcaatttcaatcataaaagccactagctgcatggagttcccaaggaggtgattttctttagtgctacctgtttacttggtagttaaagcctcaggcgcactttacaaatcagtcagtattgcaaacaagacatagtagtacacttaatcaatatacaattgctatagattaaaccttctacatcagtaaacattcataaagtaatatttaacattaagagaaagggggataggataaacgggttaatgaaccagtccaagagggtaacatgaacaaggagaatgtcctggtctgatctggatggacatcaacattttgtaagaaagagactatcgtggcagatgctgggtgctggtcatgagtaacagcaggatggggtctatgaagacggccatctggagctggtgaattcttcctctttttatagcccccgagtcctctggtgaggactgataaagtgaaccttatctgattgggtatagtcactgttgattagacaaacatctggctcctgttggcatgatgtcttttaaaaatgtaagatggagtctttttctaagatggagtcacttaggtcaaaggtcctgtgtccacaggggctgcccacatttcaccacaagttgccatgagactgcccaggaggacccgaatgcctggagtgctccagccatgctcatgccacggcttttgtccctctgcctgtctttggacacctctggtgtggagttggagatgaggaggagaggcttgcattcctatcagcagtgtggaatgagcagaggtgcgggtagactgaagctctgtgtttaacctctgtttacagaatatggacgctgagagagagtctggggtacttaaggaaaggcttgattggattgcagaaaacagtttctgaaacagactatttctgaagactcaaattttaattcttttgaatttatacagcaactcatctcacaaataattattaaatgataataacaataataatgatactcttcctcctcctattatcaccaaatagcatttactgggtgttggcaaaatgctgggcattggtcaggaatgctggacttgtatttccacttgacccttcaaaaatccttgtgatcaataaattactatgttatataattaaaatattaaaattattggaaattttatttaataatagcaataatatattagtgtaaatacttttctgaataatgaaatatacaataatatattatgcacaaacacaaatgtgttaagtaaacacatcagagcttgttgccagccatgatataatgtgtattatcatatgctataccgacatccccatttgacattggaggatatgagctctgggttgctaagtgacatttcccaggttacagctctctggaggaggcagctggactccaggaccccgtgtttcctgagacctccatagcctgcctcccgctttgctgtgctgcttctatgagaagataaagtaatttaatagcagctgtcgatatgcagggccacctctcaagtgcttgaaaatagttctcttaagcgggaaatactttttttttttcccaaaataatttattatgtttcaaaagtatttcctctaattgcagggaatccaaatcaagcgcttgcatttcttataaacaaacacctctgtatactttcccctgaccatggctgacttcaaaaccaggccggcctgcaccagagcctcagagccagagaccgccccaggcagaaccacagactatgcagggcacctctgttcacctctgcacccatctccctgaagtgccgggcttggcttcccggcaacatccttcatttcaacagctaaatacgcggtcaacaatgggttggtgaaaatgggggcgcccaggagccattccatgccttcagatggggtccgggctcactgtgcaatgcatcatttcacacaggttaaaaggaaaagcagttgccagtgcctgttgttcatttaaggagattaaaatgatagaaaaagaggattttgcatttagacagtgagcagtggaatttaaaaagcagtgccagaaatcatttagtatgtgttacattctattcttttttttttttttccagacagagtctcactctgtcatccaggctggagtgcagtggcatcatcttggctcactgcaacctctgcctccctcaagttcaagtgattctcctgcctaagcctcccgagtagctgggattacaggcacccgtcaccaagcccagctaatttttgtatttttactagagacgaggtttcgccgtttggccaggctggtcttgaactcctgacctcaggtgatccgcctgcctcggcctcccaaagtgctgggattataggcgtgagccactgtgcctggccttagtatgtgttacattaaaaaaatcactccataaagatgtacaattattatgtattaataaaaaatgaaaataaaaagaccgtgtaaactgccacgtattcccactggagagctggtgagtctctccgtggatcgtaccattaccacaagagtcctctggcccacgcacaccctgctctgcccatcagcagtgctccccctcctctccgccattggcttctcatatcctcctgggctgatgtgcccatgctgtgtactcaacactgcctctggctggtgcaagcctggaagggaggtagacggtatggatggctaagcaggcgagctgggctggctgtggcctcggctgtctatcacgctgctacccagcctcggattcaggtcgaacttgcctgcactttctgaacacctagaaagatgcagcccgggcccagacagttcacttctcactcagcaaatgggaaaaaaaaatggagaaggcgctgcgtcctttgaggctcctgccctccagccaccttatctactgtgtctctctgggctcaaatggcgctttcctccagggctctcttggcgtctcatccctctacctccacagggtgtggtaccttcctttgttcctgtggttcccactgcacagctggatctctgttctcactgcctgaaattaacattcctgttcccgtttctcttgccttcctgacttccaggaggtggtggcagttactcagctctgcttccacaccctcgccatgtcttcctcaatagactcaaccctttgtcctgctagttgctagtactcaggtcacaggcagtggaactcgtcttcggcatttagtaagagatggcctttctgactttgtgccccagccacggtgcagtcttctggatctttcccagcagcgtcgacaccgtgagtgctgcctgtgcacgcattcgttgcattcttgctccagatggcagtctgaccagcacgactcaactcccctcccctcctgtccctttctagtaaaattgcctgtatgttaccccaacctctgctgactcacaggtgactgctgtcctgatttttaaccccgcagaataattttgtctgtttttgagattcacataaatggaattgtatagtacacactatttggtgcctagtggcttgaatttagtacagtgttttagaaacacatccctgctgttttgtctgtcagtagtttatttgtttgctgggtgatgttccattgtataattatcctataatttctttattcattctcctgttgttgtgcccttgtttatttccagtttttggctactgtgggagacagcatgtgtagcagtggcgctagctaggcttggacattagtctctctccagaacttgggacaggccattaaggacaggactggtgaatgtgacccagagcttgctgaccctcagctgcctgggacagcagtggcagtctgaccctgggggagtcagaggagggccacgtggtgaccgttacaccccaggagatacggactcaatgagcaaacccctgtggacaggggtcaaggaatctccctcctaaggaaatacagggttttgtgattttctttggttcaatgtcaagagaatcaagttgtgggaaatgctggaaccctcctcaactcagtgcactgagtccctgaatgctcactaaaggagacaggaaaggtggagtgcaggcctgcacagcagctactgggctctggatcagggagggcatcgtacaatatccaaggagagagcaacggaaggaaacaccagttaattcatttaaatctcacaataacatgtcatctctatttcatagatttgaaagctgaggttcagatatgttaaataatttgtccaggggtagcagctagtgtcagagccgcttcttaataactggccacagaactagataattctccaaagataaaatgcaaactaagtgactagtagaaaacattgattatatattagttttatgccaaatgctattcttgccagggtattacagttaaaaagacagacagaaattcttgccttgatggtgccccaggatgagatgaatgatgaacaaagtgaacacatagagtattctagaaggtggtctatggagaaaaataaaacagagaagaaacaggggttgtggtttcaggggtatttgcaagagtaaatatcttgaccaggaaaagcctatgagaaagtggcatttgaggacagacttgaaagagatgagagcatgaccctggggtgggattgagcattaaaggtgaggaaatggccgtgcaaaggccctgtgacagcagtgtgccaaggctgagaaaatgcagagagggcagggtgacttaagtgactgagtgagggggagtcataggagctggcgtcagaggggggtttctggggatgagctcaggtggacctcacaggccatggtgaggaatgactctttgctgagtaaggtgggaaaccatggagggtttggaacaggggagtcacatgccctgagttgcgtttaacaggatcgctctggctgcccagttgacaacagataattgtgggacagaaacatgaagacccttaggacattattgcaataattcaagcaataattcagatggtgactttgaccagagtggctgttccacacgtggtgaaaagtggtcacaataaggttcaattgggaaagtgggacccaaagatttgctcacggataggatgagggatgtgaaagaattgattctgactccaaggatggtgacattgctattcaccgaggtggggcaggtgacaggaaagcagctttgcagggaagaacaggaactcatttttggatacttcacactgggaaatgccaaggaaagctgttagacagctggatatctgcatgtggagttgagggaggggtccagctcggaaatataagcatgggcgtcatcagcgtacagactgtatttcaaacatgagagtggatggggttatctagggagtgcctctgacattctgaggttgggctagacccaggggaggagacagtagaggggcatccagtgaggggagaggaaagcaggaaagcagcggtggactggagggggtgtctggctgtgtcacagcagctcttaggtcaggtgatctgggggcttggcaatttggagctcatttgagggagattttgcagcaaaagcctgagtgggttgggttcaagagaattggggactgtggacacagacaactgcaaagggttgggtggagaggatgtaggccaaaagaggctctgtccagcctgaccaacatggagaaaccccatctctactaaaaatacaaaattagccgggagtggatgtgcatgcatgtaatcccagctactcaggtggctgaggcaggagaatcttttgaacccgggggtgcggaggttgcagtgagccgagattgtgccattgcactccagcctgggcaacaagaacgaaactccgtctcaaaaaaaaaaaaaaaaaaaaagggaaagaaaagaggcttcttctaactctttttcatggcagatttcaaacatatacaaacacaggatgaaagaacaaaatgcttgtgtctccaccacccacttcaacaatgatcttgaccaatcctgctccatctataccattccttcccttgcaaaccccaaacatgtatattaaattaattgatattgccccacctgcaaaccccaaacatgtatattaaattaattgatattgctccacagctcactgaggccccacagctcactgagaccctgtaaaagttttttgtttttttttttttttgagttcttctcccctctatgcttcatttgggataggtgccatggggctgccttctagtttgctgatcttttcttctccagcatctaatgtaccattcatcttatccagtgaactttccatttctgatattttacttttcatttctagaatttcatttgtttggtttttgtatcttccatttctttgcttgtcatgtttatgccttcctttttggtggctcacgcctgtaatcccagcactttgggaggccgaagcgggtgaatcatctgtggtcaggagttcgagaccagcctggccaacatggtgaaaccccttttctaccaaaaatacaaaaaattagctgggcgtggtagtgcatgcctgtaatcccagctacttgggaggctgaggcaggagaatgacttgaacctggtaggcagaggttgcagtgagctgagatcgtaccattgcactctggcttggacaacaagagcaaagctccacctcaaaaaagaaaaaaaaaaaggaaaaagaaaatatttgtaagattaaaaataactgttttaagattcttatcagatagtttcatcatcattgtaatttctattgactatcttttttaaaaatccagtttatgggttatggttttcttgcttctttgtatgcctggcagttttttattagatgctctatatagcgcacttttcattgttgagggctagattttgttgcatttccataaagagtgttggattttcttttggaacacacttaagttgcttgggatcaggttgaccacttcaaagcttacttttatgttttatggcaggcccagagcagcatttagtttgggactaatttagccctactgcagcaatgtccacaactagggcatggcatggatggagtggcccatgcagagtagggaggggcaaggcacgttcaagagctgagaggccattataggaaagatcatcttgtgactattaaagtggccaaggtactaaatctgtttgtccttccttccttccttccttccttcgtccttccttctttccttccctccctccttccctccttcctttcttccctccttccctccttcctccctcccttccttccctccctccctccttccctccttccttcattccttccctcccttcctttctttcctccctccttccctccctccattcttccctccttccctccctccctccctctctccttccctccctccctcccttccttccttccttccctccttcctatctccttccctccctccttctttccttccttcctttctgaaagttgggaaaataaagaactaaattccgtgcatgatcctagattggatcctgaattgggggtgaggtcctataaaagatattattagaacaatttgatgaaatttaaatttgtacagtatattaaataataatacataaataataaatttcctgaattgggccaggtgtggtcgctcatgcctgtaatctcagcactttgggaagctgaggcaagtggatcacttgaggccaggagtttgagaccaggctggccaacatggtgaaccccatctctactaaaaatacaacaattagccaggcatggtggcgggtgcctgtaatcccagctatttgggaggctgaggcactaagaattgcttgaacccaggagacagaggttgcagtgagcagagatcatgccactgcactccagcctgaatgacagagtgagactctgtctcaaaaataaaaaaaaaaaccataaaaatgaataaattttccaaatttgatcagtgtattgtgattatataagcgaattccttgttcttaggaagtacatatgctgaagtattgagatgcaaagggtcaatttactctcaaatggttcaacgacataaagagagaaaaaagaaaaaagagaaagagcacaaatgtgataaaatgtgaacaaagaatgaatcattgttgtactataattcccgggatcccaggaatatgtactcactaggacagtcatttgtcacgttgcttaggaagcaggtttggagtcttgtgtggggaattcgtcgacaccaccagtcccgagtttatgtgcagtggaaaatggagcagtgtggtcagcagtaggagagccagcttccaccctccacctgctgttccacgtggtgggtctgcacagcctggcttgtgagcaaatccatttttccttctctttgggaccaacatgggcttagagatgacatagccttgggcatccaataaattcaaatttgagaatctcaatgattcaaaattgctgctgtcaattaatacatgatgaattcatgttgttttgaaaaaagaatgattgaggtgaccaacagaagacttcaatgtttgtccccaagtaggtaggccaccccagatttccaaccctgggtgcattgcattggcaatctaaatcccaaggactgtgaactctgtggtcattctgcagtttcctctgagagtattcatgggttggggaatctcctgctgaaaaggatattgggtaaaattgctttatgtgagcactagtaaacatttagcatatattaccaagaaaagcaacactgtaagcccaggaagcttagagcttctcaaacagaaggggatgatggagaaaaaaggtgaaaagtctggcaggcaggatgaaggtcaatcaaaaaagggcagctggccacagggaaatatcatttcacccctactagcgtgactgaaaaaaatgtatgttggtgaggatatagagacattgctgatgtcattttaaaatggcatagctactttggaaaacagtctagcaattccttgaaaagttaaatgtagagtttccatatgacccagcaattccactcctaggtatatactcaagtgaaataaaaacacatgcccccgcaaaaacaaaacttgtacacgaatgttcattgcagcatttttcatgatagcccaaagtggaaacaacccaagtgtctacaaactgatgaacgaataaataaaatgcggcatattcataccaagaactatcctttggcaagacaaagaaatgaaatactgataaatgggacaattggggtaagctttgaaaatgtgctgagtgaaaaaaagccagacacaaaaggccacatattgtatgactctgtttatctgaaacatccagaacaggcaaatctgtagagacagaaagtagattagttgtggcagggctagaaggagagggatttagggagtgatgacttatgggtgtggtgttttctttttggggtggtgaaaatgttctgaaattagatagtagtgatggttgtacaactctgtgaatatactgaaactaactgaattgtacgttctagaaggatgaattttatggcatatgcatggcacctaaaaaaaccaaaagagggcagctgtgtatcctgggtttttccttgcttcttgtatgtgtgtttctgcagtccggttgagcagctatgcctcaaccctcgggtctatcctggtcttgaatgttcctgactgttgtcttcagtcttggaaccacacagcaccacagcacagcctgcaagccttcctgggaagatttacacctctaggctgagtctctgctactgcactttctcctccctctcaaatgaaaccgcagtgcctctctgtgtgaccttctcagtcatgcaatgacttctctttcatttcctataagcctctgagctctgccttctccttgccaattccccttagctccatcttcctttggccgtccgccgttgtgtaaatctgtagggaaatgtcattcaaagacaaaacccactgcttattcttctttcttaattgctccttgggaaatgtttgcttctgtgttcttggtgaaggaaagcttaattttgtctgcttttatatcactagtcttttcagattacacattcccaatcaatcacctcttgaatcaagtaattagttttattgtatcagtctatccttcagaatttcattatgcaaatataaacatgcataaatacattcatgtttccccgccttttacacaaaaggaggcacactgttttgtgccttgctttcgtttcacttactatgtctgagaacttttcacatcattatatggagagcttcccctttctttatcagctgtgtgagagtccagtgtcaagatggactgtgtttggtttcatcagtctctgtggaaggatcctggctgacctgtgtcttttgcttttacaaaccttgctggatgatctcacaatcaccttgttgcatgcacacgtaggcagagctgtagaatagactcccagtggggcagttgctgggcaaagggtaaatctctttataattttggcacatattgccagagtgccttctacagggttctatcaactgctgggcactcctgtcagcagtaagagtggctgcttctcccagcctttccagtaaaatatgttaccaacatttgaagccaggtgcagttgctcatgcctgtaatcccagcaactttgttactaacatttgggatttccgcaatggtgtgtgctaataaatgtttaacaaccacttctccaaacaaaacgaaacaaaacaaaacccaaaaccaaaaaaacaagaagccctaattgtagtatctgctgatttccatagcataaatacttctacccaggccaattgcaagctatcaacatgatgtccctgaacacggagttgggaagagatgggccgtagcacccactgtatagtatttctaccacacagatgcaagagatgcaagtagcatggataattgtgaaatgtggtaaaataataaggaatttaagagtttttatttcctttgtatttgtatgatttatttagttataaatttatataattaaatcttagcaacaatctgcatttaacaacctactcataaaaccagctcctaaaaatctggtaattattcatggtcaactgtcaagagtcagctccagcacactactgcaatgctgccaatttgaaaggtagcgaatgccatcccaatgtagttgtcatttttattgttattgttttacttgtttaaggacgatttgcatttccttttctgtgaaatatgtttctgtccttcgcacatttatctactgagttttattctcttgttgatttctaggagatccttatacatgaagctccttctgcatatcttttgtctgtgttataaactgcagtgttttttcccggtttgttatttatcttttgtgcttgcccatggcatttttctttttttctttttctttttttgccatgaagttgttgttgttattgtttcaaaatatagttgaattatttttttcattttttctggtttttttttttttttttttgacacggagtctcattctgtcacccagactggagtgcagtggcatgctatctcggcttaccacaacctccacctcccaggttcaagcgattctcctgcctcagcctcccgagtagctgggattacaggtgtgtgccaccatgcccagcttattttttttttgttttgtatttttagtagagatgggggtttcaccatgttggccaggctggtctcgaactcctgacctcaagtgattttcctgccttgacctcccaaagtgctgggattacaggtgtgagccactgtgcccagcccattttttcttttatggcgtccaaatgttgaataactaggaacaacaggattaaatacattttttttctaatcacaatcaagtttcacatacttaagcaagtttcttatactctaagcagtctgtacaattcctgtatctccttggagttcattatattcaattttgtctttttcttttgagtcagattattatttaaaaaccctctctacttaatggtatcacaaatatgcataatatgttagagacaggcctggcacacttcagctaaaaagaagtatgcatagaggttataaaatatttatcaagataccatcactagttcagtggtggctaaccccaccacttttctgtgactagtattatttcctactggggagtttcttcacttgtgtttgacttcccatgtgggcattgtcttagtaattttgtgttgctgtaacagaatagcacagactaggtaatttataatgaatagatatttgtttgacttatggttctggaggctgggaagtccaatattgaggtactgcatcagataagggaagctctcatatggcaagaaagtttacaggggagagaaagagagggctgaccttgcttttataacaaatccactctcaaggtaaagaatccactccctcaacaatgacattaatccattcccgatggcagagccctcatgaaataataattgcttaaagatcctatttctcaacacagttgcactgggaaacaagttcccaatgcatgaactttggggaacacattcaaagcatagtaggcatgtactggcttagtcctgcattgctctctccatcagacttcaaggcccaaagctctaagaatgatgctggagtgtggtttgtgttcaagaaatattagttgagacaccacattcaaaggtatgaacccctcagatagactttcatctgcatctccaccatccctgacaatgcccattaacatttagtcagcagccacacatttccagcattacttgagaagctgtgcatgtggtctatgtggtgtagcctcagaatacggtcatgcagaaagttctaactcagtgtatctaaaagccacttgaccacttagagtgagcttttatttctagcatctcatttttggttctgactttagaaatgtgaaaaccagatctcaggtatgatatgtaatttacccaaagttacctcattgctactttggcttttagtagtgcgtctggcacatagtaagtcctcaataaaatgaagagcatttgagatgacatgattttcccatttcccagtccagggctcatgtcactgtcctattacaggtatgacccaagatggtggtggctggatagtttccttccaaggtactctttaaggggtagacatgaaaggcagtgatcactcatgccaacaccctatgcttgtaacctgatctccccctggctggtaggccttattctgtcaagatttacccttagaaaagcatatgataagtataacaactacaaaatattgagggcatattatataccagttaatgtgctatgtgtccaatcctcatccaaccctgtctggtgttaatattattactgtcattttataggggtgcagagaggttataggactagtccaagaccagacagaggcaacagtagagccaggtggaaattcaggtctgtcatggtcacaatgctctttgtccgtggggcatggagttgcccaatatattattgttttacagtctttagacacagtgtcttcgcttgacaggaggcacgttcctttatgttgtaggaaatgcactgaacctgaataactctacaggagagctctcatccccccttccaggtcgtccctgctctcagcctgcacctcccattttttgatcaagacagccttgaagttctttatgtctgtggaaggaaggagacggagcttgtttttcacttttgctgccatgattaattatttttaggaaagcattgtgtcttttgagagaggattgtaagtgctgggagaataaatggatcttagagtgagccttgtgtgctccagacttccccagcttgataaacagcttcctgaccagtggctgccagtccctggtctcactggacggacattggctgggggccaatgtctgagttgaatggcgaggactggacagtgcttcttcccagccagtgtggcaatgagcccactcttaagaaggcgccttggcttgggaaaacacattgcacattagatgttggtatccgcggcagggacctgaggctggagtcactgccaggcaccttctgggaggcctggctttccagcaaggcctgcttcacattctcaggagaaccagacccagcataggaaatgccctattgcccaagaggaaaccccatgtcgaggaactgatataattaggatactgataaaaattagaatgagaaggggagggcctaaatgaagggtcatggggtgtactttttaaaaaaaacaaacaaacaaacaaaaaaaacaaaccttcctgcccttctctgcatatgaatatactacatgcttatccaagaaaactttgaaaagtaaataaaaatttcttccaataatttcacccagaaatttaacttctactatttttaaaggagtgtcttttgtatgccaaacttctcctatttttaaataatatatcatgaaaatcattttattttgtaaattggacctcaggtgtatgaaactgggttaattgtgacctatgattcatagtgcatgtattagtccattttcatgctgctgataaagtcatacctgagactgggaagaaaaagaggtttaattggacttacagttccacatggctgggaaggcctcagaatcatggggggaggcaaaaggcacttcttacatggtggcagcaaaagaaaatgaggaaaaagcaaaagtggaagcccctgataaacccatcagatctcatgagacttattaactatcacgagaatagcatgggaaagaccggctcccatgattcaaatacctccctgctaggtccctccctcagcatgtgggaattctagaagatacaattcaagttgagatttgggtggggacacagccaaactgtatcattctgcccctggcccctcccaaatctcatgtcctcacatttcaaaatgaatcatgccttcccaacagctccccaaagtcttaactcatttcagcattaacccaaaggccacagatcaaagtctcatctgagacaaggcaagtcccttctgcctataagcctgtaaaatcaaaagcaagctagttacttcctagatacaatgggggtacaggtatctatgaaatgggagaaattggccaaaacaaaggggttacagggcccatgcaagcctgaaatccagttgggcagtcaaattctaaagctccaaaatgatcttctttgactccaggtctcacatccaggttatgctgatgcaagaggtgggttcccatggttttgggcagctccgccctgtgattttgcaaggtacagcctccctccaggctactttcacaggcttccattgagtatctgcagcttttccaggtgcatggtgccagctgtcagtggatctaccattctggggtctggaggacggtgaccctcttctcagagctccactaggcagtgctccagtaaagactctgtgtgggggatccagtcccacatttcccttctgcactgccctagcagaggttctccatgagcgccctgccactgcagcaaacttttgcctgaggatgcaggcatttccatacatcttaaagatctaggtggaggttcccaaacctcaattcttgacttctgtgcacccacaggctaaacaccacatggaaactgccaaggtttgggacttccaccctctgaagtcacagcccgagctgtatcttggcccctttcagccatggctggagtggctaggacacagtgcaccaagtccttaggctgcacacagcacagggaccctgggcccagcccaagaaaccactttttcctcctgggcctccaggcctgtgatggcaagaggggctgccatgaaggtgtctgacatggcctggagacattttccccaaggtcttggggattaacattaggcttcttgccgcttatgcaaatttctgcaggtggcttgaatttctccccagaaaatggatttttcttttctattgcacagtcaggctgcaaattttccaaacttttatgctgtgcttcgtttataaagctgaatgcctttaacagcaccaaagtcacctgctgaatgctttgctgcttaaaaatttcttctgccagataccctaaatcatctttgtcaggttcaaagttccacaaatctctaaggcggggcaaaatgccaccagtttctttgctaaaacacaacaagaatcacatttactccagttcccaaaaagttcctcatctctacctgagaccacctcagtctggaccttattgtccatatcactatcagcattttgggcaaagccattcaacaagctctaggaagttccaaactttcccacacattcctgtcttcttctgagccctccaaactattccaacctctgcctgttacccagttctaaagttgctcccacattttggggtgccttttcagcaatgccccactctactggtaccaatttactgtattagtccattttcacactgctgataaagacatacctgagactgggaagaaaaaaaggtttaattggacttacaattccacatggcttgggaggcctcagaatcaaggcaaaatgcacttcttacatggcagcggcaagagaaaatgaggaagatacaaaagcagaagctcctgagaaacctgtcagatcttgtgagacttactatcatgagaatagcatgggaaagaccagcccccatgattcaattacctccccctggggtccctcccacaacaagtgggaattctgggagagagaattcaagttgagatttgggtggggacacagccaaaccatatcagtgcactctcttcatttgaccatgcaatgcatgtttttaataataaacatctccatccaatatgaaaactcatactgtaactgtgatttataaaacctttggcccaatctttttcctacaactacacttctctttatctaccttttatttttactttttgcttacttgagcacatgctatacatgcccctttttatgcctctcaggaggtttacagtggtggaatttcatcactcagatagctttccactccacgccctttggatcccaaaatggactgcccatttatctctttctgtgtgaaggaagtcagggttaggagagtcatctgtatatgcctcctcgtttatctctgattctttagcaaaaccaccctgaaacccaggcagatgtcaagtcagcttgtccttgagggtctctgctaaaggagaggccccagtggccactgcagcctccataaatcgctgtggtcaagcatgcatcttgccatcagaccaaccaccacctgatatgtgaaattcacatttgttaattatttgctagaaatctaagaagctgttatttattgtcatgtagttgaaagcctctttccgcctcctccagaattcacttttctttctatctttcctctgatcattgtttttatcctttgactgttcttttgtagttcttttctttattcctgaatttatttaagttgcagatgaggattttggctatgtccacaccccagacttcaccaggaaggtaacttagggttccccaaaatccaaccaaactgttctcaaatgcaggaggagaactctccccttcccctctacccctgccccctcatttcttctcttacaggctttcctagctcttttccaccccatgccccttctgtctctccttccatcctggggtttgtggtagaggattacccagttgcggacgagtcacatgccttatccagtgaaaatattattgtcttatggatgccaagaacaactcctgaatgtacaaactatttttaatgctcatttgagattgatagatatcaggcaaataataaaagtttcacaagattgctacaaataaataattttgaaaacaaaaccaaccaaagcaaaaaacaaacaaacaaaaacaaccttttctgttgtgattagcatttttgctaaactcaccttgggcttttgactttccagacactctcattgcaggtgtttggagctcagttctgttcctccaggcttgtgcgctctccttgaccccaccttttgtgcgtgtgctgtccttgtctgaaaccagcctggagctccctatacagatgtgtcaaggtcaggccaggtcaaggctgagcacagagaaaggagctgctgtaggaggcccacaaggaattttgttggatctgtgagatcagtgtatgctccagcccctctgacatatccagaggagacagccttgagtttgggcccagtactgccacttattagctgtgtaaacttgaaaaagtcaattaattttgcataagtctagtgcaataagtaagagtcttcaagtcatcaccctgttgtgatggattacatgagatcaagcatgtaatgtgtcaccatgataactggcaaaaataagtgcttagtaaatgctgaccattcttcttcttaacaacatcatcatcatcatcatcatcatcatcatcatcaacaacaacaacactaggtgcaagcgccagccccggccaaggccaataggccctgtgtaggttgcgggctacctactcagtctggatgctggtttcctgttctcctgctcctgtctttgctcttgacctgttttcttcttgcctctgcaatggactctgctgctggttgtgccatctcctcaaggttggacccttggaagctgacgtatagctggtaccttccagctacctcttcaacacccctgcatagcttgaactcaggtgacctgctctgctccaggctccgagtcccccaggtgcattttcctgtccttgttcccaccatgggctcagacagtgagtgccttgaaggcaggaatagggggtcctcaacccattccctggcccctgacaagcagctggctgcaggatgtcctccactacttgttagtcaaatgcatgaaacattggatgaaggcaagaaggtgagatagccaggtgtggtggctcactcgtgtaatctcaacactttgtgaggctgaggcaggtggattgcttgagcccaggagtttgagaccagcctcggcaatgtggcaaaaccctgtctctacaaaaaaaatttaaaaattagccaggcatagtggtgtatgcctatagtcccagctacttgggaggctgaggttgggggattgcttgagcctgggaagcagaggttacggtgagctgagatctcaccactgctcttcagcctgggcgacaaaaaagagaatgtctcaataaataaataaataaataaataaattagttaattaattaataaaggagagataggaaccttctcctttgttgaatccaagtttagtaggatgttcctttcttttctctctctttctttttctctctttctctctctctctttctttcctttctttctttctttctccttccttccttccttccttccttccttccttccttccttccttccttttttctttctttcttgacaagatctcaccctatcatccaggctggagtacagtggtacaatcatagctcactgcagccttcagctcttgagcttaaactatcctcccacctcagctttccaagtacctgggactctaggagcaagtcaccatgcctggtggatgttcttttctattgaaagtctagagtaattcatggccaatacttaattttagcagctttgttccttttgaatgagccctcaagccaaaaacatatccatcttttaacagtttcatttatttcctttgaaatcacttcaactggattcaatgcaatgcatttgaacagatgtttacacagtgtgttgggcattgttatgggcacatgactgagaagagaatggtcaagtttcctgccctggacagaactaaaattttaccaggaagagagatgctgagcacctaactaataaatacacagggtaatttcatttttataagagtttccaaagcaattaccatcaccaccaaagaatcagggtagattactgggtctcgacaagtgtgtgtgtgtgtgcgcacacgtgcgtgcgcatgcatgtgtgtgtcttggggaagagataaggcctgaataaggagggacagctgtcctgtggagatctggagaagattattgtagtagaggaatggcaagttcaaaggcctggaagtggtagcagagtcattgtgtttcaggggcagaaaggaggccagcgtgcctgggtgccaagggaaggaggtgagggtgaggaggcggacaggcatctcaagtgcatggagagccacctcttcttgggtccccagtccagggcactttctttggacccaggatgtaggtactgacagctgccatgaatctcggagttgtcagcattcacagcaaagggcatttccaggctaaaatctaagtaaacaagctccagaacaaagaagacaccatgttcaaagtgtgtgaaaatggataacaaataggaaacatttaaaaacaagcactttgtggaaaaccatgtttccttgatgtgctttctgtcatggtatctgaaacactgcaaaaggacattgaagatctgggagggagagttgacaatcttcccaaataagatacagttatcttatttcaaataaaaaggaagcaaaattggcacaagtttgggtcaaatttctcctgtgccaagtctagaatcagcaggtagtgctgaaatcactgtcccacatcccagacatagtgagcattcttttaaggctccaggctcaagtgtgtgcaaacagagggaaattacacttgaaaaaaaagatcaaggaccgtgaattagatacaaccttggacaacaaaagcagcaaccatgaaaggttgtatgtacttaagaagtcaaacacttctgggaaagctgtggggaagagagttggtatatgggaaaaaagtggtaaactcaaaacgccttttgtatggagaaaggcattggccagctttaaaggcactgcagcatcagttgagcaagtgcttttaataaattactctcttttgtagctctgtactttttctgatatggataagctatctagcatccaaagcaaactcatcttaaaccaagaattcaaacaaatgataataaagatggtagaatgcctattccactccatttgaaagagatgcacaaaagaaaatggtaggtgttgcttgcaggagtgtgataatagtgttgctcttctaaactggcaactttatgagtagatcatcaaagccaaggtattttactttgtggaataagaaacgatcacaccgaaaataataaaattcagcactgcaggttttctgccctttataaatgtttttcaaagacggaaccgaaagaatagcttgagtgataacaagcttttcagaaggagctctggaaattaatatgggacaggtgatggagcaagactttcagcatgaagaagcccaggaactgggaaaacacaagtctttacttcagaatcaccccatagcctccaagtagtgtgttgcaggttgaatctagctgaaaatggcataaaacagaatattaatagctatatccacatatcactaaactaggtacattcttgatgttcctgaatataaggagattataaattaaaatgattctgaaaaactacagacattgatgcaagtttctagtttcaaccaggataatatcacatctcacctcaaacaaaaggcattttcttcagaaaggaactaaaaaaaaatggcctttattctatacttgcttatggttctggtttaaaaacaaaaacaggttccagaagactacttattcaaagaccctgccccacattcctcttgaggatcccagtgaatgtggcactgataatatgaatggtttaccttccgtgagattgcattgaggggggaaatattcttagaaataaaatttttaaaaagaaaatatgatgtaaattgaccaaggggtttaaaaaatctgtcaatctcatatcctatacctagcaaaaatatccttcagaaatgaatggaaaattaagacattctcagatagaagaaaaataagaaatttgtcaccagcattaaagaatgactaaagggatgtctctaaacagaaagtgaataataacaaagggaggctggaacttcaggaaggaaacaaaacaatgcaatggttaaaaattctcctcaagtgtttaaaaaattgtgttgaagcaaaaaaatataacatcatctggtgagatgttcagtgtctgtagtggaaatatttatttaacatatttgtattttaagggggagggtaaacagacctaaataaaagtcagatttctatacttcacttgaagaggtaaaatgctgatacagttagctatgacatattatgtatatatattgtaatatctagggaaattagtaaaaaactatatgatgaagagatatattaaaaatgtactatagatatgaatatatgtgtgggttagtatacatacatagttttccttactctgtcacctgagagaacaaagaagcaatgacaaccctctagcaattagcacaccggacacacagatcttggtttctaacaccattcaccaataaaacaaatcagggctccttggagaaatggctgattccaggccttgggggaaaaatatatgagatgaacctggagcattttgtagcaccagaatgtaaggaaatgtgtgtgtgtgtgtgtgtgtgtgtgtgtgtgtgtgtgtgaagagacacaggagccaaccaaaagagctctcaatggccaaacttggaataattggagcaagaaaataataaagtagtaatgtattatcacccaaaataaatatccatgagtccatagtgatataagtaaatacttgaataaataaatggggggaaaaaagacaactctctcttatgaagaactggaaatagttaatacagatactacaacctgaaggaggagaagtgtaagttcctggtccttaggtatgggcctacatagtgattttcttccaaagagtgtagaatagatagggggtgggggaaagtagatttacactggagacacctgccaagcactacttcagccaggtgatcatggtcaacacctgctgtgataaatcgtggtgtgagtatgtaccctggatatgatgtgatgaaaatgacacttcactgctttacccattacccttgtcgaatcatgaaaaaagcctcaggtgaatttcaataagggggtatcatagaatacattgaatataggataatacctaaccaggactcttcaaaattgtcaaggtcctaaaaatcaggaaaagtttgagaaactgtcacaaccaagaggagcctgaggagatgtgatgactaaacacagtaagtatcctggatgggaccctggaccataggaagatgttaggtaaaactaaggaaatctaaataagatatagactttggttaataataatgtatcaatattggctcattaattgaaacagtcgtgctaattaatataagatgttaataagatgggacactgagtgaggatgtatatgggaactttctgttctaccatctcattttttttaaacttataaaaaataaagtctattaaaacattatagcactttgggaggctgaggtgggtggatcatctgaggtcaagagtttgagatcagcctagccaacatggcgaaatgctgtctctactaaaaaaacaaaaattagctgggcatggtggcaagtgcctataatcacagctactcgggaggctgaggcaggagaatcacttgaatttggcgggatggaggttgcagtgaggtgagatcatgccacttcactccggcatgggggaaagagcgaaactccgttaaaaaaaaatcatgagtttaaacataaaacataaaaatatataatgtttagaaagaattcacaggagaaaatctttgggacctaaggctagacagaattcttagacatggcaccagcagcactatccataaagagagaagaaaaagtcaatatactatacttcgttgtaattaaaaacttttgtggtgtaaaagactcggtgaagaggatgaaaagacaaactgcagactgggagaaattattttcaaatccatatcttttttttgtttttttgagatggagtcttgctctgttgccaggctggagtgcattggcgcgatctcagctcactgcaacctccagctcccgggttcaagcgattctcctgccttagcctccagagtagctgggactccaggcccagctaatttttgtatttttagtagagacagggttttaccatgttggccaggatggtctcgatctcttgacctcgtgatccacctgcctcggcctcccaaagtactgggattccaggcgtaagccaccgtgcccggcctcaaatccatgtcttacaaagaccttatatctacaatacacaaaaatgtatcaaattcaacagtaaaaagacaagaagaaaaatgaagaatcccatcagaaaatgaggggaaaatatgcccatgaatttcaccaaaaagactatacagatggtaaagaagtgcaggaaaggatgttcgatatcactagcctttagggaaatgcacattaaaaccaccgtgagatattactacacacctatcagagttgctaaaattgaaaacaaattataacacaaaatgctggcaagtatgtggagaaactggatcacacctacattgctgggtagaacaaaaaatattatagtcattcagataacagtttggcagtttctttaaaaactaaatatgaaattgctgtttgacctggaaattgcattcctgtgcatttattgcggagaaatgaaaatgtatgttcacacaaaaacctgtacaagaatgtttatagcagctctattcataatagctaaaaactgaaaagatgcaagatgtcctttagtgggttaaaccatccacatcatggaatactactcagcaataaaaaggaaccaactattgatacacacaaaaccctggttaatcttgagaattacattaagtgaaaaaaagccagtcctcaaaagttacatactatgttactctatttatacaacattttaaaaaggacaaagttacaggaatgaagaacagattagtggttggtgggacagcagtgaagtggggtggttgcaaaagggccacatgagggatgcttgtggggatggaattgtttcatagcttgactttctttttgtttgtttgtttgttttttttagacggacggagtcttgctctgtcacccaggctggagtgcagtagtgcaatctcagctcactgcaacctccacctcccaggttcaagtgattctcctgccttaggcctcccgagtagctgggattacaggtgccactaccacgcctggctaatttgttgtatttttagtagagacggagttttaccatgttggccaggctggtctcaaactcctgacctccgttgatccacctgcctcagcctcccaaagtgcaaggattacaggcctgagccactgcacctggccaatagcttgtctttcaataatagtgttcttgctgtgatatcatactacagttttgtaagatattaccagtaggggaaatttggttaagagcatgtgatgtttctattatttcttacaactgcttatgaatctacagttacctcaaattaagtgtaatttaaaaaatactggaaaacaacaacccccttaccccatgcagatattttcatctattttggttgtatttatttggtattgacttccacaatgtatatagtatgttttgattgctaatctatgatttattaattgaagacgattttagatagatctgtatctttatggtagagtttatttattgtagctgcattttaatttaaaacttaattactgttgctttgtttccttctggtttctgcatgatttccactgcgtctcttgtgttctgtttgtttgttttggagtttctcacattgagagatttttctcattgttgggtaaccatgactctatcttcctgtttaagaattaggggctgggcaccatcgctcaggcctgtaatcccagcactttgggaggctgaggcaggcagatcatctgaggtcaggagtttgcgccagcctggagggttggagaaactggctgttgcattagtccgttctcacactgctataaagaattaactgagactgggtaatttatgcagaaaagaggtttaattgactcagagttctggaggctgtacaggaagcatggctggtaggcctcaggaagcttacactcatggcagaagggcaaagggaaagcaagcacatcttcacgtggtggcaggagacagtgaaagaagaagcactacacacttttaaacaaccagatctcgtgaggactcactcactatcatgagaacagcaagggagaattctgcccccatgatccagtcacctcccaccaggtccctccctcagtgttggggattgcaattcaacatgagatttgggtggggacacacagccaaaccatagcagctgttacctcatgctcctaattttgtggaagatcagataacaacttagtttcagtttggtggaattgtagcatagataactctgttttgatttttagtctggttgttggggcgtagtgagggggcttagtgggggccctgtgtgttttatctggtgaccctccagtttctcagcgccatgcatttgcttgtcctggcctctgcagtcacctttgctggctgtggcattgtgagggtgtgaaggctgcagattcttagagggggcctattccaggctctcctgtgttcatgactgtcacatcccatcttgggcgaggccaggctagagtccacaggctccactcaggctctctttcccagaccccgacacctctgtcagcctcgttgtaggtcctcttttgattgctattgccttggacctggacagtttataaaccaagcttgccaagaggcaagagtgaagaggtctgttaaatagggaaagagcttggagtctcctgggccatgtgctcagtacacaagttcttacaggtgggtagtcctgtttgggatagttcagacacaccagagtagggagtgagggtcccatgctggccacctttcttcttcacctccctcttctcatgcctccctgccaccacccaacattttcagccttgagaaattccaagtaagccccttgctcagggctgggaatccagttggcagttcgggaggcggtggggtcagagttaccgcttctttccgggcctttccagaggttctgctgctcccccaatacgccttccattgtgctccagtgcgtccctccagcacattcccacagttagattcttctggggactgttgtaggcacatccctgaaattcccgagggatctccccctggctagtgtacttccttttctcaaggtatgtgggaacaggagctgtctgccgggattagcagcccacatgatttcccagtctcaggacctgtttcctgttgggagcccctgagctctgagacatgtggttgccaagtgcttgcagcgctgggtgtggtggagccccaggctgactctcctaggtggcagactcttgggggcgagctctccccagggcggggacaggctgggggtggcgggctcttgggggtgggcaggatctccttgggtgaggggtgtctctgggggtttggctctggggaaggggttctgaggagggggcagattctcctggggaggtgggctctgggggtggggagcaggttttcctgggtgggcctctcctgggaccaactctccctggccgcagtctctcttggccacgattctttcctccacagcaacatccatgtgcagaggtgctagagctgccagtactagcttaccagcgctggctacaagatcttcaggaactttttggcctggttgttaaccagagcaactattaaaaattatagaacctcaggtaagcaaattaaatcgcaaacaaaagtaatggatacacaaaacttatactaccttttttatgacattttaccatttcctgtgcccttgaggctctttacgttatggtacctgtgtggtggaaatactgtactgggcgacggggcagctgtgcttctctccccagttcctgcttgtgtgggagtatttcaccatggaaatcagcaaatcatgcttagttatttggacagctggttattaaacatttaccagcacacaccattacctgagttctatcagcttattaaattaaaaaataaatggagccctttaatcacattgttcttattttattttattttttattattttttagaggtaggctcttgctgtgttgccccggctggaatgcagtggtacaatcatagctcaccatagcctggaactactgggctcaagtgatcctcttgtcttagccttctaagtagaaaggaccactggtgcttgcaccatgtctgactaactttttttaaaaaatgcttttttgtagagatgggtccttgctttattgcctaggctggtcttgaactcctggcaagagatgcaagtgacccttgcgtctcagcctcccaaagtgctgggatataagcatgagtcatcgtgcctggcctaatcacattgttcaagcattgtgcaaatcaatggaagcctagctcacaacacttctggtttaaatgcaggcacacttcccctctgcctggccctgactcctgctgccctctcctactcagttctctggcagctcatccccctcacccactctactccattccctgcctgctttccagtctctcgacctggacaggttttctgtccctttccccattgtttctttgaagtatttattatgtaccttcctttatcctctcagctaaagggtttcccttttcttgccaaggtttgtgatccatctctctcttctcattctcctgattctgaatttatcataacatttcctgggcacaatttaaatatgcttatttgaccttcccaggctgtgctaacagcaccaccaccactgctgctgccgaaaagagttagtgatatttatctacacctgtacctgtgccacctgtgtcccatgccagagaccccggagcactccatgggcaggtcccatttaatgctgatacctccatgagaaatgagtgtttggttgaatttaagtactgtaagggaactttttagactgccctaggtggtatgtgaaacctgagggctttgtggttgtgccaaggggcttctgagtagagaagaagaagggataccagagaagatgagactcacccacagcccttctaaccccagacctagcagagcatttcactgtccagaaataggagttgaaactgtggccttcagagcaatgttttaacctggctttagtattcttactagctgagtgaccttgggcactctgtgcctcaatttcctcatctgaaaaatggggataatactattaccttataaggttttttgtgaggtttaaatgagttaatgcacataaagctcttcaaaaagtgttcaactaataaatattagccattgtcattactgaggctatgtgcaaaattgtacttaataaaataatgcttctggtaagaggttgaagaccacatatgtagctctatggcctttattttatagttgagaaaactgaagctcagagctaagaactggacacagccagtgagcagcagagtcaggactaaatccctttctgctctgaatttttcaacaaatggtattaatcctcttctttgacctggaaggggcatgacacctacaacatttgatacccatggcatttgacacccacaccactcaacacccttgtgcctttattttgattaaaggtgtgcctttaaagtgatgagaatagtgtccaaataaatatgacagaacccttctatccattttctctgggaagaaatgaatattaatatctctggtaagatttgaatattaaacaaagagaaagaactagcccctttagtggatatagcatgatctggggaacaaagagacagcccagatgggagcatgttattggagagggataaggagcgtgcaaggtaaggtgtcggtgaacaaaagttctctgtaaaagaattggaagggaagagactttattccactaagcagtttgcaaaatggggagatgtgacctgtggtctaaaatgaaggttccttccagggagcaaaaggaggtttcagttttgacagcaaaagttcctgtccgggttcccactcaagtccatttatgcaaatgaaggattcaaacttgcttagttctaattacttgatgaagctaagttctgattggttggttcaggtgagttctgaaagtcccaaagttgaacagaggtatgggttttctgttgacacagagtacatctgtgatgtctagtcaataaatgaccactaggctcaatgttaaatttaggcccagttagccactagggatccatcttgaaggactggctctttcggtttcatattcattcccatgaccgaggcaggacccatcctgcagcttttgcccagcgggtaggagaccaggcttgggaggccattaagtcaacttcagacactgttttactgcccagggtggaggaagatctctaaactaaatgcctacagcatccacagctgaatctggctggcatgtaaagaaccagcagtaagcgatgtgcctggtgtgctggggtacacgaacggaggcgagccgggccctgtagtgatagtcagtttcactgggactaccctactccagacaggaagtcctcattgctgacagcacttaggagcagtgcctctccaccagaagtgtattctcagcaggggtggatctgagagcagaatacctagtggagaagaggggtttccacttgtggggtagagctctttcaagcacccgggccacattcagagaagttcccctgcactgggctaaatgagtcaggtggcctcacttctctcagacacatctggcaacctgggcagcttttggggtgacactgcaggaccacaggagggactccttctctctggcattctgagaggtgaagggcttcacattccagtgatggaaatcttggcaacactagagaaaggagtgcagctcctacctaaccagtgagagaatattatacatgattttgtataatctgatttgaaacttgaaataatgcaacattttcttagttgaaaaacaacaaaaaatacataatttcaaagctgttcttgggggcgaggtgcggagcgtgaactgtctcccacttcagggggtaagcaggtagacaggaatgtcaccatccattgtctcgtgggtgtgaatcactgcttctagactcctgtgcttttgataattattgcaaagtcatttcaacttttgctgtgttatgatctttaaaacaaatagtgtattctactgcaggataggttaattgtcattaagaggtgattccagtggtattgttaaaaaaagtacacccacaatcagtaaatttagaaagaaagttaggtgagataaaatatcatgaagatttaaaaacaccaggaaataaataccagtctgctaattttatgacaagcatcccaagaaatattggagatgatgctgagaaaataaaaatagcattaaagatcctcaaacagcccctgttcctctgactttgcagcatttggaggggaaagcactcttacattatgagggcctctggagccccacctaaatccttaagtgaaaactcccagggagcatcattttctgacagttgcagctggattagcaccacgtgggccagtagcctcagagaagggagtgtgcaatatcagcttcctccagagagatgccgatgggtccattctgggcccccgtttccatacctgtagcctcttaggggacacagaatgactgggaggtgctgcctattcacctgtggaatgtgggcacttctggggtctgactttctcctatatagctctgtagcttttgaatacctataataattatgtacttgtattaatttttaaaaatctattaaaaagaaaaaaaataaaggaagaggggctgagctctgctgtggaaatcagatctatttagaaagcaagaaggtctgtggacaatccaatacaaggtggcccagcctccataccacctccagctgtccccaggctgctttgcagtaacaacctatgggcaaatggcagcgtgcgcctccgtctttctgccctatatgcctgaagtcacagcggtccttcaggagtgttatgactcattcccatggggaggtgggggcgtgctaggtgtcttagtccattgtgtttgctctcataaaataccatagactggggggctttaacaataggcatttatttcttacagttctggaggctggaagtccaagatcaaggtgcagcagatctggtgtctggtgagggctccctttctggtttgcagatggccgccttctctctgtttccacacatggtggagacagggagagctctgatcccttccttttcttataagggcactaatccatcatgagaaccccacccccatgacctcatttaaacctaatgatctccaaaggtaattacatagggggttagagcttcaacatgcaaatttggcagggacagggggtggggaacatgaacatccagtccattaccatagagatattcaaatgggggtaaatgcttctgtggaaaatccccccgtgggaggctgctctgggctgtgtgtccaccccaacttggtgctcccacgagactgtgggaaagggtggcagtcctctatccccagtatggccttcagcatgtgcagtccctggcctggctacctgcagaagcccacaggaaaggggcagccaggggttgaaggagaaaagaggagagaggggtggggatgagacactccattctgaggagaggtccccaggaagaggctacgcagattctttggaactggaattgcctgagaaggcttaggacagcgctgctcattagaccactgcctgggaaatggccatcagctgagaatgtgggaccttagtgtccctgtgtctgggggagtccaagagagagagatggatactgaagattttgcaaagtggcatggctgggtgagtgggccctccaccaggagacactgactacaggtgcttgctgggcataaccgaaggagggcccggcagaatccagaccctccccattgccgtgagaggctcagggggctagcttatgaggaagagaactaaaaactaggggacacattctgaggatacaaaatgcacaatgagccctcatttagatgaggggtagggtcttaaccaaactccagcattacaccccagcctttccttgtggttctatgttgtcatgcaccatgtgcttagctacagctctcctgggtgctgccttccagagatgggaccacctcagtgacagtgaagagattaagtgtgcaagctggggacagcgggcaagtgattaacatttcctgactctgactcgtcctttggagggtgatgctacatacagcccatcatacgcactatcatggcccaatctctctgaaagtgaaatcacttctccccactgagctgcatctggaattttagcagcttggagcaatgcaaaataatggtgcttaaactcagaccagcctcctcaattttgagctgggcaatccattacacatacattttaggcagaatgggatcctggtaaatttgctgtctgtgtatgtggcccacaaatttccattcattgaacagttgtcatttttaagagctgcagggcaaaaaggttatttgttgactttttgttttttgcaaatgatattaccttgcaaaagagcttaccctgaaactgaaaagaatgattctgtgttaccatatgcttttataggcttagctcttgtctgtgggaagtttgcaagcattccctcctctgctccccattcatttataaagaaacctcccacatggtgctattaaaataaaaacttactcatatgcttagtcaatgccgagcagaatttctttcataggttccgtatgaatgagttctgaagtaacaggtttagaaaatgaaactgctcaaaaagaatatgaaaatgacttgaaaaggtgccagaaaatactttgactgtgtgtgcatgtgtgtgcacgggggtgggggaaatatcagatcatgggaaggttccaagaccttcaggttataatggcatgtgaacaacctcaggagttggtgtgggaataaacgattcaggcttaaaatgagaaactcctgttatggacaccacgggatgttctagtcaacagatctaaacacgtggccccatgactacctgtttatgtgggtgtaatcaatgcccagctctgctattcaccagctgtgtggcctggggcaagttgctccaccaacctgatcctcagttcccttgcctgtaacatgctgataataacagcatttattccataggacataggatccccacaaccccaattccttggagctcaaaaattagatgaatcttgatccttgttcacagtactttccaccacggatccatccatgactttgtcatttatttagttatgtaactagttatttccaatattgtaatgagcacccatgaatctaccaccaaacaaaagctaagtctaggacaataacctacatcttatcagctagtccccagtatcttattaacctcttctccccacttctaaggtctacaccatcatgaatcttgtgttcctgatacccctgcttcccattttatttggttttatgcttccatatgtatttctagaaagtaggtatatttttatcttaattgttttttaactttataaaacttttagggacttacttttttccatttaatgttatattgctaagagtcattcacagtattgtgtgtcattgtaatttctttgttctgactgctgcatagtagtgtatacaaataaaccatagtgtaatcatccatactcccattgaggggtacttgggaaaggagagggtccagacttttgctagttagaacagggctgttatagtcctactggtacatgtcagcctttgtacaagtataagagtttctcttgggtatggaccttcaaggagaatcatgtcagagaacatgtgaaagttcaactttaggagacaatgccaaaacattctctaaagactctgtgctaatctacaatgccacaggcttcatcctctccagcacttaattgtgttaggctttttactttttgctaattgaatgagtataacatgttatttcattgtgattttaattttcactttttttctttaacaaatttttttatttttagtttttgtgggtacataataggtacatatatttatggggtacatgagatgttttgatataggcacacaatgcataataatcacatcatgggaaatggggtatccatcccctcaagcatttatgttttgtgttataaacaatccaattatactcttttaggtatttttaaatgtacagttaaattattttgactatagtcacccttttgtgctatcatatactaggtattcataatttttttcacttttctttttgaatcttttcataagtttattgggcatatatgtttcctcttctgtgaaatgccattggtgctttttttccccattattatactggttatttgtgctttgttaacaaaattgatttgtagcagttctacatatattcttggtactaaacctttgtggttgatattatgaatatcttgtcccagtttttactttgtctttttactttttaaaggtatctcttggtgaacaaatgttctttattttgacatagttaaatttatcattttatagtcaacaatttaagtgcttaagaaaaactttagctgcgtgtattagtccattcttgcattgctataaagaactccctgagaatgggtaatttataaagaaaagaggttaaatgactcacagttctgcaggctgtacaggaaacatggttgggaaggcctcaggaaacacaattatggtggaaggtgaaggggaagcaggaatatctgcatatggccagtaggacagagagagaaggggatggtactacacactttaaatacagaactagggggatggtgccaaaccactagaaaccacctctatgatccaagcacctcccaccaggcctcacctccaacatttggaattacaattcaaaatgagatttgggtggggacacagagccaaaccatatcactactccaaggtataaaatagttacctgtattttactataaattataaagtttcttttttgacatttaattcctgaatctatctagggttatttttcggatatagtttgagagagatattcaagttcattttttcccatatgaataactacttttttccacctccatttgtttatcagcctcctctcctcactgacctcctgtatcctctgtaataaaccaacattctttatttgcatccatctttttctgggatcttattcataccccatggtctgtttttctgtctctgcaccaaaactacagggttttaattgctccagcctcataaaagtccagacatcaataagggaaacccctgatcactaccttttcagaaacatcctatttttggtcttttatgctttcacataagtttagaatcattttttcaggttctatttttaaaaaaattattaggaatttgacaagaattgcactgaatatatagatcaaattacactattaaattatataatccatgaacacaatatctctctccaattacttagccctttttaatatctcttaaagttttacacttttccttctagaggtcttgaaaatgtgtccattgttaggtttattctaggagacttgatattttaatttttttttttttttttgaggaagggtcttattttgtcatccgggctggagtgcagtggtacgatcatagctcaccacagcttcgaactcctaggtccaagtgatcctcctacctcaccctcctgagtagctgggactataggcacatgccactgtgccccactagatacctgatgttttctgatgctgttgtaaagaatattgtcttttagcctgggcacagtggctcatgcctgtaatcccagcaccttgggaggctgaggtgggcggatcacttgagatcaggagttctagaccagcctggccaacatggtgaaaccccgtccctactaaaaaaaaaaaaaaaatacaaaaattagccatgtgtggtggtttacacctgtaatcctagctactcagggggctgaggcacgagaattgcttgaacccggaaggcagaggaggttgcagtgagctgagatagcgccactgcactccagcctgggtgacagagtgagactctatctcagaattaaaaaaaaaaaatattgtcttttaattaaactttctagctgtttgatgtatgtaaattttatatcttcactaaatttaattgttcttaatcatttgtttatggattttgggcattttctatataagcagtcataccttatgtgggtgataatggtttctttccctcataagatgattttaaaagtgaatggggttatataaacaaagcaaacaacacagtggttggcagctagtcagtgctcagtaaatgcttgtgactactgatattatcgtcattactcattaacagaagaattttagaaatttctttaacaaattccttcatgttgaagaaagaaacagaggcccagaacaagtccatgatttgcctgggatgacatgacaactcaatgccaggactgcacctggaaaacctgggtctttgggctacaaagtcaagtgccctttcttttaatccccaacaaatgcaggcttctgtctggcataaacttttgcaattgtagtgtttacatgaatggggctttctggcacatccatgaaaaaaaatctattaaatcagcagcatgaattaagctctttctgtgtgctgggcttcccacattgcacacgcttctagcagaggaagaatttacaccctgcaactcagaggggcagaaaatgataatttatttccttttaaatattctctatatggatctcatcatttcctgttgatggcagaggaaggagggagaaccttaaacttgcccattgaaagcaacttagactcttttggtctaactcactttcttttgggtaaatacacagttaaataaaaattaagatttccttctcaaaggatgtctcttcactctctatgtcccaggttggcagctggaagagggaaacaattatggattctcacagtgtggagtggtgcctctgaactcatcctgcctttgagacatagcaggtgctgattgagctgggcctggcctgatcatgtctttgagcatccaattctggggccactaggtctagctgtctctgctggtgctttgggacctccactgctcagatcttcctggccccaaagatctctaaatctcagctttgtctgtcatctgtctctaggctctgcaaaggtgacctctcagcagtctggctcgcagctacaccctctgggggcacgtagaacactgagacccctttctggccacagtgtagcagaggaagaggcaggctgtggggcacatgtgaggtattctcagatactagctcagccttaacttctctcatcttctcttctctctgcatccctccctccccaacttgcctcttggccagaagagtgtctccttcctgttgggtggggtttccctaacttgatgtcctctgtcttctctttattcaggcttatagcaagctccacagtcacactggcaaggcctagctctttgaagatgaagggaactttcagaatctagaataatgtgtgtcctctttcaacaaaacttgacattggaaacctgtttctccatggcctctaaaaatgtcagttttggcatgcaaatattttctaaatattatcccaattacccatggttatggctgcctttgggattatgatgaagactgtagttgtgtagaacatgtcatgctcctgactcccctctcgggatatggaggccactgtctttgtgagtggatggagctccttcctctgtccatctcttaactaatgaaagccaggtctgtctgttctcagcagtctttctctgcctagccactgtacaggacactgtcactaacacgtcctcaaggaatgacctctgacttctggcctgaagatctctgtggcctctattcaacctttattgagagcttattatggttacagctctgtgctcgtgagaacccagagagagcgagacagaattgtcttcaagctgctcaaagagtaaaatccatgcataaagacctggctgtatcacagctgtgcttatgatattagcaaaatccagtacaactaggaagaacatgtacagagaaggaaggaaaggcaaaactgttgggtctagttttcttggttcctacatgaaagaaggctgggcaatatttaccctcgataaagttcattatgccttgggtatagtaaaaatctgaagttttgcctctgtagaccactattctgccagggctgggtgccagagtgtattttacaatgctgacgcctgtccgagacagtgggttgtggtttctgttccactctccaatgcacttttgggaaggcaggtgactgggatggacctgctctagtcatcaaatgtggcaggcccactttccattgccaacaaaagttaagtaaattaaatagggccccaaaggagctctctaggagttggtgtatcatgaaatgtgaagtgggcttgcccctatgcaagaactaaaagaaacacaatttagttatctttggcttctgaggcatcggcagagttttctgctgccaatatgagatttcagtggagagtagggtttcccaaatcatgttgaaacgtgacattgttttccttaggcccacagggccttggcctgacactgagcatgtattcgtgtgtgcacacacgactgaccactttctgcacgcttcttacacatccgccatgtgtccgcctcagccagtggaagccctgtgccactcttgagatgcaggtggctgtttcttgctgctgtcactgttactgctgctgccgcttgcagcctaattcctcgctggtttcaaaatgtgtctcagagatttccccaaatccatttctccaaattctgagttgttcatccatggataacaacaggatggcatggatgtaggcactggtaaagaagcacagaagcatgtactgagggtgttaattctgaacatggagagactgcatgttctgaaacacatcttagcatttctgtgtccacatatgtgtattgcatttcaagcatttttattattattattattatttttgctgggtcgtgtcaatagaactgacagcatcctgtgaccatatcttcacctttagtgctttctaagtaaaactcagtgtcttaatatagccaaagggaagaaaatcctagtgagagaatgaactttttctgacattcctggttggtgaaatgcaatcctcttttcctggcatttggtgaggataattgaatttatgtctggtaactaaggggatgctcgggagcctcaggaaccatgagcaggaatgaggatggtcagaaagcacattgggttatgtggattcagtgacacaaaccccaagaaacctggtggcttttggcactgcatgtgattagagacaaatgatctattttcatcttctggaaaaatcaataaatacatatataaaagagtgccttcaagtcctttgagctattaagaatagctaacgttttgattgcttattgcatgtctattgctgttctaaaggctacatatgtattcactcatttcttcttataacgtccctgtgtggcccacggtcatgttattttcattcccattttacagataagaaaatggaggtcacgagctggagaactccttgctcaagttgcatagctaataagggacttagctgggattcctggccagcaatgtggctccaggcctggtttctaacttccccttcttggcaaccaccttcacagaggaatgcaagaggtgagtggatttgatgtgatattttatatcatgcctatttctatccactttctctggagtccactaagattaaagaaggagagaaattctctagttctacaggaagtgcgggctgtttccagtgggtccttgaagtcctttgtctgtttccagtttttccttcaggtcttttgagcccagcttccctctggccagctcaggctcagggagacgggcatacaccggtggcctgggtgacagtgtgcagctgatgagccacaggacttgggcaggccatagtgggtcaggagagactggacgcttcgtcttttatgcttctgggatttctgttgtggcttctgttttcaccgcatttcaaatcctttaagttaggtcatatggggaaaatgcttgtgcttctcatttatctccctggaggctagcctggatctctgatgaggaggagcaccaggccactccataaccaccgggctgcaggatctccagggccacccaggaagccaaaatcagaacagagctccttgctgtgggggctttgctcaccctagttctgggagccagccagctctatcttggggatataactttccagggacaagagatgcctgattttgtgcagacacctgtgtcatggagagtatttcttatgttccaagcagagaagttcaaatttaccagtcttcctgtcactccacccccaaaatctggcgaccccactcagctgtttttcagggcccaccctcatggcaccttctggggactccctctttgctactgaggttgagacctagcactaggttttgtgctagaagcgccttgggggcagaaacccccatatgccagctgcccaggtcaggactgcatgttttcctactcaccgccaccttgccttgtatagaagaggtgtggccacgtgcggaatccgcgggcacaggcagcgaggccaatgaatggtatcttgcctgcggtctgctcttgggaagggtcctctagtcccggtgtccagggacccacaggctacgtcacatagtctccatgtcttcttgtgggaaggtaccgtgtgagtctttttaaaaagtaatcttaaaagagaacatctttgactgggcgcagtggctcacgcctgtaataccagcactttgggaggccgaagcaggcagatcacacggtcaagagatcgagaccatcctggccaacacagtgaaaccccgtccctgtcgcttggaatccctggaagaaagcagaaccgagaagagaagcccgggtttaacgctgtggtttcttttttgcaagataaaaccatgtgatttagatatatgcaaacaaatcttgagttaaaggaaactgagtttcaaattagataattgtctctgagaaaggcattcatatatctcatatttcatttctaactttttatcatagaacatcttaaacatacaccaaaatagagaaaattataatgagctcccatctgtcacttgccttcaacaatgatcaacttatggccaattatgtttcagctacaacccaatctcgccccattctaatttttttaaagcatatcctaaacattgtatcattttatctgtaaatattttagtatatatctctaaatatatatgaactcttatttttaatagacataatcgtaatcatcatgattttaggaaatgattttaataaaaatcacacccaattcacgaagttaaaaaaccctcccaatattcacacccttctcattactcttggttttaaatgacttttcctgttgtttgaagcctgcgttgcagtctgactctgatccttccaaaaactgctcctagagaagctagaggtacactctgagattaagctacctcaacttcaagcctctggattctgggaggagttgagtccaccctctgatctagagtttccaggcatggctttgtgaatgcacctaccttcttcccagatttttgcccgtctgaccctcttacatgagaacatccccatacatggctgtggaaaatcctcaagtgcaatgaaggcaagactgaaaacagagccgctgccaaacagagcagcaagttgaagggcaagtgcctgtcaacacaatccccttgaaagactataaagagctgccaaaacatgagatgcatctgacatccagatagtattagctgactgcttcccaaatgggttagctgtctacagaaacgccctaggtagctgatatgaatcgcaaatgtgctgtgacttgattaatttgtaacagtcagaaattaggtagttcagtgctagtcatgctcaagcttagtagtagctggtttagttgttttttgttttttgtttttttctgtgggtaattggatctaggatgatagtgtaccatcccccagcagtcatagaagacatggtaaaaactagctttacacgggtcctggacttgaggtcacgggtgtggaaggtgattcactagggagttggctcttagcttagtgggtcatgtatttctgagaagcttctttcctgaggtttacagtcagtttcagaggtgaatgaactgcttcagatgatcagaaagatacactctgtcattattcccccaagaataatctttgcttctgtagttacattaaagctaaattttgctgccagagtaggagccatccattatattataatcgatgacatgaatgttttgctcaagttcagatgtctaataagagtcattttctttccgagggagtgttatcagtttcatgaatatgcgctctgtatttcattagcattcttctagcaaaacatgattctgagtcatttctgaaatatctgctctcgcctgcaacttgtttctcagtttttacaaaaattgccttttctacttactggcagaaaagtttgataccacacgagcctaaaatgggtatgctgagaaaaaacacagcacacctatggaaccgtgaccacaacagtgcatcggtctctgtcccaccgtctcattcgaggttaatccctctccacagggcggcacctcagcagggaagggcgagtctgaggactgagggtaaacagtcatgacatgggtattcactatcatggctttcttagatttttaagccagaatgaagttcagagagcttgtcagaggatgttgaatgaacagaaaaggaaatttggaacccatatgaaaagagctgctttatgaatcacagagagcttttgagttccagcttacagtaattcaaataccactcacttatattcaactgagagcagctctggcccagccttgtcccctgaccccggggacactttctctaggatgaacaagagaaggtgttctccactgtactagctgccagtgtgtttctttcaaccaaggaagtatccatgtctcttattctatgtcattattgtaagaatggtctaccttgatccttagaagccaaccaggatggagtcccattttgcagagtctgctgtgactgccagccacccctgtaccatggacttccacagcaatgatgctgtgctgcatctccatccaaagggattgcatctgttttaattgcttgactttcaaggacactcagggacaggtactcttccataattctacgtcatcccagtttcacaggggcgtgaattccccatcccctgcaaggtctactgctctccaaagtgtgtgtctttgagatggaggctcttcacagggttcaccacctctgcaagtagggctgtgacaactcagccttgtgcactgccacaaaaggcccttcaagagcttctagaaatttctggctcacagaagccactggaatactgtaaatggagttggttttggtggctctgtcctttgatgggaggctctgtctcctgaggccaagattgaaggcaggatctgaagattgtgcgcctggatcaactctaatcctttccagcccaagagagttgttcttgcttcttcttggactgttgtgagaaacttccacactgactgcttggaagtgtcacatgttggacctcttggtaccagtgtctctgacagactcataccactgggagctcagagcgagtggctgaggccagcagagctgaacacttagtgccctgtccctgcattctgtgggatcaagaatgaactggaagtaggatgccgccctagaggaggcacaggtgctacagaggcagctcagctcaggaagcggacgtgaaccccttcctaccccccattagtgctgtggccatgaggccccctcacctgagggggaacacctctgtcagcctggctatctgccaccaacaaacacttttcctgggaaggggcctggattcctccagttgagcctccttagatgcacaggttgcaccagggtggaggccacagccaaaaccaaacagtgtagcatgaacaggccaggctcccagagtgggaagggaggactggctggaggcagcaggaggctggagccacatttgcctgcaaaaagtcttttcagacgcacatctcaggccagttacgcaactggctcctggatccctctgcccaggcccagtccctcccattgcctctcagtgtaaagcagggaatgctgcaggatggagagtcctaagccttaatcgtggatcttgggattcagagtccagagaggataaagaagcaaattcacagtcaacacttcctttttttggatgtttaccatagtgaagttttgtgcaaagtgctatgcggacatgatctgacacatcatgttcccccaccctcccggcccaggatctgaaggtccagcaggagaggcaagccaatgctaaccaaggctcaatctgatacagggacacagactgctctggacttccgtatatgcctttaaaaatatatatatatctttaggctgggcgtggcggctcacgcctgtaatcccagcactctgggaagccgaggtgggtggatcacttgaagtcaggagttggagaccaacatggtgaaaccgcatttatttattttatatatatataattttattaataaataccctggaaggaccttgttcctttaacgtgctggcacctatagcagggaccaaatttgtacttttacaaactgtctgtactggtctaaggaggagcagaggcgcacatacaatagctgcttatgcagaatcactggaaaacaggtgattcctgaacgttgctagatgaatataactcagaaataacccacagcctagattagtaatctgtgaaagttggagaccaaatgaaatttgtttagcaataaaatgcttttgaagagaatttctctttctttgatgttcttgctcattactgtacactctaatggtgttgggctcagaactattgctcaatagaggtttgataaatgaatgctccagaagacacacagaggctatcagtgtggtcgttgtcaatgagtgtcccagacattaaataagagcctgcaatgcctgagagccatgcgcagagatcatgggactgacacctggggagaggttctgaagggacctaagcacacagacaggagggaggtgtcatcagcagattcatccagccccatgttttgtagatgaatagttccaagacactttttaatagttatccaatcctgtatctcctgagcatgctcagtgccatagagcctcagtttccacatttccaagcagacttttctgttctctcataagcacatttgagaaaggacttgtttccccttgctgtcataaatgcccttgctttcaagttcaagccaaaaagaagcagtgcaattgttcttcaagctgatccggtgcagaggaaccgcaaatgccagctccagctatggtttctaattgaatatgactttctttgtaaatgcctgtccttgcccccagcagcaaactgacaactaggacttgcctttgtgagctgaaatgatgtcgctgataaccaacagcttgtattaatttttcctgataatctcatagtacttttaatgagattggtggcaaacatgccattctggggcaaattaatttgtccttgcaaaacagagtgtcagcgatttttatttcctttgtctgacgtgtaaatgggttgtttccaatggcaattgatacaacctagtattttcggctgcactgaagggagaacaagattttgccaagagcaacaaaatcagcacaaccacaattaaagcagatgatcgacatttggaaaatggtctgctgatgtttcttccttcgttttccatgctgaaataggttgtgatttagacaagggccaaagagatgaacaaggcagccagcggctgctcagcctccatgtagcctggtcatggagaagcaaaatcgacatgaaatgtgaccctctctcttttatgtgctttcacatgctgtggtcaggaaccaagtactgtatttgcattcactgctcaggcactgtgcggtgacctgcttttatgccactttgcattgctgaagtgatgtgggtgaaaactggaatcctagttagaaggaaacatggcatccgactcttccattctctcatttccaatgtattgtgttgcctctctcacccgccaaagaaatgaaatgtgattttctaccagagttggaagagttttggccacaatataagtcattatggcagtttccattttctttgctatacattttgaacaaggaaccacagttcatggaattgcattgaaaattaacagcttttttttttctttttttttttttggccaagctagccagaaaggaacttgcatgagaaattcactaatgctaatgcagtttttcaagtggtaatatttctagaattttaattaggactttttttttgctttgaagggtcccatcacagaagagaaaggaatgctaatatttgtctttgatggccagcagggtcctggaggacattaacgttttgcaagctgaatgaggtcttcccactgacacgagcataaagagcaggtggatttaacagctttcattccattttctatttagtttaatcaagataccagttaagaacaaggggaggctgctcccagagcttctctgtccttttaggggttgaccctactggctcggctggctgtggattagaccacacctgctacaaatcaacaaataatgaacttcggatgctgagaacctgaaacactacataaaagagggcataaacaaactcttctttttcaacatatgatgggcgattgaagcggtcagtggaagatagctgtgcacaagaatgtgggcctcctcccttgagccaaggtctcagttttatgattcctaacttagagttaaaagaagcaagccatacaggtaaatgattatcaggcagagaggcctagaatgcattacagttatgcaaaacctgggtttttcataggtgtttttaatgttggtgtgaacagtggagccaaatagcatcttgtagcccctacgtgggcacgattctttcctgggcgacaccgtctgcatgccccatggtgacattcctgtgcgcttgctacagttggctagtaatcctggctttgaagaaggttttccagtgccaatcaccatgttcaagacaatgtgtgggccagtattctgggtcatgcgtcttccccaggagctttggttaaagtgagtttgaggaaaatatgggtgctctcagatgctcacagaccacgtggatgtgaaatttagacttttatttggatgataataaagacagactttaaatgttttcagagtaactggacagctctatctgtctcaataactgcaggcagttcaaattcagcaggaaactactcaggttcctcctagccctgccccattctttataacatggaaaccctgattccccccgccgaacactttccttcaggtagcaggatttttgcttcaccgtaaacacaccaggatcacggatgatgatagcatttattgcttggaataaaaagtgatttgcggccctgtaaataggacagcaaatagttttgcttttgacctaaggctcccatgtcacttcatgatttcattcatcttcatattcaaaagaaggataaataaactgctttcctgcttagtagcttggtcatctgaaatccagtatctgacatcaattcccagtgggagaaattgtgctttgctgcgtgtgtcttaactcagtctctgatgttctggttctgactcaggatgttggtgacagctgcaccacatatgccacgtctttcatgctagactaagaccagacatcttttctggtgcgcatggagtcacactgtgacctagaagacagtgctttgaaataatgacaaagcacagaggcaaggaatgaagttgacattgcataccaacggcatcatcaaatttgtcctcaaatgtcactgtgtaatgctgagtgatttttggaatctccctagtttcccccaagcaaattacatatcttcataggcacatcgatatcaatgttttgaatgtaatatattttaatgaatatgtaaacatgtacaaataaatataatgaatataacaagtatgactgtcctatatgagacatagatattttcaataaatgtatatttattatgaatatatatttataatataaatatcaatacaatgttgttgaatgggtgaataaatcctttaaagcagcctcaatgttataagtagtcactgtgattcattcatctcatacaagcattctctttctatggatgtaattaatacttatggcaaattgacttttcttgagtctcatgaaatagaaaaattcctttctgacattttgactattctaatatggcacaatattataattttagtgcatgtaatcttttccacccagaaaattggcactttctaaattcctggtttcttatttgaaaacaaaaaagacaaaaattatgacaaatactaccaaattaatatttaaattatatttgaatggcaaattaatacttaaaattacattgctaaaaactaattccagatacggagcaaacttaaatgagaaagataaaacaatttaaattttagaagaaaatataggagggcaacttcatgattttggccaaggcaaagatttcttaattaggatgccaaaagcaccattaaaaaagtgggtaaaataaggcattgaaataatattgggggctgggcacggtggctcatgcctgtaatcccagcactttgagaggccaaggtaggtggatcacctgaagtcaagagttcgaggccagcctggccaacatggagaaaccctgtctctactaaaaatagaaaaatcagtcaggcatggtggtgcatgcctgtaatcccagctactcgggaggctaaggcaggagaatcacttgagtctgggaggcggaggttgcagtgagcagagattgtgccactgcaccccagcctgggacagagggagactctctcgaaataataataataataataatattgggtacagataataatttcctccacatgtgtgaaaaagaaggttatgagaatcagaaagcaggaatttagacaatatgtaggggcagcagatttcccttgttttgtaaaacaggcctcagagaggagtatcaacttgcaaataggtcaaaaaccctttgagggaaggaagtttctgggcagcagaagctttaccaccatccactgtcacatggatagggattgcaacatactggcccttcactaataacatctcgtcccatttggatggcaaccctgtgaagtacatatgatcatgctagggaaactgaggttgagtgaggcctggtgccatgcccgaagttgggctgctgtccagtggtaaggcacgggctagctgtgtcagccctaaagggcaccccactacatatccccaagatacaggccacggggctgcaccctcagccacggcccagcgtccccaaggctcagcatgagtttgcatctgctccttccctaggaagtcatttatttacataaatgactaatgatcctgggcaagggctcctgttgggccacatgttctgctttttaaaattcagagcctaggtcaactgtttgatagaaaaatgaaaacataatgtaaattctaaataaagctgatatgcaaagaaactgccctgttaacttaccttacttgtagatcatattttcggtggaagtctgttcagtttaaagataaacatgacatgattagaggagaaagaggatagcccctccctttaagctccaagataattcaagacatcagttaactattgagcgattagagaaggtgttttgggagctgaccttgacctagtattctcaaatctccttcccctccataaggcctggtatacttcatgttgctggcagtcaacatctgtctggcttatgaagaacgagataatcacactcattttggggcctcaggctatgagcacctgagtgtgttaatatcaattaaaaaccccagtacccatctgttgaggtcaggactattaaaagtcaggcgtggctgggcgcaatggctcatgcctgtaattccagcactttgggaggctgaggccggtggatctcttgagcttaggagttcaagatcagcctgggcaacatgatgaaaccctctctactaaaaatacaaaaaattagccaggtgtagtggtgggcacctgtagtcccagctacccaggaggctgaggtgagagaatcacccgagccccagaggatgaggttgcagtaagccatgatcgtgccactccacttcagccttggtgatgggagtgagaccttgtctcaaaaaaaaaaaaaaaagaaaaagagtcacgagtcaggagtcaggtgtaaatgcctgtatatcagactgtattttagaaatttgcttttaaaagttacccttgtgactgagactcaaaaagaaacttccaggatgaatgttcaagctttttttttacttaataaaaatacagctttaaggctgggcatggtggcccatgcctataatcccagcactttgggaggccaaggtgggaggatcatttgaggtcaggagttcaagaccagcctggcaaacgtagtaaaacctcgtctctactaaaaatacaaaaattagccaggcacagtggcatgtacctgtaaccctagcgactcaggaggctgaggcaggagaatggctgaaacccgggaggtggaggttgcagtgagccaagatcacgctattgcactccagcctgggtgacaaagccagactctatctaaaaaaaaaaaaaacaaaaaaaaacaagtaaaacaaaaaattttgcctgtgatacgataatgagtttcttttaaaacttctgagattagtgtcttagagatttaactgttgtgttttgctgctttcagcttgttctccctttaaaaaggcctgggatcattgctgtctccttttcctttttcatcagctcctgtgacgttttcatctcaacactttgggaggctgagatgggcggatcacttaggccaggagttcgaaatcagccttgccaacatagcaaaaccatatctttactaatattacaaaattagctgggcatggtggtacatgcctgtaatcccagccactcaggaggctgaggcatgaaaatagcttgaaaactggaggcagaggttccagtgagcccagccaagattgtgccactgcactctagcctgggcaacagagcgagactccatctcaaagaaaaaacaacaacaacaacaacaacaacaacaaaatgatcccccaagaatcaataataaccagaataaggagccattatcagatattctttattactcttaattactgttaggcttcaggaagccactagttgggtacagctgcccaggactaaacctgtttcttacaaggtcctacagccacaaaaggtggacaccacaacctccatttataaaacagaaaacttaaggctgttgttttgcaaacacatagattaataacatggttctgtaggtggacctaggagcattaatttttccctctcttccaattataattttcttgtttaacatcctagtaaagtttatgtcttctaaatttcatgtaaagatgatacggtctgtcataagtcttccaacccattctgtcttctgaccccacaaatgaatgcatcgtgccattgggccccttagttcaggtaccaaagatttttactcctcaaaggctagggaaggcctgcccccataaagtcagcaggaagcacttacagaaaagggactctgctcttctgcagtccccttaagattaaggaggagtatcgaatctctgagggagcaatgagataggaggtaggtgggactcaacccaggaccagattgaagactggctgacacaaggaagagacactggaagcacctgtccataacacatgcccaccagtgccatatcagtttaccattgccatggcaacacctgaaagttattgcccattttctagctatttctgaataacccactcctttattagcatgtcattaaaactggggataaatatgagtgcaaaactgcccctacgctactgctcttggcacaatgcctatgtggtagctctgtttcacaagaacagtcacaaagctgtaacactgccacctcagtaaagctgttttcttctaccaccagcttacgctgcattccttcctgagtgaagccaagaacctgccctgcaccacttttgtcaagtcagttgacataaaattactcataatatcctctctttattttttgactcctgtaggctgtgtaatgacttcttcctttccatttatgatattgtgttttgtgtcatttttctttccctcttctttttttttgagacagattcttgttctgtcacccaggctggagtgcagtggtgcaatgttggctcactgcaacctccgactccccagttcatgccattctcctgcctcagcctcccgagtagctgggactccaccacgcccagctaacttttttgtatttttaatggaaatggggtttcaccatgttagccaggatggttttgatctcctgacctcgtggtccgcccgccttggcctcccaaatctttccctcttctttatacacccttcatcaagtagtcacaggtttcaattcagttctttcttggtggtagtatggctcatgaaaaaagctgattcttctgtgtttgaggccattcaccatgtttatatgtaatactgtaaaaagtcctgtgacataagcctctgcttcacaaactgaccgctgtcaaacatcatctccccaccaatagataatttttttgttcctcaccagtataattcacataggagtagaaatctcaagtttaaagtgtggatttgcactttaccacttggtgtattcaagaagatgaataatattaatacatcagtagggccaggcgcagtggctcaatcctacaattccagcactttgggaggccgaggcaggcagatcacctgaggtcaggagtttgagaccagccgggccaacatggcaaaaccccgtctctactaaaaatatgaaaattagctgggtatgttggcacacacctgtaatcccagctacttgggaggctgaggcaggagaattgctttaaattgagagatggaggttgcagtgagccaagattgtgccactgcactccagcctgggtgacagagtgagattctatctccaaaaaaaaaaaaaaaaaaatcagtagctttgaattttaaacatctatttgacaagaaattcacagttctttctctcttaaataacgtaataattctttcagtaatgagcctggtttgatgcctctctccccaacatgataaaagtatcacataaatctatgaaaaattcaatttccctgttcctacaactgtctgggatggaaaacttcttcccttgctctagtcctttcttctacacctagtttcacctaatctgtgactcaaaacaatacttgtcaggaaacattctggaaagagcaaaaggcttctaagaggtgtcagagattcctggaccaacatctgtccatctctagagggggttgtgagtatgaggaagagcagagcttgtaaatcttctccttgctttcactcccactgtatttcctaacaacaacaaccacaaccacataatatcatagaacaagcatctactacttccaaggctttggtctcagtaaatcttctctacctctatcacagcatctagaaggtttgatactcatacaaatagtgctgtagctttcttttcataactggaaaagtgggcaagactcagtgtaatgcaggcattccttaagctacttagcattcagtttttagattatcattgcacacatatacccagcatatgtctaatatacatgtaaaaatccatgaagcaagtgttatattagcttgtgttttctattgtattaaatttttctcttatatcgtcttctcctttttgtcattaaaaatctgttcaagtcagtcaattaattattggatcataagtagataaagtcttttatttcataacacattgactcaatgaatatgtttctttgcaagacacagtcctcatttccaagaaaacaagcctgaaaagattatactggagcaagtctacaagtaatgatggtagtttttccttattgtcagtcctggggcaagaataacataaaagataacaaggtagaataaagattacataagaaagaaggacagcaacaggacatgggaactatttatagggtaacatttaaataatggatgatgagaagtaatgcgttagacagggatggatgggaatgattgaaggtctgagtactttagcacagattaagatcaaatcattaggattttaagagttgtgtacagttactgaagaaaatgccttagaatttaatttgactgtggataaaacattcttggattagatttaagactattttccatggtaagtatatttataatgatgatgactgtagtgctgaacatttaaacaatgaaaacaaaattaattgccacacacataatgtcctgaatactactgtaaatgttttatcttattttctttaaactgtctacagcactgtaaggcaggtaccactattgtcacagttacacagatatggaaaccgagacacagggaagttaagttacttgattaatttcaagcaatcgggaagccatggagcatctatgtcagggctgccaggacatgtgactgtaaacagaagtttttaactcaaagagggtatgtgtctgggttaatggaaagcttcaggaccctcagaaaacattactaataagcaaatgaaaggtgtatctgggccgggcgcggtggctcatgcctgtaatcccagcactttgggaggccgaggtgggtggatcaccaggtcaggagatcgagaccaccctggctaacacggtgaaaccccgtctctactaaaaatacaaaaaattagctgggcgtggtggcaggcgcctgtagtcccaggcactcgggaggctgaggcaggagaatggcgtgaacccgggaggcagagcttgcagtgagtggagatcgcaccactgccctctagcctggaagacagagcgagactccgtctcaaaaaaaaaaaaaaaaaatgtgtatctggaagattaagttctaacagactcttcatttccatagatccaataatgcacttagggagatgactgggcatattgaggacaggaagagagaaatgaaaacacagccttttatattgttcttaacagacttgtgccaaacattatacgggtgtatttaggtgattgaagagaagaaaggcacaggagtgaaattctgtgagcacaagggaggagttctacactcagactgagccaacagacttttctgacctgacaaccaaggcggcgcaggatgctcagtgcagagaggaagaagcaggtggtatctgcagctggaagcccagctcccaccccagctgctttgcatgtccctcccagctgccctaccttccagggcccatatcaatgcctgggtcagagccctggggaggaactgctcagttaggacccagacggaaccatggaagccccagcacagcttctcttcctcctgctactctggctcccaggtgaggggaatatgaggtggttttgcacatcagtgaaaactccatcaggagttttctctgatcagcaagaaatataattaaaattcaaagtagatcaacaattttggctctactcaaagacagctggtttgatctagattacatgagtgcatttctgttttatttccaatctcagataccaccggagaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataacttacctcccacagtgattcaacatgaaacaaaaacctcaacaagaccatcagtgtttactagattttaccagctgcttcctttacagacagctaatgtggccactcagttttagcgtctctgctctatttggacattttgcagttctaaaaaaaaatcattgaataatttggactttgattcttggactctcttcaactgaggcaccagaatcccaggtttccagaaatagtgactcactgtatgaatccttatatagcctcagtggttcttaactttcccagtagaggtagctcagtgcatgctacactgctccatttgaattttgcaacattctaagtagtagaaaattctatttatttatccaaatagttgactcagtaaaagctgttcatgtgaagatactaccatggctgaataaatcccattctttttctttcttcaggctatcaacatttcagtggcaaatggttattatggaaacatttgccatttaaaagtgaactaaattatttcttcaattttctctgtgatgcagtagactgtaaaaagattaaagtttgttaaaataaagtacatattcgataaggaagaaatagattattcctaatgacgtctgcaatgacctagtagaaggagtgatagaagcagttgttttcattatttttgtccaaaacttccttccaaatgggatttcattgatcatattcatttattaccacctataagacatgttgacattatgtaacatctgatgtgaagcgctgaggatacatctgtctgtattattcttgccaaaaattaatggtgtgaattgaatcagtagtaaacatcatatacaaacccaactaggaggacattcttcaacatacctggacagtaaacttcaaatgtttgaaggccatgaaagagaaacaaaagtgaaaaactatcacagatttaaagatattaaggacaggataaccaaataaaatacagaaacctgaattttatcttgtaacataaaaaaagtcatcaacgggaaaaatcagtgaaatccatatggtattttaaatgagttaacaaataacattatatctatgttcatttcatggttgtgatacttatgctgtggttatttatgatgctgacattagagcaagctgaaagaggcacatatgggaatcatttttactatatttttcaaattttaggtctaaaagtatttcacctctctcctgcatcctgggattgcctccaattaactacctgcttacaagacttttctttattttctttttgccttttattctttacatgtaaaagatgagtccatctggagcttattttaaagcacagtatgaggactgacattgacctgtttttttaaatgaaataactagctgtcccaaccctgcttgttggataacactgctctgtttcaggagtacccccactgtcatacacccgtgggtccatacccctgggctctccatctgggcactcccctgcctgtggcacctccttcctgagggccggcctcacccagggcccagctgccctctccatggcctgtgtcttcctttcctgatgcctcagatttcccccattctctggcactctttccatcctcctggcctcactctgcacctcccctgaggtgcaggactgccctgccccagcccccagcttcctcactcccaaagccttgtgccactgaagcacgagctccagagtgcacctggatggcagcttctctcctggccaacaaacgcctggtgctggctgccctcccagcatctcccctcaactcctcagctccaccccagggccttaacacacacatgcatagcacacacacatacaaacatatgcacacacagacatgcacacaaatgtacatacggacttacacagacacatacaaatgtgcacacactcgtgcatacacagatgtgttcatgcaaacacacacgtgcacgctcacaggcacgtacacatgtgtaggttatgctaagaaatccattttgtgtggaagacactcaggctcaaatatgtgtccaaagtcacacagctatggagcggcagaactcaggtctctagtgcacacagccccgacttaccgcagttccacttaacagttttcaactttatagtgatgcaaaagccatccacagtcagcagaaaccctcgtgtgagtcccacacggccagtttttcgctttcagtacagcagtcaatgattacatgaggtatccgacacttgactacaaaacaggcttcgtgttgatgcttctgcccaccgcaggctcagggcagtgttctcagcaggccaaggtgggcccccccacgctgtgctattcggtagtcaggtggactcagtcattttccactcgcagcggccttatcgggccgcagccaggggtaagttgagcagtgtctgtacttttagctccaccctgggtatttttaagtggcagatttacaacaaaaaataaaaataaaaatgaaaaaatacagcgttccaaatagtaggggcataaaaggagagaatgcacgttgcggtcagcccatgcctgggagcataagcacttcagaggcatcaccaggcgtgactggctgttgttcctgctcttcctggcagcagcggcctgggcctgagagggatcgccctggccacagctgtaggcaaggctgctgggagccaggagccgccgcgctccgcggtagcgagtctgcggcgccacctcgtgggtgctgcgtggaactccccgtggtgcgggccgggaaggccgggtccccacaaagccggagcccgagcacagcggtgcgagctcgccccaggacatcccacagcacccggagacgggggctggtcccccaaaaccctcaggggtgagaggaaggaggtccccagcctgctgagagctgtcctctgagcacgcactcgcgcacactcacacgtgcatgtgtgcatcctcaggcaccctgacgcgttcacatgcacgtacacgcgtgtgcacacgcacagtctttcacaagagtatgacgcattcacacaagagtgtgacgcgttcacacgcacgcacactccctctccctcgagcctggaaggtgcactgggctcataggggtggaaacctctaccgcggcagaggcacagcaccagggccaggatgctcgcttttatttcagacgtgaaaaccgaggcccgaaagagacagccagtgtccaaccctgtccaacgtctctgctgattgcgcctcctgtgtgtggccggggccggtgtgagggcagcgggcccaccgcatgcctggcccgccccagggcctcgagccacttcctcaggagctgctggcagctgcagcgacggcgcacccagagcccgagggtcccatggagccaggcttcccagcacacaggcacggtggagcctcggggtgggcatacaccccgcgagctcgcgggggctgggcactgcgggtcctcgggtggggactctggagttcagtcttgaaggacacagtcactgagggtcagggaaccaggagggtagggagggtagggaggggtgcctaggcctagtgggagaagcatgtgaaagttccctaagagggctgggggtgaacaagctctcggcccggcctctccgggtagactgctctggtgccctggagcctcccttctccaaggccccatggacgcccccagaggggtgacgccctcgcccacgctgagctctgagtgctgcacgagaactcccagagccgtgtgcacacgcactccccttgttataaccggcattaagtgcactcacattgtcgcatatcccctaccaccgtccatctccagaacttcttcatcttcccaaaaggaaaccatacccactgaacaccaactccctccttttgttaaccattgctctttctgtatttgaatttgcccattctgggcccctcatgtaagtgaaatcgcaatgtatttgtccttttgtggctggcttattccatctagcacaatgtcctcaaggttcatgcgtgttggcacacctctcagaatttccctcctggctgggtgatattataggctcacgcctattatcctagctgttagggagacagaggtaggaagatagcttgaacccaggagttcgagacctgcctgggcaatatagcgagaccgcattttccacaaaaagaaagaaaaaaaagaatctccttcctggtaaaggttcagtaacagtctactgtatgcataaccacatttcgcttgcccatccactcacccatagaccctcagaatgcttctaccttttgactcttgtgaatcacgctgctttgaacatgggtgtgcaaatatctgtgagagagcctgctctcaaaaaaatccatattcttggcaccatgaagaatcacctctcacagacaccagcgaaaagcaagtctgtctgagagcagagggtgaggaggggaaagccgggctgcggatcacagtgggcggaggaaagcccacccttgtgctcccatgtgtgggaggagagaggagagatgccctctagtgaaggaactcttgtagcagccagctccattcctgcttggcctgtggagggccagctcaggaacccagaccaggaagaagtcaaatgaccgacaagatccatcaggaagcagaagtgtgctgtgtctcatcggcaacaacaaacagagctaggaccagccacccaccccccaacccaggggaaatgcatccaccacacaactaccaccgctgcgctcatgacactctcagagacaggcacgggagctcctggcaaggcacaaccagggcaagtgacagtttgccagtcctgggcaagcagacacttatcctctctccagtccccaatcccaccagcctgcacaagcagagaaacatcctgcataaattaaaagatcatccggatcatcaaaagatctgagcaaacaaaacgactgagacaaaaaacaaacaaaacaaaacaaacaaaaaacagaacaacaacaacagaagaacactcatttttacagagagatttgagcccatcccaacagagtacaatgctctttccaagctcatggatggcgtttgggaaaatttagctgtgctaaaggagcaggaagcctcagcccctttcccaagaattgctgttacacaaatcacattctctcaccagggtgcaacaaaattagaaacatgcaataacaaagaccatgttaaaagtgcattttggggccgggcacggtggctcatgcctgtaatcgcagcactttgagaggctgaagcgggtggatcaccccaggtcaggagatcgagaccagcctgggcaacatgacgaaaccctgtctctactaaaaatacaaaaaattagccaggcatagtggcaagagcctgtaaacccggctactagggaggctgaggcaacaaaatcacctaaacttaggaggcagaggttgcagtgagatgagattgtgctactgcactccagcctgagtgacagagtgaaactctgtctcaaaaaagaagaaaaagtgtgttttggaaacaaagttagttttcacaatgaaaattataaaatgcctggaactcaatagcaatagggtattacatattaaaattatgaaactcaacaaaattgacatttagggagaaatttatatcctcagattaatttgtcagaaacaggataaaaggagaaagctcatgataatttgagtaaaagagaaaataaaaactaaaatgaaaaacttttcagaaacaaactacaataagtgtgtgacctatcaaaatctctggatgtgtccaaagcagttctcaggggaaacgttatagctggaagtgtttgttaatatgcttcaacagaagacatataaaattatataaactaagtaaacatacaagaagcttttttaagggaaacaagaaataaatgtatttaattttaaaacagccataataaaagtagacttgataaataaaacccaaaaccacttctttgaaaagaccgttaaaaaaacctctgagaagtcaagcaaaagagaaagaaaaggcacaaattttaaaatgttagatttagaaaaatggcataataaccaacgtggagaagctgcttcaaatcaaggagacgggaggccagcttcattccatgggaggccagcttcattccagtaggttccgtttcacctggatgaaatggaagattttcttggaatgtataaattggcttagcaggaggcagaaaacctgaacaaacagaacaaacagaaatggtaagcaggtgctcgaggggctccatcagcctccagggatgggctgctgtgttagggagggccagagcacaggggaagtggagtgtaattctttctacaagattagcaagctgaacttgaatctcacacacgcacacacaccacagtgacgtggaaagaatccacaggacacttatgagaggtaaaaatagaaagtttctgcacaaaacaatcgtgtgtgtttaaaagataccatgtggcagaaaatagtgatgtttgtttgccagtgtctaggaagaaaccttgaaggcgcacgccagactggcggctgggttggctagggaggagacgatggggtgggagcagctaaggacgacacacactcttttaactctgttcctgcgttgtcgggacgtttacaaactgaagatatatatttttaattaattatttttttttttaaaattttactttaagttctgggatacatgtgcagaacatgtaggtttattacataggtatacatgtgccatggtggtttgctgcacctatcaatttgtcatctaggttttaagccctgcatgcattaggtatttgtcataatgctctcctttcccttgcccccaacccctggatagaacctggtgtgtgatgttcccctccctgtgtctacgtgttctcattgttcagctcccacttatgagtgagaacatgaggtacaaactgcagatatttatacattactttaaagtaattaagttaaactaaactaaatgtaagccaactacatgtaaataaataaaaccaataattaataacaagataaaaataattaatacttaaataattactaatttatttctcagctaaaaattaaaaatttagaaaatgtggaaatgtgtttcataataggaggatatttaaaatgaaagggcatttctgtagtcaaaggggtaggagactcacccaaacaagacacaacctcaaaaccaaaaggaaaactatcaggtttgattatacgaatactgaaaacctctgaatacatgaaaggcaaattctatatcccatgaaactacccttcagaaatgaagagagaaataaagacattctcagaggaagagaatataggaatttgtcactggtcaatttagaaatgctaaaaagtggctacggaaatatgttctgtcatttccacaatacaaaaaattaaaacaaaaaaatcaaaataaaaaaatggctatagaaagttcttatgcagaagggatgaatatgggactatgggaggagggacaaaggaaagacgagaaatgtggatacatacgcgagacaatccacagttcttaaaatcacatctgacgactgaaacaaaaactataccaccacctaatactcaagccagtgatttatacaagtggaaaaggtaaagagacataaatgcaaggcaggtttccacactttgaagtggtaaatactggtaccagtagactactatattacaatacacatattgtaacatccagagcaaacactttaagactatacaaagagatacacgcaacaacattttacagaaatagatcaagatggagggaaagaaaaaggaaacaaaaaagcaaataataaaaacatcaggcataagcaattatgtaacaataagcaccttaaatgtaaatggtctaaataaaccaaaagacagattgatggagagcctataataaacacatggcccaactaaatactgttcatgagaaacttcaaactcacttaaggacctaagtaggttgaaagtaaaagaatggagaaagatatcctgtgaaatcattaattttttaaggaagcaggagtgactatattaatatttcatgaagtagacttcaagcaaaataatttaccagagctggagagggtcttcgctgaattttaagatctaaaatttcctatgctgccttgacatctttgagcctcacagggccccaaaggcctagccgtgggttttcctgtttctaccagacaccccctaccccgccacccaacaggaaaggctccccacctggctagttcttttatcagccagaacagttgcacctcagcctaagaagtttcgcttcacctgtctgccagcccatgaatttattcaaacaagccaattgcattccccctcgggaaccattggtcatcgtgtgctcttgttactaccaagcccgcctgcttcctcagcccgcagccctcactccactacagagtgcggtgcccatctgaccctgtgtggcatgcagtgtcctcctccgagctgtgggtatatgcgactaaaacactgctgtcaatctcatccatccacgccaggtgtcatgttcggccatctcctacactttagggcagggacccctccttcaccaatggggtgaaaaggaagtgaccataacaactgcttaatgacaaaaggattaacccaccaagaagacatctacttcaacatcctcctcttagcaactgttaaaactaggcagaggccgggcacagtggctcatgcctgtaatcccagaactctgggaggcaaaaacaaaggatagcttgaggccaggagttcgagcctgggcaacatagcaaggcctcatctctccaaaaaattttaaatttagccaggtgtggcggcacacacctatagtaccagctactcaggagattaagccagggggagtacttgaccctaggaagtcaaggctgcagtgagtcatgttcgtgccaccgcactctagtgtaagtgacagagtgaaactaggcagaaaaggagcaaggatttacaaaagatctgaacagtcaaccagcaaaatctgacatccgtataacaccccactccccaacagcaaaacacacacatttttaaagccaatagaaatctaccaagatgaggtacacttggggcaataaaagaactcacagcaaatctcgctgtgtgcccctctgcgccggcgccgtgcccctctctgcgccttcttttctcaccatggggaagcgtttgggggcctcttgagggaccccctagatgcttctactcagagcccccaaagccggggagcctccactcctctgtctgcagcctcccctgtcggttctcgctacccagggttcagtggcctgggggtgacggagggggtcgcctctgccaaggcccctcccggcgcctccctggctcatctagcccaccttcctcccacgctggctcacgcaaagtgctctggtcaccaggagcccttcctgaccagccccagccccttcttggccttcgcccacctggcctcccctggagccctgacctgggtgccgggcctgctgggtccagagcccaccccgccctgaacaaccccgagtctcagccaccctcggttcttaccctttcacagctggggagtggagcctgggcctgcacctctccgcgccagagccggcgccagcgcctctccgcgcctgcgccgccgctgcgcgcctcgccgccgctgtctgcctctccgccgctgtccgtctctccgccgcgccgccgctgtccgcctctccgccgcgccgccgctgtccgcctctccgccgctgtccgtctctccgccgcgccgccgctgtccgcctctccgccgctgtccacctctccgccgctgtccgcctctccgccgcgccgccgctgtccgcctctccgccgctatccgtctctccgccgcgccgccgctgtccgcctctccgccgctgtccgtctctccgccgcgccgccgctgtccgcctctccgccgctgtccgcctctccgccgctgtccgtctctccgccgcgccgccgctgtccgcctctccgccgctatccgcctctccgccgcgccgccgctggccgcctctccgccgccgtccgcctctccgccacgccggcgccagcgctgtgtgcctttgcgagggcggagctgcgttctcctcagcacagacccggagagcattgcgagggcggagctgagttctcctctgcacacacttcggagatacagcgaaggcagagcaatgttctcctcagcagagacccgggcgggcgggccggtggcaccgcgagggcggagctgcgttctgctctgcacagaccttgggggcactgcctcgctttgggacaactcggggccgcatggacggtgaataaaatccttcctgtttgcagccctgtttgtggttggtggcagcgatggacactgcagccagccagagcgtagaaaggcgtcggggtaagtgcgctatccaggctgcactgtgggtggcctgggacgggttgggagccctatctcaggcgtcactgcccgtcttgggtggccggttgggtgtgctatctggggctgtgctgcctgcaccgggcggggggtggggggtggtttgggggccaaaccggggctgcactgcctttggtggggagccggttgggggcactatcccagactgtattgctggcaacagtgaggtgggctaagtgtgctatccggggctgcactgtgcggctgtcgggggggtggcggtttcgggttgagggcgctatggggtgctgtaatgcccatggtgtggggaggcggggcagtttgggtatgttgggtgtgctattgggggggtgacactgctggtggtagggggcagggtgggttgggggccatatcaggggctgcactgatggctttagctaggatttctggtactatgttaaacaacagtggtgacagggggcatccttatcatgttccagatcttagaggaaaagctttccatttttccccattccatatgattctagctgtgggtgtctttcctgtagtttttattatgttgcggtatgtttcttctgtgcccgtttctttgaggatttatagcatgaagggatgttgaatttcatcaaatgctttttcggtttcagttgacgtgatgatactgtttttgtcgtttatttggttgatatgatgtatcacattgtatgttgagtgacccttgggtcccagggatacatcccacttgatcatgatgaattatctttctaatgtattactgaatttgattcactggtattttgttgaggatttttgcatccatattagagatcctggcctgtagtttccttctttgatgcttttgtctgattttggtatcacagtaataatggtctcacagaataagtttggaagtattccctcctgtttttcaaaatagtttgagcaggattcgtactaggtctttaaattgtttggtgtgaagccatcagcagtgaagacatcagttcctgggcttttctttactgggagactttttctgatggcttcaatctcattacttgttaccaatctgttctggtcttggatgttttcattgtttaacctaagtaggttgtatgcatctaggaatttgccaatttctactaggctttccaatttattggcatatagtagccagttatgatcctttgaatttctgaagtattagttgtaatgtctccttttttaatctgttgattttatttatttgaatcttgtctcttttcttagcctggttaaaagtttgtcaattttgtttagctttccagaaaaccaacttttcatttaatcttgtatgttttttatttcaattttgtttgtgctacgatcttatttattttcttattttcggtttagtttgttctttactagttctttaagatgtattatttgaaggttttcttttgtttggatggtaggcacttatagctgtaaatctctgcctttgtactgctttctgcataacaagttttggtatactgtgttttcattaccctttgtttcatgaaatttttgaatttctgtcttagtatcttcattgatccgctagtcatttattcaggagggtagtgtttaacttccatgtgattgtattgtttccaaaattgcttttcttattgatacctagttttattcctttgtagtgaaagaagatggccacggagacagacagcagcgtggtcagagtggtaggagccggccatcagcgagagctgctccatgcctggctgctgggtcctagagcctgtggcccactggcttgcctcactgtggttggtggtggtggtgacagagactgcaggacgaccagatggtaggacaggggctatccagggctgcacctttcgcagtgtggggtgggttgagggcgctatccagggtgtcattgcctgcattaggggtactggttggtagcactgtacagggctgcactgcccacggcagggagggtgggttatgggtgctttctggggctgcaatgcccatggaggaggacaggttagggcactatcggttatacgctactggcggcattgggggacggaggtggggggcgctattgagggcaggactagcagtggagcgggggcgagttcggtgctatcaggggctgcactgctggtgtcggtcaacagagttggcatcccaggaaggagtggttctcctctccctgactccacactccagagggcgacccactcttggtcatactggagtgcagcagggcacgcagcgtttgcgtgggaatcctgagcatggcagagcccccacacccaccgtggttcctggttcctgggcctgtgtactgtgggtctgtgcctcagaggctgccaggcacccctggggacaccacgggggacagggccctgtgcgtggaggcgtccggaacaggaattggcacctgggtgtggagggctggctgggtctgaatttttctgcttctcctgctccccgaggagtgcagccccagtgggcccaatggttcctgtggagtggggagctgggtgctgtggtgtctccagcacccaccccagaccccagttcctgcccagcttgggccaaaaggagaggctggactttggagggtgggtgtgagtgcctttgctgaaactggcccctgccacccagtggccggcatgacaagttgaggctctaacccttccacccctcacgtctttctctaggcttttctggctttgcccgcccagctgctctgtgccaggaagaggaggagacacctagagcctgcgacaccatggctcgcctcgctgcgggtgggcggcagtgacggagactgcagtgcgccagagcggtaggagagcggctgcgctaggagggcaggcggctgcagccagggttgggggtcaggcttagagcgatggacgggctgcagcagtggccagatggtaggagccttgtaaggagggctggtgcattggcaatgggcctggctttgccctgcgcctgccgtggatctggccctgtactgccctgccttgccctgtacctgccctactgttacttggactctcggccctgtcctgctctggtcccatcctgaccctgtcttggccctgtgctaccctgtccctgccctggtcttgccctggcactggctctgccctgaacctgcactggcctgaccttggctctggccgtggctctggccctgcctcttgtcctgaccctggtcgtgtcatggcactggccctgccaatggtcatggtcctgctcctgttctggccctgacctggccttggacatgtcctggccctgctttggcccatccctgccctggccccaccatgggcctgcctgttctgccctctcctggcactgaccttgccctgtcatggcccagtggtgccattgccctgccttaccctgcgctggttgtgacttggccccgcttggtgctggccgctccctggacctgccctggacctgccctgaccctgcccttggcttttgccctgccctcactgtggcctggccctggccctagccctggtcctgccatatccctggccctgcccttatccaggccctgcccctgctgctgccctggccctggcctggaacctggtcctgtcaaggacctgccctgactctgccatggccctggccctgctctgccttgttcctggccctgacccagacccagaccctttcctggctctgcactggactttccctggccctgagctggcaatggtctgcccctggtcttgccatcaccctgccctgctgcgctctggatgtgtcatcaccctgccctggccctactctgcctttgaccctgccctggccttaccttggccctcaccctagtcttcgctagaccctgctctggagctggccctagcacagacctggccctgatcctggccgtggtctttgtcctgccatagccctggccctgaagtggacttggaggtgtcctggccccggcataacatggctctgcattggcctgtccctgccctgccgctaccatctccttgccctgctctgtcctgtcccagtactgtcccggccgtgctatttcccttccctaccctgccttggctgtgccctggctcggttctggccctggccccggccctgccctggacatgctctgacactgcctcagcctcggcactagcctggctctttcttggcatcagctctgctctctctgtggaccggctcttgtcctgtcctgcactggccataccatgccctgccctgccctgccctgactcagtcctggctcagccctggcccaaccttggccttggcattgcccctggtcatgccatatttcttgccctgtccctaccctggccttggccctgacccttaccttgctgtggccctgcccttgccctaacgcagcccctggccctgtcatggccctgccctggacctgtcctggccctggcccttccctgcttgagaacttgccctggttctcccctggccctgaccctgaaatgcctggccctaccctggccttgcactgctctggcccttgccctgactctggtcctgtcactggcctagccccagccctgttgctggtcttaccatggcccagaccctgccttggccctgccctgacactgtcctggaccctggctgtgccaagaacctgcactgtccttgccattgttttgctcctgccccgaacctggtcttccccaggccgtggccgtggccctggccctggccctgcccaggtcttggcactgtcctggccccgccctgccctggccctatgctttcctggccctgccttgccggccctggccctgccttggccctagcctggctttgaccctgccctggccctaccttggccttcaccctagccttacctgggcactgtgttggacctggccatagcacagacctggttgtggccctggtcctgccgtggccctgtctcagaccctagccctgccaggtacctgtcctggcccagctctgggcctggctttgtccctggttcttagatgaacctggtcctgctcctgcccttgctcttgccctggaactggccttggacatgtccatggtcctaaccctggccctgcccaggagctgccactgtcttggctgtgccctggctctggccctgccccggccccaaccatagacctgccctggttggtcgtgaactaccttaaccctgtgctaccctgggcctgctccaccctgccctggccctgccctccctttggccctgccctgaccctgccttggccctcacactggccctagcacagacctggtcctatgtgtggccttggcctggcattgacccctgctcctgaccccggtcctgccatggccctggccctgccaatgaccctggcagccctggccctgtcttggccctggccctgaactggccctgccctgaccctggccctgaagtggatttgcaggtgtcttgtccctgatgtaacctggtcttaccatggccctgtccctcccctggctctgtcctggccttctgctgaccctgacccagaccttggccctgccccagccttgtcctagatctggccatggccctgcgtctgccctggaccagcgctggcactggcatggaccctggccctggcccttcgctacttaaggccatgccctggcccagccctggtcctgaccctgtcctggccctaatttggcgtggctctaccctggcatgctattctggccctagccctgaccctgtccctgtccctgtcctggccccagccccattgctggtcctgccacggcccttgtcctgacattgccctttcctggttctggccctggccctgtcccagccctgctctggccctggtctgaaccctggccctgcaatagacctgccttggtcctgcccagaccctggctctggccctacctctgccctggccatacccttgccctggcctggaccccagtcctggtccttgtcctgccccagccgtggccctggccctgccctgcctgtgccctgttctatcctgggctggccctgccatggcctggtcttgccattgccctgccctagcctgccctgcttgtgccctagacctgccccggcctttgcccctgtcttggttctagccttgactgagccctggaccttccctgatcttgcctcagccctggcactaccctggccttgccttggcatttgccttactctctctatggcctggctctggtcctgccctgctctgctcttgttctgtcctggcacagccctggccctggccctggccctgccgtatcactggctctggtcctgcccttatgcagacctgaccctgccactgccttggctttggcctggaccttggccatacagtgaccctgccatgaccctttcctggccctggcctggaacctggccctgccaaggactcgccctggctctgtcatggccctggccctttcctggatttgggtgtgtcctgtcccttatttgccctggcccttccctggctctgccataccccttctctggggtagggccagggtcaggaccagaccagggcagggtcaggaccagggtagggccatggtaaggcctgaagatgggaagggccagggcagcggctggaccagggaagggtcagggccagggatgtagtaggactaggggcagagccggcactagggctgagccaggacagagcaggagagattacattgggctattacgtaaaatttttattttagatttttaagataactatagtagtagtaatgtctatactatattgtttgtaatagtaataatatttgcagtaatcactaaattttaactaatactatctttgcttccagtagtgttctatgagtataattttatcaatatgttaatatgtgaggcattgattctcacaataattctatgtgctaggtacttaaagcatccccattttccaaatgtaggaaacaggcataaagaagttaaatacttggccagattactcctgtaatcccagcactttgggaggccaaagcaggcagatggcttgagctcaggagtttggaaccagcctgggcaacattgtgaaaccccatctctactaaaaatgcacaaaaagaactaatttaagtttcttgtaggattctggttacaaaacactggtcaaacacacagggcatggatagggcagggccagggacaaggtcaggccaggaaggggccagggccaaggcagggccagagatggacttggaagtgtcctggtctgatttgccctgccccaacgttggcccagccctgctctggcacttcctgtcatgccctgtccctggcctgagcactggccctggccctgtcctgcttctggccctgccccggagttgaccaggcactgccatggcccagtcctgcattgccctgccctcctctgccctggtgctaccatggccctgcttgggccctagctctgcctctactctggacctgccctgactctgctcagccctggatctaccctgactctgccttggtgttgccctcccatctctatggcctggctctggctgtgccttgcatagatcatgctctgccctgcgtgtcccagcctgggcccagcccttgtcctaccatattcctgaccccagccatacccttcttctggccgtgaccctgccgtggccctctcctggcccttccttggtcctgccctgcccttccatgccctggccttgccctcaccctgcattggccctgcactggtcctgccctgccctggcactgccttggccccggccctgccttctccctggtcttgcctttgccctgccctggcctgaccccaggcctaccgagtccatgaaatggccctggacctgccttgccatcgtctgtcctggccctgtattgtccccaccatgctctggtccagcgcttgccctggccctgttgctagtcctgccactgttatggccctgccctgtttttggccatgccctgtgctaccctagccctgccctgccttggccttggccctaccatggccttctcctaccctggcctggccctacactggccttttctaccctggccttgcccttcccctggtcttgccttgccctggccttgccctgccctggccttggctttgccttatcctggtcctggttctgccctgaccctggccttgctctggatcctctctggttctgctttctccctggccctgcccttgctctggccctgtccctggcccagccttgaccctgaccctggccctgacaatccccaggtctgacactggccatgcttggccctggcccctccttttggccctgccctggccctgccttggccctgtgctatcttagtcctgccctggccctgaactcaccctggccctaccctcaccctacactggccccgccctaccctggccttgccctgccctggccctgcctttggcctgctctggctctggttctgccctggccttgcccttgccctggaccctccctggccatgttttttccatggtccttctctggccttgcccttgccctgtcccctttctggtcctgccatatttctggccctgtcctgtccatgtcctggacctgactctggccctggacctccctgtccctgccctgccataccctggcccgttccttgctctacactgaccctgccctgccttggccctgtgctaccctagccttgccctggccttctgctgaccctgatcctgccatggccctggccctgccatgtccctgccctggccctggttctgccctgcttctggccctggccttggtcctctcatgtccctggccgtgaccctgcccctggtttttctctggccatgaccctgcccctgttctgtcctatccctggccctgtcttagttctgtcctagccctggcttttcacagtactttatgcttagtaagggctccatggtgtctgtgagttgaatgttgtgttcatagtatctgccaaaacagaaagaaaaaaaacaaaatattttgataagaagttaaagctttgtatataatatgccttgaattgtaaatgcctgttattagttgtattacatataggtcatggttttgtacacataactccaaaccattgatactgttaaaagaatatatgaatatatgaaagaatgtgtaaatgtaagaatgtatcagtatctaattacctttccaaattaatttttatttttagctctattagatttttctcagtgtaacaaatgtttattcctatgtaattaagggcgtatttcctgtacagaatattcatattacctaattgaaaattatatgatacaaaaatataatactatttttaggccaggcatggtggctcatacctgtaatcccaacattttgagaggccaagtttggagaatcatttgagtccaggagttgaccagcctgggcaacatagtgagaccttgtccttattaaacaaataaataaataggttgggcactgtggctcatatctgtcatcccagcattttgggttgccagtgcaggaggattgcttgagcccaggaatttgagaccagcctgggcagaatagcaagactccatctctacaaataataaaatattaaccaggtgtggtggtgcgcacctggggtcccagctacctgggaggctaatgtgggaggttttctcgaggctgcagtgaactgtgaatgcaccactgcattccagcctaggccacagaacaggaccttgtctatgaataaagaaataagtaaaaatataaataaaaataagtaaaaagaaatattagtaaatataaatataaatacatataaacataaaaatgcatgcatgaaaagaaacaatttttaaatttaacatcactgagggcatcctatccatttcatttcatgattccattatgtcatttcacttagatgaaatgataagatgacttgagatgagatgaaatgatgagatgaaatgacaaaatgatgagatgagatgagatgatgagatgaaatggagagtggaaatgagatgaaatgatgagacgaaatgacaaagctgaaaagaaattgaaaggagatgagatgagatgaaatgagatgaaatgatgagatgatgaaatgatgagatgaaacgagatgaaatgatgagatgaaatgaaatgaaataatgaaatgatatgaaataatgaaattgaaatgagatgagatgagatgaaataatgagataaaatgagatgaaatgagatgaacgatgagatgacatgatgagatgaaatgagatgaaaaatgatgagatgaaaaatgagatgaaatgaaataatgaaatgaaataatgaaatgagatgaaatgaaataatgaaaggaaattatgaaatgtaatgaaattgaaatgaaattgaaatgagatgagttgaaatgatgagatgtaatgatgaaatgaaatcatgagatgagatgaaatgagatgaaataatgagatgaaatgagatgatgagatgagatgaaatcatgagatgaaatgatgaaatgaaatgaaatgatggatgaaatgatgagatgaaatgagatgaaatgtaatgagatgaaatgaaatgacataatgaaatgaaataatgaaatgagatgaaatgaaataatgaaatgatgaaataatgaaatgaaaatgaaatggaaatgatgagatgagaagaaatgatgagatgagatgagataaaatgagatgaaatgatgagatgaaatgaaatgatgagatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgacataaaatgagatgaaatgtaatgatgaaatgagatgaaatgatgagatgagataaaatgatatgaaatgatgagatgaatgatgagatgaaatgatgagatgagatgagatgatgagatgaaatgatgagatgaatgatgagatgaaatgatgagatgagatgagatgatgagatgaaatgatgagatgaactgatgagatgaaatgaaatgaaataatgaaatgaaattgaaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacataatgaaatgaaaaaatgaaataatgaaatgaggtgaaattaaatgagatgatgaaattaaatgatgaaatgaaataatgaaatggaaatgatgagatgagatgaaatgacgagatgaatgatgagatgaaatgagatgaaatgatgagatgcaatgatgagatgaaatgatgaaatgatgagatgagatgtaatgatgagaggaaatgatgagatgtaatgaaatgagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgagatgaaatgagatgaaacgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaatgagatgaaatgaaatgatgaaatgatgaaataatgaaatgaaaatgaaatggaaatgatgagatgagaagaaatgatgagatgagatgagataaaatgagatgaaatgatgagatgaaatgaaatgatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgatgacataaaatgagatgaaatgtaatgatgaaatgagatgaaatgatgagatgagataaaatgatatgaaatgatgagatgaatgatgagatgaaatgatgagatgagatgagatgatgagatgaaatgatgagatgaactgatgagatgaaatgaaataatgaaatgaaattgaaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaaatgaagtgatgagatgaaatgatgaaatgataagatgaaaagagttgatgagatgataagatgaaatgatgagatgaaaagatgtgatgaaatgaaatgatgagatgaaatgagatgaaatgaaattagacgaaatgtaatgagatgaaatgaaatgacataatgatatgaaaaaatgtaataatgaaatgaggtgaaattaaatgagatgatggaattaaatgatgaaatgaaataatgaaatggaaatgatgagatgagatgagatgaaatgacgagatgaatgatgagatgaaatgagatgaaatgatgagacgcaatgatgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaatgagatgaaatgaaatgatgaaatgatgaaataatgaaatgaaaatgaaatggaaatgatgagatgagaagaaatgatgagatgagatgagatgaaatgatgacatgagatgatgacataagatgagatgaaatgtaatgatgatatgagatgaaatgatgagataaaatgctatgaaatgatgagatgaatgatgagatgaaatgatgagatgagatgagatgatgagatgaaatgagatgaatgatgagatgaaatgatgagatgagatgagatgatgagatgaaatgatgagatgaactgatgagatgaaatgaaatgaaataatgaaatgaaattgaaataaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaaatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacgaaatgaaaaaatgaaataatgaaatgaggtgaaattaaatgagttgatgaaattaaatgatgaaatgaaataatgaaatgaaataatgaactggaaatgatgagatgagatgacatgacgagatgcatgatgagatgaaatgagatgaaatgatgagatgcaatgatgagatgaaatgatgaaatgatgagatgagatgagatgtaatgatgagaggaaatgatgagatgtaatgaaatgagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgaaatgagatgaaacgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaataatgacatgagatgaaatgaaatgatgaaatgatgaaataatgaaatgaaaatgaaatggaaatgatgagatgagaagaaatgatgagatgagataaaatgagatgaaatgatgagatgaaatgaaatgatgagatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgatgacataaaatgagatgaaatgtaatgatgaaatgagatgaaatgatgagatgagataaaatgatatgaaatgatgagatgaatgatgagatgaaatgatgagatgagatgagatgagatgatgagatgaaatgatgagatgaactgatgagatgaaatgaaatgaaataatgaaatgaaattgaaataaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacataatgaaatgaaaaaatgaaataatgaggtgaaattaaatgagatgatgaaattaaatgatgaaatgaaataatgaaatggaaatgatgagatgaagtgacgagatgaatgatgagatgaaatgagatgaaatgatgagatgcaatgatgagatgaaatgatgaaatgatgagatgagatgaggtgtaatgatgagaggaaatgatgagatgtaatgaaaggagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgaaatgagatgaaacgagatgaaatgatgaaatgatcagatgagacgagaagaaatgatgagataaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaatatgatgagatgaaatgagatgaattgaaatgaaatgaaataatgaaataatgaaatgagatgaaatgaaatgatgaaatgatattgaaatgaaattgaaagatgagatgaaatgatgagatgaaatggtgaaatgttgaaatgaaatgatgaaatgaatagatgtgacatgaaatgagctgaaatgatgagatcaaatgaaatgaaatgagattaaatgatgagatgaaaaatgatgagatgaaaaatgatgagatgaaatgctgagatgaaatgagatcagatgaactgagatgagatgagatgaaataatgaaattaggtgaaataatgaaatgatatgaaataatgaaattgaaatgagatgagaagaagtgagatgaaatgttgtaatgaaaggaggaaatgatgagatgaggagatgaaatgatgagatgaattgagatgaaatgagatgaaaaatgatatgaaaaatgatatcaaaaatatgagatgaaatgaaatgagattatatgaaatgacaatgaaataaatgaaattagatgaaatgaaatgaaatagtgaaatgaaatgatgaaatgaaataatgaaaatgaaatggaaatgcgatgagatgagatttggtgaaatgatgagatgaaatgatgagatgatatgaaatgatgagatgagatgggatgagatgaaatgagataaaatgatgagatgaaatgatgagatgaaatgatggggtgaagtgatgcactgtcacgtgtgtgtctattctttttcccaagcaacaaaaattataattcattaattttaattttattatttaagaatattcttaagagttgaaggaaaaataatatctgtacattatgggttacaatctaagtataaataatacataaatatattaaaacttacaaagaatatgttttggaatcgaatataccatgcttctgtgatgacagttatttcatgctggttgtcacaattttacatgaaaaactaatgaaaaaatgtttttaactgtttctaaaaataacagtttccaaaacagttttacattcgaaatatgaaaaagttgtctttgtgttccttaatctgatgagattttcacactctgcacatgataattgttagatttttattgtgttgataaattgtatatcaaataaaaaatgttattacctcttaaattaggatttttaggtgatataggcagaaaggacagcaagtttttataactttgtctaaatgaactttctaaatgcctgagtattaaaagatagcatgtctataaatcacaatgtatatattactgtatgacctaggaccaatcaaaaccgttacctctgataacattatattgtgcccagtataaaatagatataataatacctcaaacttaaatccgggcattgtcattgaatatcttaagaatatgcaacaaaggtgcttttaaaaatacaagctagtgattgtaccaaatttgtaaatcacataggatagtgggtcattttaagaatattagttatttcaatctataaacgtggatgtctttccttttttgtgttttctttaatttctttcattaatatttgtcatttttgttgtcgaaatcttttacttccttggttaaatttatttctaagtacatttttgtagctattgtaaaaggaattgctttcttaatttcttgtttcagctagtttactatcaatatatagaaatgctactgatttttgtatgttgatttatatcctgcaactttattaatttcatgtatcaccctaagaagcttttggtagagtcttatttttttccatgtataagatcacattgtctttaaacagggacaatttgactgtctcctttccaattcagatgtcctttatttctttctctcacctaattgtcctggctaagactttcactatgtgaaatatgattggtgagaataggcatccttttcttgttccagtaaaatctttttcttgttcacagtaaaagctttcaccttttccacactcagcatgatcttagttgtagatttgtcctttatgtccttctgttttaaggcatatattttctatactaaattgttgagaggttttttgtcatgtaagaatatttaattttgccaaacgcttttattgtgtttattaatttaatcatatggttttcagtatatatccaaaggaaagaaaatcagtatatcaaagacttacctgcacccccatgtttattacagcactattcacaatagccaagatatggaatcagcaaaagtgtccatcaacagatgaatggataaagaaatgtgatatacatatataatggaatactatttagtcataataaagaacaaaatcctgttatttgtggcaacaagaatgcaagtggagggtattatgttaggtgaaataaacctggcatagaaacataaacaccacataactacgtgttctcacttatgtatggaagctaaaatttttaatctcgtagaagtagatagtagagttttggttaccatatcctggaaagagtaggagaaagaagagtataagaaaaatgtggttaatacatacaaaattacagctggagagaaggaagaagttctagttctctacagcactgttgggtgactgtagttaacgggaatttattgtgtgttttcaaataactaaaataaaagattttaaatattctcactgcaaagaaataatacatgatttaggtaatggatatgataatgactctgacttgatctttacgcattgcataaatatatcaaaatatcactctgtaccccataacatgtacatttattatatgtcaattaaagtaaatttaaaagagaaaaaatgaggtaaaggtaaatatacataatttaattactttttcttctataaaacccgagtcagtaccaagaagagtcaatttattagttttctaaaataaaaaaaatcaaaatcaccaaaaaagagcaatatccaagaaaacattgaaaatgaaacacaacattcagtaagaatagaaaacttgggcaccgtatcaccctgttcctagataccgatttactgatggccatttaaatagaattttattctatctaattcatttatactcccagagttcgaaattacattttacctacaataaatgagataacacttgtaaattatatggtactctgcctaacacacgttaataactcaatacatgttagcaataagcttttaatatagtagtcaaagtattaatttctcacattgcaatttccttcaaagacatgaatacaacctttctaatgactccttgttcatcaagatacctcttcaaattattctatttgtttcattcagtatattatctgtgtataccgatattacactcttttctttttttgagatggaatctcattctgttactgatgctggagtgaggtggcatgatctcggttcactgcaacctccacctcccaggttcaagcgattctcctgtctcagcctcccaagtagctaggactacaggtacataccacgatgcctggctaatttttgtatttttagtacagtcaagagtttcaccttgttgtccaggctggtctcgaactcctgacctcaggtgatccacccaccatggcctcccaaagtgctgggattacaggcataagccaccgcacccagcctgatattgcactcttggattttgaacactgaatatctttttgaaagattacacctctttactttgtgcttcagaaattattttccttcaagtgttctaagagtctaatgaagaatgaagtcatgttttatcacttttgtccttaaagatttcagacatgctgaaactgattgaagtatcatttgctactagatagattaattatctccagttgtaggagtggatacatctttaatggtatattttgggttattgtcttatttttgatgcagtattctataaataatttattaaacctggcatccttgggtgagcacagatttttcaactttggtgttatattgtgtttgcttttaaaaactgcttctgaggccaggtatggtggctcttgcccatacccagcactttgggaggccaagatgggtggattacctcaggtcaggagttcaagaccagcctggtcaacatggcaaaaccatgtctctactaaaaacacaaaattagccaggcatggtggtgcatgcttgtagtcctaaccactcgagaggctgaggcaagagaatcacctgaacctgggaggcaaaagttgctaggttgctgtgagccaaattcgcaccattgccctccagcctgggtgaaaagagcaaaactctgtctcaaaaaaaaaaaaaaacccaccaaaaactgcttttgaatggagttgtacatataatttttatgaaaaaaattaacaagtgcataagttcataatagaaaaaccaataatactccaggcacaagttagtactaaaaaaattatgttgaatattctctaatacaacatgctttttcccttcatgaacaatttgtgttttactgagaagagtcactgtttatggtagacattagactacagatgaatatgtactttaaacactcttagttgctttcttaattttatatctgctgctttatgcttctgtttattttcattctttccaatgtccacattctagtaaatttgaatattttaatccaagtttatatactatttaatattgcttgtatagtttagtatttttaagactcaaaaaggtttacagaaagaagaaaaagatcaacatgttattaatcatttaaagatcattttgaaatctttgacctttatattttaatgaataaaatattagtagttattagtataaaataatttatgtcttttggacttagcatccagtatttcttttttaataaagaaaataattattctcttgcaatgtactatgtttatctgggttttgaaaagtgatgtttcctaatatgagaaagccatttacagttttaaatctacaaaggcaaatggaatggtactaaattatttacataataatgtttagatggtggcccttataacattctttctatacttcctacagagttggggatatgcaatcctagaatatttctgggagctaatcctttagcttgatgaatgaaacaagacttttaaataaaattaaactttcaaattatccaggtaatgggcctgtcttttaattcaatggatatggagcataatgaattaacccctgttcattgggtaataagttctcattcttataatactcaaaatgtcctttaatttttaatttttgatagtcatatcattatccctaggtattttagcttctatcttaaattctaaaataattttgaaataggagaaagtattctttattactatatgtattaaacatcatggttttcaaattgaactgcaaatgtatcttttcattgcttcttgatgacacccttcaccctatccatattgtcactaccaagtggtgattacttttcaggttcacatacttattcttcagaaaaatcttctctgtgccttataaagaatatgattgttggcattcaaaagccagcgaagtatacattattagcctgttgcctaactcatttctttaagaaactacactaattacccacatacttatgtttttatttcctcattatttctggagaaaacaaatactgctaacatgatatttgtaagagagaaaaaagtcttttcttgaaaagtgctgtcattgtagtactaacttatagtatcaacttctttataaactccttagacactttttattctgagagaaataaaaaagctaaaagtcaaatgactttttttactctccttattataagcacccatcttggtaatttagggtctttatagttagggtaagttgtgtcataccgaggttacaaaataaaaagtattttgtctttttgggcctttccttattcagtaatactgtcagtttggctttttttgtaggtcaacttattgaactcagtattctgaaataatatgtttactatcttttgagaagcacttaaaatattagatttattgttactcttctgcctttattgggctggaagaataattgtttcactccacaaaaggcaagttgcggagaaaaacacatagacattcaaccgcaaagcagagaaacttgactattttctgcaattttaaagtgtatattgaataaaaccatctttttattttcttttttgctcactggcaaatattaacaacatcaagtgtattattataatgttatctagttaaaaatctcaaaaagttttcataattaccattttaaagtatataaataggtgacctaatgttaatttttattgtctgagaccatgtctgttatttcactctttaaattcagttagtagtgcagaacctagcacttagtagatactcaaaaattatttgctgaataaaaaaaggttaaacatgtaatatatacaaaatgtactggaaaaaaatgcaccaaacaattttgttataccagtttaatgtaaatattgcctttaaaagataatatagttttcaggtgtctacagtgattttgtaatatttgtgcacatataaaataatatttccaaaaatgtaatccagtggggaaatatactttctaaattctagatttataatttagggtttaaattataaaatcattaaataagacacaagtgaaatgtagtcaaatatccccttggaaaaaaattaagtggcctctaaagtgaggtattcatatatgtaattttacaatcctctagtgatagaattaattaaatacaccaccaaattgattaattcctactgtgttaaaagagaagcactaacaatgccagttaccatgtaacatggatttaagctacaagtcatagaaatgtgatgagaagcctcagcgctgtaaaacagagggtggaggaaagcttttcctctctcaaatgagctttgcgaggtatacttcttgaaggataggaagttgaagtgttcaggacttttatgtctattctactttggcttagtttacatgattcgtagtttattagcctagaaatggccaagaaaacttaaggttcaataattagttataaatatgaaatatccccgatttttaagataaaaacaacttataaatgtatttgtctgtaaaaattgtgtatatttttacagaacatctatttctttttttatttttttatatttatttattatgctttaaattctagggtacacatgcacagtgtgcaggtttgttgcatatgtatccatgtgccatgttggtgtgctgcacccattaactcatcatttatattaggcatatctcctaatgctatccctcccccctccccccaccccacaacaggccctggtgtgtgatgttccccttcctgtgtccaagtgttctcattgttcaattcccacctatgagtgagaacatgtggtgtttggttttttgtccttgcgatagtttgctgagaatgatggtttccagcttcatccatgcccctacaaaggacatgaactcatcattttttatggatgcctagtattccatggtgtatatgtgccacatgttcttcatccagtctatcattgttggacatttgggttggttccaagtctttgctattgtgaatagtgctgcaataaacatacgtgtgcatgtgtctttatagcagcacaatttataatcctttgggtatatactcagtagtgggatggctgggtcaaatggtatctctagttctagatccctgaggaatggccacactgtcttccacaatggttgaactagtttacagtcccaccaacagtgtgaaagtgttcctatttctccacatcctctccagcacctgttgtttcctgactttttaatgatcgccattctaactggtgtgagatggtatctcattgtggttttgatttgcatttctctgatgggtctatttctttaaaacaaagggaggggagtctctcatttgcattagtttttttcatagccttttgaacttcacaatttctatgtttcagaacctatttcttacagtttttctatgctaaactctgtcctagtcagttctagagtgtatgaagaaccaaatgatgtaatagtatgccacctggctgtagtggaacaaatttgactcttaagtatgcaggctctaattttcctgtctggttttggcaagtattccttacataggttttttctttgaaaatctgggattgagaggttgatgaatgaaaattaatcctttcacttttttgtatataggtttgcaataattaggtcagagtggagttttaaggtcacggaggggtctgatgacttacaaataatgggctctgattgggcaactactcatctgagttccttccatttgacctaattaagcttgtgaaatttacactaagccatgagctcatctttaaaaagttttattaaaagattttcagctgttccaaatgggacttattactggaatgtgttttaaaggatcatatcagatgaatgaaaggtatttgatccttcgtttccttaataataaaatgatggtttggaaaaataggctacagtctaaccacagtgctattattaggctttcttgttaaacataggtctaagcctaagtatgtcaatacaacaaatacttactgtttcatttctagtaatgaaaaaaaaaaaaaaaacaagtctttctggcataaggatgattttcatctggttattttgaaacatttttgtaaaataaatttccatctataaagaacatttttatttgtaaggaggggtatgtctctgtgcactggaagagagggaggactaaatcactgggaagtcttatgataaagaagccattggcttaaatcagcgaagcaagccgtcccttggtttaaggtgtttttcctggccatcctgtcttgactagaactttacctacaccttcctttttggtttaggcaaattatagtatctaaaactaaagtctcagctctgtgtctttgacatataaatgttctaccatgtcttctctggaatctgataactatctatctctttaaaatgcaagtctagggagatgactcatcagaaaaagaagaaaaaagaggtatttggaaattgtgcaaattaaagcagcccctgatgtcaaagtctacacattcctgagtgagtcagttctggccagttctagctggatcaagagagctcttctgggcaggcctgaagagcacctgaatggcagccacctgaggagccaggtgcctgaaacttccttcacctgcttgaggagcgccaaagcccaggtgctggctggacaaccacttctggctgcctaagcagatggcagaagaaggaaacaaggtcagaggcagagtattgaaccctgcctcccaggtgggtggaagatgcctgtcgccaaactagggcccagcttgccgggtgagatgggtgaactggtgatcccccgagagagtggacgtcagaactacatgttcctggacttcacctcggccagcgaaggagagagagggttaatgttaactgcacgaggcccactctagccttaaattctgtaattcaaacccttcccttggagacaaaacaaacatgacaaggaattctgaggtcaggggacaagaatcacaaagtgggagattgaggaggcagtgtccttcctgcccttggtctactggctaagaaccttcctcagcctgacctttgcacattgcactttcagctctgtttgcaattttcctcctttagtgctgagggaatcccagtgttccatcctgaaatctataggttcctaatgggtggttaaaaaaaaacctcagcgagagaagcagaaaatgtttcctcttcctgaaaaactgtagaaaggcaggcaccattctgggtgaggacatggtccttgcaaatgtctttgtgttgtttttgtttttgttcttgtttttgagatgaagttttgctcttgttgcccagactggagtgcagtggtgtgatctctgctcattgcaacctccgcctcctgggttcaagcagttctcctacctcagcctcccgagtagctggaattacaggcacctgccaccacacctggctaattttttgtatttttagtagagatggggttttgccgtgttggccatgttggtctcgaactcctgacctcaagtgagccacccgcttctgcctcccaaagtgctgggattacaggagtgagccaccgcgtccagcctgcaaacgtctttaaagacagcgtgtttcagaggctgtgacagtgccctgtgaacatgccaattctcacagtcccgggagctctgaggagcaggcccggctccttgccaggctgatggtactgaaactctgctctccaagacataacctgatggccatgcaagatttcttaatcgactgtggaccgtgagagtctgcatctcattttaattaagatgggaaaagaaagaacaaaagagcaactcccaggttatagagaaagtggattttagtataatattcaagtgtagcattgctaataataacaaacctttcccctcccaaacggtaaacacttgcactgcctattatacaaaaattcaaccaccctctctgttaccccgatatctcctccccagtgaccccccctctcatgcggcctcatgagcctggccagtggtgaatggcactttcatgggcatgagactccacgtgagtgggactcagctgggacccctctccacgtgggagctggggaagccaccctagtagcagctcaaagtgtccgtgatgtccctgctgctgaggtaggggccgcctctgagctggtctcggggtgtgagctgctgctggtagtgggctctgccctgagggcctggtggctggtcagaagggcaggcacacatgggtgactccccaggaactcaggccacctccccaccacagccctgcactgtgtgctccaggcatgtgctgagtgcctggtcaatcaccagtgccctattgatcccagtctccagagagagcatttagtgtcactccacagaggggaaactcggcccagagaagtaaagtgactctccccagtcacagggctggtcagcagtaggatgggaggctagtcccttgctgtctgactccctgagcccacccatatcccaaggcagccaacctctgcccgccctggttcaggccccgactggcccctgtggtgggtgatgtctatcttcctggcctttgtgctcccagccaactgggatggagcctccagctggcatgacaggttgtagctacggacagaagagtggctgtgaggctgccaggaatctcaccagggccccctcccagggcctgtccagagtgaggtctgggtaccccaggcattgccagaccacaggatctgatgttggccaagaggccatggccacaggctttctgaggctggcccccagggagagttcaatcctactatcccaattcctgtcctggccttacctctcagtctcaccgagccacttcatggtcccaaaccaggacccaaagtgctgcttgggctcaaggttgtaattatttgcagccaactggagcagtggacctccttgcttactttgaattcctgggtccagagggaaaaactgggtgatgacagggactggacagggatgccacaggggccctgtgggggtgttagatggggtggtggccagtctttgctcataggggaccccctcctcctctccagtcctgtccccacctgttctcagagctggctcaaacagcagctcctccaggaatgtgtccttggtttcaacctggtactcccacctgcaggtcttcctggagtgtctcctctttctctctgtctccccataaatctaagacgagggggatggatctgcccactgctactcaccgtatgactcttgtgaggttgatcagtctcccctggaaggccaacagctgaagtccatcagaaagggtcctctggcccagagccagcccctgcccacccctgtcttgctgcacccagggtgcaagacccagatcaggtctgggtgacaggaggggtatagaggggctgaggctcaggggccttctagcctaacttgtctggagacagttggggaaactgagaccccaagcagggaggtatggctccgagagattattctcattaatctggaacatttttgcaagctgttaggtataggaagtctgtcacaggtaagagaaatgctttttaagagcatgagagacagcagggttgtgacaatattgaaacaccaccgtgcagattcaccaattgccaccaccgggagccccctgagagtcattgcagatgcacagccctcccctgcaacccctggacctccccgtggtctggcacctaaagggttatgcctcatggcaggaatcaggaccctcagggtgccctgcccactccaaggtctgcctctgctctgattggtcactgacattcagattgtcacccaaatataaggacattagcagaaagactcattcaatacaagtggactcagacatagataggaattgggttgcaagaagccccttttgtttcttttattttattttggaaaaaacttttattgtgaaaattcacatatatatatatatatatatatatgtatatataaactcaatcaatgcaaaaggatagacaatgaacaaatgaattccccttccactccagatccccaactcagatccagacctcctgagcccacttcccccatctcatcacagatccagacctcctgagcccactttccccatctcatcacagacccagacctcctgagcccactttccccatctcatcacagatccagacctcctgagcccactttccccatctcatcacagatccagacctcctgagcccactttccccatctcatcacagatccagacctcccccactttccccatctcatcacagatccagacctcctgagcccacttccccaactcatcaccagtgatttcttgggctctgcattagttttctattgctgctgcaaccaacagctacagactcagtggcttccatttctgtcttatagttctggttgccaaaagtcctaagaggatctcactgggctaaagtcaaggtgctggcggggctatgtcccttctggaggctcaagggatgaatcgggtccctgccttttctagcttctaggggctccagcttctaggtttgtggcctccttcctccatcctcaaagccagcaacagcaggtgaagtcctcgcccatcatgcatcactctcccttcttcctccttcaacttttttttttatatttagggggaacgagtaccggattcttacatagtcaaaaagctccttatagagaagctcggaactttcaatacaactttgccttttctgccattttaattttccatttaatttaaatgtattctctcatttgaccttcatactctgtggagaaatattcctatttcggcttgtattgacaagctgttttcacacagcccccacatcacccaaccaaccagcaagaaacagataaagaaactgaggcccagggaggctaagagtcctgccaggatcattcacctttcaaggtaaggagccagttccagacctgggtttgtgcagctccaagctcccccgtctttctacaatgctagatttagactatagcaatctagcaagtgtggccacacaatgatcaagttggatttagatgatgttccctataaatccattctcctctcccgtgtaagcaaggcaaagtcctccaggccatggggagtccctgaagactcgatgaactgcagtggccacatcaggaggttgcaggttgaccagaactcaccgacacagcaggagagcagcttggaacctgcaacctagccaaaacctagtgccttggattgggggagaaaacaggcagccattcctctctctctgctggctagaggggattctggcttttcctgccagagccacccctttccctcctcctaaagttgatggtggttctttaaggaaagggagaagtgcacggtgtgatagggcaggaagagaagaaaatggaggagaggaggggactttcccataagcaggcagaagaaaaggcagctgtggtgtgtgatggacatggatgcagtggtgtccaatgtggggtcagccctagaggagagacagagagagagacagaaaagtgagagtcctgacccttacgattaacatgggatctgcctgcaaatgctgtttagggccatcgcctcttcctgtactgctatttttgagagtgatgctcctgagccccatgacccagtcaaatttgatgtcccctcgagccagattcagtgctgggagtccagtgtgatctgcctggatcttgctgcattgagaacaggccagtcttgaccccaatacaggggctggatatgaacaggcaacagctgggtttctgagtcagaaagacttggttaattgctaattgcttaggcgagtaatttaattttgttgagtcagattcttcagctacaaaatgcagatgacagtacttattcctccaggttgtggggaaaatggagattctaagcacgatgtccatttcacagaaaggtaccaatttggtggcttattttcctttctaccttcagaagtggctatccctgccacccaaacagacccttgactctcaagtggacggggtcccatttgcacagggggagaccttacagcctacgttgagtctatacttaccacttagtgagcattgtgtccgctcaggggcctctgtgggcatccgtctcctctgcagcatctttcctccccactgctgggtctgcacatgaccccctccttgggttaggcctctgatcagtgatgaccttggtatggtggtgatggtcagtcttggcatcaaatgagccagtttatatcatcagctattcaataaaatactaatctaggtgtcaccgtgaaagtattttgtgacattgttatgtacgtgttgttacaaatgtgcatgatgcatttactacagcatagaattttgcctgggtgccagcctgaagtctgtccgacagatcatagccatgttagtcccacagtcacaggggccaattgattaaattattttatctcccttgaaaactaaaaataaaatcctaagccccccacccgacttaacagaccccctgttggccaacggaacctcaaataaatcttaaaattcagttcttggccatgacaggacaggaggtcagacatacctccctgtacctccctccctcttatggtttagaccccacaactgaacagcattaatgttaaaatagagatcatgagactgacagaacagactctttgtggcaataagacctcaaattataaacaggagctagggccatgccaggcgagcgttaagtcttgtaccctactcttaaagaattaactagattctaactaccacgtgggttttatttttctctagcaaccaagcaagcactggctgtgagagaagcaagattaaaacaattacaactcacccagttcacagacgctgagtaactgatctcctgccccactaaccttaatgacagctttctctggacaagggactgatttcagtaactttctcctgataagagaccatcctccatggactggttctggccagttttggaggctgtgcctgtacagaggctgagtaccttcatgtccctgcttcactttttgatgtgtagggcctaattataatacatttaaatgtcaagtctccaccccagaatgaacatgcatgtttatggaatatgcatgcattaggacctcttttatgagtattctcataaaatgatatagctcctctgatatcctattgagtatgtatatgtagccaattcatttggctcaaattcctgtcctctccttccctccctggaaatgcctgcctctggccttggctgtaggccacacttcccagcctgtcataatggccaccttgcagactgcaaacctatataagaaataaagctctcttttctaaatttataaaattgtgtgatttttcagttgatgctctctttctacacacacacacacacacacacacacacacgcaatttatacagaaggaaatctggagaatatatgtgggaatggatattaagtgtgtggcaccgtggtggaagtaacataaagttggattaggctaaatttattaatgttggcccactaaacagagattctggactcagggttgtaggtcaaagctttagaaagggctccaagggttggtttgatcggttacttggttggttgcttgcttggttggttggtgcttgcttccttgcttggttgtttggttggtttgttgcttgcttgcttgttggttgattggttggctgtttgcttgtttggtgacttggttggttggctgaaacagaatcagagtttacctaaggtacataaagttgagatgccacaacttccttggtttatgtgtacagaaaggtatgcaaaaactcagggagactggatttattatgtcagacctgctcactcacactggagggtctacggaacatactcctcacaacgatcatgagaaagaatattgtgagaggagcccagtatcctggaagagctttgagcttgtgctctcagtaggcaaaatgttacagcaggaactgcagccactggactgggatctttaagtaaaatgaggataattgaatcctggggtggcagggaacatgggctgtccttaatcaccaaagatgaggtgggtgtggtcaccacagtggaaagcagtgtcaaagcagcagtcagaatggtttgactcacagacacccacggcattgtgtagtccatggtatccacagggagagctaatgggctgtaccaaagtcttagttgttctttaaaaaatgaagaattctaggtcaactgaataaaagactaactcaaattaatgaaacacagatctaaaaccctcaatcaattcccagacttgagccagttcacaggcccacaaccccttaagtgaaggggaggctgggtgatcttggggaagtacgctgctacgttgccaaaaatttacattgttaatctttttcccagtcttccccaaagggacttacagccttctgccaggatgactgtgacttaaagaaaagaaaattctcagatatttggggaattactggacactggctctcatttgacactattatcactatgttgcctaggatggattcatgctcctgggttcaagcagtcctcctacctcagcctcccaaagtgctgggattacagacatgagccactgtggccagcagagctttgaaactagaacatggaggtccagtggtaaagatttgacaagtctgggaagagattgggccaaggcaatgttgatgattcttttttttttttttttttttttttttacaacagagtcttgttctgttgtctaggctggagtgcaatggcgcgatctcggctcactgcaacctctgcctccggggtccaagcaattctcctgcctcagcctcctgagtagctgggattacaggtgcccaccaccacaccaggctaattttttatttttttgtgttttttgagacagagtctcactctatatcgcccaggctggagtgcagtggcgcaatctgggctcactgcaaaccccgcctctcaggttcatgccattcttctgcctcagcctcacgagtagctgggactacaggtgcctgccaccgtgcctggctaattttttgtatttttagtagagacggggtttcatttcaccatgttagccaggatggtcttgatctcctgacctcatgatctgcccgcctcggcctcccaaagtgctgggattacagggatgagccaccatgcccagccacaccaagctaatttttgtatttctttttttagttgagacagggtttcaccatgttggccaggctggtccctgaccttgtgatccacccgcctcagcttcccaaagtgctgagatgacaggcatgagccaccgtgcctggccaatgttgatgattctaaacagcagccgttaatgtgaaaaccatccaactggaagccctggccttgcccagaggacacagtctgggtggtgggcagagacttcagctgccttccaaggcaagcagctccttgctgcccgcttgctggggattttacttacagggcagaagctggcaggtgatttgggggcaggaattgcttcctggatggtataggatgaaccacactccccaggaaggcactcatcctggtggcctaacagaagcagccctcaccccaaaaggcaatgctgctccactagttttatggggtgactccttcctgtaggttccttccagctttaccagaaacacagaacatctttcctgacagggcattggttttgtttttgaacagagagatccttcttttaaaaagttagttttttgttttgttttgttttgttttttgtaatggaatcaacctaggtcctaagcctagcaggttgttattattatttttatgattattttttgagatggagtcccactctgtggtccaggctggagggcagtggcacgatctcagctcactgcaatgtctgcctcctgggttcaagagattctcctgcctcaacctacagaggagccaggattacaggcatgcaccaccatgcccggctaatttttgtacttttagtagagatagggttttgccatgttggccaggctgatctcaaactcctgacctcaggtgatccacgcacctcagcctcccaaactgctgagaatacaggtgtgagctgccatacccagccacaggttatttttgctgatcttctccctcctcccaccctcaaagaaaacgcggtacatctacaccatggactactacgcaaccctgaaaaggaacaaaatcacggttggtttttttttttttttttttgcagcaacatggatgtagctggaggccattatcttttttaattatttttattattttttttctattctactttaagttctggggtatatgtgcagaatgtgcaggattgttacatagatatacatgtgccatagcggtttgctgcacccatcaacccatcatctacattagatatttctcataatgctgtccctttcccagtcccccacccctgcagtaggccccagtgtgtgatgttcccctctctgggttgatgtgttctcattgttcacttcccacttatgagtgagaacatgcactgtttggttttctgctcctgtgtcactttgctgaacatgagggtttccagcttcatccatgtccctgcaaaggacatgaactcatctttttcatggctgcatagtattccacagtgtctatgtgctacattttctttatccagtctatcactgatgagcatttgggttggttccacatctttgctattgtgaacagtgtggaggccattatcttaagtaaattaatagaatgctgcgtgttctcacttataagtgggagctaaatgttgtgtatatgtagacacagagaagggaacagatattggggtctagttagggggagagaggaaggtagaaggacaagagttgaaaaaaccaactgtggggtattatgctcactacctgggtgatgggatcactcataccccagacctcagcatcacacatcgtacccatgtaagaaacctgtacatgtacctcctgaatccaaactgctccatcatttgcaccagcaattccaagactgggcatctacccaaaggaaaagaagtcattctaccaaaaagacacatgcatggtaaagttccttttttttgtttgttttttgagatggagtctcgctctatttcccatgctggagtgcagtagcaatctcggctcactgcaacctctgcctccagggttcaagtgattctcctgcctcagcctcttgagcagctgggattacaggcatgcgccaccatgcctggctaatttttgtatttttagtagagacagggtttcaccatattgaccaggctggtctcgaactcctgacctcaggtgatctgcccaccttggccctccagagtgctgggattacagtgcctggccctgtaaggttcatcacagcacgacttacaataggaaagtcatggaatcaacctagttgcccatcagtggggtaccggataaagcaaaagtggttcttctacagcatcgaatactacacagccatgaaaaagaacaaaatcatgtcctttgcggccacatggatgtagctggagggcattatgcttaatgaattaacacaagaacagaaaatcaaataccacatgttcttgtctggataaagcaattgtggcccttctacaccatggaatactgcacagccatgaaaaagaataaaatcatgtttttgcagccacgtggacacagctgaagggaattatgcttagtgaattaacgccaggaaaagaaaatcgaataccacatgttctccactagataaagcaaatgtggtctttctgcatcatggaatactacacagccacgaaaaagaataatgtcatgtcctttgcagccacatggacacagctgaaggacattatgcttagtgaattaatgccaggaacagaaaatgaaatactacatgttctcaactggataaagcaaatgtggcccttctacaccacggaatactacacagtgatgaaaaaaataaaatcatgtctttgcagccacatggatgcagccagagggcattatgcttagtgaatcaatatgaggaacagaaaatcaaataccacatgttctgcactagataaagcaaatgtggtccttctgcatcatggaatactacacagccatgaacaagaataaaatcatgccctttgcagcaacgtggatgaagctgaagggcattatgcttagtgaattaacgccaggaacagaaaataaaacaccacatgtttttgcttataggtgggagctaaacattgcctgcacctggacacaatgaaggggcaccacagaccctcaggactaatagagtaggaagcaggggcgggggtacaagggttgaaaaactaccctgagattctttgaatttcaggcagaaggcagcaactggagagatctttgggtcacggatttttctgttgcattttcttgcttgtttgttttctatctctctctctctcttttttttttttcttttttttgagatggagtctcactctgtgacccaggctggagtgcagtggtgcaatctcggctccctgcaacttctgcctcctggattcaagcaattcttctacctcagcctcccaagtagctgggactacaggcacctgccaccacacctggctaatttttgtatttttagcagagacggggtttcaccatgttggccaggctggtctcgaactcctgacctcaggtgatctgcctgccttggcctcccaaagtgctgggattacaggcatgagccactgcacctggccctcttcttatatatttctagaactcctctcgaatttggggtttgtttttcttaattacaaggaatcaagttgaatcattagtgcatatataaatatacattttattttagtacacattatatacctcaggaatgtacaatgctcagcgcctgggtgacgggattattcataccccaaacctcagcatcgtacaatatccccaggacacaaagctgcccgtggatcccctgaatctataataataataattaataataataataataataaataaaaagtgactttgtcattcgcagggaaatgtgaatgacattcactctgcctctcaggcccttggattcccaaagtttgttttcctcacgcccaggggacactcagaatgtcgtttgcagaacacgggttgtttttcttagaaacgccttgcaaaacaaaataggaagcaaaatctttctcactccttccactccataatagacaaaataaaatgagggggcaggaatccagagactttgaccacagttggcagatttattgtggtacagacatgaaggcaagcagtgttctctctgattctacgaaccgtacagcccgggccagctgccttctgctttctggatggtgcaggcgtgagctccaagcccaaatttcactggagctccaagaatcgagcctggcccaggcactcactgcacgggggccaagcgtgaaaccagtgatcgctccagcaaggtaacaggacagcttggtgatccttcttgccggccacaaaaggttatagccagaattccaccgaatgtggtctttctgtgtctctccccagatagtgaagctgcacaaacctgggggtggggggtggggggtgctgacctcagtggggtgtcctggagaggcaggaaccagagtttacagggtgcagatcctactgaagcaaatggacgtggcatccgtgggcagagctggctgtggctggccttccagcctggatgtctcccccccccccgcctggggtgtcaccaaatgcacccagagaccccttctaaacctggggggatgtgctgacctcagtggggtttcctggagaggcaggaagctgggtttccagggtacatatcctactgaagcaaatggacgtggcatccttgggcagagctggctgtggctggccttccagcctggacgtctcccccactgcctggggtgtcaccaaatgcacccagagacctctcttctgaaagcccattcatgggaagcctccaggtctcctcagcaggcagcatcacgtctgatttcactgcgttatcaggtaatgcaggcctgttctacctgtgtgcgtgagcgcgtgtgtgccgtgtgggagtgtgtgtgttgatgtgggtgtgggtgtgtgcttgtgtggctgtgtgtgtgtgcctgtttatgtgatgatgagtgtgtctgtgagtctgtaagacaacgtgtgtttccatgcgtgtttctgtgtgagcgtgcattcctgtgttttatggaagtgtgtttttgtgatggtgtttttgtgtgcacctgcgtttatcgtatttgtgtgtttgtgaatatgagtgtatgtgtgtgaatctgtatggcaatgtagaaattcttttttttttttttttgagacggagtctcgctctgtcacccatactggagtgcaaaggctcaatctcagctcacagcaacctccacctcccgggttcaaacgattcttctgcctcagcctcctgagtacctgggattacagacacccaccgccacatctggctaatttttcttttttgatatggagtctcgttctgtcacccaggctggagtgcagtggcgtgatcttggctcactgcaacctctgcctcccaggttcaaatgattctcctgcctcagcctcctgagtagctgggattacaggcataagccaccacatctggctaatttttgtatttttgagtagagatggggtttcaccatgttggccaggctggtctggaactcccgacctcaagttatctgcccgcctcggcctcccaaagttctgggagtacaggcgtgagccaccttgcccggccccagtgtgtgaatttttatgtttgtgtgtctacatgattatgtgagtctttttgtgactgtgtttccatgagtgtgtgactgtatttatgtgtttgtgtgtgcttgtgtgattctgagtgtgtctatgagtgtgtatgacatatgtgagtgtctgtgtgggtgagtagccatccacgtgtttatatgagagtgttttcatgattctgtttatgagtgactttgtatgtatacgtgtttgtgtgctttgtgagaatgtcaatgtgcatgtgcacccacgtgtgcaaaaaacccacacatttttgtaattgtgtttgtgtgtgtgtccctgcatttgtgtgagtgtgcatgtcttcgtgtgtccatgtgtttctatgagtgtgttttgtgattctgtctgtctttgtgttgatgtgtgtttgtgtaagtgtgtggttgcatttgtgtcagtgattctggagcaggtgagctgatcacaagtctgagccgagaatccatggagctcatttacaacagaagccgggaccctgtgcaaatccttctgaaatatccccggtttacagagctcctaggggtggggaagaaaaattccctgacttttcggcctcagggaaagagagagacaccccgctggccgtacacctctgctgtttctcagaaaacaggtggggtatcactctttcctaaatgacggtgattttaagaacggttcaccttttgaagagacgtttctgccctggcgatccatacatattgaacccaaatgaatattttttaattaaaaatttttatataaatatacattgtgcatactttatattaatatattgatataaatatattttaatataaacatgatttttatagttcatataaataaagttatatatagtgtatatgtaaaatatacttttatttgtgatacataattttatagattaaattttatatactaagcaaagttacatgtgatatatacatgccatataacatcatttatataatatatctttatgtaaataagtatataataaaattgatcttatatttgttaatacataattatgtatatatactatgtaaaaataaaattatatattgtatgtgcataattatatttctataaatacacgcttatgtgtgtatttatacatgaatgcctgtgtttgtgtgagtacatcagtgagtgtgtgaatgtgtgtgcatgtgtgcctgtgtttgtgtgagtgtaagagtgttgtacatttatacactcacattttgttttctggttaataacaagatctatctttgatttaggatatgaagaattcttataagcaaccccccacacaaaatttgtatttattttaaaatattcttaaaatatgggttcttttatttttgcacaaacagacaagagtgttttttctttccaaaacttttatttcaaattctgaccctgaggagcagaaaaagaagaaaacattgtgtaaccttatatacattagaaacataagtagttactaaatgcaatacagattttgacaacatgcatttaggaaaaatgaggaattcaaactcgtagctgcctcaatattgaactttctaaagtttaattttttttaattaaaaaatattcatttgggttcaatatgtatggatctccagggcagaaatgtctctccaaaaagtgaaccactctgaaaatcaccgtcatttgggaaagggtgatgccccagctgtcttctgaaaaatagcagaggcttccggccagtggggtgtctctctctttccctgaggccgaaatgtcagggaatttttcttccccacccctaggagcccagtaaatgcagaatatttcagaaggatttgcacagggtcccggcttctgctatttatgagctccatggattcttggctcaggcttgtgatcagctcacctgctccagaatcacttcccatcttagcttctgggctaagacacctcaaaaccagcaaaggaaagtcctcactggtcaacgcgtccatcccaactcccccatctccccttagggtgggtttggggttcgggactgctttactgttcctttcaaagcagactgggaggtaagattttattctgcttccagaggttcaggatttctgcagacggtcagcaactctttgcatcctactggtaaaagttttatatactttgtatttatagaaatacgcattgtgtatattttatatgaatagattgatataaattattttagtaacttaaccatatgacttttatatttttatataaataaagttatatgtagtgtatatgtaaaatacttttatttctaatacataattttatagattaaatttaatatattaagcaaaaatatatgtaacatatataacatataacatcatttctataatatataacttaatgtaaataagtatataaaattgatattatatttgttaatacataattatacatatatactgtgtaaaaataaaattacatattgtatatgcataattatatttctataagtacaattatatactatgtataattatgtataaaataattgtataataaaattatataataaattttgaaacgttataaattattatacatagtattttattgtattaaatttagaaatgtgttatatgtaataaaattttattataataaatgtagattatataaaatcttatttataataaattaccttatgtataattataatatgagaaaataattacatatcattgtattataataaatttagagatgttatacattattacatataaaatttcattatattaaatttagaaatatatgtaataaaatggtattatgttaaaatttttatgtaacattttattatacatgtataattttatataatgttttataatatatagaatataagtacacagaatataagtacaaaaatatttatatacagctacacgtaatataaatacatcagtgtaagatgttttgtgtgtgtgagatggagtctcgctctgttgcccaggctggagtgcagcaacacgatctcgtctcactgcaacctctgcctcctgggttcaagcgattctcctgcctcagcctcccgagtagctgggattacaggcatgcaccaccacacccaatcaatttttgtatttttagtagagatggggtttcactgtgttagccaggatggtctcaaactcctgacctcaggtgatccacccgcctcggcctcccaaagtgctgggattacaggcatgagccacagtgtaagatactagctattaaaaaataaatatatatatatactgcaacagctgatttgtctggaagagtttggtcagaagacagtgtattaagaagactgtgagttcccagaggaatataagaatatacatcatgttgatatattatatataacataaatagctaactacatctgtgtatatagtataaacaaaagtacaaaaatatttgtatataactatatgtaatataaatatatcagtgtaagatattagctattaaaatatatatatatatagagagagagagagcaaccggtgatttgtctggaatattctagtcagaagacagtgtattaagaagacagtgagtccccaggagaatacaagaatgtgcatcatgttaatatattatatataacataaatacctaacaacatctgtatatatagtataaacttaaagtacaaaaatattagtatattactatatgtaatataaatatatcagtgtaagatattagctattaaaatatacatatgtgtgtatgtatgtgtatatgtgtatataaatattatatatatatatagtaaccgctgatttgtgtggaagactttggtcagaagacagtgtattaagaagacagtgggtcctcacaggaaaataagaatatacatcatgtttatattatatataacataaacaactaattacatctgtatatacagcataaacataaagtacaaaaatatttgtatataatcgtatgtaatataaatataccagtgtaagatattagctattaaaatatacatgtgtgtatgtatgtgtatatgtgtacatataatatatatacatatataacatatataatatataagatatagcataataatataatatattatatataatatgtaatatgtaacatatattatataattaatatattctatgctatataatatataatatattctatgcaataaaatatatagcatatatatatatatagcaacagctgatttgtctggaagaatttggtcagaagacagtgtattaagaagacagtgagtccccagagaaatataagaatatacatcatgtttatattatatataacataaatagctaactacatctgtatatatagcataaacataaagcacaaaattatttatatataatataaatatatcagtgtaagatattagctattaaaaaatatatatatatagcaaccggtgatttgtctggaagactggtcagaagacagtgtattaggaagacaggcagtctccgcaggaagcatggtgcaggtgggatctggaggtgactctgggctgccagaagacgccccactgctttgcggcagacacaggtggagaggtcctctctgtagcttcagcatggacagtgtgtgtgtcttgctgtgggaacacttctttctgcttccctctccactgtgaccccatcacactcactgacctgccctcctccttcctctcgctctccggggcccctgtggaaagagggtcttccctccgtgcagcaggaacccccaggaccatccccatgctcctgggttctgaacttcagggacatatgatcctacctgaccgggcacaggctctgttcaccctcaggaacccctgtcctcccaggccaccgtggactggagaactggcctcctgaaaatccagagagaacttagcactcacaacttctttctttttttcttttttctttgagactggatcttgctcttttccccaggctggagtgcaatggcatgatctcagctcactgcaacctcctcctcccaggttcaagcagttcatcctgcctctgtctcccgagtatctgggatcacagtcatccacccccgcggccaactaatttctgtatttttagtagagacggggtttcaccatgttggccaggctggtctcgaactcttgacctcaagtgatccacccgcctcggcctcccaaagtactgggatgacatatattagcatgatgtatattcttctattcctccggggactcactgtcttcttgggcagtaaaccactgtgcccggacttctctgtccacatctgcacacatctaaacctctgtagattctgaattgtttttccttttgcacagaatgagaggaactgaagtcgggaggcccagccccaacacggtccctgtggctctgtgctcaggtggtttatggctgagaaggacttggggggttgagggcttcctatcagcccaggagacattacctgggtctgggaagcctgctctgcacttgtgggtctcgaattgtctgttgcatttacctgcctcattattttttcttcctgtctctcttcttacatatttctttcgaatttggagcttgtttttcttaactacaatcaacttgaatcattactgcatatataaatataaattttatattgagtagacattatatactcaatctactacacattccaacacgggccatatctaagacgaatatttatatttaatgtttaaaatatgtttacatttcatatagaaaaatatatttatatttaatatatatgtgtatatttaatacaggaaatatatatttatatttaacatataaaaatatatgtttatatttaatatgggaaatatatgctttgtttaatatacataatacatgttgatatttaatatagaaaaggtatagttatatttactatgcaaaatacatgtttatatttaatatagaaaatatgtttatatttaatgtacaggatacatatttacatttaatatagaaaatacatatttatatttaacatacacagtatttatatttaatgtataaaatatgtttacatttaatgtgctgaatatatgcttatatttaatgtctaaaatgtctatatttaatgtactgtatacattaaatgtaccaaatgtattcttatatttaatgtataaaagaagtttatatttaacatataagatatgtttacatttaatgtataaaatgtttatgtttgatgtataaaagatgtttatatttaacgtatacaatttatatttaatgtaccaaatatattattatatttaatgtccaagccagccaagccagtcagccaagccagctaagccacccacccagccaagccagccaagtgagtcagctagccagccagccaagccagccaaaccagccaagccagtcagccagccaagccagccaagccagccagccagccaagccagccaagccagccaagcaagccagccagccaagccagccagccagcccaggagccccagccagccagccaacccaaacagccaagccagccaagccagccagccagccaagccagccaaggcagccaagccagccaagccagccaggcagccaagcaaaccaagccagccagccagacaaggcagccaagccagcaggccaagcgagccaagccaagccagccaagccagccagttagccagccaagccagccaagccagccagccagccaagccagcccagccagccagccagccagccgagccggccaagccagacagcgagcccagccagcccagccagtcagccagccaaaccagccagccagccaagccagccagccacccagccaagccagccacccagcaaagccagccaagagacccaagccagccagcaaagctggccaaaccagccaagccagtcagccaagccagccaagccggccacccagccaagccagacaagccagccaaccagccagacagcccagccagacagccagcccaggcagccaagagacccaagccagccagcgaagctggccaacccagccaagccagtcagccaagtcagccaagccggccacccagccaagccagccaagccagccaagccagtcagccagccagccagccaagccagccaagccagtcagccagccagccagccaagccagccaagcctcccagccagccaaaccagccaagccacccagccagccaagccagccaagccacctagccagccaggcccgccagccagccagccagcgagccaagccagccaagccagccagcctgccaagccagccggccagccaagctagccaatccactcagccactcaagccagccaagtcacccggccatccaagccagccaagccagtcagccagcccagacagccaagccagccaagccagccaagcccgccaaccagccaagacaggcatgctagccaagccagccaggcagcgaagccagccaagccagccagcaagcaaagccaggcatgtcagccaagccagccaggcagccaagccagcaaagccagccaagccagccagccagccaagccaggcatgccagccaagccatccagccagctaagccagccggctagccaagccagccaagccacccggccagccaagccagccagccaagccagccaagcctgccaagccagccaaccagccaagccagccagctagccaagccacccagtcagccagctagccaaaccagccaagccacccagccagccaagccacccagccagccaagccagccaagccacccggccatccaagccagccaagccagtcagcccagacagccaagccagccaagccagccaagcccgccaaccagccaagacaggcatgctagccaagccagccaggcagcgaagccagccaagccagccagcaaggaaagccaggcatgtcagccaagccagccaggcagccaagccagccaagccagccaagccagccagccagccaagccaggcatgccagccaagccatccagccagctaagccagccggctagccaagccagccaagccacccggccagccaagccagccagccaagcctgccaagccagccaaccagccaagccagccagctagccaagccacccagtcagccagctagccaaaccagccaagccacccagccagccaagccacccagccagccaagccagccaagccacccggccatccaagccagccaagccagtcagccagcccagacagccaagccagccaagccagccaagcccgccaaccagccaagacaggcatgctagccaagccagccgggcagccaagccagccaggcagcgaagccagccaagccagccagcaagcaaagccaggcatgccagccaagccagccaaccagccaagccagccagctagccaagccacccagccagccagccagccaaaccagccaagccacccagccagccaagccacccagccagccaagccagccaagccaatcagccagccaggcagccagccacccagccagccaagccagccaagccagccaagccaatcagccagccaggcagccagccacccagccagccaagccagccaagccacctagccagccaggcccgccagccagccagccaggcagccaagccagccaagccagtgaagcccgccagccagccaagacaggcatgccagccaagccagccaggcagccaagccagccaagccagccagccagccaagccaggcatgccagccaagccatccagccagctaagccagccggctagccaagccagccaagccacccggccagccaagccagccagccaagccagccaagccagccaaccagccaagccagccagctagccaagccacccagccagccagccagccaaaccagccaagccacccagccagccaagccacccagccagccaagccagccaagccaatcagccagccaggcagccagccacccaagccagccaagccagccaagccagccaagccacctagccagccaggcccgccagccagccagccaggcccgccagccagccagccaggcagccaagccagccaagccagtcaagcccgccagccagccaagacaggcatgccagccaagccagccaggcagccaagccagccaagccagccagccagccaagccaggcatgccagccaagccatccagctagctaagcccgctggctagccaagccagccaagccacccggccggccaagccagccaagccagccaaccagccaagccagccagctagccaagccacccagccagccagccagccaaaccagccaagccacccagccagccaagccacccagccagccaagccagccaagacagccaggcagccagccacccaagccagccaagccagccaagccggccaaaccagccaaccagccaagccagccagccatccaagccagccaagacagccagccagccaagccagtcaagccagccatacagccaagccagccaagccaggcaagccacccagccagccaagccatctagccatcaagccagtcaggccagccagccagcctgccaagccggccacccaccaagccagccagccatccacgccagccaagccagttagccagccagccaagccacccagccagccaagccagccaagccacacagccagccaagccacccagccagccaagacagccaagccacacagccagccaagccatccagccagccaagacagccaagccagccaagccatccagccagccacgcaagccaagccagccagccagccaagcaatccgtgccagccaagccatccagccagccaagcgaggtgtccggccaagccaccccaccagccaagccagccagccagccagccagccagccaagccacccagccaactaagccagccaaaccacccagccaggcatgccagccaagccacccagccagccaagcctgtcagccagcgaaccagccaagccagccatgccagccagccagccaagccatacaagccagccagccagccatgccaggacgagactccatctcaaaaaaaataaaaaaaaaacagcctggccaacatgatgaaaccccgtctctactaaatgtataaaaaattatctaggcgtggtggcacacgccagtaatcccagctactcgggaggcccaggcaggaggatcgctttaaccagggaggtggaggttgaagcgaaccaagattgcaccacctcattccagcctgggcaacagggtgagactcaatctcagaaaaagaaaaaaaaaaaggccagcctggccaacacggtgaaaccccatctctactaaatatgaaaagaaattagctgggcgtggtggcacatgaatgtaatcccagctactcgggaggcccaggcaggaggatagcttgaaccctgggggtggaggctacagcgagccaagattgcaccactgcactccagcctgggcaacagggcgagactccatctcagaaaaaataaaataaaatagaccagcctggccaacagggtgaaaccccatctctacaaaatatacagaaaaattagctgggggtggtggcacacacctgtaatcccagctactcgggaggcccaggaaggaggatcgcttgaatcagggaggtggaggctgcagcgagccaagattgcaccactgcactccagcctgggcaacagagtgagactccatctgaaaaaacagaagcattccagcctggccaatagagcgagactccatctcaaaaaaaaaaaaaaaaaaaaaaaaaacaccagcctggccaacatggtgaaaccccgtctcttctaaatatacaaaaaaaatagggccaggcgtggtggctcatgcctgtaatcccagcaccttgggaggccgaggtgggtggatcacgaggtcatgagatcgagaccagcctgaccaacatggtgaaaccccgtctctactaaaaatagaaaaattagctggatgtggtggcacatgcctgtaatccctgctactccggaggctgaggcaggagaattgcttgaacctaggaagcggaggttgcagtgagccgagatggcgccactgtactccacggtggtgtcagagtgatactacatctcaaaaaaaaaaaaaatagctgggtttgatggcacacacctgtaataccaggtactcgggaggcccaggcaggatgatcacttgaacccgggagggggtggttgccgtgaaccaagattgtaccactgcactccagcctgggcaacagggcgagactccatctcaggaaaaaaaaaaaaaaaagaccagcctggccaacatggtgaaaccccgtctctactaaatataaaaaaaattacctggatgtggtggcacatgcctgtgatcccagctgctcgggaggcccaggaaggaggatcgcttgaacctgggaggtggaggctgcagcgagccaagattgcaccactgcactccaccctggataacagaattagactctatatgaaaaaaaagaagaactccagccagggcaatagagtgagactccatctcaaaaaaaaaaaaaaaaaaaaaaaaagaccagcctggccaacatggtgaaaccccgtctctactaaatacacaaaaaaattagctgtgcgtggtggcacacgcctgtaatcccagctactcgggaggcctaggcaggaggatcgcttgaacccgggaggtggaggttgcagcgaaccaagattgcaccactgcactccagcctgggcaacagagcgagactccatctcaggaaaaaaaaaaaatatcagcctggctaacatggtgaaaccccgtctctactaaatatacaaaaaaaattagctgggcgtggtggcacacgcctgtaatcccagctacccgggaggcccaggcaagaagatctcttgaacccagaaggtatatgctgcagcgagccaagattgtcccaccgcacttccgcctgggcaacagagcgagactccgtctcagaaaaaaaaaaaaaaaaaaaaaacaagaacaggttggccaacatggtaaaaccatgtctctactaaatatacaaaaaaattagttaggcatggtggcacacgcctgtaatcccagctactcggaaggcccaggcaggaggatcgcttgaacccgggaggtggaggctgcagcaaaccaagattacaccactgcactccagcctgggcaacagggcgagactccatctcagaaaaaaaaaaaaagaccagcctggccaacatggtgacaccccgtctctagtaaatatataaaaaaattagctgggcatggtggcacacggctgtaatcccagctactcgggagccccaggcagtaggatcgcttgaacctgggaggtggaggctgcagcgagccaagatagcaccactgaactccagcctgggcaacagggtgagactccatctcagaaaagagagaaaaaaattaaaaaaagaccagcttggccgacatggtgaaacctcatctctactaaaaatacaaaagtattagctggccgtggtggcacacgcctgtaatcccagctactcgggaggcccaggaaggaggattgcttgaacctgggagtttgaggctgcagcgagccaaaattgcaccactgcactccacccgagtgagactccatctgaaaaaaagaactccagccacggcaatatagcgagactcaacctcaaaaaaaaaaaaaaaaaaaaaaaaaacaccagcctggccaatatggtgaaccccgtgtctactaaatatacaaaaaaattagctgggtgtcacggcacacgcctgtaataccagctacttggtaggcacaggcaggaggatcgcttgaacccgggaggtagaggctgcagtgagccaagattgcaccactgcactccagcctgggcaacagggtgagactccatctcagaaaaaaaaaaaaaacaaaaagagcagcctggccaacatggtgaaaccccgtcaatactaaatatacaaagaaattagctgtgcatggtggcacacgaatgtaatcccacatactcgggatgcccaggaaggaggatcgcttaaacccgggaggtggaggctgcagcgagccaagattgcaccactgcactcgagccagggcaacagggccagactccatctcaaaaaaaaaaaaaaagaccagcctgggcaacatggtgaaaccccatctctactaaatatacaaaaaaattgctgggcgtattgctacacacctgtaatccccgctacttgggaggcccagacaagaggatcacttgatcccgggaggtggaggctgcagcgagccaagattgtaccacagcacttcagcctgggcaacagagcgacactccatctcagaaaaaaaaaaaaaaaaaaaaaagaacaggttggccaacatggtgaaaccccatctctactaaatatacaaaataattagctgggcgtggtgacacacacctgtaatcccaggcaggaggattgcttgaacctgggaggtggaggctgcagccagccaggattgcaccactgcactccaccctgggcaaaatgtgagactccatctgaaaaaaaagaagcattccagcccgggcaatatagcgagactccaactcgaaaaaaaaaaagaccagctggccgacatggtgaaaccccatctctactaaatatacaaaaatattagctgggcgtggtggcacatgcctgtaatcccagctactcgggaggcccaggaaggaggatcgcttgaacccgggaggtagaggctgcagcggagccaagattgcaccactgcgctccatcctgggcaacagagtgagactctatatgaaaaaaaagcactccagcctgggcaatagagcgagactccatctcagaaaaaaaaaaaaaaagaaagaccagccttgccaacatggtgaaaccccgtctctactaaatatacaaaaaaattagctgggcgtcatggcacacgcctgtaatcccagctactcggtaggcccaggctggaggaatgcttgaacccgggaggtggaggttgcagcaaaccaagattgcacctctgaacgcctgcctgagcaacagggtgagattcaatctcagaaaaaaaaaaaaaaaaaaaaaaaagagcagcctggccaacatggtgaaaacccatcaatactaaatatacaaagaaattagctgagcatggtggcacacgaatataatcccagctactcgggaggcccaggtaggaggatcccttgaacccgggaggtggaggctgcagcgagccaagattgcaccactgcactccagcctgggcaacagggcgagactccatctcaaaacaacaacaacaacaacaacaacaacaacaaaaaacagcctgcccaacatggtgaaaccccgtctctactaaatatacaaagaaattagctgggcgtcatggcacacgaatgtaatcccagctactcgggagtcccagacaggaggatcgcttgaacctgggagttggaggctacagcgagccaagattgcaccactgcactctgctctgggtaacagagtaagagtccatctgaaaaaaaagaagcactccagcctgggcaacagagagagactccatctcagaaaaaaaaaaaaaaaaaaaaaaaaaaaaaagaccaggttggccaacatggtgaaatcccgtctctactaaatatacaaaaaaaattagctggacgtggtggcacaggcttctaatcccagctactggggaggcccaggcaggaggatcacttgaacctgggaggtggaggctgcagcgagccaagattgcaccactgcactctggcctgggcaacagagtgagagtccatctgaaaaaaaagaagcactccagtctggtcaacagagcgagactccatctcagaaaaaaaaaaaaaaaaaaaaaagaccaggttggccgacatggtgaaaccccgtctctactaaatacacaaaaaaattagctgggcgtggtggcacatgcctgtaatcccagctactcgagaggcccaggcaggaggatcgcttgaacctgggaggtggaggctgcagcgagccaagactgcaccactgcactccggcctgtgcaacaaagtgagactccatctgaaaaaaaaagaaacactccagcctgggcaatatagcaagactccatctcaaaaaaaaaaaaaaaaaggaaaaaagagcagcctgtccgacatggtgaaaccacgtctctactaaatatgcaaaaaaattagctgggcgtggtggcacacgcctgtaatcccagctactcgggaggcccaggcaggaggatcgcttgaacccgggaggtggaggttgcagcgaaccaagattgcaccactgcactccagcctgggcaagaaagtgagattccatctgaaaaaaaagcactccagcctgggcaatatagcaagactccatctcaaaaaaaaaaaaaaaaaaagaccagcctgtccaacatggtgaaaccccatcagtactaaatatacaaagaaattagctgagcgtggtggcacacgattgtaatcccagctactcgggaggcccaggcaggaggatcgcttgaactcgggaggtagaggctgcagccagccaagattgcaccactgcactgaaccctggacaacagagtgacactccatctgaaaaaaaagaagaactccaaccagggcaatggagcgagactccatctcagaaaaaagaaaaaaaaagagcaccttggccaacatggtgaaaccccgtcagtactaaatacacaaagaaattagctgagcatggtagcacacgaatgtaatcccagctactcgggaggcccaggcaggaggatcgcttgaacccgggaggtggaggttgcagcgaacaaagattgcaccactgcactccagcctgggcaacagagcgagactcccactcagaaaaaaaaacaaaatgaaaaaaaacaccagcctggccaacatggtgaaacaacgtctccactaaatatacaaaaaaaatagatgggcgtggtggcactcatctctaatcccagctactcgggaggccaacgcaggaggatcacttgaacacaggaggtggaggctgcagctagccaagtttgcaccattgcactccagcctggcaaaccaagccagccaagccaaccagccaagccagtcaagcgacccagccagccagccagccagctaagccacccaaccagccagcctgccaagccagccaagccagccagccagccagccggccaggcagccaagccaagccagccaagccagctagccagccaagtcagccaagccagctagccagccaagtcagccagccaaaccagccaagccacccagccagccaagccacccaagacacccagccagccagccagccaagccagccaagccacccagccagccaagccagccaagcaagccagccaagccagccaagccagccaagccaggagccagccaagccagccaagccagccaagcctgccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacacaagccagccaactcagccagctagccaagcaagccaagccagccagccagtcaagccagccaagccagccagccaaccaggccagctaaaccagccagcctgccaagccagccaagccagccagccagccaggccagccagccaaacaaggcaccgcagccagcccagccagccacacaagccagccaagtcagccagccagccaagccagccaagccagcccgccaaggcagccatgccagccagccagccaagccagccaagccagccaagccagccagccacccagccagccaagccaggcagccacccagcaagccaggccagcctgccacccagccagccaagccagacaagccagccaagccagccagccacgcagccagccaggacatccagccacccagccagccaagccatgcaagccaacaagccagcccagacagccaagccagccaagcaagccagcaagccagccagccaagccagccagccaaaccagccaagccacccagccagccaagccacccaagacagccagccagccagccagccaagccagccaactagccaagccagccaagcaagccaccagccaagccagccaagcctgccagccagcagagccagccaaccagccaagccagccagccagccacttaagccatccaagcaacccagccagccaagccagccaagccaccgacccagccaagccagccaagccacccagccagccaagccagccaagccagccaaaccagcctgccagccaagccagccaagccatccagccagccaagccagccggccagccaagctagccaatccactcacccactcaaactagccaagtcacccggccagccaagcctgccaagccagctagccagcccagacagccaagccagccagccagccaagccagccaagccagccagccagccaatctagccaagccagccaagccagccaagccagccagccagccaagccagccaagccagccagccagccaagccagccggccagccaagctagccaatccactaagccactcaaaccagccaagtcacccggccagccaagccagccaagccagccagccagcaaagccagcccagccagccagccagccagccagccgagccgccaagccagacagcgagcccagccagcccagccagtcagccagccaaaccagccagccagccaagccagccagccacccagccaagccagccacccagcaaagccagccaagagacccaagccagccagcaaagctggccaaaccagccaagccagtcagccaagccagccaagctggccacccagccaagccagacaagccagccaaccagccagacagcccagccagacagccagcccaggcagccaagagacccaagccagccagcgaagctggccaacccagccaagccagtcagccaaaccagccaagccggccacccagccaagccagccaagccagcgaaccagccagacagccctgccagacagccagcccaggcagccaaaccagacaagccagccagccaagccagccaagccagccagccagccaagacaggccagccaagcaagccatggaagccagacagccagccagccaagctagccaacccagccagccaagctagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccagggagccaagccagccagcaagcaaagccaggcatgccagccaagccagccaggcagccaagccagccaagccagccagccagccaagccaggcatgccagccaagccatccagccagctaacccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagacaagccagccaaccagccagacagccctagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccaggcagccaagccagccaagccagccagccagccaagccaggcatgccagccaagccatccagccagctaagccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagccccaagccagccagcaaagctggccaaaccagccaagccagtcagccaagccagccaagccggccacccatccaagccagacaagccagcaaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccggccaagccactcagccagccaagatggccaagccacccagccagccaagcctgccaagagacccagcaacccaagccagccaagacacccagccagccaagctagccaagacacccagccagcgaagccagccagccagccagccagccaagccagccaagccacccagccagccaagccaggcaaacaacccagccagccaagccagtcaagccacccagccagccaagccggccaagccacccagccagccaagctggccaagtcactcagccagccaagccagccagccagccaagccggccaagccactcagccagccaagatggccaagccacccagtcaagccaactaagccagccaagccacccagccagccaagctggccaagccactcagccagccaagccagccagccagccaagccggccaagccactcagccagccaagatggccaagccacgcagtcaagccagccaagccagccaggcagccaagccagccaagacctccagccagccaagaaaggcatgccagccaagccagcaaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccacgacacccagccagcgaagccagccagccagccagccagccaagcctgccaagccacccagccagccaagccaggcaaacaacccagccagccaagccagtcaagccacccagccagccaagccagccaagccagccaagccacccagccagccaagctggcaagccactcagccagccaagccagccagccagccaagccggccaagccactcagccagccaagatggccaagccacccagtcaagccagctaagccagccaagccacccagccagccaagccagccaagccactcagccagccaagccagccagccagccaagccggccaagccactcagccaaccaagatggccaagccacgcagtcaagccagccaagccagccaggcagccaagccagccaagacctccagccagccaagaaaggcatgccagccaagccagcaaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccacgacacccagccagcgagaggcagctaggcagctagccaagcctgcccagccagctcgagccagctaagccaggccaagcaagctagccatccaagcttgacaagccagccaagcatgccagccaagccagcgcagctggagccagccaagccagccaagccagccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacacaagccagccaactcagccagctagccaagccagccaagccagccagccagtcaagccagccaagccagccagccaaccaggccagctaaaccagccagccagccaggccagccagccaacccagccaccgcagccagcccagccagccacacaagccagccaagtcagccagccagccaagccagccaagtcagccaagccagccagccagccaagccagccaagccagccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccagccagccaagccggccaagccagccagccagccaagccagccaagccagccagccagccaagccagccaagcaagccagcaagccagccagccaagccagccagccaaaccagccaagccagccagccagccaagcgctttacccgaacgtccgtgaggcagtgagagccaaagcagcctgccagccaagccagccaagccatccagccagccaagccagccagccagccaagctagccaatccactcacccactcaaactagccaagtcacccggccagccaagcctgccaagccagctagccagcccagacagccaagccagccagccagccaagccagccaagccagccagccagccaagccagccggccagccaagctagccaatccactaagccactcaaaccagccaagtcacccggccagccaagccagccaagccagccagccagcaaagccagcccagccagccagccagccagccagccgagccggccaagccagacagcgagcccagccagcccagccagtcagccagccaaaccagccagccagccaagccagccagccacccagccaagccagccacccagcaaagccagccaagagacccaagccagccagcaaagctggccaaacccgccaagccagtcagccaagccagccaagccggccacccagccaagccagccaagccagccaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaacagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagccaacccagccagccaagccagccaagccagccaagccagtcagccagaaaagccagccaagcctgccagccagtcaagccagccaagcctgccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccggccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagcctgccagccaagccggccaagccagccagccagccaagccagccaagccagccagccagccaagccagccaagcaagccagcaagccagccagccaagccagccagccaaaccagccaagccagccagccagccaagccacccaagacacccagccagccagccagccaagccagccaagccacccagccagccaagccagccaagcaagccaggcaagccagccaagccagccagccagccagccacccagccacccagccagccaagccagccagccacccagccggccaggccagcctgccacccagccagccaagccagacaagccagccaagccagccagccagccagccagccagccagccaagccagccaagcctcccagccagccaagccagccaagccacccagccagccaagccagccaagccacctagccagccaggcccaccagccagccagccaggcagccaagccagccaagccagtcaagcccgccagccagccaagacaggcatgccagccaagccagccaggcagccaagccagccaagccagccaggcccgccagccagccaagacaggcatgccagccaagccagccaggcagccaagtcagccaagccaggcagcaagcaaagccaggcatgccagcccagccagccaggcagccaagccagcaaaaccagccagccagccaagccaggcatgccagccaagccatccagccagctaagccagccggctagccaagccagacaagccacccggccatccaagccagccagccaagccggccaagccagccaaccagcaaagccagtcagctagccaagccagccaaccagccagccagctaagctggccagcctgccagccaaccaagccggccagacagccaaggcagccaagccggccaggcagccaagccagccaagccaccgacccagccaagccagccaagccacccaagccacccagccagcccagacagccaagccaggcagccagccaagccagccagccagcaaagccaggcagccagccaagccagtcaagccagacagccagccaagccagccagccagccaagcgagccaagccagccagccagccaggccagccagccacccagccagccaagccagccagccacccaaccagccaggccagcctgccacccagccagccaagccagacaagcctgcgaagccagtcagccacccagccagccaggccagccagccacccagtcagccaagccatccaagccagccggccagcacagacagccaagccagccacccagtcagccaagccatccaagagagccagccagcccagacagccaagccagccagccagccaagccagccaagcaagccagcaagccagccagccaagccagccagccaaaccagccaagccacccagccagccaagccacccaagacacccagccagccagccagccagccaagccagccaagccacccagccagccaagccagccaagcaagccagccaagccagcgcagccaggagccagccaagccagccaagccagccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacccaagccagccaactcagccagccagccaagccagccaagccagtcagccagccaagccagccaagccagccaagccagtcaagccagtcagccagccaagccagccaagccagccagccagcccagacagccaagccagccagccagccaagccagccaagcaagccagcaagccagccagccaagccagccagccaaaccagccaagccacccagccagccaagccacccaagacacccagccagccagccagccaagccagccaagccacccagccagccaagccagccaagccagccaagcctgccaagccaaccatccagccaagcctgcaaagccagcccgccagcaaagccagccaagtcagcctgccaagccagccaagacagccagcaagccaagccagccaagccagccagccaagccagctagccaagccagccaaggcagccaagccagtcagccagccaagctagccaagccaggcagccatccaagccagccagccatccaagccaatgaagccagccagccagccaagccacccaagccagccaagccagccagccaagccagctagccaagccagccaaggcagccaagccagtcagccagccaagctagccaagccaggcagccatccaagccagccagccatccaagccaatgaagccagccagccagccaagccacccaagccagccaagccagccaactcagccagccagccaagccagccaagccagccagccagtcaagccagccaagccagccagctaaccaagccagctaaaccagccaagcctgccaagccagccaagccagccaagccagccagccagccagccatcccagccagcccagccagccaagccagccagccacccagccggccaggccagcctgccacccagccagccaagccagacaagccagccaagccagccagccagccaagccagccaagcctcccagccagccaagccagccaagccacccagccagccaagccagccaagccacctagccagccaggcccaccagccagccagccaggcagccaagccagccaagccagtcaagcccgccagccagccaagacaggcatgccagccaagccagccaggcagccaagccagccaagccagccaggcccgccagccagccaagccaggcatgccagccaagccagccaggcagccaagccagcaaaaccagccagccagccaagccaggcatgccagccaagccatccagccagctaagccagccggctagccaagccagacaagccacccggccatccaagccagccagccaagccagccaagccagccaaccagcaaagccagtcagctagccaagccagccaaccagccagccagctaagctggccagcctgccagccaaccaagccggccagacagccaaggcagccaagccggccaggcagccaagccagccaagccaccgacccagccaagccagccaagccacccagccagcccagacagccaagccaggcagccagccaagccagccagccagcaaagccaggcagccagccaagccagtcaagccagacagccagccaagccagccagccagccaagcgagccaagccagccagccagccaggccagccagccacccagccagccacccagccagccagcccagccagccaagccagccagccagcccagccagccccgccagccagccaacccagccaccgcagccagcccagccagccacacaagccagccaagtcagccagccagccaagtcagccaagccagcccaccaaggcagccatgccagccagccagccaagccagccaagccagtcagccagccaagccagccaagccagccagccagccaagccagccaagccagccaagtcaactgagccagccaagccagtcagccaagccaggcaagccagcaaagtcagccagccagccaagccagccaagccagcccagccagcccagccagctaagccagcccagccagccagccaagccatccaagccagccagccagccagccagcccagccagccaagccagcccagccagccaaccaagccagccagccagccatgccagccaagccagccagccatccaagccaaccaagccagccagccaagccagccaagccagccaagccagccaagccacccaggcagccaagccagccaagccagccaagccagccaggcagccaagccagccaagccagccaagccagccagccaagccagccagccagccaagagagccaagccagccatccagccaggccatccagccacccagccagccaagccagcctgccacccaaccagccaggccatccagccacccagccagccaagccagcctgccacccaaccagccaggccagcctgccacccagccagccaagccagacaagcctgcgaagccagtcagccacccagccagccaggccagccagccacccagtcagccaagccatccaagccagccggccagcacagacagccaagccagccacccagtcagccaagccatccaagagagccagccagcccagacagccaagccagccagccagccaagccagccaagcaagccagcaagccagccagccaagccagccagccaaaccagccaagccacccagccagccaagccacccaagacacccagccagccagccagccaagccagccaagccacccagccagccaagccagccaagcaagccagccaagccagccaagccaggagccagcccagccagccaagccagccagccacccagccacccaagacagctaaaccagccagcctgccaagccagccaagccagccagccagccaggccagccaagccagccaagccattcaagccagccagccagcccagccagccaagccagccagccagcccagccagcccagccagccagccaacccagccaccgcagccagcccagccagccacacaagccagccaagtcagccagccagccaagccagccaagccagcccgccaaggcagccatgccagccagccagccaaaccagccaagccacccagccagccaagccacccaagacagacagccagccagccaagccagccaactagccaagccagccaagcaagccaccagccaagccagccaagcctgccagccagcagagccagccaaccagccaagccagccagccagccaaaccagccaagccagccagccagccacttaagccatccaagcaacccagccagccaagccagccaagccaccgacccagccaagtcagccaagccacccagccagccaagccagccaagccagccaaaccagcctgccagccaagccagccaagccatccagccagccaagccagccagccagccaagctagccaatccactcacccactcaaactagccaagtcacccggccagccaagcctgccaagccagctagccagcccagacagccaagccagccagccagccaagccaaccaagccagccagccagccaagccagccggccagccaagctagccaattcactaagccactcaaaccagccaagtcacccggccagccaagccagccaagccagccagccagcaaagccagcccagccagccagccagccagccagccgagccggccaagccagacagcgagcccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagccaagccagccaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaccagacaagccagccagccaagtcagccaagccagccagccagacaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccagccaagcctgccaagccacccagccagccaagccaggcaaacaacccagccagccaagccagtcaagccacccagccagccaagccagccaagccacccagccagccagccggccaagccactcagccagccaagccagccagccaggccagccgggcaagccattcagccaggcaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccagccagccaagccagccaagccagccagccagccaagccaggcatgccagccaagccatccagccagctaagccagccggctagccaagccagacaagccacccggccagccaagccagccagccaaggcagccaagccagccaaccagtcaagccagtcagctagccaagccagccaaccagccagccagtcaagccggccagcctgccagccaaccaagctggacagacagccaaggcagccaagccggccaggcagccaagccagccaagccactgacccagccaagccacccagccagccaagacagccaagccagccaaaccagcctgccagccaagccagccaagccatccagcctgccaagccagctggccagccaagctagccaatccactcacccactcaagccagtcaagtcacctggccagccaagccagccaagccagccagccagcccagagagccaagccagccagcccagacagccaagccagccagccagccaagcctgccaagccacccagccagccaagccaggcaaacaacccagccagccaagccagtcaagccaaccagccagccaagccagccaagccacccagccagccaagctggccaagccactcagccagccaagccagccagccagccaagccggccaagccactcagccagccaagatggccaagccacccagtcaagccagctaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccaggcatgccagccaagccatccagccagctaagtcagccggctagcccagccagccaagccacccatccagccaagccagccagtcaagccagccaagccagccaaccagtcaagccagtcagctagccaagccagccaagccacccggccagccaagccagccagccaacccagcccagccagccaaccagccaagacattcagctagccaagccagccaaccagccagccagtcaagccggccagcctgccagccaaccaagccggacagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccactcacccactcaagccagccaagtcacccggccagccaagccagccagctcagacagccaagccagccagccaagccagccaagccagccagccagccaagccggccaagccactcagccagccaagatggccaagccacgcagtcaagccagccaagccagccaggcagccaagccagccaagacctccagccagccaagaaaggcatgccagccaagccagctaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagcaagcaaagacacccagccagccaggttagcaaagacacccagcagggagccagccagcaagccagcgagccaagctgggcaaggccaccaagcgagcccggcagctcagtcagtcacagaggccagcagaccgtggtcaagccacccagccagctaagcagatctacgcacaagctctccaagccactcagccagctaagctagccagcagtcaagccggccaagccactcagccagccacggcgccaagccacgcagtcaagccagccaagctagccaggcagccaaggcagccaagccagccaagacctccagccagccaagaaaggcatgccagccaagccagccagggagccaagccagccagcaagcaaagccaggcatgccagccaagccagccagggagccaagccagccagcaagcaaagccaggcatgccagccaagccagccaggcagccaagccagccaagccagccagccagccaagccaggcatgccagccaagccatccagccagctaagccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagacaagccagccaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccacccagccagccaagccaggcaaacaacccagccagccaagccagccaagccacccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccaggcagccaagccagccaagccagccagccagccaagccaggcatgccagccaagccatccagccagctaagccaaccagcaagcaaagccaggcatgccagccaagccagccagccagccaagccagccaagccagccaaccagtcaagccagtcagctagccaagccagccaagccacccggccagccaagccagccagccaacccagccaagccagccaaccagccaagacattcagctagccaagccagccaaccagccagccagtcaagccggccagcctgccagccaaccaagccagccagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccactcacccactcaagccagccaagtcacccggccagccaagccagccaagccagccagccagcccagacagccaagccagccagcccagacagccaagccagccagccagccaagccagccaagccacccagccagccaagccagccagccaaaccagccaagccacccagccagccaagccacccaagacagccagccagccagccaagccagccaactagccaagccagccaagcaagccaccagccaagccagccaagcatgccaaccagcagagccagccaaccagccaagccagccagccagccaagccagccaagccagccagccagccactcaagccatccaagcaacccagccagccaagccagccaagccacccagccagccaagccagccaagccagccaaaccagcctgccagccaagccagccaagccatccagccagccaagccggccggccagccaagctagccaatccactcacccactcaagccagccaagtcacccggccagccaagccagccaagccagccagccagcccagacagccaagccagccagcctagacagccaagccagccagccagcaaagccagccaagccagccagccagccaagccagccaagccacccagccagccaagccagccagccaaaccagccaagccacccagccagccaagccacccaagacagccagccagtcagacaagccagccaactagccaagccagccaagcaagccaccagccaagccagccaagcatgccaaccagcagagccagccaaccagccaagccagccagccagccaagccagccaagccagccagccagccactcaagccatccaagcaacccagccagccaagccagccaagccacccagccagccaagccagccaagccagccaaaccagcctgccagccaagccagccaagccatccagccagccaagccagccggccagccaagctagccaatccactcacccactcaaactagccaagtcacccggccagccaagccagccaagccagctagccagcccagacagccaagccagccaggcagccaagccagccaagccagccagccagccaagctagccaagccagccaagacagccaagccagccagccagccaaaccagccagccagccaagccagccagccacccagccaagccagccacccagcaaagccagccaagagacacaagccagccagcaaagctggccaaaccagccaagccagtcagccaagccagccaagccggccacccagccaagccagccaagcctgccaaccagccagacagcccagccagacagccagcccaggcagccaagagacccaagccagccagcgaagctggccaacccagccaagccagtcagccaagccagccaagccggccacccagccaagccagcaaagccagccaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagtcagccagaaaagccagccaagcctgccagccagtcaagccagccaagccagccagccagccaagcggccaagccgcccagccagccaagatgccaagccacccagccagccaagcctgccaagagacccagcaacccaagccagccaagacacccagccagccaagctagccaagacacccagccagcgaagccagccaagacagccagccagccaagccgccaagccagccagccaagcaagccatggaagccagacagccagccagccaagccagtcagccaagccagccaagccggccacccagccaagccagccaagccagcgaaccagccagacagccctgccagacagccagcccaggcagccaaaccagacaagccagccagccaagccagccaagccagccagccagccaagacagccaagccagtcaagccaggcaagccagcgagccagccaagccagccaacccagccaagccagccagccagccaagcggggggagccactcagccagccaagatggccaagccacgcagtcaagccagccaagccagccaggcagccaagccagccaagacctccagccagccaagaaaggcatgccagccaagccagctaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccgcccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccagccaagccagccagccagccaagccaggcatgccagccaagccatccagccagctaagccagccggctagccaagccagacaagccacccggccagctaagccagccagccaaggaagccaagccagccaaccagtcaagccagtcagctagccaagccagccaagccagccagccagccaagccaggcatgccagccaagccatccagccagctaagtcagccggctagcccagccagccaagccacccatccagccaagccagccagtcaagccagccaagccagccaaccagtcaagccagtcagctagccaagccagccaagccacccggccagccaagccagccagccaacccagcccagccagccaaccagccaagacattcagctagccaagccagccaaccagccagccagtcaagccggccagcctgccagccaaccaagccagccagacagccaaggcagccaagccagccaggcagccaagccagccaagccactgacccagccaagccacccagccagccaagagagccaagccagccaagccagccaaaccagcctgccagccaagccagccaagccatccagcctgccaagccagctggccagccaagctagccaatccgctcacccactcaagccagccaagtcacccggccagccaagccagccaagccagccagccagctcagacagccaagccagccagccaagccagccaagccagccagccagccaagccagccaagccacccagccagccaagccagccagcaagccagccagacagccaagccagccagccacccagccagccagtccagccagccacccagccagccaagccagccagccatccagccagccaggccagcctgccacccagccagccaaggcagacaagccagccaagccagccagccacccagccagccaggccagccagccactcagccagcccagacagccaagtcagccaagtcagccagccagccaaggcagccaagccagccaaccgaacaagagagccagccaaccaagccagccaagccagccagctagccaagccacccagccagccagccagccaaaccagccaagccacccagccagccaagccagccaagccaatcagccagccaggcagccagccacccaagccagccaagccagccaagccatccaagccagccagccagccagccagccaagccagccaagcctcccagccagccaagccagccaagccacccagccagccaagccagccaagccacctagccagccaggcccgccagccagccagccagccaaaccagccaagccacccagccagccaagccagccaagccaatcagccagccaggcagccagccacccaagccagccaagccaaccaagccatccaagccagccagccagccagccagccaagccagccaagcctcccagccagccaagccagccaagccacccagccagccaagccagccaagccacccggccatccaagccagccaagccagtcagccagcccagacagccaagccagccaagccagccaagcccgccaaccagccaagacaggcatgctagccaagccagccaggcagccaagccagccaggcagcgaagccagccaagccagccaggcagcgaagccagccaagccagccagcaagcaaagccaggcatgccagccaagccagccagctagccaagccacccagccagccagccagccaaaccagccaagccacccagccagccaagccacccagccagccaagccagccaagccaatcagccagccaggcagccagccacccagccagccaagccagccaagccacctagccagccaggcccgccagccagccagccaggcagccaagccagccaagccagtcaagcccgccagccagccaagacaggcatgccagccaagccagccaggcagccaagccagccaagccagccagccagccaagccaggcatgccagccaagccatccagctagctaagccagccggctagccaagccagccaagccacccggccggcaaagccagccaagccagccagctagccaagccacccagccagccagccagccaaaccagccaagccacccagccagccaagccacccagccagccaagccagccaagacagccaggcagccagccacccaagccagccaagccagccaagccggccaaaccagccaaccagccaagccagccatccatccaagccagccaagccagccaggcagccaagccagccaagccagccagccagccaagccagcgaagacaccgagccagccaaacaagccaagccacccagccagccaagcctgccaagagacccagcaacccaagccagccaagacacccagccagccaagctagccaagacacccagccagcgaagccagccagccagccagccagccaagcctgccaagccacccagccagccaagccaggcaaacaacccagccagccaagccagtcaagccacccagccagccaagccggccaagccacccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccaggcatgccagccaagccatccagccagctaagccagccggctagccaagccagccaagccacccggccagccaagccagccagccaagccagccaagccagccaaccagtcaagccagtcagctagccaagccagccaagccacccggccagccaagccagccagccaacccagccaagccagccaaccagccaagacattcagctagccaagccagccaaccagccagccagtcaagccggccagcctgccagccaaccaagccggacagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccgctcacccactcaagccagccaagtcacccggccagccaagccagccaagccagccagccagcccagacagccaagccagccagcccagacagccaagccagccagccagccaagccagccaagccagccagccagccaagccagccaagccacccagccagcccagacagccagcaagccagccagacagccaagccagccagccacccagccagccaggacagccagccacccagccagccatccagccagccaagccagccagccatccagccagccaggccagcctgccacccagccagccaagccagccaagccagccaagccagccagccacccagccaagccagccacccagcaaagccagccaagagacccaagctttttcagccaccagccatcactatcctcttgttttcaaacaggattgggatttgattatttcaaacccttcatgggattgaaactttgtcttaagtcagtgactactacatttccaagtactttcgaggagacatattttcatgtgtttttttgcatagctctggatttcaacttacacacccagaaatgtcacctttagaggcccctttgttgagtacatttgatctcaagtattccaggtctggggatggatctagctggaaaatgttcagacactgaagtttctagagcctgaagatgctcccctatcaggtaccaggaccagccagatctcattctctgactctacataacttctgacaaatgaaatgaagtttccgtttttggccaaccatggagcctgctccgtgtctgatattcttctttgaagactgaggatgtgacctgattgttctctgcctcctttttctagctacatttttttttttagctggttctcacacgggctttccatggcctctctctgattgtggggactggccgtttcccaggcacagcaccttggcctgggggagccgtgagaactgatgagtgtcttttgaaggagtcactgggcttctgcaatgggaggatcttggtgtgtggggagcgtgggaacttttccttttgttggttcaggaatgaaattgttgtgtaaatggaccaagagacctaaggaaagggacagtccttttggctggtgggtcctctccactgatagatccaaacaacagagtggaaaatgtaccacaagaagactacgctcgttgcctggaactcagtagcccctgtggctggtgttggcacttgccttaccagtgtgagcctggttttcccgatcatttggccttccacaataaggacaatttaagagattatttctcaatgttaactacttccttgattaattttgtgatctacctttctcctttctgaccagtagtagaatccatttatgttttcaagatgttgctacttaggatacaattatttctaagaaatacaagtgacattgctttgtagaatgggaaccatgttctacagccctgcaaagacctgtcctgagagagctggggggacgcaggcttggaggaggtgagggcaggcactgagtgggtggagggaatcaaacggctgccagaataaacatcagatggagctcctgggcttcttgaggggtagaatttcctctgagctctctacaagacctcagccacaaccattcatctacttaatacattgaagcaattcacataaaaagccagacagatttttttctctgaatttaaaactggatttagagactagattaataaatattgtctttgtcatgtgagtcactttggagagaatcatgtccccactgtatggcaatgcagcagatcctgaccatgcatatttagtgtgtccttcctgctctcttgggcagaccatcccatcaggctatagcacggagctctcacccatctccctgctctgccatgcaccctccttcttgcctgctctttcttctccctatggccagcccctccagccaacatactttttatctctctttgttttgcaaaatccttttctcctatcacttccatcataaaactagtatttggcaaacaatcacatgtcggcataaagctcttaaattgacctgctttagattaaagcacaatatgggttttatagtttgcctcaggtgaccatttaaatgtcttgaataatgaaatgaaaaactggacagactaaaataagagtcctgtctgcctgtgacagtgaagaataagagtcctgtctgcctgtgacagttaaagaatgatccctcattgcctctcacacagctgcagtcagggttcccaccaccctttctgctgattctgaaatcagccctagttcataaattatcagggaatttggtgagttttctcttttaatgtcagtctgtttatttgactggtagtttctggccttaacacatcccactaatgtgttgtttagttgagcacaataataaatagaacttttgtttacttttacatccaaagataaatgttgagtgctattaaaaacttttctaacatagtaggcctccaatgaggaattttccttcagcaaatcataaaactgggtctagaagtgccaacccaagtaaaattactgatgaactaatcatagttgttatttttccttcatcttttcctttttttttttagacaatcttgccctgtcgcccaggctggagtgcagtggcgtgatctcggcttgctgcaagctctgcctcctgggttcacgccattctcctgcctcagcctcccgagtagctgggactacaggcgcccgccaccatgcctggctaattttttttgtatttttaatagagacggggtttcactgtgttagccaggatggtctcaatctcctgacctcgtgatccgcccaccttggcttcctaaaatgctgggattacaggtgtgagccactgcgcccggctccttcatcttttctatgtgctttgtttgacacttattgaggatacagttgctgaagaccagctgagtaggacataggctctgtcatgcattaactcatccacccattcatttattcactcatctattgagcatctgctatgtgtcaggctctatgccaaactttctgttcaggagccaatatatcaataactacagtgtaagctaagtcatgcaatgaaagacttagagaatagacaccaagttgaatattaacccaagtaaattattggaagatatattagttatctaaaataggcttaaaacaataaacatttattatcacaatttctgtaggtccagaatctggacatgacttagcttgatgtttatggctcaagacctcttgaggtttcaataaaggtgttagtcagggctgcagtctcatctgaaggctcatctggttgggggtggtgtctgtatctatgtggttattggcaggccttggtcctcactacactggaactcttcaaagggttatctcatgacacagaagctagctttccccagggtgaagaatgtaaaagaatgtgagaactcttaagacagatgctatagtcttttctataacttaattttggaagtgatattccatcacttctgccatattctttgttagaatcaagtcagtaaatccagcccagattcaagtgaaaggattccacaagagtgtgagtaccaagaggtagggatattgggagccatctgagaggctgcttaccacagagggccagccagttaggaagtgggttcagctgctgctgttaacaggctcgacctaagtggcttaaacacagaagagttgttgttgttgttgttttttctaatgagaaatctggaggcagtcagttgctggccttggctcaaaggctgagggcactgtggttcttgtagcctttcgcttatggccctaagctgctggaactcttgccatcatgtctgcattccaagcagcagaacaacaagaaaagaacagggggagaagagaaagagggcaccagcccactgactatcctgttcatcctgggaagtaccactcaacaagctcaactctcatttccacagccatctccagctgctcaggagtctgggaaatgtaatcacatgcaccattatccccaagtgcaccactgcctccagcccctttccacctttcagttatagccataaacatccagttagccataaacattcagctaatgcatgtgcagattcttgatctacagaaattgtgatagtaaatatttattgttttaagtctatcttagatcactaacatatcctctacttaacatttcacttgggttaatattcagcttagtgtctattctcaagttttccattgtatgtcttcgttcgcactctcctcattgaaatattggctcctgattagaatgcttgagtactgttcttttataccaccaagcctgctcctcaagccgattttgtgccccgcaagccagcgatggctctattaatggttgtccttgtcttttatgagttcatgtgactgggtgggggagattcaacacccaccctcatgctgctcactctcaagtaaacaagtaagccaacattagagtctcagggctatgaatgggagcacagaaatcacagtgcaacctcccaagtacaggtcaggaagcctggtttaaatatttgaaagcaatttgaggaagttcccagtgggaaatgaacttgagaactaggtcattcatatgtccattcaacatctaccttctgcttatctggagtgtgcatggcactgcctggggccactgcagtgaataagagagatgagaacccaggcaactccgagagacccagtcccacctgctttgctggcaggggcttaggatgcagtcactttccattaaagtcagagtcctggagtcccatctgctttgcttctgcattccctacaatgatgagtggttaggagtccaggtctcagagaaagactgtctaggtgtgggtccccaccttgtcacttctgtgtccccttgtgtgagctgctggacatctctgggcctcagtttcctaatttataatgtggttgcctgtcagaggattacatgagaagatgcatattgcttagcgtagtgccaagggcatagtaatagcccaacacttattaaccacgttgatgatggctatggagatgatggtgatgatgacaatgatgttgatgatgacaatggtgatgattatgattcagtttctattctaagatgtggttacagtttcctaactttgggagatatgcctatctgtatatatcacggcatagtctctttctcttattgtagagaaaacaccttcacattatagatgcaccgcttggccttcctatctctcagtgtagaggagactctggaattcctcttgactggtccagatgcccacaaaattctacagacaagcagcaccaaacttaagagcatacatgtgatccaaaatattcttttaaagtcaaagctgtcattgcatttttccagaaataaaatgataaaaactgtgcacaggactgcttatcatacttaactcttaacacagctgacctttaaatggcattaagagtaccaacctgagttctgggtcctaggaaccaggaggagataaaagattaagaaatagggaaggagagcccgggtgtggtggctcacgcctgtaatcccagcactttgggaggctgaggcgggtgcatcacctgaggtcaggagttcgagactagctggccaacatggtgaaaccctgtctctactaaaaatacaaaaattagctgttctgcagacttgggtctagaggtgatcagtttttccccagccaaagcccaagggcagccttgctcctctctccctcccctggcttatgttcccctgtgtatgactgtgtccctccagcccatgacctatagagaatgcagaccatctctctgccagtgttggagaccagatcccatggaagggcactcatgtccagcctggggccccctgccttggcagacactactagttgacataatccagctacttgggaggctgggacaggagaattgcttgaacccaggagtcagaggttgcagtgagctgagattgcactgctgcactccagcctgagtgacagagtgagactctgtctcaaaaaaaaaaagaaaaaaaaaaaaagagaaagaaacagggaaggaaaaatgactggaagaagatgaatatgctgagccacattctgagattgagaagtctatctatgatcacttgcacctcttctcttctgggtagtgtctacttccccacgtccctctgccattcttttgctgaagccatgcccaccttaccatggggtgcagggcagtgaagaagcagcaagctgcgaaggctgagccatacctggaaagagtgactgctaagtgcgtgtgtccctggaggcatttgttccttcacaaggaaatggttgtgaactcaaactgggttctaattgtcaacattcaagggagttggcaaaaagagtcattattcaataaactataccaaatactacagtatgtgcctggcatgttgtagatgctggagacacaggagtgaacaaataagcaaagcccctgccctgtcactgcatttctgcagaaaagatgttttgcttcagggaagccaaatcgctcaccaggagcctggccccgagtccactcttggggtcaacacccagggctgcccagtgggctgtgtctgctgtccccccggtcctagcccacaggctttttgaaatctccagtgtgctcgccatgaggaaagcaggggtgaagtctgctgggcagcctttgtcatgtctgtgattaaggacgactcttttctggaaattaaaatgagcagtcctgctatctcaccgtacaatcactggcatagtttacttttttattctgtgtctggattttccccctggggctgcagcagtaagcctgcttccttggttcaaagccagtgtgtgtttctgcaagaaagaacttctggatcagcagggccccttaacaggctgcaagctggctcttgagagggagcaggcagccaaacaatatttggcctgtccttcccctccatgccagccttagttctggttcctgctcagtaggcaaggggcagcccaggacttcagagggaacctgataacttgtctttgtgtgattaaggctgggtagcagagcccactgagaaccagctatgcttcaccataaaaatagaacttagctctgggtaccagggagttttaataatgtggaaaaatgcttatgttgtcatgttaagtgaaataaagtagagtcctaagcaatgtatacagtgtaactacaactctgtaaacagagagagagcagaaggaaatataggaaaatattaatagtgtgtggctttggaaggtgggattaatatgctctacttggctgggcacagtggctcatgcctgtaatcccagcactttgggaggctgaggtgggtggatcaagaggtcaggagttcgagaccagcctggccaacatggtgaaaccccgtctctactaaaaatacaaaaataagccaggtgtggtggcatgcacctgtagtcccagctacttgggaggctgaagcagaagaatcacttgaacccgggaggcagagattgcagtgagccaagatcatgccattgcactccagcctgggtgacagatgagactgtctcaaaaaaaaaaaaaaaaaaatacgctctactcttctaattttctaggttatccccaggcagcatttataacttttataatcatacaaaaataaactttatattaaaatatacatattttgcatattttaatacttttccccagctttaagaatatctgataaaagaaatttatgttactctaacgagcagctgctatcttggttaattcatattttttcacaattaataatataaacattaaacagaaactggtgggagcaattgtccattgggtaatcagtgggcgaaactgcccatgaaatgaaagcaaaacaaaaaacaatatgaaaataaaaacaaaaaatccacaaactacatcagaaatgaatttcctctttgggacatgctgaaaaatatcctgggtaaaatcaaggtattttgcaattatttttcaagtaaatattgtacagagggacgcagtgatcaatgctgctttcctttactgctttgcaggcctgtctagaaactttagtggccagagaggcggcctgcaggctcagggataactgtcttgccaacaaggaacttgttaagttccttgttgcagtttcctactatgaaaatgtggggtagttttgtgggaaactgttagttccctagtcaatttctgaaagatctaagagaataaggaagttcaccaaatcgcaaattacggtggggttacagccacactgcagatttttacaatgtggtacccagagttgattaggatggggcccactgtatcaattacacttaacggttcgttgcatatagcagaaacctacaataacaaaggctcgaatacaagacattttattgtttcacataaaagaaatccagaggataatgggtctggggttacctggccactgctcatccctgctaactcaggctccttcgacctcttcaccctgcctctccccagtggtggccacccccagctgcaagggcgataacacacgtggagttgttctaggaagaattattttgtgcccagctgaaaatcaggggcttgattatcagggaagggggagaacacatgtggggttaggcaatcagcagtcactgccgtggccatgactggagcatgtcgaatgttctgaggcctccagggggtgcatggcagtctctcagtagtgtgcaacttggcctttctcgacccagaagcctataaacagataataaagcaataaattagctgccacacacagctcggtaccctacagtagaacaggggcaggataatagcaacagcaccaccattccaagaggagcagacaggaggcacacaggggcccctgcctagcaataaaccttctgagcatgcagtgggaggcctttccccctggttttctggtttatccctggggaacctctctactcactgtcctctggggcccctagcttgtgctcagagagaccctctggtctctcactctggatagctgtgtatgatatgggattagggacatgcccttagtggggtctgcacagctcctccttcccacttgctgctgctgaaggttggaggttccacagttgaatagtcgaatgcctttaaaaaaattgagatgtcgtggggcacagtggttcacgcctgtagtcctagcactttgggaggctgaggccggaggatcccttgagcccaggagtttgagaccagcctggaccatgcagtgagacctcagctctacaaaaaaataaaacaattagctggatgtggtggtacgtgcctgtagtcccagctactcaggaggctgaggtgggaggattgctttagcccaggaggtcgaggctgcggtgagtcatgaactcaccactgcactccagcctgggtaacagaaccaaacactgtctccgaaagaaaaaaagaaaaaaaagggagggcggtgaaattcaggtaacataaaattaccatttaaaaatgaacaaattcagtggcatttaggacaaccacaacatcgtacaaccaccacttctgtctggttccagaacattttcctcaccccaaaaggaaaccttgtactcattaagcaattattctcattcccacctccccccccagcccctgacaaccgctaaactactttctatctgaatggacttgcctattctgaatatttcatatcaatggaatcatgtagtgtgtgtccactttgcataatgtattcaaggcttgtccatgttgaagcatgtattaatatttcattctttttatggctgaataatattccaatttatccataaaatatatttttaactcatggtttctttgacaattcaggatccacaaaaacacagtcagcttctgacctagttgcttctcatcagctccctggctgcagtcacactgaattcttgccaagacctatgcctcagacctgctttattgcttttcttttgtgccccttccctcactctcatttgatggaatggtggctaccttgactcttcccggaacaccatatggcaaacgccagtcctttcccttcatctcattctgagccgcttcagaccttgaccactcaaaggccagcacagtctcatctctaatatttgggctttataagcagtcgacttttctgactttgcaaagccctgaatttctgaactctattcctttcctaagaacaacaattccgttgacttctaaacagcattggttgcatcaccaaggggaaaaaaataaaccaaaaaaacccaaaaaacccaaaaaccccaaacctctgccagttaaaccatgtcatgccgtataaagcaagtgccattacaatgtgaaaaagaaatatgcaccgcagagttgacgacgtgcagtaaaacagtaccgatatgaatggctgacattagttgaggttctacgctgtgtcaggcattgtgaatcttttgagagagatgtcagaattgttatctttcttttacagaggaggcagtggaggcagagtgaggttcacacccagcaaccctcactcagaaggcttctgcttgggtagagcttgcattggccaaacctcatccacttgccattcattcagtcattcagtgacaagtgtttatggtcacctgtgggagtgtgtgtgtgggaagggtggaaaatttccctcttggtgttttcaatttagtggaggagtaaagccttgcagcaaaatatgaaagatcattcaaacattagggactcaagtgaacgcaaaggagttggggaaagttccgcttaggaagtgacatttgaatctggtcttcaagacgaagaaggaatttgcttggagagaggggctggaggagaaatgagcaggctgggggtggggggagcacaggtgtaggcagggagaaaagaaaaggggcttttggtttgagaccctgcgaggaggcagcatggaggaaggggctgcagggagctttggggttggggagaggatgcagctggaggagtccctgatgtcacttgggtattattaatgtcaataatcagcttatatagaatgaccttctcactagaataaacagtcataactgtggtgctttaatcaacatgacagcattggagaatctactcaaactcacttgggtctagaggggatcagtttttccccagccaaagcccaagggcagccttgctcctctctccctcccctggctcatgttcctctgtgtacaactgtgtccctccagcccatgacctatagagaatgcagaccacccctctgccagtgttggagaccagatcccatggaagggcactcatgtccagcctggggccccctgccttggcagacactactacttgacaacagatacccctctccccttcttgcttaatttaaaaaaattctatttcagatggcattgtgtcagttgaaagatcacattttctagactagtctgcagctaggtgagcccaggtgatctagttccatatgtggaaccattatgtggaattttcagtaggctccgtcacggtgggaagagatggcgttacacatttttctgtcgtccctcacttcctcctactgtcaatatggggaatacggacttgctggctggagtgccagcaggcatcctgggctgtgaagccactttgaagatgaaagccaggctctgggatggtggatcaggaagacaggggcccaatttcctagcaatgctttggggctgcacccttggcctgtgcttcctatgccaggctacttttacatgaaagagaaaaagaagtcctgacttaatgcattgctgtatttttccagaaatgtgcagccagacctaatgataggtggtttagggtgggaagcagagtaagatgacagaactttaggaccacatgaagggaaggagagggtcccccaggaaagggtgcagtttgttagacagaacaatagcatatccgttacaaagagctgccatttgctgggcgctaagggcctggccctctgtgaacctcaccatctgcatcatctcacttcatcctcaccagggtgggggcatgaggactctctcatgaccagggctattctcaatttacaaatgaggaaacaaaggctcaggaagggctctttctcaaggccactgagttgggagctacgttccactctgggtctgtttgtttcagggacaaaccttgaagccacacaagggccccgagaaactgtgcagatgtgaaacccagagtggcccgatcagatctatgactttgtgtcatcacaaaagtgaaagaagcagttcacagaaggagtggagtgtgcaggtcagaggcaggaaggacaggcagacactgtgatgatgataggctgtgaagaggtgggcgatgcctgggatgggagggactgtgttggacccagtgctgacctgagaacctcctctcaggccctcagtcaggctggcccctgttagacatgagatttgactcactggttcccattaacagccactagagatgaatgcactctatcaagtccatgtctgattaaattcaacaactcaggagtagtggtcaggaagtgtgctgattttttttcaatacaggtaaagtttttaattatgaacttttcagagggcaaactcagattgcttagggtgtatttgtccttgtagtgtttttgagggagtcattaggggcatggaataattaagtgaaaattaagaagctatgaaagaatcactcagctaagaaacaagatggtagatcaggctccgtctgatctcttggcagtatgcattagaccaaagggttatttaggtgtcaaggattttgttttgccagttatcaagcctaagaaacttcccagttacatcaaatcaagcaaaatgatgaaggctatcatccacccttgcttacaacaaaaagaaaccacttataagttcttcccgttagccaaaactgaagaatttaaactgccttggctcttaataatagttttactttatggttttcttgctagtatttcaaatacatagtctgtcttcaccaaactagaaatagttgataccaagaaaaacgtgtttgcccggactgaatgatgtcattgcacactcacggaccatgcactctttagcagcacccatctaattccatgctgacctgccttctccatttgtaggataactgcaatactcagaagccggctggtggatcccaggcctctatcattcaattgccatcactgtacttggtggggcctcaaaggatgctccagatcccattttcctgcttctctttttgaaagcattgtctatgggtgctgcacccactccctgcagccaagctcctgtgcctcactcatggaggctgccggggccatctccctggtcaccatggcctccatgtggccaggtcagtgcatcctgctctgctcctgtctgacttgacctctcagcagtgctggcaggtggacctctcctgccttcttgatacgctcactccttggcttctgagcggtgattttcttggtgttcttccaacctcaccctcactggctgagggtgctgggttcccttctcatctttctccacatattctctctctctctctcatccaggccaggtctttaattccatctgtagaacattaactcttgaatctgcctctaatattgacttttcccaagaattctaagcctactcaacatctccacatggatatctgataggcacgtccaaattaagatggccaaaaccaaatctgggatttcacaccacccatctctgtaagtggcactcctcagttactcaaaccaaaaatcgaaggattatgcttgattcatctctctccatcactgccctcgaacccaatccatccaacaactctatctccaaaacattactcaaacaggtcctcatctttctgtctctgttacactcatcagaccccaaggggacccactgatctcccttggttccacttggtcctacacaagggcttcacacttagcagtaagagttatcctcagaggctgggcatggtggcacatgcctgtaattcccgcactttgggaggctgaggcagctggatttcttgagctcagaagttcaagaccagactgggcaacatagtgaaactctgtctctataaaaactacaaaaattagccagcagtggtggtgtgcatctgtagttccagctatttgggagactgaggtgtgaggatcacttgagcccaggagattgaggctgcagtgagccatgatcacgtcactgaactccagcccgcaacagagcgagaccctgtccaaaaaaaaaaaaaaagaaaaaaaagaaaagaaaaaaagaaaaagttgtcctcagaaaattcaagtcagatcatgtcactctcctgtttaaaagcctccagtgtctcctcatcacacctggcacaaaattcaagctccttccttgccaccttctccagccccatcccatcttctcttgctgttgcttactaagcagcagccatcctggggactcttacttgttcctttgtgtcttggggtcttggcgacagctgctctcttgtcctggaatgctgctgactggctcctggacatcattcagatctcagcttaaatggcacctctccagagtgaccttcctagatgacctgcccatctcaagtatttccctcctaccctatgctaattttttgcactgttcaattcactagcttgtacttttctcatgtacttattttctgtctcaccctcctagaatataagcttcacgagaacagggatcttttgtgccttcttcttgctgtgtcccaggacctgagttggagcttggcatctggtgtgtattcattaaagattagttgaatggttgagtcccaaacttactgtcttttgctccatgtgttctgatatcttctttattatggtctgctttgttgagtaatgtgttatgatcatcgagatttactcataggcactgagtttcaaaagatgatgcatatttagtgtatgattcatttatttaaaattctagacttttgactgcagcctgtgactcaaatactgtattggtggaaaaactttcaaatcatcaaccacacgtatttgggttttaccagctccatggcacatacgaaaaatagccagtacttagagattgttcttattatcatcctagacatttgtggatattaatttttaattcttatataaccctatgagtatgaaactcttatccccattttgtaaattggctgaatgtgtcagttctctaatgctgtgtaacaaattcctgcaaatggagtgacattaaaacaaaccccatctatgagttcacagttctgtggggcagaagtctgggcagactccactgggttctctgctcagggtcacacaaaccaaaatcaagatgtcaaaggggttgggttcatgtctggaggctttaggggaaaattgacttgcaagctcatcggagttgttggtggaatccaattccttctggctataacctagaggtatctgttttactgctggctgtcagctgggggttgctcttagtgcttaaagacctcccgaattcctgacacgtgaccttctcctgctttgcgtctctgacttcctcttctgctttcagccagagaaaacgcgctgcaattttttttttttttttttgagacaaggtctcattctgtcacccatgctggagtgcaatggcatgatcacagctcactgcagcctctctgagtagctgggactacaggcatgcaccaccatgtctggctaaatttttaattttttttataggtaaggtctcaccatgttgctagctggtcttgagctcctagattcaagtgattcttccgcctcaggcttccaaagtgttgggatttctggtgtgagccaccacgcctggccaatgccttgcttttaaagggctcacctgactgggtcaggcctactcatctattctccttattttgtggtcagttaacttggactttattatacttacaaaatcctcttgcagtattacctattattagtgtttgactgaaaaagcagagacaggaatcttggggaagtatctttagaattctgcccactgccctgaggttcaaagaagttaggtgatttatccaaggtcatacaaccagcagtggaaaccagattcaaatcaaggcattctggcccccagagtctatgaccttgaataataccctgcagtgtgatgagaatccagtgctgcattggaaattctgctgggcagattttctgacaatctgatgtagccatgcaggtgagacgcactgggctactttgttcataaggaccggaactatccatggtgccttgtctcctcactcccatcacctccgatgtaaccgaagacagacatgaccaaagaagtcaggactctgcttttcaatggattgaacccacggatgctgcaccattttccacgagtcagcagcaccatttccaggtttttgctgcccccagaacttggttacccctcaaatcctttcatcatcagcatgagtgaaatcaatgtgactcccattaacaagaatattattattgtgcacatgagaattaagcccaaaatgcaatctgtgctcacacaggtttgatgatggatggatgcagtggtgtgctggcagtgacttgttctgggttttggaactaatttgttcatctctgcccaactcactttcagtgagagcatgctggtagtttgcaattggcaattggggagaatttacactagagaaatcagcaaacactacaaatcagggtttgctttattcatttatatttgaagatgtgattgctaaacatttgccagcacacctctggatggatggatggtagatggaagcggtgagagccaagagagcttggggattccagctttcataaccagaagcatggacattcttggaatgcttatgggggtgtggagggaggacccccagcatcagcccaggagaatgagtcttgtgagctgggagatgaagtctctaaataagtgagaagggaggtgatttgagctaggaatcttggcaaatagccccagggcagaggcagaggggaggagaaaaaagaaccatcagagccaggaagatcagtggaaaactggaggcctcacagaaagcaagggccttgcttgagcagaatgatgcctcttgagtttcttaaaaaggaaaaggtaggggtaaggggctgtttaatctattaatacttcagcccactctcagcacccaaataatagggtgggtgcatcaaatcttggtagccatatacataagaatacttgtaggggttgtttaatttagggccttataaagacaataaaatgacttattgagaatcactaaaccaacacccaagtatttaatgaaaatactttttagctcatatagcttgagacaccaaactatgactatgtaaatagctataccatgtttatagattggaagacttaatgtagtaaagaagtagattctacacaaattcattgataggtttactgcagttcctttcaaaatccaagggggggacattttgtagatacaaatgaactgatactagaatttatatagaaaaaaaccaagaatagccaaaataattttgaaaaaagaagaataaagttggaggaaacatactacctgattttaagatttaacatatagctgtattaatcaagattgtggtgttgggaaaggaatagactggtagattaatggaacagaattgaaagtccaaatataaatgcacataatatggccaagtgatttcttttttttttagacggagtcttactctgtcgcccaggttggagcgcaatggtacaatctcggctcactgaaacctccctcttccaagttcaagcaattctcctgccttggcctcccgagtagctgggactacaggcgtgcaccaccatgcctgtgtaattttttctgttttagtagagatggggtttcaccatgttgcccaggctggtctcaaactcctgacctcaggtgatctgcttgtcttggcctcccaaagtgctaggattacaggcgtaagccaccatgcccagccagccaagtgattttttttacaaagtcccaaaaacaattcaatggaggaaagatagactttttaacaaatggtgttttattggatatcctcagtcagaaaactcctcaatctaaacctcacatattgtgaaaaattaacttagaattgataatatgcctaaatataaaatgtaaaactctaaaacttttagaataaaacaggagaaaaatcttcattactagagttaggcaaatattccttagaagacctaaagcactatccataaaaaaaagataacatcaactggatttcatcaaaatacttttattctgcaaaatatattgttaaagaggatgaaaagaccagatatagactgggagaaaatatttgcaaattacatatttgatctaaaaagttgtacctagaatgtataaaggtggctctaaactcaacagtaagaaaacaaagaatccgattaaaaagtggagaaaagaatgagcacacggaaagatgctcagcatcattagtcattagggacatgcaaattaaagctatgaggagacaccatgactcacatgttagagcagctaaactaaaaatactgacaataccagcaggggaaaggatgaggatcaactggtctctcatgcatacattgctggcggaaatgcaaaatggattgtatggtcactttggagaaagtttgacagtttcttataagggtaagcatacagttaccatatcacccagcagtaaattaactatttactttagacaaaagaaaaacttacatccatacaaaaacatgtacacagatgtttacagcagttgtgtttgtcacagccaatgtggaaaacaaaacaaatttccctcaacaggtgaatggatgaacaacctatggtatatccataaaatggaatagttctcagacatcaaaataaataaaatcccacaacatcaccaaaggagactttagtttcatctgtaatgttttaaggttttaagtagacagactattttcatgttctatttgttgttgaatttttaaaattgatgtttcttttattacaaagtatgaaaactacaagagcatatctctgtgcctggtcaatgtcctgtcatgtagatagattctccctcaccatagccaaaccctctctttgagcagtaggttctagccttctttctaccccaccaaattccttctcattctctcttgcatcatcaatttttctctttctaccaaattatttctatcaacaagtacacggatgggctattatttttcccatcttaacaaataaggaaatctctcttgacctcatttccccctccagctatagctttatttctagaaagcagtgtctgttctgtcttcaatttctttcccctttctctcctcactcaattcagagtttcaccccctcttccccagcaaatccttttttttgccaaatccatgtatacttttctgtctccaccttacatgacctttcagcagtgattatgcaggtgatcagtctctcctccttgaagcaccttcttcacttgcccttgaaggtcctacactctccaggcttcccttccacctcaccagcccttacttcccccactcccatctttgctggctcctcctcactccctgacctcttaaagctgcagggcagggctcagttcttgctttctttttctacgttcatttctgtggtgaactcatgcaattccctaactttacagactacattagatccaatttaagatgtcctcaattataagatgcaccattaagttaaagttccactaaggaagaagaaagcactgccaattaaactcttttcaaactctttttttttttttttttgatatggctctgtcacccaggctggagtgcagtgacagtcttgggtcactgcaacctccacctctcaggttcaagcgattctcctgcctcagcctccccagtagctgggattacaggtactcaccaccatgcccggcaaatatttgtatttttaagtagagacagggtttcaccatgttggccaggctggtctcgatcacctgaccttgtgatccacccaccttggcctcccaaagtgctgagattacaggtgtgagccactgagcccagctgccaatcaaactcttacatcctatcatcccaatttcagatgtctctttgttctcagagtccctaaactgctctggagtgagtgatgatgcttctccttcccagcacccctcttggggaacagggttcgcacccttccttctatctctttccttctaactctcttcatcacccagcctgtggaatccttatatgagcttgggatggtatcgcctgtttctacacctagctttgccacatatggttgggcacatcacaacttgtatggatttactccattgggttgtgcagtatataacctgtacaactatacattgttgcctgacttcacccattcctccaaggttttttatttttctctttataatactgtcttagtctattttttgttgctgtaactgaacacctgaggctgactagtttataaagaagataaatttatttttagcaattctggagtctgggaagtccaaggttgaggggctgcaactggtgaggggcttcttactggtagggactctctgcagagtcctgagatggctcagggcaacacacggtgagaggacccaccagagacggccaaagtggctttcatatgagacccacttttgtgataacccattaatccattaatttatgaatgggtccattcatgagagcagagccctcatgacccaatcatctccgaaaggccccacctctcatattgctccattgggatccaagtttccaacacatcaacttctgaggaacacatttaaactacagcaaataccttgtcctgaacttttgaaactttaaagcaagaaggagactctttagttctgtgcattcttccctgttatttcttgcctgaggcaatcgctgtagccttggggtttttgctccagttgggcacccctgagcttaccacggtggctagaaaaaacatgccctcactgacataggcctgggagcccatctaggagccattcacagtggcaaggggtggcccttattttgcatagccaatgagaagactcccctggctatgagggtggagtccatcttaaccaaatgtcaaggttgctgccaagggaggaggaatggaatgaatgtgggggaacccattgggtctactccacagtgtcaaaggcagggatagtattactgggatgaaagagacttgagcctgtgtttaggtctacagacaggaagcgattaaagacgttggaggaaagagcctaaatttggttaggagcaaaatcctagagaacaaatgaggtgtacgggggagggtctagatttgaaatgaaggcatgaaacttctcctggatggaggatgatgaagagacctgctttgaaggtgtaagcgaaggaagggatgtgagggcctctaacagtcttgtgtcctccaggtaggaggagcagcgcagctggagatattggtagtgtggacagcttcatggtactttctgggaagtgtccaatgtgtaattttaattggctcttttcattaaatagaattgatattattttaagagacagatcacttgaaaattaggattttgattcacttctcaaatgaagagaaagtgcctttgcctcatgtatgtgtgcagaatttgggagaatacatcatgagctcagggaatgtgtatgcgaagatgtttgaaaagtcacttgtgggaatttgcctggcttggtggttaggaatgtggactctgaagccaggaggcctgggctcacatccaggctttgcagccttgggcaggctcctgaacacctctgtttctttgctaaacagtgggcaggatatcactatttttggtatagacctactggaaggatcagaagacttaatacctgtgtgtgttttggagagttattggcacatattagatagttttactgtgaatcatcattatttataataattctctgacatgctggaatgtacactgtctttagaaatgaaatttgttttgttttcctaatttcgtgcaacctacatttttccagtgctattttctttggggaaagagcatgcagatgttccgtgttttcaatgtagcggtgtataaaatgtcatcattgtttcctttctggtggaatattaagagccagcttaaagataatctactcccagaaagttccatattagcaattatgtggggctggtgctcatatgcctcaatgaatgatttatttattagtatattgggaatggcctccctcttctcacactagcaccttttccccactttccagcccatttccaaatgagaagggctgaagtcaatcaggaattaagatttagcatttgtgggattatctttgaatgcgacactgggggggacacagtttcactcactctccatggtggcagtccaaattgctctttcgggaccctggctgtgtctaaagcctcagaatgatccagaaggctcctataacagtgccactgtggaagaaaccacttctaatatggcaggaaggtgtggccctgcttggagcccatgttttctaactatttcacatttctttctttcatccctggtgttattttttgaaattaatttttattttcagttctcctaggaattaatgagttaacttaataaaagtaaaagtcttcataaagaaggtaaaggctggctttccacatagagaacaaacataacaacccacatcctctgcagagctcctggtcaatgcattcttctagtggggctgccacacccctggggcctcaggcaagcaagccccttgtggatgacaggggctgggctcaaagcagtctctggggctgtgcctccttcctgttctccactcttttctctaaaggaaatgcactgcaatgaattgcacaatacagacattcctaaattctggaaaaccagcaggctttgaactctcctgggggaaaaaacccataaaacacaaaactgcaaggaatgagactatttggccaaatggccaatatgctacaactttcatagggaactcaccgcacttggtattgcctgatggaaaaaaatgccctgaatttcccaataaaatatttgagatgtggcaaaggaataaatattttttccctaagataaatctagctgtagatgaaaactgggtctcatgcctcggacaaaatattatttccttatttactctaagtctatatcagaatatagcctacacagcatcaggtactaagccaaaaaaggctccaagggcaccattgttcatccatgactttgactgtgtcaccccccagaaaccttgagttgggcagatgtaatcacagcagcctttggtggtttcttgagcagctgctaaggatcacatggattctgctcacacccagtgcttctcataatttaaaaatgcttgaagctgtgggaggctgcccagccctctgcattattcaaaagaaaaccaggaggcagcgacaattcttgattcttgcagataaacattctccaacaattattaagagttggattgctctaccttcatttaattccttggtgctttactatttgaatctagaatattcttgaagtctgaaagatggatagaaaagaggtaagtcatgtaaacttataaacagggcacgaaccccgctaacagacagctttgaagagatgatgattttagatcttgtgaattgttatgtcagaggaatacatgcagaagaaaacaggcaccgaaatagttattaccagagcaaagtaaatctgaacacctaaaagaataagaaaatatcttatgcttctctctactctgaactgccttgaaaagagcaagaatttcatacatgagcctgtagcacattacaaaatctgagtatgtatttgaaattcaaatgcacacaaagttcatgcattttattttccagttgttctcaagactcctaaataaagcatttcccctgtgtgggcgacccctgggtcccatgtggggtcagtgtttgggtctctctgagaggatcaggaaggctgctcttccaggaagggctgcagggaccctgggaaccggaccagtccagctcacaagtatgaagagaatgtcgggagaggaagtggtggctatgagtcagcatgagtcatctcgttccaatgagaatgaaggctgaggtgtgcgcctttttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccttggtgagtatgtttctgtcatttttagggttgcttctgcagtttgccttggagtctgggctgtgggaaaggctgctgcgtcctggtgaggacactgcgtttctttcagactttgaagatctgtcgttttagaaaagtggctgcctctgtcaccagccccatggttactgtcctttagtgtgactgtcaggaggtgtttctcagtccttcgttgtaagaatgtagatgccggttgcaccttctgttgtcttggaagagactgcagtgcttggctggaaaataagctgctcgggactcctctgagaagccaaagtgaagctcagagatggaagtgggtatacttgtgctaacccagggttgctgaggttgggtgagcttccgcttctccgaggtggaggagaggcagctcctgagccatttctggcctcgtggtcagagctgcccaatttcagtgtgagaaataccagagaggcagaactttggctgccttctctaaaagcatatgaatgattgcaggagcgtattttacgtcctttccttttccttaacgttgaaagtcacaaactgtagtaaaatcaggaagaacgtaaaaatgctgggggccagcgctgggggtgggggactggggaggactgaggagggggccactcagtctttgaggcctgacttgatcttgataggtatttctcaggctgttagtattccgatgaagcttagctttactgtcaagtaaaatacaggaaacatttttttttaatgttgttctagttactgtaaatgaaacggttaaaatgtcataaataccttatgataaacatttttcaaatttgcttaaaaagcaacacatcagtaggcagggtatgacagggagctttttcagtacagtcatttgagtgtgtgggcttcctgagttaataatgagtcagcacccaattctaaaattggagcagctaagagaatgttcaatctgctcctcagcacagcacggtggctggccggccccccgtaggaaggcttggggttaaaatcgacttaggatgccgcccttatgtaagtgaccagctcccagcttgggtcccagctcctctgggctactgctgagagaccccctctgctaagggatctgtctctgaggcaggagctaacacatttggcttccaacctttggctaatgttgacgatttttaggttgtcttgaggcaacaggttgaacatagtttctgaaatgaaaaatctagtgtttattaaggctagggcagctgagggctgagcctgcatctggagccttgagatgttccgcttgcacgtcaccctcgccgagggattgggcgggagagtcggtcaccgagtgaacttcaaagttggcgctctgcatgtgacgtgtagcgtgggaagattaagtcagcttaaaatgagagaacaagattccaaggaagaaaacctccccagaaccttactcgtttatagataaaagaagataaatattgagaaaattaaaaaaataaaacgaaatagttgggctgcaaaccagcagctctgggaccagatgcagccctggtgaaggcatcccccaccaggttctgtttggcctgctcaggattgtttttttgtgttgagataactgtgggtggggtccacactctccggatctcaggccctgccacaccctaatgccacaaagcttggagagtgcgattacagcgaggctcagaagccaggctgagggcctgccagcctcgtggggctgctgtgtggtccccatgggttagcatctgcccggccgccggaacagggcctggatggagaaggaactccatcagcactaactctgctagactctcttattaatctgccctctgaaggcatttgggcttgtggcccttgagttagttccatggctttttcaagaaagatcctgcagttccaatgtgagcagcagttgtttccaaggctaacaatttcacgccaactagaagcctccacaagtcaggtgccaggcatttctaagccagtagagcagctccgcttgtttctctgggtgagtcctctcagggtgagaccctgtctccttgtaagcactcggagacgtgccaccttcatggagacgggagccaatcaaaggcaaactgcgttagacagctcttccatgcggtatggacaccaacattcgatcatccttgtttcagagaaggtgccgggccccagacatgtgcttatcactgggtcccatggccttcaatcctttaaagggttttaaggtggctgatttttatcccagacattgatcatgttttttttcatgcagaatttgggcagttgtctggacattaggagttgagtcacctcctacccatgaggaacaagcctgtggggggactgatattatcacttctgtcatcaagaaataaggccgcaggcatccctgaatatagagcatttattaatcgaactgtgaaaatgaaacacagacagtgatgacagctggaagttggccaatgtcctgttgtcatattgccctcagcctagggactggcctgtggctcactgaccctgtctcccactctccacctctcatcagcaactggacctggtgcacctggtctacctcatgtccagtgttttccgcagtacctgactggtatccccacccttggttgttgtgtggtgagctcgtccctatgttggcaagttacttaattcctaggtgtcccgccttcctcactgtaaaatgagaaaagtcatagcacgaatgtcatgagtccttgtgaagattttatgattagcacacaagttacaaggagacacgataactgttacgtacgtactcattcgttcggaaatataacagacagcttagtatctccacccgggtccctctgccctgtgggaatccataaagaattgattctcatcccccagaagtgagatcccgcttgtgtcatcaattacatggcatgttctgcatttacaggacatttatttattaggtaagtggggaatcctccttggttctctccaggaaaacctggagttctagttatcatcatcatcatcatcatcatcactgtcatcatcattgacatcatcacaataagaactcccattgtattcagccctaaccgtatggtagcaactttatggtattccctttaacctccccccaccccaatatccatcctggaagatgggaaggatgataggtttgttgactcactcaaggcggtgggactctccagcaggtatcaggcacagcatctgcttcaaagaacacatcggcgacaggggagccccttgcactcactcaggacaggagaatcaggaaaagcagcagatctgcagggctttgtgtgtaatccaaccagactgatgccacaggccaggaaaccgaggacggttggcttcagacctaccctggagtggaagcagctggattctgtcctcacgcttcctgtctaaagccagctagagtaaatttctagtcatctagattctggttatttggaaatcatcacagtatctggagatgactcatattgaaaaaaattaaataagatacacttaaaacttaacccagggtgaacataacatggcctttccttgtcaattctgaagaagatcattcaagtttgtgcagtgccttagaagccagatgctctcttccattctgccagggtcctaaagaagtactactgtgtcctttagatcactctgccttgatcactctgtcccgtcactctgctatttcacctgtcagtgaaatacctggtatcgtcctgccaacatgaagcattgaatgctttatacgtctccatcctgattgtttaggctttgaatgctgagaagtatctgcactttgttggtcaattgtagatggtgctaatttgtggggagtttttcctgcaaattccccctgtgccataatccagaggacctccctctgcccccagtgctgtaggctaggcagctatgggcctggctcagggctgtcgggcaaggattggactctctataggttccgtttggttctggttagatcacagagctcaggcaaggaaaagccgacaatagatcagaaggaagttgagcgctcaggaaggaggagtgggcaggatgcttggtggtgtcagaggattccttcggattaaaaaaaatagatgttattgcactttgtgtaatcagaaaagctaaggttgacagcagatcttatccactgtggttttcctgcttatcttttgttttaggagtgataaccctgcgagtgagggcttctgctacagggtcttgtagctcttctcttcatcctgccctttaaaacatttattggactaaaaatcacaggatttttaatgatgacagaaaatgtattattttagctgttctcactggacaaatcacttacggagtgttgattaatacattgataagtttctatcaattcagctagatacaagggaaaatgtataaaatagcaagggctccgaaaagagtcaggcttaatttctcttgcacagaaaaaggattctattgctctttctgttccgtcctcaaacaggaagcaggttttctgggacaagggtcaacaggcagccagttcatccatctgcctactcagccatccttagcactggcttccttcctccaagttatcttatgcttcaagaaggctgctggagctcctgccatcacttctgcattccagacagaagagaggaaggaagtggagggcaaaaggcaaagcctcctagatgtcagactcctctgcaggcctttccttgaattcccagctaaccctttcagcctagtctttcactggccaccctatctgtaaaggagctggaggaggaagatggaggagtgaggcaaggccctgagatgatgcagagcaaggggcacacaagaggggactcaggtccaaggtgaaatagcagcaagcactctccctccaaaacccaccgcctccttatgaatccctttggccttgattatgccagtagataataggtatgtgacagttttagcttctctggcctttgatcaggttgatttatgtgaatagactccatgtccttggagatgaacctgttctaaaaattctaagcaaccagccatttggctctttgctggaaagtagcctggcttttgaagccaagtctggacagtttccttgctgcacctcaggactcaaaggacatggtcctgactcaggaagagctggctttgagggaaggggtgagtcatgaacccaagcacagcagagattcttggtgtgtgctgcagaaggtgagagtagcccccatctccctgtgccagtcttctgggggaaatttatgatggccttacataattgggcttatatgtgtttcactagaaagacaaaaaaaggtgagaccttgtctgccaattcgctaccacctccttggggtctaagagctaggctgtttgttcaaagctaggctcctttgtgtattaacagtgtgaccccgggcatcatccttaacccctctttgtcccaattccacatctgaatgatggggatgataatggtagactctgccacatatggttctgaggactaagtgaggccacatgtgcaaaggatccggaacagtgcctggccccaagtcagccctcaggcaacagaacagtgtttggattgtccttgttgctttattggatacgtgataagtactggtgaaatgcatgaatgaaaagaaatcccacttgattttaatacaagaatcaagcaagtgacttctgtccctttgaataccctcctccaagtggtccaaagtccttgaagctaccatctccttggtacccttcctgatgcttctggtgtgggcaatgtggttacttcatcaagtagaccctggttacagagaagttaaatgatttgtccccaggcccactcacaggagagagtactatacaatatcaagctggttgtcttcagcactctgttgtagagacttccagtatgcattctcttctgcttcctctgttgtcaaccacaagtccatgttgttagggacaacagtgtgcccagttaaaaaacgatatttcctagtctcctttacagatacggtggccaatgaaagatataggctgaaaggttagctagggattctagaaaagctctctaaaggagactgacatgtaataggcttagcattttgcacctgaattctctccttccccctgtctggaatgcagacgtgatggctggagctccagcagcctccatgaagccataagacaatgtggaggaaagaaaccagtgctaaggatggcagagcaggcagatggtcacaggtctttgggtgaccagctattttgcctgcctggagatttgactatttttggagccggatgcagagggaggtgggaaaaatattccagctgaaattcaacctgtaggagtatttttcagggtgtcagggtcacttctttgtggagctgcctttcaggtctctggtatagggggcaagggtcatggcctcatggtgatgcccagggaccccaggtgctttggtctttgcagaccactttcttatgaaaaagcagagtgtgactgctctggcagaaagataaatgtcattcaggctgattcattattatacattcattatcatttatttgtggttttcctctgattttaaaataaatcaaaattaaaacacttttgcaggcccctaacagtatcatgggccccatgcactgtgcccagcatgcccaatggacatgtaggccccaagagggcagagagcaatcacagaaggacttgccctggccaacataggctggtctctctaggggcagcttcggaattgtgaattacccagagctgcgtgccaggaaatgtggacctaactcttgcctctgaggaaggcaggcaggcttggtttcatgtactgttgatgagcccgacatcctcaatgctcactcgagctttggaaatgacaagcaggattttcagaacaggattctctgtcctgtccctgttttaatttcagcctccttattccccatgtaataattccccatactggctcaattatttgtttaacgggtatgaattccagtctataatgccaaggtatcaaaatgtgacgtacctttactctagaaatctctaaattatattaaatctgctccaagatcgccctgccctacctcaccctctctgcctggttattgggagattcaaattctgtcattattggggatcctttcttgtcataatgctccagatgtcatcaaacaaacttgggcttaggtgatgccaggaaacctgggggggagcatccattgtctgcggtggctgctaccattgcaacttcgacacctgcagtctcagtgtgtggggggctctgggagctgctcagggcctgctccagttggggtggaccccacacctctcgtgatctgtcctctaactgtaggctccgctgctggaaatgtgtcgctgctctcatggccactgtgtgagctcccagtctcagcaaatgcacccagcaatgtctgattgatagggcaccctctgtgggctttgtcctgcttgctgctagctgctgctgggcctctcccagcctgggcctcctgtctcagtctgaaggccaagagacagcagcgacagcagaggaggcagaaacagaaaactctccgaggacccggggaagtcacaaggtggcttcccaaactctctagtgcagcactgtctgatagaaccttctgcaaggatggaaaagttctgtatctgtgctggtcaaagcagcggccacaagtcacatgtggctcctaagcaactgaaatgtggctactgtgactaggaactggattgaaagttttatctaatttcagttaattttaatttaaatgcccacaactgcatgtggctaccaggttggacagcatacatgtggaacacagactcctgatctgggagccttgaaagatgagccgtcactctgatgaggtggagggcctgaattgagccctgcggtggcactcggcaggtcttcagaggggctggtgacccctccaaggtgcacagcccctgggctacgagcagtggctagtcaggttggggtccctggcctctgccacgagtggccactagtggaagcctcaatgtctccacttccagtgggctctcaggcctcacatgcccatgccagggtagggggcctgtcgaggaggatgccctggcacccagagcttctctgctgtttgtcctgagggttcccttgggctgggggcctcaggtgcagggcacatgcagccggactgtccagccttgtggtatttgcacatgaactttcctgcgtggggatagacagccttattcttgtttgtgtaaagccattccaggaactattaatagttagactggcataaataagcctcaggtttggttcttgttagtgtcctacaaatccctcaaactttactcttttggctttttaagggagaagatttacagtatgttcaggcacaattgacaagaaacatacaagttgtgcggagatgagcagacccagggccccaggcctgagcctcttttctctcccatgccctgcctgctcaagttaccttgagcacaaatgatgtccttctgtgtgtgggatcacagactgagacatggggctgttcctcccctgaagtcacccctcaagttccccacatgattttactcctggctactccccagtttgctgtagtttgctggaccatgtgaccttggaggggctcacaaggcccagtgatgaagccaccgccagggctgagcctcagctcagccagctacttaatgcatgcatagcaagttacttaacacctactgacctcagtttcctcacccgtaaactagaaatagaggaacaattaccacagagagttgttctgaggatgcaaagagttcttgcatgaaaaattcttaggaaagtgctgcacatagtaggtattcaatagcattagctatttagattggaattagtggctttttgccatttactcctgactgtaggagctgttctctgggccccagatctccattccagcaatgatctctctcctccaactctggcattggaggagtaccacaatcctgcctccacatttcatttgctgacacccaggggcagcattaggtgtagagtgctggacatctaagggaagaggttcaattgtccatctgtttagttatttactcattattcaatgaatgttaattgagaccagtcagggcagctgagaagcagtgcggttgtgaggagggctgttagtaggggagatgcaggtgctggtgtgcttccgtgtatgaatatggcagctagtgcagggtcatgaagagggaatcagggacactctggggatgttaaaaactctgttgatgtggaatcagaatccctgggccagtcctgccttcctcttgctagctgtgtggccatgatcgagggtcctctttgatcctccctgatacatgggcgaggtgacccacagtggcagatgcttaaccatccaacatggagtcatcatcattacttagacacccttcatttggaatcacgattctcagtgtgaagggcacttcccaccatagaagcccctctctgtgagccctcagagggctgtctaatccataagccctttccctcccaaagaggcagcccagcgcatcactgcaaagcgccagctgagaagacgttctataaattatccaaagcctattctctggcacatccatattttggacctagctctgcccccgaagtcatataagcatagccacgatgggaaggatggtcataactcaacatgcccattcatataccttgagcacatatcctgtcccagagactgctgaattattgcatgagccccagctccttccacaccaaagcccttccgactgcatggacctcaccacttctgttcaagctcttccttcttctcatggttcctggaaagattctttatgtgctgaggtgttcagctacccttgatcttgtgctgccttccacagcatctacttggcaactttccaatgtcccacttcaggtgggcacagtgacctcctttgtctggtttttggcaaccatacctatctgttggacctgggcactgcactgacagccagctgacctccctgcctctctgtgtgggaacgtgctgcaaagccacatctctctaattctgtgtgtgtgtgtatatatatatcttttagagacaagatctcactctgtcactcaggctggagtacagtgaagcaatcatagctcactgcagccttgaacttctgaactcaagtgacccttgacctcagcctcctgaagagctgggactacaggcatgtggcaccatgcctggctaattttaaaatcttttttttggtagagacgagcgtctcactgtgttgtccaggctggtctcaaactcctgtcctccagtgatcctcccacctctgcctctcaaagtgctgggatcattctgaatatgaggtggtgacttttttaaaaaaaacttttttttttaacctaagtagaactttgcattatcgttggtgttgtcttttagatttagcccatgtattctctaatataaaacatgaagcttcatgtcatctataacttggagtggtatcccctttacatcttcaccagaagaccacttggatcagtgaagaccaagagcagagacctgtgacatccactagcgattgtcttcactgttgccactatcccagtgctctcgggcactgcattgaacacaaatagctccccttgctgcacaagtttcactgatgggggtaaagggggttatgaaacgtatcatatgatcaaatatgtgatagtgatcccacagacaaatggagcgtgtggggatgatttagacactcagccagccttgtcttgatggatacccatccttctctgctgttctctctttcctccatcctcaagcacagggagcttttggcgaggttagctaacttcggggcagctgtgaattagatactggctgtaagttacctccaacatccagagcatttaaacgctcggctgtcaatgattgtcattttcattgtttacatatagtcacatcctcagtttgtggggtggatgcatttgattcaattcagatatgcctttcaagctggccctgctgagctgggcctgaaaggcacatggctcatctcatctgcatgtgacagtctctttgaagtccccagaagtgcctgctcagagtcatgctcgggagggaagaggtaaggcacagaatgagtacagactgccacccagccgcaggaaaggtgactgcacaccagaggttcctggtaaggaggtgactcacccgcgactgtctcacctgtccaaagtgtgtgtcacctgctctgtgttcacccactgggttcatcagaggggcacttgaacaaaacaggaatgtcactggagaggggaacaaatgctgtccccaagtccttccctgccgtttagagtaacgcagcccctgtccgcacatcctcacccccatctgccctctgcttgccagaattatcagaatctctcaattctaatttcagccattctctgtgaaaatgaaaagttagtggcaggcaatggacaccctattgaaatagaaattgttcttcatatgtcagaaaagtcccagagtaatctgggagtaatctgagcaaactgattcaaaggattattacaatttcttagtcttctactgctgcaaaagtggcactctttgattctcatgtttgaggttctaattactacctcatgcaggacttacaagagatcagccatgctgcttacattgtgtgtagtgaatcaatgttattctgaagggcctcctggaagcagtagggattggagaatgtatgtcttttaacatgatcattcccatcctatgggggttgggcactcttaactcatgttgcagatgagtaaactgaggcttttgagagtttgagggtgcacagcttgaggcagaggtggaattcccagcttcatccaagaaatcacgaatctccaatggcttgcacacatccaggtttgctggatcctatttgtcaagaccacatgcagattaggagccttcaaacaaattatttccaagggagggcatctttctctgtaacccctaccctggcaattctccatggcctcagggagtccagccggaagctctgcaatgagtcctggggaactctcatctggaaaaaggcgctcatgacaggtggtgccaaccttccacggatgcttttcagcatctcttgggatgaggatacagaatttctctttcaccctgtaaatgtggtaaatgagggaatagaatttccagctttaatttttctgaataggattcaaaaatgaaattgtataaaaaggtatccagtgaaaaacacacacccatccccatctcccatccagttccctccgtaacccttttcttagtttcttatatgtcctttcagagtttctttatgcaaatacagtataagcaaaaaagaatgggcctttttcttttcttccttattttccacaaaatctatcaaaatgggttttttttgttttgttttgtttgagacagggtctcactctgttgcccaggctggagtgcagtggcacgatcacggttcactgcagcctcgacctccccaggctcaggtgatcctcccatctcagccttctgagttgctgggactacaagcatgcatcaccaggcctggctaatttttctattttttgtagggacagggttttgctgtgttgcccaggctggtctcaatttcctggacacaagcaatctgcctgcctcagcctcataatgtttttttttaatgttaaaccccttcttgtgttgagaggcctggcttgtgtgtttgagcgcagctgcctacctttgcagctgtaaatgtcagggctccaggagggctggctgggtctcccctcctcccctgttgggtgggtggggccctgagcttatccaggcatccctaggtggatggatgggtggatgggtaggccctggccttcagggaatgcactgtgtgtggtcttccagccccagcaaagtctcagggggcccgagcgggaagtcgccatcctcagggggtccgagtggggagtcaccatcctcacggtcagccgtggtttcgaattgagctcccaggggcggagactccattcccccggggaacaatctgatagccagaaatgagagcagtgagtgacttggacgctgtgtgattcaggagggtcccagtccctcagagtcgcctggacaccagattgtatttacaaaacagatggatgaggaaatggagattgggtcttcaaaagaattaacctcagattttatttatttattttaaaaattttaatttttcccaaggaccctttccaagtcaagaattgttttaaaaagaagcctggtgaaggcaaatgctgtctgtggccgaaggcaccgtgaggagctgaggctgacttatgtttctcctctgggctatgtgcgcctctaaggagttcacacactttaacccccttaggaaccctacatgatcatcctcgtttcttaaagaggaagcagagccagcaaacaagtgggggagccacagttccagcccaggtgtcactgggccctgcctgccccagccagctcctcaggagcacacggcaccccacgtgcgtgcaggggacagctgtcctcacaggaacagccccgggacctacaggacttcctggggtttaccctcagagcacccatgaggttagaatcacaaagcccgggagtcaggagacacagggcagctggagggaggtctttactgaggctactgaggcacagcagccccgtctagaggcctccccgagaggcacttcctgaggagtctggtggattttgagctgctttttaaacaaccttctccttagcatagacactgacactgaagggaaagaaagcaaatggtctgttcttagtgggaaggcaacttgctttcaggggaacgagtttgggggaagaggactggtagaagacacgactaagaaagtgagtaggagtccagacgtgtgtgattcatcctttagggcctctgtgtgtgatgggttgacttgtgtgtcccaaaattcacatgtggacgtcctcgcccctggcagctcagacgtgaccttatttggaaatagtgccattgccgatgtaattagttcaaatgaggtcatgctggagtcgggtgggcccctgatcccatatcactggtgtccttataagaaggggaaatttcaagacagacacacactcagggagtacaccatgtgaagactggacttaaacagctacaccaccagaagccgagagagaggctggaacatagccttccctttggaggtagcctggcccggtgggcactgtgatctcagacttccagccttcagaactgtgagacaatattttattgtttaagccacttattttttggtactttcttacggcagccctagcagatgctaatccagcgtgcgtcctgacagaggttgaagggggcttctcaagtcccaggtccagcttggtgtggttcagctactcaagagacatctgctgctaatggatgagcagtcaacctggacgcaggaaatcattttttatttgggtgaatacaatattctccttttgttttcacttttcctaaaagttaaatcaaggttcaaaagaaaatcgaggttcaaaagaaaaatttggtctttacatgtgctaaaaagaaaaaaacaaaaagactcatttcatctttatatgggatgggatccgtgctctggtgggctacagagtgtgtctctgtgtgggtccctgtactccgtgcgaggttggcggccgagccacggttcccatgtgagcaggacagcacagtctcacctcacacagagaacctcgcccgaacatggaactttcacccacgttgccattttcccgctccctttccctcctttgaggttcacactcgtctctccaaattaaaatttacaaagagaggagatggaggctcccaagtggccacaaagtcacattttatgtgagacctttttgcctcatttgctagttattgaacaaaggtgactctgaacctagcagaagcacgggttcaacacacagttcagaaaaacaggaaccatcaattcataagaacttaaagaaaaaaatagtttaaagaactgagaagttgccacattatagtgaaagaatgttgggttttggaaatgacaaaaacgagcaatcttcaccttgaaaatccggtggagtcagttacacaagacataaccgcacacaaacatggcatttctgatagtataatggcatttacagtcaagaagcttctttcagagtatttcatggaaagttattttagtagcaagggtagccttaagcagtgagtattcgtcaagagagtgaaaccttgacttcaaagtcaagaggcggaggagtgaggactcagatctggaggcgacctgcagggcgggtgcccacgcacaggtgtcccagctgtggacatcccacgtgcacaggagtgggccaaagagaggcccatggatccctgcccacctcagaaatgtgagcaggcagctggggggcatttggactctagccgggacaacctagtggccgggcaggggatgcaggcaccacaggtcacagtggtttgctacgagcgtcagcttttaaaattttaaataatcctcttattgtaaaattgaggacattatttgaagcaacgcaaaaaccatgtaaaaaaatgtctgtaggatgtgaatagcatgtttctttaaggcaatatctgaagaaaatataaaagccccaggtgaaagacaccctgggagcagaggtgcccctgagggtcggctgccccaggacagaggagggctctgctggtgcccaggtggcactgcctgtcttgatgccaggtgcaggggtttagaagaaaagacaaggaagaaaataaaactcaccaccgacattcctaccactagagttacccactgttcccagtcaggcatatttcctcccaatcctgtcctctctgtgtatttggtaattgcgtaaatcatctctcccataattaatctcctttaaaatttggaataatatagttgttagaataatataataatcatgcagaataatttagaataatgttgtttagaacaatttttgtagtcatgctaccttgcagtcattcataactcagaagaactctgcatttagaaggtctatttaaaatgtgccttctttgctgaagagttagttttatggtaaaaatccaataaaattgtagctaagcactgaaaaaaagtaaagaattaagctcagcctccagaaatactgattttatatatatttgctctggggaagattggtttaagaagacctatagcctgttaattgcccttttataaattgcctccctatattttttgccctcttttcccctccctccctcctttattccctctgtctcttccctttcccctccctccctcccttcattcctttcttccttctccttttcttccttttttttattgttgttctgggggaacttttctaatatcctggattttaagactttgatatatatgctgcaaatactttctctcaacctgtcttaactttctttactgtgtcgtttatattatggaactatttaacttttaagtagttattattttccttttaacacccaggttttgtcttgcttagaaagtctgttcctacccctagattcgaaaaatatcctcacatttttttcttctgatacttagtaattttatttttggtttaaaatgtcaagtcaagtagaacttatttttgtttataatttgaagtaagggagtttcattttaccctaaatgtgtagcaaattttcccagactatttattaagtcattcacttttttcctgctgaaattatgatatttaagttgataagttttatgtgttggggaggtgtcaaatgggcagtttccagttggaatgtgggattgggtagagctttgacacaacgtctgtgtctttccgactcccatgtgacttcagggcaaagaggcagaggaatggagctcagagcttttagagaatatgggccagaaacaggaaggagtcaggacctgataacgggaaccagcggacagtgaacgcagtggagggccactggggccggagcagccgagagatttcaggaggtgagcttcagagagcctcggcataaatggatccagggtgtggtcagctcagggaaagacagacaaccagggctgagcacaggccaggccaggccaggcagggcccccggagaatcacgttttagtatctgcatattgagaaagtttgaccttgagtgtgaaatgtagacaagcaacccaaataaaaaataggcctgattggggccaaaaacaaaacagattgatgaaaataatctcaagagtaggaatggacacaacctacaagaaggagactgaacccaccaagtgtggcgcttgagtcaaatcaaacgattagaggctgccaagtcggcccaaaccccaagagcgtgggaatctgggagggcaccgagggctgggctgagagcctcttttcaaggaagtctttccaggatgctgtacttctgtcttgccaccttgcaggccttacagtgagaccatgaagtccctggcactctccctgccggacccgtggccgatgttgatatctgctcggccggcctcacaggtgtgcgcgctgtgcagtcgcttagggcctcccctgcgcagaaggtcctggcttggtttaatgccctgctgttaccatcttaaaattcttaatggtttttgaacaaaggccgcacatgttcattttgcaccgctttgtaattacatgatttaaaactctgtgcttttctcttcctttttattaaaaacaagaatgtcagaaattgcccctttaaaactgtaaaacaagaaggcattaaactcttaatatttcaggtcaaatttgacactgtctctggacatgcaggtctgggtattggtgggccttagcccctttcctgctgagcccagaacatgcttctagtcacctagcataggtctctagggggcctctgccacaaggcagggccaacgccaaatgacatgcagttgcctttgatgaatgggactctccaccactgctttatgtaaacagcaggtcctgatatatgaaatgtggcttcaaagcaacttaaagaaatgaagggtcaaggatagaatatgtgatgagattctgataccatggagcctccagccccatggcttgctgtgcttgggctgtgttctctgtcctggaagggtccacagagagggcaggctgccagcaggaggcctgcctgctccaccagactgatgacacttattccacttggttcccagaactaagaggtcaggggccatgaaggactagttgcaggagaactctctgtcttaatttaaggcatgctctgtggagtggggctgttgggcagcctttccaatttatccacccatccctgggatctcttgggattgagaaactgagtttctccagggttcttctctcaccactcatatcctgcaaccttagggtcctccctgtactgggtatcagcctggtctcagcattcagggactcagagagaataatcagaggtgcatttctatcactgtgaggaccttaggctcaggccaataatgtaaagaagcaccctacctgggagaaacttactgtctagttgtaaagaaagcaccagggggccatgatgcccatcccacccatgttcccacccaaactctcctaaacccacagctcccaaacaagttctggattgtacagatcaggctccagccaaggtgagctcactgaggtcagagcttacagaatctgggagctcaaccaacatgatggcttcagagatgaaatacccagcacatccagctgcagttgccccataaggagcagaaagtttgctatcacttcctctgtactgtttttatgttcaggtgacctgtgggtcagttgttcgtaatgtggtgatgcctgtaaagggagcactggaggtcagggggtgccagtgagtggaggagaccattataaatactgtgtccccaaagggtgtacagtcaaataaatatagcatgggaaaagccaggttgacccaagagaaacatctttttctaaaaatctgcaagacttctcagagcctttggtcgtgcattttaaatatccaaatatgtgttttgaaaatatgtgaaacagcataacatttgtggtatatgttaaatgtagatgatggtggaactttctgtttttttcttagagaatttcatgggaccaggcttccaaaaaacacaaatgttttgaggacaaaacatatgaatattgtagaagattagaagcgataaattactataggcagaagataagtgacattggattgaaatttttaaaatgggaaaataattacaaatggaggagtggcatggtcagaggcggagtgcaggtgcctgtggcacatctgggctcactggctcaggcaagctgcggtggagcagaaggctggggacatgtgtgtagagtcccaactgtcagatcacagtgttgggttgggtctttcacctgcaggggcgtgtgtgtgtgtgtgtgtgtgtgtgtgtgtgtgtgtgtgtgtgtctgtgcacatgtgtgtgtgtgctgcttagagtttttgagcaaagtttggaatgatcaatgtgcagctttagaataatgacttggtgggaagaattgaagtgaggaaacactggagatttgtagccctcctagaagtcactttcagcatggatcttggtgtggcctggaaggaaaggacctggcttgtgggaggcagcagcagaatggacacatgagagccacaatcaagacagacgtggcagggtgaataactggctgaattgtgaaactctaggctgcccatatcacactgacattttgagaattcagaacagatggcaacacctgggcccctgcctgtgcagatgggccagaaaaacgtgacatgtgtgaaggtgggcatggggtggcagcagtttctctcgcccaagcattaagagtgttacagagcagaactgttattacggaattggtgaagcacctctgggggactccctctccttcccccaagtatatgttggctaagtagccaccaataacaaatggagacacctgcatgctcctgcagccactgcagtgtggccagctcctctgctgggctatacacgtggagatcgtgtaagtgaccagggccaatgtctctggcagccatggagaaacaggtggcccagcccggccctttcactgcccgtgatggacagcttgccatcgctggtcaatagctgcactcccagatagtattaggtaatatataattaataaagaatattccagttgatctggttcttttaaaacaaggaaacttcttgctatttggtacccacaaattccactactccctgaattgtatgtcctgaaatctcacaaatttgcatgctgacattgttaataaaagaacaggagataatttaaacagccctgtggtttggaagtcacaggttctgctgcttcatgttcatgcacgagactaagagcctttgaagaagatcacttcctagaccaaggctttatgtttggattaaatgcagctcctccagatcatctcccgaggagattcagccagcctctgttctctctactatccccgtcttcttgcctcatcccatgcacacatttatatgtgttcacatttatgcatggacatgctctagtgtgccctctagtgcagacattttatgcatgaaactttaacccctcttgcatcaaggcatataagcagaagagatgagtggaaagattttagggcttggaagggcaaacgtgatagtcactgtacattataaagaacaccaaatgacagtgtgctttggaatatactactaggaatgtttctgctttgcaattggaaagtaatgacattgaaaagaagtgaaaaaaatcacaggtatataattcagcaccaaattgatgaggacacagaggtgaactagaaaggcatcccagcggaaaccacttacagccccataaaagcaagatctaagcaatggggatataaaaaaggaagggaaattgatgaagatgacttggggtgacgtgacctggagtttagggagggacagggacttgccttggactcactatgggtgctcatgaaggaggcagcatttggacaaggccctgagaggcaggtggatttggatgtgcagtggtggtccgggtgtgtggagtgggggtcagcatgtgcaaaggcatggaggtcagcaaaccaaggctgagagcacaagaggttcgctgtgtgtcttccagctgcccagtgagcacatggaggtaaaggtgcacaacttggtaagcgacaggagtttgtgtggatcaggcctgctgtgacataaatatgcaaatgatgtggtccctcgtggtagcaccctcaggatgacgcactcttctaccaaaacatggctgaaaatttttggtgtgtgggggtgtaccctgggagcccatttagaagctacagtgaaaagagccctcattgcttcagctttgagccatctgggccctcccacctggctcatttcacctgacagtttctaaaacttctcacaaggaatttgtcggtttattacacatccatagaatgccctgaagagctattccaaaagaagagcttgaaagtcgaacgctaagcagaaaaacagtgacttccaaaccacagggtttgttcgaattatcaacttagtcctttattaacaacttcaaggtgcaaatttgtgagattccagacaggcagttcaatgagcagctggattttgctggttcccaagagcaaggaaaattcccttgttttaaaaagccagatccatttggaatagtctttcttccccacatattacagcatgaacgtgactctaaagtacctgccgagggtctttctttttgtgacggtgggcgctgttccccactgtcgtggacttctcacagcgctcagtgtgcattcggttgcttctctccataacgcctctcagctaactgtgctgtttctgtgctcctgggttgttaatgttcaagtcttggctctataccattttccttatcatttaggattccactgggaagacatcactaagttgtgaaatcaaacttcatgagttggctgagatcatagggttgggtgtcctctgagcacttgcaggctgggggaagacagaaaacctggacaacttgcaattgtttgcaacaaagtggaaaaactaaagtagttttgatatgtgcattagtttgcttggactgctataacgaaatactacttggtggcttaaacaacagaaatttcttttcttacagtcctggaggctggaagtgcaaaaggaaggtgtcggcaagatcgtttttttctgagagctctctccttggcttgcagatggcagcctgctcctggcacagtcttttctctgtacgtgctcatgtctgtgtcctgatttccttttcctagtagggccagtcaaattggattagggcctaaagtaattatctcattttactttacttctttaaaggccatatgtccaaatacagtcacattctggggtgctagaggttaagatttcaatatataaatttgcaggggacacatctccacccataacaatttgtttttcgtaatacgtttaaaatacccatttctgggctggatgcagtggctcatgcctataatcccagcactgtgggaggatcacttgagcccaggagtttgagaccagcctgggcaacatagccagactctatctataaaaaaaaatacacacacacacaaacttggccagatacagcggtgcacacctgtagtcctagctgcttgggggactgaggtgggagggtcgcttgagcccagaagtttgaggttacagtgagctatgatcatgccactgccctccagcctgggcaacaaagcaagactgtgttacttaaaaaataaaataaaacaaaaagacccacttccatttatttcacccatggataaattgtgtagcaagtggttaggtgaaatgtgaaatgtctggccaattattgtcatcatgctcaattatagagacacagtatgctcccctttgcattcttcattgctgattctgtgctttacatctggcagctacaaaaatttagtattttgctagcaggtgcatcaaatctatttttggtttcaaacaatacactttttgttttcagcgattctgaccagtagtcaacaattgcaagtatgtggaatgtgattctcctgctttgggaacaagggagctcccagttttgtgggcaggatccgacattcccatcataagggcggcctcacctgtctgtacctctgacacctcagtcagagcccttggagtcggctaggccagttttggccctccttactgagacctagtcattctgtagacatacttcattctcccaggcttgggcttctggttcaacctgtggctctgtcattatcaccagaagatatccatctggcccaccttctgtggcttttttcccatgcacctttcagactaaattgtatacgctcatcctccaaagggttggctgtctttggtggtattttggcctgagttctgccttggatttatgttttttgttacatatatatatatatatatatatatatttttttttttttttttttttttttttttttttgagatggagtcttactctgttgcccaggctggagtacagtggtgtgatctagattcactgctacctctgcctcctgggttcaagtgattctcctgtctcagcctccagagtagctgggattacaggcatgcaccgtcatgcctggctaatttttgtattttcagtagagacggggtttcaccatgttggccaggttggtctcaaactcctgatctcaggcgatccactcgcctaggcctcccaaagtgctgggattacaggcgtgagcctaccgtgcccagccttatttcataatttttgatcgtaattccacccacatgttctattcatgtgaaatttactaaggtgagaccaagtggagataaaaactatctaaacgaaaaacttaggtctctctttcagacttttttttggttttatggtggtaaatacaacccacttggcctttcccctgagactactggttcttttgtcactggagtcccagagatcagggtttgaactagcccaccacttactggtcatgtaactttgggcaattcagtttgcatccctaagcctcaatgtcttcatctgtaggatggaggtaaccataatgcctgtctcagaggctgctgctagtgttaactgtgggacacaacacagagtgaggcacagacgaggtatgcagaaaacatcagcttcgtggttttttactcttctgcacttgctgtagcattctgcaaaactattattcctttcctagactcatgcccaaagttacggaggacccagcaaccatctcctgcagcccctggaaacctcttgactcttctgtgatgtccccagtgatccagcagccctggccttcttttgatggcttgaacatttggtcttcattgaacagtttgtatattggaaacttgccagcctccatccacattccaacctccgtctgcatccctcggtacaaaatggttcaatctgtctacctcctttcacattccaccaagatattccaaggcccagggttcctttgaccacctcacacctaacaagttccctcactgtctctcactctcccctgaagattctaagctgcctctgtcctgctaaaactgtagacctgagaatgaagtaaggtgcttcaggtgaggcttgatcagcccagagcagaaaggggccacctcctcccaccctataagaccctattagtgcaccttggagccctttgcttggctggtggctacaatacacttctgttaatgacggaattccataacatttttccccattaatttctgctacaaaacacaaaagtcttagccaggtgtggtggtgcacacctgttgtcccagctactcaggagtctgaggtgagaggatcgctgagcctgggaggcagaggttacagtgagccaagatggcgccgttgtactccaacctgggtgacagagggagaccctgtctcaaaaacaaaaaacaaaacaaaacaaaacaaaaaccaaatacacacacacacacacacacatacacacacacacataaaagtctcatattttacacttatgaagttaggtgggttttttttgtttgtttctttgttttgttttgttttgttttgtacccaaaagtacataacctactactacctacctttttggtttttttttttttttgagatggagtcttgctctgtcacccaggctggagtgcaatggcgctatctcagcttactgcaacctctgcctcccaggttcaagcgattctcctgcctcagcctcccgagttgctgggattacaggcacctgtcaccacacctggctagttttgtatttttagtagagacaggatttcactatgttggccaggctgattttgaactcctgacctcagatgatccacccgcctcagcctcccaaagtgctgggattacaggtgtgagccactgcgcccggcccctttcctaaggttttctaaagcatgtttgtggcaatctatcttagaatcttgtcaaaggtaaatacaaggttcagggtttacggagccaccttctagccctttaagccaccagaattgctgatgtcttatggactcctgagaagtttgtggtggtgattcttagagctcagctcccgactgctggactgtcggtcactgggcagaaacagaactcagttctcatcacctggatgccgtttcatactctccaccctctcctgggcttcagttgccccacacaatgtcagtctctttgtgatggttagttttatgtgccaactttgctagggcatggtacccagatatttggtcaaacattatcctggatgtttctgtgaaggcactttttagcagattaacatttaaatcagtagattttggcaaagcagagtcataatgtgggtgggcctcatccagtcagttgaaggccttaatagaaaatgatgggctgggcgcagtggctcacgcctgtaatcccagtgctttgggaggccgaggcaggcggatcatgaggtcaggagattgagaccttcctgactaacatggtgaaaccccgtctctactaaaaatacaaaaaattagccaggcgtggtggcgggcgcctgtagtcccagctactcgggaggctgaggcaggagaatggcgtgaacccaggaggcggagcttgcagtgagctgagatggcaccactgcactccagcctgggcgacagagtgagactctgtctcaaaaaaaaaaaaaaaaaaaaaaaaagaaaagaaaatgacgaacctccccaaagaagattggattctgtcagctgacccaaactgcaacagggactcctggggtctctgcctgccagcctgccctgtggattttggacttgccagcccttaccattgtgggaacctaatccttaaacaactcaatctccactaccctcctcgcccttctctctctctctctctcacacacacacacacacacccacacacacacacccacccacacacacccacacacacacacacacacacacacacacacatccaattgattctgtttctttggagaactctgactaacacagtctccttctcagtattaatgtttttttcttggacagaaaatatagataaaatagaagtctagaagttctgttttctctcacgaccaaattcttctatttctcttttaacccattcagatttgtgagtcccggagcgtgctttgccagggctctgttgagttccacagtgcattgagcaccactatgtgggaggcactggctctcaacaggcagcaggcaccttttccctaatgaactgtctttccaggtttcactcaagccctttctatcagacttctaccatgcagctctgccaatttctttaagcatctctcccttcttcctgactgtcctgaccaggaaactccctaatctctaatatctaaagtcatgaagccaattgcatcattagatgcgcagtatatataaataacatttacttacaagaatatttttatagaaatgtatgtaaacatacttacatacatttctataaatacatttaaattcctaaagacttgtttgagcaatttaaaaaaaaaatgctccagtttaacttcctactacaattaggaatttggggcagggtgcataattgccagtgtactcacagtgactgcaattagaatgtgctgtggagtcagaggaactgcctgacagtgccgggcagttgaccctgggctgggttcagagctctccagtggccactgagaagtaggagagtgtttcctgcacaatcctgatttcttgggggaggaggtactactgcacgctgctgggaggagcctctgaaactctcctgggccaggtctcctcccgtgcttcctctccctgaggcagcctcacctcttgacgcctgtccccagcacacccttctgtagctttcctctgactcacccctctgtgtgtctttctctccaactcggggtcctgtcacctaggcctctctcctttttcctaggtggctggcagttgctcttcccttggttttctctaatttgatctctttcccacccttccagtctgccacagtcacccttgatatccgcagaatccaccctccttggaagggatgaggaagggggtttatataactcaatttcatttgtaatgtttcaaatggtattttttttctgggaataattggcgctggattctgaactatctttcctgttgcaaagaatgaaatcccttctaggtgatggggcttgatctttctctgttgcaatagcagcgatgtccaaaacaatcaatcagaggcattttctaccgtacctgagccattcagtggtttcgacctctgctccagattacccagggttatccagatgggttaatgcgagtccttagaatggtgtttcccaccttgagagtgggttgttggctaggtgtgtgggggagctgtttgtctacacctcagaaacgctcacaacagcaggttccagggaaagtccctgggtgtccagtaaaagctgggtcgccctccctagggggctctgagactagcagaactgatggccccataatttgagcacaggtatgcatatttcttaggggttggtgggcagactcattcatgttcccatcccaggggtgcaggggacccttctcccttccccacatcagcccagggccacagaagctcctcaggaggcaaggaagggaatggagaggacaagagtgcctacagagtgggaaggagacaagcattctcaggtatttatccagggtaagggcaagggcttttctgcagtccaggacattagaagagtcctgaaccaagaactccacccctgccccgatatcagctgtttttattgactgagctgttggagaacagttttggtgtgcggaaacagtgagatccctaaccctacacccctgaacccagcagatatatccacactgaccagaaaggactggctaaccacaagcctgcctgtgcatggcagggaaaggaaagccattcttgagtaaatggtgttcaaaggttgggcaatatatgtatatggtgttctcctgtggacataattgtgcacaagggtcagaagaaattgctttcattgggcaagctacttaacctgtctaaagctttgtttttttatgatctgtaaatgaagacagatcctatctcatggctctgcacgtcacacagcgatagcagacaggtaattaggatgcaggtagttagcagacagcctgggtgtactttagctgttcaagtttcctcaacctggcctcctagccatgacctttcacagaggtgcaaatcatctatgagtttgcacagaatcccctgcaaggaaatatgttcttgttcttgacttacatttgagttggttggtcttacagttaaggcggaggtcatcactcttaataaaggccattttaagtggagtgacaagtcactaagggacttgttggcattgtttacttcttatccagggctttccaagaagggacagtgtgtctgagtttttatcttatgaaggtttcccacctgcagtttagtttactattattctaagggctgtttataaatgaactagcttgtctttgcactcagggtaattcacagatttgtcagtgacttcattgcagctgtgagctttacacgaaccttgcaatccgccttgaaaaatgaaactgagtataagtggggaccaaggaagaatgtttttgagggaaatagaaattaccatcctaaaaatggttccttctgtgtgtctgctgatagaaacccttgacctctttagaaacaaccgcaaaattattcactacaattatctgaatctcataaataaaataatgattacagctgcatggaattattcaggtctaaattcatataaacatatccctaacaaatttatttatcatgacaggaaaggaaagcatagctttgtgcaccccatcccacaccctccaccccctacaaattttactaacactgtttctgggttcagaatttttttgcctgagttggtacctcaaatcacttgagttaaactgcaaatgaatcacacataatgcagataaaatgacttcatgccctaatttctagaacgtgacctgaatgtgaactagacattcgttttcctaaaccccatgagacccaggtattcttgacatgtgtagagaggattgaaggggcccgaggctgtctgtcctctctccgtgggcctggctctccttggaccaaatcgaatgcatgggaacacaccccccagttgtctttttccttcggtttatataattcctggcatgtgcctttcaacactccgtttatgttagaagtttggtattagcctcggggctttactcttgacactgctactaattctctactttatattcgtgattgcccttctgaaaggagaatcttgtttcaaaattgcacctgggcattttaaagtaaataggatgcaaatccttagttggcctcttgtgtacattaacttcagagtgaagaatgaatatgtaagacagtgatgggggatggggagttgagcaaggaaaataatttgcataatggtgtttgctccctggtgaaactgaaacccagcctgtgtgggtggggccttgtttccaaacgtcagcgctgctgcccacgaaggcctgcaccaacgcacggtgccctccgggccgcccacagaggccggcgtctggccaggagcaggggctggggacagcaagtgtgaaaccagctgaagcacctgcagctcaggcgggctgcaggctccctgctctccccctgtgaagaagcacacattgttctttcttcccgcacatttgaatctctcagtggggtctcattttctgtgacatggcaaacctcaaaaaatgggagtaaatcatttctaaagagcttagctaggcatggtggctcacgcctgtaatcccagcactttggaaggtcgaagtgggatgattgcttgagcccagaagtttgagaccggcctgggcaacatagtgagacctcatctccacacacacacatgcgcgtacacacacacgagcgcgcatgtgtgtgcacacacacacaaattagccaggtgtggtggcatggtaattccagctactctgggggctgaggttgggaggatggtttgagccagggaggtcgaggttgcagtgagctgtgatggcactgctgccctccagcctgggtgacacagtgagatcttatctcaaaaaaaataaaaaaatcaaaaataaagagctcctgatttccatcccccaccgagaatcattttctgagtcagctggagtgtttcagagcccaacacccaaggagcagtgcagggatggtgcccagttacaggggacaactcagctctgaatgttacaaagggcacttcatggaccaccaccttttctctgcttgctctgtacccctaaagtactacaaggcatttttggttaataataatttgaatactatgtgatcttgtagattctactgcgtttggctagctaatgtctctaagtagcaagatgatttattttttctggacaataccaggactatatgctgatacaggactggcttgctctaaggatcagattttccagtgtaaaatatatactccttatagggttgtaagagcagaagcccttcatagcctgtttctttttgctctctcttcagccagcagttggcctggatctttgctggtagacacagggaatgttctccttgacgagtggttcccaccctggcagcctcagatcccaccatgttggcagggatgctgaaatccacctgcctatcagcctttgtaaataacaaaaatcacaagtggctctagcatttatgtattctatgatattgggactcgtgatataaataatacaaatgcttttacatgcataattcaatttatactatgttttatctttaattactggataataaaaacataactactctcaggaagtgtgggggattgtgactcaggctaaggtgagcctcacagcctggaggctggctttagtgctggctgggagagctgcaaggagatggcatatgctgccgatgaaggtgttctccaggaattttcagttagaagttttgatcattgttcatttggcctcaggatgaacatcatggtactgctcttcattctctataattaatatacttttcaccgtcaactttgcatttgaaagtatttattttatgggaaacagtgaaaagtagataattagcacatgtgcaaatctgtttggcatttgtggggtgtttgccctgaaaacctatggatgaagcccaaagacaggagctggggggtttcatttagttaacttaaaagttttaattggtctgtgttactcttcttgttacatatttttttaaggccctaaggtgagcaagttacattttaaaataaggaggaaaagccagttttaaaagtagaattgagtcattgcatgtgttttttttcccacaaacattagctgtgtgattattatgtcccaggcacctaaggaatagtgcccttgtcctggggaagttcacagtttggaaggggagatagttgggaaaggtaatgtgaatattaacactcgtgtttcctgggggccaaaatgttccagcttctgggccaggttaattatctgaattatcttatttcatccttacattgggaaccagatgtccccaatgcccttcagtgatttttttggtggctttgaggaaaaatgaggcccagagaggttatgtaacttgtccaaagtcacacagcaggtagatttaaagtcaaacagttagctcccaatgtgcacactcttaattaccatgccactaaaccagactctgaacaaagcactctgggagcacagagaagacctctgagggtctgtctgtgtgagtctagggcatgttcaaagttaagagctgatgtttagctcagcaggaaagggctggggcacagtgttggatacacatatcaggtggcatttattgctgatgacagtaaaagaaaagtgtaaaacaagataatttgtttacatttcaagatacattaagtttttttttttttttttttttgagataagagtcttgctcggttgcccaggctggagtgcagtggcgcaatctcagctcactgcaacctccgcctctcgggttcaagtgattctcgtgcctcagcctcccgaatagctgggactacaggcgtgtaccaccacgcccggctaatttttgtatttttagtagagatggggttttaccatattggtcagtctggtcttgaactcctggcctcaagtggtccacccacctcggtctcccaaagtgctgggattacaggcgtgagccactgtgcccggcctcaagatgcattaagttttaaaggcccctggttatttctcgtcttctgagatgtcattccagtgtgacatggttaacatcagtgaggatggcattcctgtcccacacagtaaaatgtcacctctcacacatgtaactctgggtgtaaagtgagtaaaaatatgagacttagaagaatatttcatcatggtatgctgactggggatttcacttactgatactagaaaggttttgcatttcagaacacgatgaaataggtaatatttatctgaaagacgcagacaagtggtggaggaaccagacacccccagtgccatttgctggcttttatcagacagaaagcagaaaggagaaacatgttttatcccatgagaaggaaatattggcttgatgcctaccatgcccagccttgcactagacatccaggtagctgctccatggagaagttcacagggtggtcaggatagcacagggaggaggtaatacgcttgagggaagtccaggagggactcagggagtgtaagccagtaggggggtgctcctgagaaagggaatgaggctgtgccttgaaagactgattagatagaggaggaagtgaagcatcagaggctgcccaacagaggcaggagctggggctggggtgggcaaggagaaaatcacgccatcctcctgtgtggacagtagagtttcatctgctgagggcagaggccatgttttatccatctctgtccccttctatgtccctttttctcctcccttccccattccctggcatcatattgggacttgttaagggctgaattgtgtcccatcccaaattcgtatggtgccaccccaactccagtaccttggaatgtgaccgtatttggagaaagggtctctgaagaggtaattaaggtaaaatgaggtcatatgggtggcctctaattcaatatgacttgtgtccttataaaaggagattaagagcacaccaacatggcacacgtatacatatgtaacaaacctgcacattgtgcacatgtaccctagaacttaaagtataataaaagaaaaagaaaaaaaaaggagattaggatatagacatacacagagggaagacccacatgacaacatagcaagtaggtggtcatctacaagccaaggagagagggaggcctcagaagaaaccaccctgccaacaacttggtctcagacttccagccatcagagctgtgaggcaatacatttctgttgtcagtctctaatactttgttatagtagctcaagcaaactaataatccagtgctcaacatatttttgttgaataaaagcacaaagagattcatgagaagagggaaatgttgcatacttagggtaggagcaaaccacagaggtctttctcagcctgggcaaagaatgtcaactctgtgttggagccagtagggagctctgtgggtcctcgagcaggaaaatcccatggcttaagcagtgtttcaggaagactgggatgttaggctccggagctctgagcaagtcagatgggactgggagtcataagaaggcttgactgtggctagtgataaccaatgagcactggaaacatggaggggaatctttcctcccttttatatcagggttctctcctagaggagcaggtgaggacctctgatggaccaggaaattggaattctgcctgggaggcaagcccatggaggccctgatctgcttggacagagagtagctcccttcacctgtaaaatgagagtgaacgagctggtgtctaaggaattcagaatccacacccatggagttccacagggtatgtgggattttagggggaccagggtgtccccagtgcaagaaggaggctcccaccaaggggctgcagcactgcagataacccccaggggtatgaaaagaggctgaactgggggcctccacagtcagaatccatccattgacccaggatgccaggaagggggaggcccatgggcagcagaggctcaacgaactccgtggcctgacttggccactaggttttttcagctcttcagccactgcctgtaggaggctagctggcattccttccttggcccttagcttgcatggatcggggtttcacgttaaattctaagcccaataacatggctctttttatttaaactcagtgctgcacaatgatgaatgaatgaatgaaagatcagggcagatgaactgtcaaacctcagcagttgcccttatagttagaggtgtttctgtgaagcaaatcaaagcttatagtatcaagaactttttaaaaaagtacactttgatccaagttggatgttatttctaagtgtactcagggtgaacacctcttaaaaccccttattatgtatgctgagctattctgaacctcagtgagaaatcagtaatgtcaagaaacctatacataattatttgttataatataaaaatccagagctcttcaagcattattctatcctagttggtcagattctgcaggaatctgagcctgaaggaaaataaattccttgagttgaagaaatttgtgtcttgtaaaaaagctgaatgagaaataacgttaaaaatggaaggaggcctaatgatgatattatgccatctcttgtcattacttagtcctctgttgtttcagtcatttaatctggttttctttctggatgctttaacttccatcttaattttccttataattgttgtgcaattataaaagacaatctgagggacccgccttgacagcctggggtaatatcactgggagtaggatctctcagaatgctaaggagcagatgcactaagagagctgcatttcactccattttattggatcttttggtatatacgtttctgtgactttagttcaatgggatggactgttgcataatactgagggctatatgaaggaggagtcgtctacacttgtaaaaaccttcttctttaggggtgggtagtgtataattgcaaaggcatttctgatttaattaagagttgtttggttggccgggcgtggtggctcacgcttgtaatcccagcactttgggaggctgaggtgggaggatcatgaggtcaggagatcgagaccatcctggctaacacggtgaaaccccgtctctactaaaaatacaaaaaattagccaggcgtggtgttgggtgcctgtagtcccagctacttgggaggctgaggcaggagaatggcgtgaaccctggaggcggagcttgcagcgagcccagatcgcgccaccgcactcccgcctgggtgacagagtgagactccgtctcaaaaaaaaaaaaaaaaaaaaaagagttttttggttacaagtgacggaaaactcaattcaaagtggtttaagcaaaatccagagttttaccatctcatgtaagtgaacaatctaggaaaagggcgtcatacatacagctcaaaatgaagtcaagatatttcagatctgtcttctcctcctggcccagtttttaatgctttgaccccattctcaaataaactcaaccctcatgatcccgaggtggctgccatttgtcctttcaggtccaaatccagcaggaaaaacttttgtcacagcattcctgtaaaaggtatgaggttcgccctgattggaccagccgaggtcacatgcctacacatgagccaatcacagtggataaaggactgtgatgtactcattaatttacccgccattatctccactcctgtcctgagggtggagttatgaagcttgctaatggggcactaggatgtccactaggttttactcagtgacataggtgacccactaaatttaagcatattggtgtgcaaaggaggcatttgttgacttgcaagtagacacctctcacttatttgtcacactcgctcttccttttgtaagcttcctgggagagggatctcagtggctttcaagatcaccccttgcaaattaggcatcatgcccatcattccatcccctgtgtgagatggcggcagaacagttcctattcagacacctgccctcatgcctcttcccccgtcctcccagcagccccagctcctggttcccagcatctagctccttccttatcagcacagggagttgctttttgtttgtttgtgtttgagaaagacttcttatttcgtgcatgcacatttcctttctgtgaagcagactcgggagctttgcctttctgacttattctgtgcatcctatcagtgaagtcagtgagtggcttcaaaaatgcttgctttctttctttttcttttcttttcttttttttttttttttgagacggagtttcgctcttgttgccctggctggagtgcagtggtgcgacctcggctcaccgcaacctccgcctcccgggttcaagctattctcttgcctcagcctcccgagtagctgggattacaggcgcctgccactgtgcccagctaatttttggtatttttagtagagacaggatttcaccatgttggccaggctggtctggaactcctgacctcaggtgatcctcctgcctcagcctcccaaagtgctgggattacaggcatgagccaccgctcccagcattttgtttgtttgtttgtttgtttgttttagacagagtctggctctgtcacctaggctggagtgtagtggcgtgatcttggctcactgcaaccttcacctcctgggttcaagccactctcctgcctcagcctcccaagtagctgggattatagtcacccaccaccgtgcccagctaatttttttgtatttttagtagagactgggttttgccgtgttggccaggctgatgtggaactcctcacctcaggtgatccacccgcctcggtctcacaaagtgttgggattacaggcatgagccaccgctcctgacccaaaatacctttttctttttttttttttttttgagacggagtctggttctgtcgcccaggcaggagtgcagtggctcgatctgggctcactgcaagctccgcctcctgggttcacgccattctcctgcctcagcctcccgtgtagctgggactacaggcgcccgccaccacacctggctaatttttttttgtatttttagtagagacggggtttcaccgtgtgagccaggatggtctcgatctcctgacctcgtgatccacctgcctcagcctcccgaagtgctgggattacaggtgtgagccactgctcccggccccaaaatactttctgatgctgataaaatgttttgtctactcttatgcccaaggaacagttcctcccttagcagaagttagtggttaaagcttcctctatgtttgccagtcaagaatgccacagggccagcctaagtgtccatgagtggatgagtggataaagaaatgcagcacacacacgtatatacacaatggaatactattcagcttttaaaatgaggaaatcctgacatttgcaacaacatggatgaacctggaggacattatgttaagtgaaataaattaggcacagaaagacaaacaacacatgatctcacttatacgtgatatagaaaaaagttgaacttacagaagtagagagtcgaatggtggttaccaggcattggcagggatagggtaatggggagatattgttcaaaggatacaaaagttcagatagataggcgaaataaacttaagagatctactgtacaacatgtgactctagttaatagcaatgtattgtattctgaaattattgagagtaaattttaattgtcttcaccataaaagataagtatatgtgaattagctcaattgagccattccttaatgcttatttccaaacatcatgttacacagtaaatgtaatagagtttttgtcaattaaaaaaattaccaaaaaataaaaaatgaattccatagagacgttctctccaggaagggtccccttcctagatctgactactggttagggttaatcaatgccccttggcaaaacaaaaccaaccccacatttcttcatctcccatgtccaagacacatgcagtgagttctcagtgtttactaccagcacacaaatgatggctgctttattatttggtgacctttgttgtttgctgtgattgttctgttcagttttagtccctcacagcactttcggccatttagaaagacagtatttgttctgctagagcatttgcaatctgtttctgattagcttaactggtcttgaccagtgctaagttcacacttcagctttgatttatgccgtctctatctgcagatatgtttcttgttacactatacaagaggaggcctcttcttattgacttcttattttcatgtgaacgaggtaataggtatcaggaataattagacaaggccatacgcgctaatgtcataggagactgagatatggagagtaaataataacaaaattcctgattactagggcatagaaaaaaaatcataggcaactccccaagttgataatcccaaatgtctaggcgtccttctcaaatagggaaacgtgacattaaaactactcaaaataaatgagactcagtggtatttataaccatagataaaaaagagcaagggtcctggggaactgtgccaaggcccagccctttgattcacaagtatccacaaaaacagactgtacgggctgctttcaagagaaaatgtggccatcaaggtcaacactggaagccctatggccactcattcattccatctcattggccctgagcctttcgaaaagtaggcagagaagaagcccaaagaacaacatggcaggcaggttaaggaagaaagcagagttcacagacatcactaacaatttcgtaatgacctcatgacttcgctggaaggattccagtggaggcgtcaccagccctttgtccacctcttaggctgagaacctcaaaggttgcccacaccttgaccacatactttcttccttttcttacacaatcaagctctgcaccaaacattagggggacatttgcattttcattatattcatgcgtatttctagcaaaatacaaattcttacaagatgttgacttgtacagtgtggcaaggaatactgtcatacagttgtgccaaaaacaagcccatttacttatttttttaaaaattaattatatataattcttataaaataacaaattccatttatttcctcttgatctctgtcatcagagacatttgaaggtcggaggtgggttcaattgaaagacataatgcacttgacaagttgttgtatgtgtgcattgtgaataggccttaacagtgcattcatttgttttattttttcccatttatacagacttttgttctgctcttagataaaatactaataaacaggaagttgaaaaaaaaatgtggtgcaattgttctgaatgttgtttttcttgcaaggctttatgggctacaccacaccatcctattcaaagcagtccctgtaggtggtggtgttaataaagaaatgaggctgcccagggccgcctgcctgagcctctctgcagctgctcacctcctgctgaggcctctgccttcagagctagtggggcctgctcacacattccagtagtttcctctttatttgtcctgaaccaagttgtagaatttaaaggaggtgaagtaaggcgatttctatggaaaatatatttttcttctttactcctcatgctgagtgcataagaatttattatttcccctgaatgttcaaagtggtgtgtgtgtgtgtgtaaaagaaccaggagcaaacaatcttaataggaatgtgcgatcttgtgtttatctttagcacacttaattagctacaacccgggactgttgccatttgaacaagttgttaagaaaatctgccatgttttgctcttttttaaaaggaatgactttaataaccatagcaacacttactcagttttgtgatccactccaagattatgggagcaagaacagatactcctgaaagcaaccctcacctcctcccccgccccctgccctcagcaagtcctggcctgtgtgaactgaagggtttggaagctctggtttctaggagtgcccagaagctagaaagactagggtgtactagttattgaggggcagttgtcagtggcagtgtgggggcaccccagttgttattcgaggcactgcattgcttttttgtctcctctgtaagcatcctgcctcagtgtcagggcttgcagaactaggcctggagttatgccccctacccaaccaaggctttgccttttgccccccactatggtgccacctacttgggtttcccacagttggtagtgccaggcaggaagcaggagtgcaggttgcaggaagggagagcagaggaaacagaagttgcttaggagggagttgggcaggctctgtccccagcagatccaagggtccctgacaaagagaacacctcacctccgcccctccccagaggcacacagaatgccccctcccaccacctccaggctgttaattcacacccacccaggctgcccccaggctccccagacctgtgccagtcaagcctggcctgtggctgtgacacctgcattaccccagacggttgcctgacctaggcctgtccttctatctgctttgtttttatgttgattactaggtgaagcacagtgttaaaaacgggaagaaaaggctaggaatgcagttatgggagtgtgaggctgggttggaataggtgggagaaagtccagggctgagtgtgtggaccctgctctagggatctgaccggctcaagctcccaggccattaaacaaagttgttaatgaaaaaaaaaaaaaaaaaaaagggagagagtaaacaaatctctcctctgttattctgcacctggagaaaagtaaaccccttgggcataataggctgtcaccaattagacatccgggaaaggcttttctgggtttagcccttttggggaagcatgggggtagatgtaagtgtgtgaaccttcacccaagttctggagaaggattccagagtgaaagaggtttccatgctgagtcttgcatttaagggaccttccatggcatagctgcaaagaaacctgaattgcccaggattaaccacctttcctttagacggtgagcagtgtgtttcacgaacacattacacattttagggttgtctatggaggtatcggcactttcattactatttttaacattttattctctgttcagggttaagaacttcacccacctaagtcagctcctgatacaacatggaatgttccagcaatgaaatgtgaacttaagatatttggattaaaaccccaaagttgagtcaggtttaaatattctgcaagaagcagtgagctccttttgtctatttgggcacagttttcgtgaattatttaggcttttcttagatgcctgagctccgtggttagacagcagataagttatttttccctttaatgctgaggcattttcactgatttcagtcttactcattagaaaattctgtgctcacccacagctgccagggtttctagaacacaacaccctaccttctcctgtagacattttagtccgtcctcgctcctgcactgtggctttcacagtcaaatgtgagttgaccagccgtcatttgtgagctgtgagcggtatttttggaacttgcccacccccgttcccccagagtcctgtggaggtcatgctcatgggttctgccaccgggacaggaaagtttggacattactaccaaaaaaatgcaacgtgactaagcaccgtttaaaatagcctttcttattctcttgtaaaattgcagggatttccatgacagatgtcgttttagtcattttaaaacttcagcgcgctgaacctcatcagcatatttttatttttgacatttcatattttagagtggattgaaaactaatttgatccatttcaatttggaacatccctcaaggtcattttaccagcatttaggccagtgttgatcttgctttcattttaaacatagttattttctctctgtgaagtgattactccttgcttggtgtgtggtctggtgacttgttaatttcaaaattctacgatgcaagcgggtttggacgtggagcctggcccggtgtggccaggctgtggctttgcccatcgcaacggctgcctttgcctcaaatggctcgaggctggcacctggtcaatatttgcttttgtccaaaagaaggaaacagtaggggacttgggtggtgtaattttagaactttactgttgggttgttggcttgaaagatccattctcttctataaatacagatacatatttactcctccaacctttccctccacacaattaagaaaccctacaattaattatgccaaatcaagatttgcttttctacatgattttttcccttttccctaggaagtctgtaatgaattttcttctttattgtaatattttatgtttttatatacacttgtatattcttatagcacatatatgtatatatgcaaactttctgaggcttctaaaaaagagaaataatattggttgattaacctcaatttcttttcaatatcaaatgtgtaacaataaccccaaaaggagaggtttcagaaattaaaacaagttgacatttgcccacttctgaattaaaatgcagcatttgacttttgtactgttttggctgtcaagccttagttttttcacactatcaggtattttcagatcaaaggtaaatatgatttagaattatatttcaaattagaactgtcatatgcccacacatacattttgctgatatacttacaaactggtaaacaatgctctttaatcaacaattcataatctgggtcagcgatttttatctccatatttgctcatactgtatgacatcaatattttatattggcttgcccataacttaatattttataaaagcctacctatgaaattcatatttcatatttgcttggctatgaaattaatttttgtgatgctgcagttcaccttgtagcatacaaattgagaaaattagcaagctgcatgtagttccttgctgtacaaaaacaaatgacacatggtgtctttatcacttgttttgtatttacagataaattttaaaaataaaacttgccatttctgttaacgtggaaaactccccaccccactcccattcttgttgactcttttttatttttaaacaacaaatacataatcaacttcagtcatctcattttcaggggagttactcattgtattttctacttacagtcaccggggctgatgttgggatctgtgatcagtttcctgttgttacgcatagcttttctcagcggtgagagagacatcatgtacagagtacacacggagggttgagatagcagcctggtttatcttacttctgatatgacttttaaaatattgattttaaaagtgtgtctttgagtgtaccaaaatagtatgtccctgatgcttctcgctggatgcaatccctgcgcaaatgctttctatgcaattagattttggggctcagcttccattttttaaatctgtgaaagcattgatcatgccagcggccctggagagggccactctgttttagtgccatttacatgtatcaggacaggacagaaaagggacagcatattacaaacaaaataaaactataatcttgttcaatccttgtcatgctgaggatgtttgtaaatataaaaaaaattgtatggattccacttacatgagataactggaggggttagattcatagagaaagaaattagagcagtggttactagtggctggaggcaagggggggaatgaggagttattgtttaatggggacagagtttctgtctgggaagatgaaaaagctctggagatggatggtggtgatagctacaccacagtgagtgtacttaataccactgaagagtacacttaaaaaatggttaaaatagtaaattttatgctatgcctattttagcacaataaaataatacacattcatggaaacagggcatttaaatcattatgcataataaagtgagaagctagttgtgatttgcaaagaattatagaaattatagggagaaacacaatctcaagagccaccctggagtccagagctctcgttttacagattcaggagtggaggctcaaagaatatatgctttcttaatgactggaacccagacggcaggacccccacacagggctccttgctgaccctttgctgccttcccccctcccttagaggggccattctttattctgagtaaacgtgccactgattagatgggcttcatgataaagacctgcagtaaggacgttttaatcctttaatctagacggttcacgagttccactggtgtgtctctgggggcaggctcccagatcacagactggttccaccgtgccccgtgacctcagcgtgccattagatgggaggccgttatttcaggggaaaaatcatgtttgaaactaagtgggtccccggcagtttgcagcaacactggctgctcaaaaggacagcacgaggcttttcacagcatgtagatgccatggctttatgagagctttgagcttgggagggtctacttgtgcttttgcaaccttagtttagatttcatttgcatctactatttgtaagtgcaccatttttctacgggaagtatgtatgtgagaattatctacatgatttttgtaggtggctcacaaaacaaatgtcagtagccattctatggccttggagtatcatttcccacaccttttctatggactgtctttatttttgactctaatacgtatcccttatcatacaaaaagttcttgagcatatttgatatattttaaaacttccaccccagtggaattaacactaattatatttaattccacacaaacttttgtcccagttgtagaccatttacctacttcctgacagcaaacactacaccgctgtgaaattttattttaacacatttgtgcccattttcagcattaataatcgtgtgtggaagtggcagcaaaatgaagatatcgcctgagcatggaaccacaaatgcctgaacgtgtgatggcatttgtgaaacaaaagcatgacatactttttctttccaaatgaggcagtgccacaactaaaaaagccagttcgcctttcgctttctaaaatcatcttgctggagagaacggttatcaaatcccatccactgcccatgtaaaataaataccattcagaaaagcgtggcatggatggccatacttctgatgggtttataactgtagattgcatacgatcccaacgtgaagcctgaaatacgacattcaacgtcaggcttattccaggctactgctgtggctacttttgtaattcaaccagtggggcgttttaggctaacgtatattgcctctaagctgataagcattttcctgatcccaggccccttctaaaattgaacacacacgttcagctggggacacctagatggaaggaagggaaagaggagaacccgaagtgaaggaaaagtcaccaagaacagtttcatggaaaaaaaaaaaaaaactctcaagaattaagaatgttgagttgcttgaatggagcttgggcaggaaaaagaccataactctcacacacgtgaaggttactgatacccaggaggtaaaagaagtatttaacatgctctaaagaagggtaaccagagtaatggggcgaaaccaagggaggacgtcctggaatgtaatattagaaataaacttccaaacagggaagtgtccatccgagtgtgaaatgggtttatcagaaacaagctgcatgccagtttcattgacattgcaaagaaggttagaataaaaagctaatgaacagaaagaagaaagaggcaaacagggtgtgtgttgagagtggtggaatatgaaggatggtgcatttgtccaggctggggctgctggcctgaggaatggtggtggagtttttttacagagcatcttctgagcaccaggagagtcccggaagctgagtttgacactagcaagacctgccctgaattggggactgctggatgcctggaagctcccctacacttacgttcctgaagttgggctttttatcaccttaggactatggcttcccaaacttggcagtcagcgtcccggcaaaagcctctctattactgcgaggtagtgtttatggagtcacagctaagaattacagaaaaaatcataataggtgaatcttttttttttaaaaaaaacaacattttttgactttgcaaataaattgcagaattatcaccattgttgaaatattttccattaaaactagagtttattaaaagtgcctggaaggatgccccctgctgcctccctgagtcatcgctttggatttgttcttcagaggcagagatttatttccatagcaggggttttcagttttgtgcttacagtcccgcagtaagtcttactggcttcatcttctgacctgcttttaaaacagtcctccaccgtgctaggtacacaaagggatactttttgggtttttttgagacagagtctcgctctgtcacccgggctggagtgcagtggtgtgatctcagctcactgcaacttctgcctcccaggttcaaacaattctagtgcctcagtctcccgagtagctaggactacaggtacgcatcaccacacctgaataattttttttttttgtatttttggtagaaacagggttttgccatgttggccagactggtctcaaactcctgacctcaggtgatctgcctgtctcggcctcccagagtgctgggattataggcgtgaaccactgtgctgggcccaaagtgaaactattataacaaggtaagagcaacttttcccagagttaaaggatggtgctccatggaatagtgaaagtctgggaccaaagcaccttttccctttaatttctccaattgcttttaaaatattctatgcaataagcatctgagtccaaagggaggctgtgtcttcctctagggtctctctgaatgaggtcagtttctatgttaacttttacgcttccttttttgtctcatcccaaaccatttctcctcttgtcatcctctttttcctcctccttttccttcttatttctcctgttgccttttttctacctttttattttttgccaatatacataaaattgcttgttaaaaaaagatcaaagacagcatttttatatttttttcttaaaaaacaatatgaagggctgggcacggtggctcatgcctgtaatcccagcactttgggaggccaaggtgggcggatcatgagctcaggggttcaagaccagcctggccaacgtagtgaaaccccgtctctactaaaaacaaaaaaattagctgggcatggtggcgcacacctgtagtcccagctactcgggaggctgaggcaggagaattgcttgaacctgggaggcagaggttgcagtgagctgagatcgctccactgcactccggtttgggcaacagagcgagactttgtctcaaaaaaaaaaaaaaagaagttaaaccatgaaaccacccataatatattagtcttcagaaagaaaagaaaaccaaggtaagatgcaaataacagaagtacaacttttatttttctaattgtggagtgactccaagaggattctgctcccaccaggtgggcgataggcgtcctgttggtggcgtgtaaaggaatggaaagctaccacgacctggggggtccaagaggggctgctgcaggtagcctacccccccagccttccccatgaccacagccacccactccctcaaagtgggacttcaggccaagcaggggaagatctcaggcgaggagaaacagtccatccgagagctccctgggagaatcttgtagactacacgctaatgagataggcctgtcgccaaaggtcacctccgcactgtcttggccacaaatgaggcctgaaatcctgctattagagttgcacacacacaggagcctcctctgggagttctgttaaccactggtctgggagaagagacggcacagatggcctccccagtctttccagggcagagcggtgggggcgggaaggaaaggaagtgccgagtagttcaggagagggggtgggcatggggttggggggcagcctggggacactatggccccatcctagcctggtgggagctagaggaacagggaaagtaagtctaaagtaagctagactcaggaaagggaaagaaaactctgcgtgtctttttttctttccttcttttcctgacacacatagtcttgtgctctctctgggctggttccactagtgcagcgatgctatgggggaggggcccagggccctgataacaggtgggcgtgtgtcaaatagcaactcaaccaatgaatgaatgaatctgcctctcctacctctccggacagttttgaagtttaggtgaaaccatgtgtacaaaagctcctgtgaactgggagacactttgcaatcccaaagtggttaataataaaaatagtaatacttttaaaaaatcataacaaataataataatgctattggaaccatcaatctaatacactttttttctgtgagagacttattggattctttccttggcatgaaagccctgcttctcccaacacaggcaggctccctctggcacagggtgattgcatcatagacctgacccaacgtgacagagaagcggttctttctgagttaccaatggccatccatctttcagcaggcgtgccttcccattttccttgctctgcccatgagaattttcagcagaaccttggattaggtgtgccagacatgttctactcttgattgtgaagattatacacactctcaccttctgagataaatgttattaaattggataaacaaccttgtgtagttttgcttttctgttttatctcaagatcctgctgacatggctaacagggcaactgtgaaaagatttttattcgtgtctacatcagtgtgaaaggcttcatcctggtgtgtactaatcactcagacagtggtatgaataaatgaaggaatgcattgacaaactaatacacaaggtgattccggaaaggcgcacctcctgggataaatacggtgacagtggtgagtctgctctaggtctacgaagttcttgctcttagtagagatccagacacccaatgttgaagacagttcctctttgctttagaaagctttgtgtgcaagagatggcaaactacttcttaaaaaacagagagtcccgtaaacatatgccaaggtccacggtgctccaggcagggtgcttggtgccagagagacagagtgaactgagctggccatggcatctgtcctggagaagtcacactccaatcaggaaggcaggaatgtgggccagacctacagcctctggggaagggtgtccataagctgtgaggtggtggctactgactccaatggcagagaaggtgtggtaaaaaggcaaggacatctgcaatccttctctaactcttgacttattgttatctgcagcaggttaaccacccctctgttaacttccttctctctaatgaggatattaagagtagttgcctcagaaggttgagcaaatttggtaatttacacaatgtgtagttgtcccttggtatccatggggaattgattctaggatctcctatggatatcaaactccaaggatgctcaagtctctgatacaaactggcataatatttgcctgtaacctacacagatcctcttgtgtactttaaataatctctagattacttataatatctaatgcaacataaatactatgtaaacacttgttatgatatttttattggcattatttttattgttttattatttttaaatatttcaatccatagtgggttgaatccagtaatgtggaacccacagatatagaggccaagatacctcaatgattggcagttccagcattgcccatctccctgtaccaatctgtgccaacctcggaactgtggttgagtcccaagctagggggtcggttcacaccatccatcccaccactgcagcagatgctcacccagcgtcaactctgaaccaaacaccattctgggcaggggcgaaggtgagaagcacagaccttggccctgctctcccctcctcaggagcccagcagagccagtccccacaggtgggactccactacccaagggaagcctgaggcatgaggcctgtgtgttgctcagtgaccgggtccatcctcccagtgccagagaaaaggaggtgcccctcaaaccacaaagtaacccttggacttctctttagctggggtggtggctgctggagagggccctgcttgctcatctctgccagcttcccagtccctgcaaccagcagtggccagcctctggccacccccatgaaagcacataaaagggttggggaagccgcaaccccagaattgaggtgagctagagtttgaggacataggttgcttttcacttatctccagcaagaaccatgttatagatcattggtacagtgacgattttatgcttctaattgaatactgatgaaaaatggcaatggtttctcagttacttcttggaaataaattgtgggtaaataacatctgcttaaagcttggaaacccagtttcctttggtttgtgtttttaaatgctttgacgatgcggtttgcttttttactccaagaaaaaaaaaacaattaaatagaggctgacaactaggtgagatccacagccaagctattctaagagcccgaagtcaccctggacacccagcttgatgacaaagggcagaaattcaatatggaaataggatccactccaaatgcaccatctccgacattatgatgaagagaatatgtatttcatgacagggcaaatgttgccatccttctgagggaagatgtaaatgaggatgcttttagggatgatttctacattgtcactaaactgagacatttgtgcttgctcgtgccaagtgaagattgctgttgctgttgttctctcgcagtgattagggttcattccctagcaacaggcagcagcagaaaggaagctttgcaggcagagtcaccgaataaacgcagtgggaacagtatcaacaacaaacccagtgatgaagggaggggcatgtggggcacaccacattgcctctctggcttctcgtctgcacctggggccagaggcaggtgggaaggagaccttgacaatgtgggaagtccctttgatttgctgaaatggaggagttcacattttactgtgcagtctaacattgcccattctggattagctccatcagacacgcttttgtgctttactgtaactctttctttatttgtcctcctcgaaactgatccataatgccaatttgctgatcagctgtccctgggacttcggtgtactgggctagaacctcagtctagtgttcaaaggagctggcagaatgggttgtctcggcatggaggacccaaaagcagagctccctggtgctttgggggagagtgaagcccttcattccactcctcattgcagaccagctttcctggtattcatgcactgctttttgtaacgcctcaaatgaaggccacagctcagccaagtagaagagagctcctaataaatgaagtctggttgcctttgaatttataaaataatcaaagttgctatttcctgctaaggagacagatacagaacaggtgataggccacagtcattactgtcccctgcttgttccctgagcccctggccttctaccttttctaactgctgtcagaaccctggttggggacttccttttgcctggttctcctgggcttgaatggcaacctatattgacagatttcatgccacagttctttttcaaacaagatgattcacaatggaataattgggtttgggaagaaggcctttttaaagcaaactatggaaaataattgatgagtagcgcagttttataaaacttttttttctattaccctttaaaaactatgttgctaactgcacatcacactgcattcatatcctgggactaataccccttgacctctgccatatgaattaaggtgaaagaagggtcataagtaacaaagtttcaaagttgaatgaaccttttttttcctgtaattttactgaccatttccctttctgtttgagagatctgtgcggtcctgttgctgaggttctgtggttcaggggtgttatcggcgacagagtgctgatttcacttgggtctgttctggtttgtcttaatttctcttttagagcttaattttcatttccaacgaattaggcaagacagaaagtgacatttggaaaagagtgaatggatgactaaacattcaccagacgtcattcttgtaacagttaaatggtagtgattcatgtctccatctcttgataaaatataaagcattaaatcttgatggctaaacacactgacaaaactaccgaaccatgttcctggttgaggatacctgaaggtcgacatttatctgggatcttttgctgctgctttggtatgacttctatcaagatagctttcgacgaggtagaacgtttgctttcactctgggttttccttggtttcgacaatttttaagtgttaactgaaggaaatcccgtcttgtcagaatgttcttttcaatacaaatcgcagtgaaataacgggctagaaagatgtggatccttcttgattttaggaagcacacacctatcggcaactctctctgcctggcctgtgttcacggcggtatttttgcctctgtcaccatccttgggactaggtacaaaaataggcttatgttccacgtgtcacccaccacttcacttcctttttaatagatcatgggtaaggaggtgagaggacatgagaaggattggtatgaagtaaataacagttaaatcttttcagccaggggtggtggctcaagcctgtaatcccagcactttgggaggccgaggcgggcggatcacctgaggtcaggagtgcgagaccaccctagccaacgtggtgagaccccgtctctactaaaaaatacaaaaattagccgggcgtggtggtggatgcctgtaatcccagctactcaggaggctgagacaggagaattgcttgaacctgggaggcagaggttgcggtgagccgagatcgcgctattgcactccagcctgggcgacagagtgagactccgtctcaaaaaaaaaaaaaaaaagagttaaatcttttcagatttctaggctggaaatcaacagaacaagatctgctagcagaagttgttacatctcaactaagtatagactggagatgaatctgacaacctgtgacatctttaaatgtcaaacccaccgcacatcacagatgacatcgtacctaatgatcaaactccctttaaaatatacttcatgtaaatacatttttgcgaaaccacaagctgtttctctcagttttgttttcagctggctttgataaggagattggttggcagcctacagctaattaagcagctttcaagccaacatcaatgaaaggttttaggtgactatcagaaatccattccactctccatggtccaccggtgtcgactatgcctttcaattgtgccgacagaccctgtcagaagagaatggtttcgcactaatccaagtttacaaccaaaatcatcctgttttcagtggtgtagatccagtgtctgtatctgtcttgtcaactcacaatagcattagcacagggggctggatttatgctctaagaaatgcaatttacctttctaagctcacttatatatatttgtatctaacatattgtaaatttcttaaacttgttacacatttaattttataactagaaatcaatttttatttatttatttatttatttagtggaaaacagaaaatgaagtgcaagagaccctcatttccggggcaagaattctgagttccttggcttctttcattcttgtctgactttcccccctccagttgcagttatttctagattttggtaaattattcattgcttttaaaagagaaaaagctcgattttctaaatctacagttgagctagccctaacctctaaagccagattgctttaacaaaattgtcatcattttatacatgacagattggcttcaaataaaatggtaaatgggaggaaaagtatattttgcttacacttaggaatgcctgtaaacgtaacagagtttaaaaaaaaatcttggtgttttaacaaatgcatattgtgaaaaagaggaagaaaaaattagctggttgcctgtgaagtaattgtgctaaaaacattcatttttaatatataagagttcacattttaattcatatacttgcaaaagaaaagtgggattttttttcttaaggctttgactatttaaggaaagcttttgtgctgtgccagtctgcttttaagaaattccagagttacagatacaattgagggtgaacttgaatttgttccgtgggcacggccttttctgttgtggtaaaacaaagttaaaatgacaacggttctgaagaaagtgcttcaagaccatgtcctgtttcactctttccagatgactaaaatcaccctcatttcccaagtcttacatcgggggaagaggatatgtggtttaaaagagtggcaagtactagttaaggtcaggctttttctgaatgtgaacattcagttatgctgcatgaagataggggcaggtattgcagagtaaaattctcatacagaaaatgtctgaaagtaacaaattaggtgattaccacggtctccttatccactgtcatctttaatcgtcgtgtttttttttcaaggctgttttgtctgtttttaaatgctgttgtcttatataaatcaggctacttgctttaaagtaccagaagaatcctataatactgaaaaaattgaaatataaaaaagtgaagtaagaattctgagtcacatgttttagatacggtgttaaacaacataacacattatcttgaatggaagatgttattaccttggtgctctcatcagttcagcttgcccagaagcaatgccaacctttcactgagaatcttttaaactgaccacaaatgtccctattcttctcaatgatttaaaatgtcctgtgctaacttttctatcagtcaatatgtatttttcagtgttcttactgagttttgttatttgcttttagttcttttcactgtttatttgctggtttatgttttatgaagaaatccactttcagaagaaatgatgacttattttctgtgggtgtttcctttcttcactactttaagaattttcaagtataaataaattgtgagaatacatatgtgtgcaaggagtgtggggaagagttaactaatttttaaattgaaatgagggaaatactgggctgactctactggtgtttttcagagtgttcctcaatttaacaaagcaaagcactgagtagtatttctttctaatatagatgtttaaaaacatcttccaaagtaagtagcaagaactaatgctcaaagtgttgtctgaaaaatctagaaatatctgcatgctgttatgaacaattctgtttctttatggagagttgtttgggctttttagaaactcattaatttgattgtaagcacctcactgttatcaggaaaagaagctttagaaaatggtttcagaatgtgtcattttctccttgttttaatctgagacagtgtgtgggcatgctggtattttaaaaggctaaaaatgttgtacatattgctgtgtcttcaaatatgagggaagattacaaacagaagttttcttcaagcctctgtctgaaattctgcttttcttctcagtagtgattcttaaatttttacggagagatctttcattcttttttttttcattttcaatctgttgttgaaattcagcaaaacaaatattttaaaagccaagtcagctttctaccgttttgatctgaatatttaatgctttataaaataaaaccctgtgttttaattttaactagtttcattctttttttatgaaatgatttgcggtattagactgtcatttggtttcaatattaatatataacatgaactacgtgggtgtcacttattttcagtagtaaataactgcttaaccgattactttactttaacatagttctactgttctccttgagcctcgtgatctgcatcttcaaacaatatttggtgtgtgtttttgcaaaatagcatttacatactgtgtcattaaaaactagtttcatggtgtcatggtggtcggaatcagggaatgtcgtgtagttggtttcaaaatccatcagtaggttaatcattaattattctttttccaggaaaaaactgatgaggttgtttcagaatttgaatttactagaattccttttttttttttgcattaaaaaaaaacttttgcattttaagcttaaagggggttaatttggtaagaaaaggtaccttttctgtttgtattgtggcttgttcattttctcataaactgtatttggtagctaaaatgttgaaagcagtttgggaacaaaatgtctgctcaaaccatgacaaaattggccacaatttgccgattgggctgataacaaaagccagcaacacaaaataggtagaaaaacagtttgttcggtgatgtgagaccactgaagctcttttttgcatgttttttttttttttttttcattctgatgcttatgttgtgatggaaatacatgaagtctctgcttacccattgtttctgattaactatttcatctttggatttcttttaaaacttcagaaaacaagctgccccctgggcatctgagacaaatttgaaataagagccagctctgcacctaaacattgtgttttctctagaccccacttggttgtaaatgtcccaaaactcttgttttgatcgtttaaagcagcatttaaattccatttcccccaccaccccaatgttcaacattgaattgtatggcttttactacacttttgcaagtgtaaaacaaaaattctagtttgcagtttaaaagaaaagttctccacctgggtatatagttgacaaaaatgtcaacagctaaaagtacatattgactctcatattatcttcgcagactgtaagcaactattaatgttttacatgagacaatacatttttttcaaatgatagaacgagataacagcctcctctcccttgcctctgctgttgtaacttctcataccttgtgttgcctctgtgtgtgtgatggtcttatttttttggtcttaaaaatcagatcctccaggacaataattaggatgaggtttatgtttctacttatctaatctttgttttcacaaataaatacaaataactcaaactgaaacttgatggctttggtgataatataatagcagccacggggaaattttcttcattttaatgttctttcacaacccacattcagtttcggtaggaaaattattaaccttttcaaaagcatgctgaaatatgggttcacaatagactcctgagtatgatttgcaggttttggttctattttgagattttggtgtacagtttttctctttttttctctctttctttcgttcgttcattctctcataccaattgctttctttgacaccaatcgcaatgacttaaaatccttcagttgatatctttttaatgtgtgcacgttatacagtgtttgcatttatttttttattatgagaagggagaattcctatttccttctctcctactgattggttctatgaaagaggacatactctttattctcactgtttttctccactctaatcctcatgtggaggttgtgagtcctccagccccatttaaaaaaatccagttgagccacatttccccgagggcacctggctccatgtcaggcatcagatctgactcctgtctgcctccagtggcctcgtgtctgtgtccatcacaccaaagcaagtccgcccgtttgggcttgctgtcctgaaggtctgcacggcctcaggcttccaaggaaggcctgggtggcggtgtctccatagctgactgctgctggggctgcaggtctggaagggctattggagggaggtgatcatgattttgtaactctggcttcttcacctgaaacacacacgagggcaggacctggggccagagaggcaggtgagtaggaggatctcggataacagtttctgttttaggcatccccttctccaagtctggctgggacagccacacctgcagagagggccctgattggggtcgtggtcctgccccacatctggcaagcctgtgcctcatgtactcacagtcaccttttttatttgatccccatccatcctaagtccccaccccaccgcagtgccctaccctacctgttcccaccgtccctgcaaagttgaatatggaaactgagaaacacatattttatctgtaacaaatgtggacatttccagtattttagcctgggtttttttcttcttcttcttctgcttctcatacttcctgtatgaggttagtttttttaaaatgataaacaaactattttttttttcaacttttttgggaggcctggttgtctagtgcctcctacctgtgttgttgtgagccttttgctggtgctctctacctgggcacagaggtcggtgtgagcagagcctgaaagtgggagtgggggatgtggtgttttgcatagggttgcagtgaggagggttgagctggtgaaaacacttctgttctcctatttgagagagatgcagcagaattcatggctgtcgtgttctgtgcaggcaaaatgagctgaaggatggaaggcaagggggataggagcaggggtggagcatggctagaagagacatttgatgtttagggagagaacactggtgcagattgaatatcccacagtgctcagtcccacgctgtgcagatgagcaacatctggaaaagaagattaagggatgaagcatgccaacatttctccccaggtcaccccaaaaatgagttgaaaattctggatggcttctgagctgcttgctctttccgcccccagtcgggatctcaggagagagcgtccggcaagtagcttgggtacagttgactaagtgtgaacatcagtagccagccgcatagccaacctgcagtcacccatggccctgcatacaagagtgtcactaggagcagatatcacttgccactggtggttgtgtgtatctgaatcacctgggcactgtgaaacacacattcctaggccccagccccagggtttccttcttagaatatgtgaggtgaggccggagaatttgcatttctaacaactctcaggtaatgagatgctgccagtgctgagactcccattgagaactgcagcctagagccagggtgctggaaatgcctaaaaaccgtgtctactggagtctgcaagttgtctccacttttttcctaatgtccctttgtgtgtcctaccacagacttaaaatccacaccagcctctcagaaggccttttgcatttctcagtaactgcacagcaaggttacctgtcatcttggccttttaccatgtccatcagactataaaatggctaaaatgtttttgaggtttggttctctgaaaaatgggttgtattttacagatagtgaaagggtcaagctgtagtgtatggtatcactagactaggaaacaatctaccaagggccaacccttgggttgctgccccttgacaatttccgcctttattataaactaagggagctgtcataggttcttccctatatagagcactcttgacgtaagtgacaccatcttagaaaaagactccatcttacatgtcaaaaggcatcatgccaacagggaacagatggccacctaatcaataaagaccacacccaaccagacagggacatcaccagccctcttctactatcagtccttgccagaggtctcagggctataagaagagcaggatttcaccggcttgagatggtcgtcttaacagagccttgctctgttgttgctcgtgatcagcacctggcatctgctgccaaagactctgcccacatcagagactcttgatgtctgtccggaacaggccaggacactctcatccacgttgctctcattggattggctcattaaccctttcttctatccccttctcactctttttttttcaaagccacacttatgctctgttatcccctttctctcgatgttaaatgttactgttccatgtggaatgtttaatatagcatttatatattgattaagttaaggacactgctgtgtatggtttgcaatattgactgacttgcagagtggcttgagcctgagtgctcacagctctgactaccagttgaacaggacgtactaaggagaatcacttccttgggaactccatgtaacttgtggcttttgtgattgaaatagcatcagtaaaagtctgaccctgtggaaagacacaaatgtgcgtggacctggctatgtctgactttgtgctgctcaggacactctctgtaaccaaaagtgagagagcctggaagacctcagggggtcagatgtttgaaggagctgctgagtatcctggcaggcagcagagcctcaccatcagtttgctgcatggaaggctgtgtgcctctatttccctgctatttgttgaactcccttgagctccggtccttcctaagtgagagagatgataccaatagcaccaacctgagagggctggggagatgtttgaaggaaagcttggctggggagctgtagctggcctgtggtacatgcttggtaactggtggccaggagacccgggtgtgtgtcctgggactgtcacactctgctgacgagggtattgaaagtccccactcaaagacacagaatcttcctgaccaagtgtaggtctgtaatgacgtgtggagcactttgcagaaactgcttctcagcgggggtccccttgaaaaggtgctaagtctgctcagagatacgtggctgaagctctagacgcgggagcctctgtcagagacaagggcagggggactcaagtgctgctgcctggctcccctgccctgacagctctagcagcacacgagtctgatttatacaaagaacccatctcatatctccctaaaattagtctgtgataagcaatatacatttcctgagtgtgcggtctaggttttaatattctgaaaaataaaaacagtggtctcttgagagctgaacagtttggtagttactgagcaggctccatcctccttggcaattcttttgaaatctcaaaaagttggcttcctatactgttagaatctgatgtgagtcaagaatggacaggctgtgagttcctcactcgtcccttttctatgcattgaggaagacctcggtgctgccaatggggcagaggaagctcaagtgtgtttttgcatgaggctggctggaagctctggcttgggctctcagcagtgaggtactggcagttccttggatgtcacagcaaatcgaagctcgtggtcttcacttcctcctaccttgagacttactgcgcagaaagtagaggcttggatggttcaacttcaggggcaaaacagcctgccttgggggtgggactgggggtatgcatctgtgccactgcttctctccctttgtcagtttaccatgccagcagccttctgtctgttatcgggaacagaaagagcacgatttgggagctagctggggagcttcccgaaggttgcctgagctgcatttggggcccctgatgagggcttctattcagggtgatgtgtgtgaccctgaggccatctctcagatctggggggaagtgaggttgtgtacccacagtggggagacctacctggcggctcatcaatattagacacctgcaggaacagcaggtcagccaagccaaagagtaagagtggccctgtctgtgactagacgcttcttcagggttgcctcaacaccggagtggcgctggtggtctccacccactcccagtgtacgctggcgtctaggaagccatgtgtgtgatcggccctgaattaggggcaaaacttttagttctcagatgaactgtcgtgggtttattcagtgataactagacagccaggccaacatggagttgattcatccatgcaaaacctcccagacaaggcctttcagtggagaactggaattcagggtcttctcagctttggccagaagccaaaggtaggagaggtaggagagacccaggtcctggtcccagctgtgtcccatccagagtgaccttgggaaggttgccaacttcctttttcggtgagccttgctttcttcacctgcaaggtgaagggttggttggatgatccgtaagggccggccacctctcactctgtgactttggcccaaggtccacatggttgggtgttccatactgtagccctcctgggctattacattttggtttttcattgcactcaaaagtgggggtaactggtgaggggcacgggttggtaaaccacctctctatttcagtgatgaaactaaagaaaccaggtttccccttccacccctacaggccactgatgcattacttagttcctgtttctctttgcccacccaggaagacactgcgtatgaaatcctgggcccagatgctggactttaagccacattagaaaatgctagctcataggactcaaaacgggaagctggctttcccaacagattcatctgggcagtgttcttcccagaatgtgtaggaatcatggggccaggttcgccaaggctcaggaagctcgatttttcactgtcactagccaatgaggcctttaaggaaaaaacagataagactgtaggagtttatatggatccgttaactcacttgtacaagacattgggaaagatactgggggtgggggggaaacaatacagagtttcaaaagataaatagagactgtcataatcaccacatgtcctggcagccagggctacggggtcaggagaagctttattccctggcctgcagcactgcaagagaccctaggaggaggagagctccgccaggccctgcaggctgggcagcctgcctttggccacatttcctaacaccactcagcagagccctgccagcaaaggtcattgtgcaaaaaatgttatgccccatatatgtttgggaagtgcacaataatttaaacagctttcttatttcttaacttctctgggtattttgtgtgctactgtatcttgtgaatgaatctcaagaggaaggatgaagcttttccaaaatcacatgccttcatctcattttacagaaaaatttgtgcctaatattaaccaaaggaaatggggagcggcagggccagtgggttttcatggtgaactgagggttgcatcttggacaggttgcatgtggaagggacagcagggttcccaaggaagctttgcacggtcatgggtagagccatcccttcttcatccatagtgaatatggctggaaatagcgggtagtcttggatttgacctccctcccatggaagtgctgtctccagctcgctcctggaaaaactgctttctccccaaagtgtgtctgagcagcagatttaagcatgaagttggttttgtggggctacagtatggactttgggaagatggtgccatctgtatttctgattctaccgtccctctgtctgtctttggaagtatcctttcacttgtttgggagactgagaatgattttctgcaaacagtgagccagaccatgctggtctcaagcggcagagcagttattaacagaatcacagtctttctggagctgctgtcagtcctgtgctgtcctcagggcctttgcttggtcaggggccccacttcttatccacccttccctctacctcaccgaggctgctaggcccaggtgtattgtgattatttgatgtacctgggaggccatgtctcccggggaggctcaggacctcattgggctggaattccacagggatctctcattgggtctctttgggcctttggagaggggagtgcagggcaccacctgggcgaacacctgtgccatcctgtaagtccttgtgtgactcttcatccaagtcaacaggggcatgtaggggaagagcctcagggcccatcaggagtcagaccctgaccaggaagtcagaactgaatcaacttttcaataaacacacaggctggccccaaacaaagcagcaggcttttgggaacatctgccttttcagtctcttctgaattctgtttatgtggacaccccatgtcccgcaccaccattgccgccagcaatgtttgttgcttgccaatatttgaatagatgctgataaatttgattctctggcttattgtggcattcatgatatgtctttcccttttcagtttccatgtactagagcgactgtcagtgtggttggcagtgacctgtgtttttcatgcatgtttttgtttcagaataactgggagatgaaacaggaagctctatgacacacttgatcgaatatgacagacaccgaaaatcacgactcagccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaacagaattgtttgcttattagctatctttaaacgctgtttgaaaggatatcgaatagtgtttgagggaaccctggcacgtccacacagctcatctgacatgtttaaatgtgtgttgggcttgactctctcataactcagccacgcttgccttgctgcttctcatacctctccagattgctgtagagtcagtgtgggcagactgacatttgagagaaacgtcgggcttcatctggaagcctctttccacacccaccctgatcgtggcctgtaaactgtggccccaagatctccattaaccttgggctttccactagagacatctgccatctctgctgcctccctcccctcacacatcctttactgcttcacttattcatcccataaggatttcttaggggcctgctgtgtgctggttctggagacaaaacagtggatgggaccaactcagccccggtccccacccagcacctctagccaagtctgagtgggctctgctgaagaagtgttgggtgcagtgcacagttcatcatggtcgatggctccatcccatttcacttagatgccccgatttcctaaatgctttcttgaactctgacactctgggactggcacctgaacagtctataaaacggtgaaatgtcgaagcattcctgctgtgtaatcccactctcttccccaacctcaagcaggacaatttgaccccctcctgaggacatggccagacaggccattagtagaagccttccagaactttctggcaatcttcacttttaagcttagcaaacatctaagaataattttaaatggccatgtttactcttttgtacttgttggaattagtttaccaataggccatgatggtgatcacaaaaccccctatgtacatgcacagtgttcattgcaatgcatatccaggtctcaacccaatgtccctttctcaaggagaattccctgagcaccatgtcgtgagagaaccctccttcctccccaccatttctctctatcttgtgattttattttattttattcatagacttatcattatcagcacttatcctgaatgttcaattatcatctgtctgtctctcactccactcccaaaaggcagactgtggtctgtcttatttcccggtctgtccccagcgtttgagatccgagcctcatcaacaactatgtgctgactgggttcatcctcttattacttctcaggcacaccgagatgctgagcagcccagtgctctgaccatgtttggtggataaggaaactgatctgagtctggtgaatggcctcactagggtgaggacccaggctttcctctgggacatcacccagcagaaaagggtgattgtgaactctctactgtctggacagtcaggttctcatcagaaaccaagctttgccctgctgatgaacttcctaaagtttatgtaatttgcccccatcctggaagataaagaccactgtgttgtggagggaaatagcctcagctgggcgtctctggatgctactttctccagcagaacactaagaagatcagatgagatgaacacaaagattccaccctgccctgagtttctgctggttctacctggctaggttctagcagaagagaaggaagtatacaagggtaacatgtgcaagggccgtgtacaagggtaacatgggcatcagggacagtcctcctgaggatgtgaggagccaggcccaactgtgggctggcaacctgccccaggggttgctcacactcacctaactccggcccctctggacacaccccttgcccaggtgcaaggggctccactgggaagaacatctccacccaagtgatcactcttcctctgcgtttttgagcaggatgaaaccacattctctacccatttcgcagtcttacccccaggattatttatgacctcaaaaagatggaagtcacaggtgcagggaggaccagacgtaacccatatgatgcctgcaggatagttagttcacaaggatattaggagaaagagcaaaagagaagtgaccacacaattctagatggttaaggcaatagttctgaccctggccagacattagaattacccagaggttataaaaaatccagacacccaggatccacttggaccaatcacatcagaatctggggattgagggggtgtagacatcagtattttttacaactctgcaggtaatttcaatgcatagccaagactgagaaacattggtctctcaacgtaccatccaatgtggtagctgttagccacagatatctatggaacctttaaaatgtggcttgtacaaccaagggactgaatttttaaattcctttttattttaaatttaaatatccacatgtgacttgtggctgccatattggactgtgcaggtacagaacatgtctacggtcacaggaagttctactggctagtgtggtccaggggaacctggagtcctataactgccgagtgaaatcctgctgatcctgaagggactttaaggtaattctgtctgttaacttcactaacaagccctcctgtcttgggtttgctgtatatttttcatctatgtttcaagccagggcttgtgcagcagcaagggtgacaaactttcaaagcactgcactgtaggattgaaaagcattgaaaatacagttatgcactcactaatgtctcagtcaacaatggactgcatatacaatagtggtcccataagattataatggagctgaaaaattcctatcacctagtgatgttgcaactgtcataatgttgtagcacaatgcattatcttttctgtgtgaagacatgtttagatgcacatattcttaccgttgtgttacaattgcctacagtatttagtgcactgaaatgccgtacaagtgtgtagcctagaagcaataggccataccatatagcctaggcaggtagtaggctatgccatctaggattgtgtaagtataccctgtgatattcgcatcacaaagaaattgcctaacgatgcatttctcagactgtatccctctcattagcaatgcatgattgtatctgtaaaaatctaaggcccagacctcagtcttttggtgttcattctgctggtttactcagtttgcatcgttgaagacccagtcctagaaaggagctttctaaattattgtttaattagtgtaatccaagaatttatgagacttttggaaaagcagagcgctagaagtgccacctttcggaggtcacggatttagtcaggtgacccagcaaactccactcgttggggttagagatggagaattagaaccaaagctgaatcactttctgcttatcactcatagactgccagattttcttttttttgttggagggaaagcaccttacaacaaataataatactattttgaatttcagagctttccctttttcaaagcactttaccacctatgacttattttgtcctcctaacaaggccataagataaggaagggagggctttttagagcctgtctaacaccctaagacagagcttaatattgctgaaggcattgaaaagtataggttttgttctctcatccctggccacactcaagtacttagtggcacaacttgaagcaaattgacatagatgtttaatcctacagtggactgtgtttttaatagacactagagcttcacatttgttccctttggttccatcccaggtttctaaccttgtgcctaaatttttgggggccctttcttcctcagagctttgtgtgatctgcaaatttggtaaatatgccttcatttaccatgtctctttccaaggtgggtttcaccatgttggccaggatggtcttgatctcttgacctcgtgatccacccgcctcagcctcccaaagtgctaggattataggcgtgagccaccgcacccaacctccaaggtgttttttaaatggtgaatgggacagaacgcaggacagagtcccatggctctccatgaagaaagtcctgtgtcacttcaaaggatgtcccctgtgcagaaccaaccacgctaggctgacatcctcacttttgggtccccaaccttctcatgggtagagctgcagagagtcatttcaaaccacacttgcctgtgggcagaaagcacggaattgtctgtccaactagggactcaggagcagcctggctgtctgcagcagctgcaaagggagcaaaggcaagcaggacttccatgagctaggaggtggccttctttggagatgagtgtcctgccaattgcaagtcctcctggtcacaccatcatctggcccatcttttgtatcttagatcggatagggtgagaggttttcaaaggctttactgaaatcaagacacactttctggggcattcccctaatcgactgttctggtgaagctcgtcaaaacaggaaatgaggttagcatggagtgactttctcttagagaacttatgttgcttccttgagaccaccaatttcttcccaaaagcttgtgagccttatttcgtgtctcttttgggttttcttggaacttggaggaagtctgttcttctgtagtttttagaatccattcctctggaaaatggtggtggtgtttgcttattcccagctttccagactctctccctttttctccagtatctctaagatgtttgcaagtttgtctgaagtgagatctgcacatacttgaactacagcaagaatgggattgacccacatgctctgtgcccacgaccaggctgacagggccgcatgtgggctctctggcatgggctttaggcagctccttcccctgagaagctgttggatccacatgttctcacggtatcaaaaatggcaggaagagaaaactaacctggtggagatgaaacttagtgggaacactccgctttcctcccctgctccgtgtgtgagcacttggctcagaaatgcactgtggctgagacagccctatctggcttcacctaagcctacccccgtgttgagttctttaacttagttatcaaagcggcaagggtttcagatctagacaagctgcatcatgcttatttttgctgaggttttctgacaaatggctctacttgaaatttccagatttaaatgtctgttttattaaaactaaagtacttttgagtcatatttgcttttatgtagtagaagcaagtagaagagagtccatgggaaggaatagctggctttgcctcacaggtgtttagggaggactgctgtctccaatgcaagacctggattaccgtttagagatccacctacccctcatgatgctcttgttgctggaatcatggtctgtttcatgctttacgtgacttagcaggaccttgaaagctgtcctgagtgcccatgctggaatggggtagatttcagttccctctccctcactcccgcatgaacctcagcctcactctactcaggtctagggtacttagtgtgttcagtgatgattgtctacatagatggattaatacatatgcacctttataatcatcccagctaccatctaaggttctagctttctctggagacatttttggtggtttacaatgttattttccagtgcgcatagcaggccccagaggcaaggtgatcacccctttgtttcagttaagaaaactgagttttagtgaggacaatcaatttttcccatatcacaaaactggtcatgtgatgctgcatcccatatttaagtccagagcagtgagcttctccctatccctctattatgctgccattttgtattttgtaggtgtgtaaaatcaaatgtcattcttccttaaaaaggactgtgaatggtaagcaacagttgggaagggtgacaccagacaatggctgaaaacagggcgactggaagttgactgatgggtgctgagcacttggcatcccttcctgctgcagaccccactggaatctcctcagaaggggacactggtggcttccattggccctgcctcccgccagggctgtgtgaggatccacatgggctgggatgagggtggatgttgttctctgaaaactgtccactactcaaaagtgatgttgtggccgggcacggtggctcacaactataatcccagcactttgggaggctgaggccggtggatcacgaggtcaggagttcaagaccagcctggccaacatggtgaaaccctgtctctactaaagatacaaaaaattagccaggcgtggtggtgtgtgcctgtaatcccagctacttgggaggctaaggcaggagaatcacttgaacccaggaggtggaggttgcagtgagccgagattatgccattgcactccagcctgggtgacaggggagactccatctcaaaaaaatttaaataaataaataaataaatagatgttgctgggtcaaaaagggagaggccccaccctggccccctagcaccagaatctgcatttcagcaagatcccagggggctgtcacagttgctagctctgctctttatgcttgcctcagctaggtgctgagtacctgctagaggtgtgaattcggtctttattcttcagaggcactggtcagagggtggaaacatcagacagggactcctgggcccccaggcaggactccatggggatggagcgggggatggaacatttgagaatcaccaacatgcagcaaggacattagtgagaaatgagttccacctgccagaagggaagctgagaagggaatgcacaaatcaggaaaatataccatcaaaaactacgactcttctacctccagccctcgccaccaattcctatcccattattttatatccgagagggttgataggcagcagacacactgattctgtaagcattgtccctagtccctgtaggcgaggtgaccatgtacccaagttcactcaaggtggtcctgtccatgcctattagaaatgagttcataattcctttcagctccgcctttcactctcgagcgtgcccttgcttgacgattcctatctggcttggataccctcacttatattaccttatatctgctattatatttccccaagaagttgctttacaaacactgactcctcaacacacggtcatctctaaaagaaagggtgtttggcagttcctcgacagttctggaaaggctgccttactagaagcagagtcagccatgggggggtgagaacgaaagtgtgcactcaagcatgtgtgtttggggtgtgtgggtatgggtgtgagacatggtcttatgggttctgtgtacctgcatgtgtgacacaggtgtgggtgcagaagaggacacggggtgtctggtgcatgggtgcctgtatgcacgtggggtggttgcgtgcatctgtgagtgcacatctatggtatgtgtgtatgcttgtgcatacatgcctgtgtgtttgcatgtgtggtgtggtatggtgtgcgggaatgcatgggcggatataagtgtgggtgtcttagtggatgtgtgcatggatgtagtatgtgatgtggctggatgtgggtatgacgtgtgcagtatgagagtagggttctgtagcacgtgtgtgtatgcagtatgtatgtttgtggtacatgtgcattgtgtgtggctgggggtgggttgcatatgttgcatatggagtgaggtgtttgtgatgtgtgtgggtgtgtgcggtgggtatatgctggtacctgtgtgcatgtgtgttggtgtgtggagtggctataggtgacatgtgatgccatgtgtgcttcctgagcttgtttgtggttgttcccagacccactgcagactcaagcatggctccacatggcaccaccacaggataagcctctgtgtgtatgcagtatgtatgtttgtggtatgtctgtgccttgggagctggtggggaggagggtctcacccttgtctgtccctgggcatccactatggctgcactgggaagccactgggtgcaatggtgttgctgtgtgggacggggcctcaggcccacaggcagcaagcatagaccagatccacccagcaccctgactgttgaggatgggccctggctgtgtctctctagcccagctagctcctactgcatagtcaggctttgggaggcaggaatctctgaatggatttccttcctcctgccctgcttggataggggcacttgtggatgcttctggctccaacttttgtgtgcagtgactatgatggagaagcaatgagctccctctacagccttctgggctgctggcatccccagtatgtttctccctggagacactctcagtgaggccaattccaggctgctgggggcttttccttctgtcactgtcgggcctccgcagggatctgcctggctgcaagatgctgatgggtggaggggtggcccacctggcctccagaagcaggagctccctgcccactgcccgcatggccctcagccctggccctcacctgttgcccctctggaagaacgttgctcttgttagctaacaaccacctgactttcctcgatctgtctctccctgaggcaagaatgacctaggtctgaagactgaagaccagtgctggggcccctcttggaaggccaaggaagtggagaagtgcccaggtctggtctgcttagcctcctgctagttgttggagctctttgagccttggtttccaaagccataaactgggagaatgacacctaccccagcagcacagagggatctttgcaataatgtgcaaacccactcagcatgatgcgtggcacaaagcacaaacccaataaatggtggctattatcactattattttatttcatagattcaaatattgagaatgaaataaatatatcagaaagtagtagcatcgtgccatcagaaaaatactctgatggggtcctagcgatcttatccatgaaaataaaatatcaaaagaaagacaagacgatctagaaagaagggatgccggcagtcttagaaaaaacaaataaacaaaaacaaacaaacaacaaaaaacaaaactggtggcagagagtgagacaacaggagcaaatatagggccagccagacaggcactgcttcctctccctttgacaggcaggacagcggcccgctcccaaatctgcagggtcagacgtggtagatgaacagtgatttgcctgagtgtaaatattgtgatgtctttcttttcttgaacttttaaccttgctggtaaacagggtgcatccagaattgtttttctgagaactgagttttgaggaaataggggggaaaagggtttttattagctaattttcagtcttgtgcgtgactcaaaaccttcttattctgtttcttaactttgcttcaggagacacttggccaaaaaatagctttgtttttaattgatgaaagaaaaatcattacaatgtgtaagtatgccaattcaaacatggcaaaactttcaaagacaaagcaggggtggggaggtcattctgaagaagatttctgagacaagaaaaacaaccaatccaaatccccatttgtgttttctaatgagaaactcctcacacgccattgccctgctgaccccggtcttaccttgaccacctcgccccatcttcatctgttataacttctgagatattgtaatggaagtatagagtaagcctgagatacactctcagcattcaaggtgctgccttcctttctccaggcaggaggctgacacagccgcctttatttacaaatgccgtaaattgactgcaggatcctttcgtgagaaaggagaataacggcagggaaccatcccagcaaaatgaagttctgggctccaccgccagcttttccctcgaaggtcatatttcacctctgccctgtaatttcatgaattgttcaatgaagatgtgacttattggcttccaagcttcatggaggtgttgtccaaatacaaggtccataaagtgctttggaaggcttggaggaacaaagaaacactcttgatctgaggttgtgatggagtctcctcaacattgtagccgatgatggcgagtgctggagggttcatcagacctgacagcaaccccagccttcaaaccactctctcccctcactattcatacctgcatttgtgtctgttcagttgaatgctggcagaccgtctttcaaataatgctccagttggaaagtaaactgagtacattgagaataaatatctccagtcttctaagctatacggcagtgttgctgggacctgtaagaaagtttctctctgccatcttagaagaaggaggaagaggagaaggaagcaggaaaatggaacaaattgccgtacctttgtaaaagatgagattgaaataaatcacaaagagtgttaaaacaggcagcttgcgggaagccaattgctaacattctcaggccccatcctttcctcctcctcttcctttcagaataaattaaagaatgggcccaagtccaagttgtgtgtatggtatctttatctgattgacctcgtactcctaataatatcttatcttcgcttgtaaatcattagcacccttttccgttctcccggcatgttacttctttaaatgtgatgaacactcacaggagtccgctctgcagacagacaaagctactgcaaggatcctctgtcattcatttggcgatttggtcccgaaggcctcagctggctttactagcaaagtgtttcacaaattcccatagccctgcaaacagccactcccccaaagcaaacaacctgagacatcaggtaaacactgaagaatggaaatttcattcattttcctgcctgcatcctctctagttgacagagaatgtcagtcaatgcaagatttgttgagagtggtacatttgaggatttatttgtaggctgtgttaatatactttcgagaaattcagttgtatctaattaatgcttttttccctttgattcattccaaactatttaaattggaaaattgtgtgctatttgaagatgcacttcaaaactccttttgttgtcatggtgcctgttgtcactgctttttgttggttggttcttgtttctatagggcccctcctctttgggatcgtgtgggtacagatgagactcacagttccctagccagatgatctatagaagtttttcaaagactgcataggtagtgttactgaacatagttcatatgtggtgtgtgtttctaaccttgcaagctccttgcaaaactacataaatacttgtatttaagttgtgctgtgcatatgaacataccttattatgagaaaggtagattttaaagtattccttccatgggtaaataagtcttccctgatgataaatcattacagttgctttcacctcccaaactcctttagctctcctctcccattcagcccctgtagaaaagggctccctttatttactgccccacttgttgcaagttgggggctatttctttaagtctaacttaatattccttgtatttagttcaaactgaaaaattctcatgtgtaaccgccgggcagggcagagggaagtagtgtctactttaaatctgttgcagcacatgaacttaaatgacaaaacaaacacagaagactgaaaagtcagagaccctcttaaagaaaagcttacaaaattatagtgtccactctaggcaggactttcatatcctttatctaactgtcacatgatggggtgacatgttgatccccccacagcctggatgatagaaatatttgtggtttgatatgcgtcagcgcttatgactttggcataaaatacaatctcctttgtttcttccccaaattcaagaagtgcatctttccataatattgagaatagaacctaacatttattgaaaatctactagcatattttgtctttaaaaaaaaaaaaaagcacttccacatactcagcaatggcccagtgaggcagataatagcttcatcccatctcacaatggtgaaataaagatcagagggagccagtaacttacccaaaatgactcccttaggaggtggcagagcccatactcaaagtcagtttgtttaaccaaactgcttaaaatgtcaacttagtttgcaaaacagccctatgtggttggtggtattatctgcaattcatcaccaacacactaggcccagggcaaagctaaaagcaaagctaaaaacaaagctaacagccagagtgaccagaactgggtctcacctctgctacacctgtgccagggagaggagatgaacactctaaagtgctttcatgcacttgggggccttcctgtccaagtgcagtataaatgttctttgtgccacatcttaaaggaatcctcttacagaaagggcttcccatctgagtggcaagacccaaggctaggctgatgcctcttcctttgctatgtgagacctgaaggcaaagtctgcctggactgacagagatggatgtggcctccatctgtctgtgtgtcatgacagaaaggaggtgggaaaacttggaaaatgggaaccctcactttcctgaaattcccagcaatcagttccaagaattgtaaccttgaagcacaggaaagcaagaccctcagccgggaacatgaaagcttttgtcgggaattctttgaggtcctgatgaggtgacacagtgaccagatgttccagattcaacatcaaggccggtgggggtggcactgcaccggtcacgtcaggaagagcagtgtagtcagagagcgtggcaaccaccattcgcctggtagacagctcattccatctgccttgcatattttccgctgagctcagaatggagaagatcgaatacagtctgctcttatcaccctgaagacttttaaaaaggctctgcatactcacacaaaaatcgggaacttgatcactgtggcctgacaatgtgttttgaaaaggcgggggttgggggcggtcagtctttccctgaaagttcccatccattgttgagtaaacatcataaatctatcgcagagagacaggctgcctgtactcaaattaccgcctgctacaattttagcttcaagttttaatgccctaaacatgaataacgtcgtatcccagcacaggtctgattaatgaggcaactttgccaacttcagggtcggagagtggctccccacctccttccttttttccccctgtggcttagtaaccatttcagcaaatttcctcattaaatatacaaggcgactgagtgcaataaaaactaaaggatgtggcagataaacaccagcgtctctctgagcagacctcgctgcccaacagagcaggccagctcaggtttgctgggaggaatccagaatgttccatcatgaattccagcataaaaatcatgcacgcattgccctttgccatgggtcattttcagtctgtgggttacacttacaggaccgtctgctttccgagctgtcacatggtttatacatggaatgccactcatgccctacttgcacgtaaggtgaccaatggctggctgaaggtcacactcaggagatgacccaaattagcacgtaatgtccaaccttgaaaggaaagagggaagttttatcttgcccagatattgtctgttccccaaataagattgtgtgtcgcttgagtaattcccgaataggagcccgtttgttgagcacttaatgcaccctgggcactgaagaagaaatgcggaggagtccccaggacttgctgagtctcctagagacagcagaggtgctctgctcacaggagctcattttctgcccacaacaaccctgtgccatcagctacattatctccaggtttctcatacaaccaaagctgaggcttatagggtggcacaacttcccctgctctggctccgaattcaatattcctaagccataaagcatttctctttcctccccatcctgttcccattcccagtctctccatgaacacacacacacacacacacacacacacacacccttgtctacacttgagctgtagtctgggcccgttacatcaacaacacaaccacggcagaacgtggattggtccaaattgcagagattttaaatctaaatttcccatgctattgagactttacagaaccagtccttcaggtgagttttgattttctgtttaagccagggttcagcaaacattttttctaaagaccagagagtaaacattttaggctttgctgggctgcatggtctctatcacaatggctcaactctgccattgtagcatgaagcagccaccggtaatacatagaggaatggcagaaggtgtgttttaatacaactttatttttaaaaacaggcagagggccagatttggcctacgggccatagtttgagaccccatagtttgagatctaagtcatcactaaaagtgttatcagtaattgagggttttagacattgcatctgtctaacctatcagaagtaagattgggggccagggccattgcagtgaggctgtggaagttcacagctgcttaagaagcactgtgaccaacatcgctccttaccccagatgggccaggccagcagtcacaacatgtgctccatggggagacagcaataggcatttcgctagaaaagaattctctggactagtaagtttagaaaaccttgggctattattatcgttattattatattattccatgactgcaggacttctcagggctttcataatgctgatgaacatgaatcttcctagatattctggatctctaggaagggaaggtttgtgtgcagagcatgtctgcacgatattctttgggaagactgcgctggctcccgtcctagagattctcatgctgtcttttctttctacctgttttcccaactgttcccacttgagagtactggcctgagttgctgccaaccttacaatatccagctccgtcctcagagccacactgcggtcccactggggactttggtggccctgcctccctgcaaccccaggtactcagtttggagggtgtggagagggcagggttgaaatgcaggctgctgtgtctctttccttcaattttatcaccagctgctgaccatgcttgcttaaaggtctggtatttatggtctcctagaatctcccagaacctcacaaatacccccgggctcctggtttgagggactagatgggaagcccccctccctgggagaacacaggcctagagcttcctggaacttaggcagcttggtcagagagtgtgaggactctgacaggagcacgggtgtgggacattcatgcctggaaggccctcgacacctgagacctcggtgtggaggcgggacttggaggaaaggagtccctgctatagtggaaaaaccagccagggtaggtagttttgtataagactcttaactctgtggagacttctgttcattatctgcaaaatagaaatgtgtatcccagcagcctaggcttagattgtggaggactagctgaggggtgtgtgagaaagttttgcaaacatggctgggcacagaaggctgagctattgtctggaggaaaactctcagggcaattcagacctttctgggcccttctgaggcaagaggcattgaggcaaagtttgagatttgacttcagggacactgttctctaagcatatgcttcagtcacgagcgctgaacccactctcaaaagctaagtagtagcaatgaaatgcttaaaaagttcgacccagactgcaaagacccacagaaaatagagcacagtggctggcttggggagggaccctcggtccagacagcagccaaggagttcttgagccttatttatcacgttgtagtattttacaaggagggctatgcattatttctctaattgaacgttacttttaaaaacagacaaagagaatcaggaaaaatgatgtgaggactttaggcccagatcagtttccgtttcaacaagatgtgtcaggatgatgaaaatgtcgtttggttgagccgtggtcatcaccccgcattgttgttctttcatgtgtttgtgtgtgtgtgtgtgtgtgtgtgtatgtgtttccctctgagtttcccagtagtcattactaaaaaaaaactcctaaactgactcaaaacaacaatgacaaaaacaaaagcaaacaaaaagacccaatcaccacaggcgccattcaggccctcttgtctgacggtgttcacagactgtgcttgtgtttttggatgtacccgcttccttttctctcttactcaccagatatcactgggaatccctccttcttgctccaggaccctaaaggagacactggggtaagactcatgtgggtcttggggcagcccatttccaggagagcatgacccccaccccccaagccccaggaggacggacccttcccagctgaggtctcctctgcatccggaccagggccctgggcctgaagccaggttttagtgaaggccttttgtgggtgcctctcttgcccaggaaacacaaggtctttaagctaagcctgtttgtggggagagcaacccatttcttagagggactcaatccatagggaggacactagtccatcagggggcccttgtattttcatcctggaaagcacagtcccctgtttccttctgggacatgagaagttgcttctaatggttcatccccacaacctcacttccccatccttgatttgcaaatgggtccatagagaggtcccaggcagctacttgacccaggcagcgaaggtgagcgtgggtctcctcactgccatgagccaggcagaagagcaagcaaaacagctaagaaccagacaggccagagttcaggttgcagctctgaacctgactaagctgtgtgacccaaggcaactcacccaacctctctgagcctcagtttccccacttaaagtggaaacaagaccagcccctgcctcatggaattgtcatgaggaagagtgaagtggtgctcgtgcagagctggtgcccagggaaggggctccggtgccaggcctgacagctcgtcagggaagcctgctgccggccatcccagggagacagtgccagatcagagggaagctcagcaagccacttaaaagggaccttgactcattttgtggtaaccgaatgtgcagttcaggaagtgcttcgcaaaagcgaactgggctccagccgccccctcgtccccctgccctctgctcaggattcactgtgcgaggacccacctgacaccacctgatgcataccagcagcgtggatggcaggccccacgtgttctcaagcccaccaaaggctggtgggtgtcggctctcggaaagacagcctgacctcctggactgaaattccactcctctctttagtcgaggtgctcaatctccctgagcctctgtttcctcctctgtaactggcactaccgcatactagggccggtgcaaagcccttggcaactaggtatcatttaatccccacaagcagctctaaaggcaagtacgaaaccttgccatttaaggatggggaagctgagggcaccttgagttatgcaagggcacacgcagggtgagtcttggagctggaatttgaacctggggaatggcactcctgggccttccctcctaactcatagtatctacaacctggattgtagacctagctagtaggtcttgggggttcttccctcctaacccctggtatctagaacctggatcgtaaacctagctagtaggtcttggtggttcctcacatggatggaagagatgccaatttccattaaccatgcacactgctgcttggtgggcaggtgaggaagtggtctgagtgtggaggaagcccaggacaggaccctctttgcctccccgtgggatgtcctggctgccctgggaggatatgtgtggtgttctctacacccacctgaacctctagctccccagagcctctgactgcatgttctgagggcagtggcatcgggaacgcatgggcgcagtgtgcagagactggccgaggagagctgtaggggttacctattaaggaggcaggtcccagcaggtactagggactgaagagggtggagggagacccgaggggggaagaggctgccctcgtcattagcccagatccatcccacccacttcttcccatctccctgtacttgccccatagggattcccaaagagagggaagtagagggggagaggagtacatggacacaggagagcgagtgagcaccccaccccacaacagtgtcctgaggaaggcccctcttttgtcccctgcttcacaagccttgggaacggggaactctgcaggctgagcggcatccctgctgggaaatgagggcctgtcttagttcctcatttaaggcacccaccctcattcccaaggcagttaaaagccccaagttgcccaactcggtcagaggaagcctgtcccatcagtctcacacacccagaacttgattctctggcctccgagactgggcagggaccagctctgtgtccccgagcccacatgtagaggagggagccgcgaagctgatagcccaggaacatctattccccacttgtcattgtcaaactctgatgtcttctgggactaaatttgaaggacagtttttactgttgtaaccaaaaaagcaaaaggaagcaaacaattaacaggcccccttcttttcgggacttttttctttgtcagtagaaagccatctcagtaaacaagagctgttacgaaatgtacctcaccccacactatgcctgtaaagcatctcccttccccccgctgcacaacccattgtacaagaaatattgtgatagatacctttgggttgaggctggaacaaaatgagccatcaggaagcattccattttcagctggacttgtttctgcatcttttggaggatttctgcaaacccacagcccagtatggcatttcccatactctgtgataagaacctccaggataacgttggtggctcagggatcatctgagccttgagcagcttccattctgatctggatgtctctgatgtgtgcttgttcaagcaatcgatgagccagtcatgggccccagactcatgggaactgggggagtgcccaagtcaaccctgcttgcttttacagctttcctataaaagcttctccactctttgcctgggcaagcccatgcccagatctccagcacacactccagctgccagagggggtgggggggctccctcctgcgtctggaacctattcagccagcctgagattcagaagggcctacctgctggagctgagggtgggtgaacccacccacttggggctagcgaaagattgcatcttgtcccaaggctctgctggacctcggaggattcccaccattgtctttttgggatttgagggaggtgtttcagactgggagactgggagaatgtttcccagcaaaaggcagaggttggggttcctgggatgtggctccccacagaccaggaggctgacacagttcctctctctgtcttcctgcttttctcatgcaaacagcacccctttcccatggctgctctaacatccttggtagcttaacacaaaacacaaatgtattctctcacagttcccaaaggccagaagcctgaaatctgtttcaatgggctaaagtcaaggtttcggcagggctttggggagatcagcttccttgtctgttccggcttttagacatggccaacgttccttggcttgtggacccctcctccacttaaagtccatcactccagtgtctgccccatcgtcacatggctatcccttctttaaccttcttgcctccttcatataaggaccccagtggttacgttaagggcccactcagataatccaggactacctctctatctcaagatcttcaacttaatcacatctgcaaagtcccttttgccgtgtaaggtaacattctcaggttccagggatttgtggatgtctttgggagccattattcagactcagatagttatagttaagacctatgagacagtcttctacatccctgagtgatacttgaagcagcctagcaacaaaaaaagccacaaaactttgtcaggagagctgtttttggggccaccccacattgacccttacctctgcagcccctggtttcctctggcccctgcacttgtgtgataccttgagaaggggtggatccacatgccagcctacgcaggagcaagaggaccagtgctgcctctcctttcttggtacatgccagcatggtctgtggctgggatgctgctctctgagacttgggagcttacttgttcacctcagcaatgaactctgaccacattttgccattcctattctcaggcccctagcaatctcattcccaaactcgatgacccagtcttttgcatggctcagagaactgccagaactgttagcacctaggccctctgctggagttcacagatgcaaattctgttgcttgcactccaaatctgtgatgcaggattgtctgctatgtggaattaattcaggacttgaggaatccttgtagtgccaccttacaaatgggttggtgccttggaaacccagtcctggcatcaaggccttggcatctgtcaagcagaagtgtgcctggggtgtattggggggggggcagtgttggagccgatttcaccgatttctgtccctggctctctattgtgcaacaacaggctcttctattccttaagacggcagcattattgccaggtccttctatttgctcataaaactcccatttacacagcagtttgcaggacacatcaaatacaaaaatggatgtgaggtttagtacagggagaccacagccataatgaatcctggcagggtttttattttggttgcatctcagaagcactttgccaagcaatgtatatgtgttgaatgaatgaatgaataaatgaatgaatgaatgccggtggactgacatggccgtatagaactgtagtcacccttcagagagaagcctctgcaatgcacctgaaaagcaatgaccatctacatgttcttccttttcttgttactatgttttaccccaccaggatgcccactgaccagaaactaaacaaaaaaactcatgttcctgaattcatcttttacttgagggtaaaagcttggggtagtgaagtgaatgttggtgccatatcatgttcaagcattttggaattatatagctctaatttagacaacagcaacaacaaagaaaagagactccatcatcagaattgataggttagtaaatttacagatcactcaaagatgttaaaacaaaaaaacaaaaaactttctaaactctcggtgttcttgggaagtagcctgctgtcgttgggctagagataccaagaagagccaaggcagcagattgtggttgaaatttaacacggtgtgggggtggtaggctggcggcacaggggctgctgtcagagataacacacagcccggagaaccagggtgtagatcagtgcatcagagccctttccaacggtcaggagaggaggcagctgccctgggggcagggaggacctctgacccacaagtcctgacctactggcaggagaaccattcctggtttgcttgctgggtctgagacatttctggagatgtgggactttcagtgttaacacccaaatagccctggggaaactaggatggttgctcacccaagctccaacttgtctatagaattatctggctttgaaagaatgtcacgtgcttttatcttgaatctaaggtcactggcatgcccctctcatccactggttattcttgatggtaagggggcggggtgggtagggtgaggggagggtgaaggggaggttcctcctgccattccttcctggagaagagaccagggcctttccaggattttggactctgacatggaaggaaaacacttaaagaccttcaggatttcgtgagaataacaagattttattttaaccataaattgtaatatttgagaaaatgcagacatattgtttctcagagcccatactaagtcagtgtggaaaacagcctttctctggaggcaaaattgcactgattaacttgaattacaaagggagcattgcttaccttaagctaagacagctcaatgagacctgctgtagcatttttattacatgtgcaattgtgcacatgtaccctagaacttaaaagtattataataataataataggaacctgaaaatctagacgtggagtgcttgcggtctctggacactcaggtctctcctcttacctcctttcacctcctctcagagcccatcgctgacatttagttcctctagaaacacaagcatagctcagctgcatgtcagaagtgcaaaaatatttaactttaatttttttatgtatatgtctaaacttgtcttacacttaaggtccctgtattagtctgttttcacactgctaataaagacatacctgagaatgggtaatttataaaggataggggtttattggactcacagttccacatggctggggaggcctcacaatcatggcagaagacgaaggaagagcaaagggacttcttacatggcagcaggcaagaggcatgtacaggggaactccccttcataaaaccatcagatctcatgagacttattcactactacaagaatgccatggtgaaaacctgcccccaagattcagttacctcccactgggtccctcctatgacacatggggattatcacaattcaaggtgagatttgggtggggacacagaaccaaaccatatcagcccctttctattggtggcaacaaaatatttcattttactaactaaagattagtaatctctactgtattaaaacttacgttcattaaggttctaagtttctgatgccactcaaggattccccactcccctcctttcccaaaatgcagcccaggtgccaggagaagtgggtgtgtgtgccctgtggcatctggggagaaggggctggcctcccaaggaagaagagcttctccctcctggtctttaggtgccaccctcatggggtccctgcctaggtgtctatggctggggttgctcatgacctgttctcaccacaggcacagcattaaggtccgaggtgacttgtatgtgtccccagattggctgagaagtaattcattgtatgattatagcacagtttgtttagtcattcacctgctgatggccatttgggctatttccaattttgtagtacagtagtccccctcctatccacaggataggttccaagactccccagtagatgcctaaaactgtggacagtactgacccctatatacactgactgtggatagtattgacactatccgtggatttgataactgagagggctactaagtgacaaatgggtgggaagtgtatatggcgtggagacactggaaagagggagtatcactgtccctggtggaataaaacaggacatcacgagatttcatcatgatactgagaagaaggcacaatttaaaacttatgaattgtttacttctggaattttccatttaataattttggaccatgattaaccacaggtagcaaaaaccatggaaaacaaaactgtggaaaagcagggactactgtatcatgaataaagctggtaagaacaagtacaggtcattttgtggacaagtgtttttacttctctttggaaagtagaagtattgctaaaccatacataagtggatgtttaatgtataagtaactactaaataattttccaaagtggcgtatgttcccactaacaaagtatgagaattgcttcatgtcctcaccaacagtttgtgtctttaatctctataatttgagctgttctagtacatgggaaacggcatttagttctggttttaatttgcatttccccaattactcattatgttgactacctttgcaagtgcttattgaccatttgcaaagtgtctgttttaggccttttattagacctatctctaggctgttccaggcctatttttatatttggccatgtattttttattatggatttatagaaattcttcatgtatacttgatataagtcctttgccaaataaatatattgtgaatattttctcctagtctttggcttatctctttttcattttctttctttcaaagagaagaatttcatgaaaataaatttattactaaaataaatgtataattaatgtatgagtagtgttttttgtatcctaagaaatctttgcctaacccaaggtagcagagatcgtttatgctttcttccacaagttttatagttttaggcttttatttttaagtctatattgataaacctaaaagtgtgttacttaatttttgcatgaaaatttttaagatattatatggttgttgatttctaatacccacttagttagagaatacactttgcataacatgacatagacaacagggataagcaatgggcaattattttttaaagaaattagagaaagacaaagagagtagtcttttatggttacacacatattttacctatccatggttgttaacatcttggtatctgctttccattctcaatacccaagtttccatctgatgtcatttctcttcaacctgaagaactttctttcatatatcctggtgatgaattctctcagcttcacttaactgaaaatgtctatattaccttcattttttgaatgatatattttactggacatagaatttcagcatttattatttcgttaccacaaaattttgtcatctctgacctcattgcttctgataaaaaaaccgatatgatttatatcattggccccacacaggtaatgtgcctctggctgctcaagatttttctctttctcttaatttttcaacagtttgactgtgttgtgcatgtgtgtgtgagtgtgtgtgtgccctctgtgtgtgtgtgttcatcttctttggagtgttttgagatccttgggtttataagttagtgcttttcatcaaatataagacattttcaattacattttctctctattcctcttctgaaattataattacacatatgttaaactatgtgatattatgccagatgtcgctgatactcttttattaaaaaatattttctatatgttcttaagattggatagcgtatattgagctctctgccagttcactgaccttttcttctgttgcctccaatctaatgttaggcttatccactgaaattttcatttctgagttctagaagctctatttgtttttgttttttgttttaccccaagttgttgctattttcttctctgattttctatctgttccttcattattaaaatattttcctttatgtccttgaacatatttataatagctactcaaaaattcttgtctactaattccaacacctagagtaccttggagtttgttgctattaactttttttttctttcgagtatgagtcacttttttctgtttctttgcatgtttataagtttttattatatactgtgttttgtggataatagatttagagattctggattctattgttttcctttggcaacatcaatcagttaattatggaatgtcaccttaaagttgcagaaccttggttttatactctttagggtaggcctatttagatttttccttagtcttagggaggatctttaatcctgggggcatagttattactcttaggtatgaccccttcctaggattttagtgaaatgcccaagatgtttccaaacagctcttttggaaaaattgataggatttaaactccaaaatctgtctcccaatcattgagcaatgggcaattggttgaaatcattattcagctttaaaaactttagctctttccaggatttatccccctcaatttccagtcactctggcagccccaaactctgtcctctgacacctcaagcaataagatcacagctttctgcctggcggactagagagagcccttagataaaaacagggtaagcataggaagcacgggtgcagttccttatttcaaaggtcaaactccagtttctctctgccagtgctttcaatttttaaaaaatattttgttcagagtttataaatcttatctgcaggaggattgggccagtggaggatactccatcatcattaaaactagaacttcttctatacccactttatggttcttaaaatgtattccaaaattgaccttcacaaagattagacattctcactggcaagaaatgagagtccctgatatcctttccccttggcagccagaatttcttagaccaaattgcatagaatgccagaaccttagaaaacaccagacccagtacttcccagctcaaggctcctgaatcccaaaagcgtttatgagggtagcacagggtcaaatggcagcttctataaattataagcactatgtatttttccaagcataaaatatacagttattcataacacaaatcttaaatgtcattacttttggttggaattacatcatagttttcctgcagacataggttttctcttgctcatcagaagcactgctttatagttaagtacatttttggtcaacctcaaatggcaaggtgtattattattattgataagtgacatgtggcttttaggacataggaacctcagaaagaaagtttattagaagaattcttggtggccctgggcactttgaatagtaatgagtgtttctggttgatgaatttagatttaatcattggatctatctttgtttataagagctgctatagctttagcttcattatttgctgaggccccaagacatgaaagcacttgcctggagtgacacagactgacaccccttgtgggttcagagatcagaaactaagatcagactttgttctgaacacagcagcatttataactgtgaaggactaattctgatacctaccatgtttcagagacaaaatataaaagggtaaacttagagaagagcactttagagaggcatccagagagaatgttgatgattggatggacatgaccttttgaaatgcctgtgatttctgttccatttcttaccccggcaagaataaaccaattggaattcaggtgaatgaattttgattgagcacagattcatcatatcttgccaggtttgtcctttatttgtctccaatgctgatgcatctggattcacatcaactccatccactacacttacaaaggcaaatgcttccccaccttctgtaatcatggaggaaatgtatggtatagggcaagcacataggtggctttttctttataactcctgtaatatccaggccaatgttacatattccttaatatatatttactgcagcaaaatttagatttatttcaccatatttttccccagaaaagccagcatccccatttacagaagcaatcacagaaacatggagaaattcattacagtcttagtgcctcagaaggacataaatcaacttttaattacctctacctggagatgcttggtgcaatgtgctgtgtgtgtgagactgaatgtgtgtgtgtgtgtcggagattgagtgtgtgagtgtctgagaagtgtgtgagggtgtgaggtgggtgtatgtgagattgtgtgtgagagttagctacgcatctcctctgtctcctcagagccatttcttttctaattgtgctctcagacaaccagccagctaagcagggtctggcgagtctgagacattcatgctggggtttgcatgaagcttgtctccaggaatccaggacacagtttagatttgctcagacccgtctcagcagcctggagttaggatgaccagatcctttgaaaggtaaagaagctgctgcataggaaacagaaatgagtcaatttctgggaagttgctagagtttgaatatttgtcccctccaaaacatgtgttgaaatttaattctcggtatgtcagtattgagagacagtgcctttaacaggtaactgagtcatgaaggttcttcccttatgaatcacagggttatcataggagtgggactgatgtcttcataaaaaaggaagcgagacctgagctagcaggtgagcatgctcagcccccttgccatttgatgctctgtgctgcctcaggactctatagagagtccccaccagcaagacagccccactagatgtggcccctccaccttggatttcttggcctccagaagaaaataataaatgcctggtttcgagtgctctgttatatgccacagaaaaagacaggagtggagaggcttataacccccaggatggccacaggcttatatcccttttatcctcaggggtgaacccttgcctacctgtttttccatccagccaggccagcactgtagcagagggaaaacccaagggccccatatcctggcaatgcagccaggactagtgtccaaaaatatactgggaatggtgctgtgactacatgctgtgaatggaaacagcctgactgcagagggaggagtcaggaggggcttcccagaggacagggtggggtggggttcacccctagtgcagcctcagcaggagaatggggggttgttctctctccactgtgaacctggtgttcttcccttctctggggtctggctcttctactgagagaacaaggtgggcaacagaagtcaccaaaacctcctccagttgtgcaatgctaaccttgagagcagggccaggctgagacaaacacagaacccagcttcttgcagataagatgtgaaaagagtctgttactcattccaggtcctgtggcacttttagcagagatggatgtttccagctggggcttgccttagtttactagagacactgtaacaaaacaccttagactgggtaatttgtaggtaatagacatttatttctcagttttggaggctggaagtccaagatcaaggcgcaggcagatttggcgtctggtgagggcccactctgtacttcatagatggtgccccttgctgtgtcctcacaaggtggaaggggcaagcaagctctgctgcagctgttttataagggcactaatcccatctaggaggcctccaccctcatgacttaatcatctcctaaaggcccacctcttaatactattacactggtagttgtctcaacatatacatttcaaggggacacattcaggccttgcagggctttagatcccaccacttcatcttatcctctttcttgtcccttctcccttctcctgaagcttgaactgaaagatgcttgattttggcctctactttgtcctcattgccatttgtgacaaatgaagaaattctatgtatggtgaggacagcaccatggagccccttagactttagacttgtccatttggctctgtggatatgggttgtattttctctacttttctttgagctctccaaataaaaacagttgataatctgaatacattgaccatgtattctagaggtatacagaaacatgtgtggactctgaagccaaactttctggtttagtcctaacttcaacacatattagaagtatgacttgggcataaattatctgggtctcagttttctcgtctgttaaaaaagacagtgatacagccaggtgcggtggctcacgcctgtaatcccagcactttgggaggctgaggagggcagatcacttgaggtcaggagtttgagaccagcctggccaacatggcaaaaccccgtctctactaaaaatacaaaaattagcccggcgtggtggctggtgcctgtaatcccagatactctggaggctgaggtgggaggcggaggttgcagtgagctgagattgccgccactgcacccaagcctgggcgacagagcaagacttcatctcaaaaaaaaaaaagaaaagaaaagaaaagaaaagaaaaaaaagacagttatataatagcaaagacatggaatcaacttaaatgcccatcaatgatagactggacaaagaaaatgtggtacatatacaccatggaatactatgaagccataaaaagaatgagatcatttcctttgcaggcacatggatggagctagaggccctcgtccttagcaaactaatgcaggaacagaaaaccaagtatcacatgttcttacttacaagtgggaacaaaatgatgacaacatatggatacttagggggaacaacacatattggggtctgttgggtgagtaggggatggaaggagggagaagatcaggaaaaataactaatgggtactagtcttaatatctgggtgataaaataatctgtacaacaaacccccatgacataagtttacctatgtaacaaacctgcacatgtacccgtgaacttaaaataaaaatgaaaaaaaacagtgatagtacctacctcatagtattgttcttggaattatgttagccattatataattcttaaagagttcttggcatgtagaaagtactatgtaagtgacagccatcgttgcttttgtaatgattattttgcttcctttctttttgttcattgcacatttaaatttctaaaagagattccaatgtctttattattaaggtgagaggaaagcctgaatttaccttccccctcttcccagctctgcccctcacagcccccagacctttgctttgcttgctggacccaaagacacacaattcttgtccctgtgcctgggaaggggtgttgggattcagggcagatgtatttaccagactgtggtttgggcccctgtgttgtcttttaacttataaaatatctgtataattatttttcattactagccaccacattcctttgttataactgcttttttgaaaatgaatatatgcacattgtaaacaatttcaagtgaaaccgcctccccatcccttgtctgatggctagtctccctcccctgagggccgacgccactgcttgccaattttgacataaggcttgaaaccaatgagtgtccagtgactgggtgagtttggttcctcctacttgtcttggcaatctcaaacagttccaggagaagattgtttcttggagagtgggtggcaatgaaataatagcaatggtggtcaacctttattgagcaggaattgtctgccaggcacccttccaggagctttgcctgagggatctcgtgatctttgtgatgagctatcgaggcggctactgctgcgacctgggatggagatgcccaggtggaggcccagagaacggaagtgtccttctaaggcctaactaacagataggggacttccatctgctccaaggatatctagttccagagtccacactcttggaatctagaaaactccatcaggactaatttatgagcatcttagaaccactttccctgaaatttcctttctacaaacctaggaagggttttttctcccttcttcctagcaagttcttagctttttatggaataagaaaatgcacagagtggccttcatcctggacaggctcctttgatgtgagccacgaggcacctagggctgggtcatctgtggtctctgcaggtggccaccacgtgtccttgggcttccccatctgctccaggctttggtcttttaatttcaaaagcagggaaagagcaggctcacctgaaccttctccagagttctttctattactcagagtccatctagctaaacatgtttttaaaaatatttatttgcactggtgagcccatggccatggtggaagtggggacatgggtaagcaagagtccaccctgccccacggagctcacgttccgcaggagtggaacacacagcagccctgggcaaggcacctctggcctgtccctcacctgctttgcacctggttatgcttcccttactcccagtagcaagtgccccaggaaccccgtgggtgacctactcagtggtaggctgtgcctgcttgcaggagggaccagaaggctacctggggttacttctcaggcatgagccaagggtcacattataaaagctatgccagattccccatagatgatcctctatccaaaaattaggagctcttaagtcataagatgagtcaaatctacccccttagaactcaacatagctatgttcagttttactggaaaataagtcactggaaagcactttttatggttttctaaatctctcttatgcccaaagaagtggttcagccctggtctaaggcactgctcacttactctgattgccatcttcagcatcatcgtgatgatgataatgatgatgatgatgatgatgatataacaagatagtagcaataacaagagctgcctcctcccagttgtgaaattatgtttatggatatctggggctcactgttctctttaggaatgacccctgagggctcatggctcccagcccccagtaccgcaggtaaagcagtgaccctatctccagaaacgtgggtaccaccaccacagtcatagcttagatggggcaaagagtgctgactccagaagccgccatcatcaccgactgtgtcgaatttggaaatggggacagaaatgtacacatacccatgggctttgcagagaggccatcaaatcgactgtttctttttggttgtaaaaccctgaggatctctctgcatttcttcccttcccacccccattgtttaagcctcagtttctcctttgagctacctgggattctgatgggcaggattgctcggtaagcgctaagctctgtccacaactcagccattttgtgtctctggtttgctttggatggcagttttccccttatcctgcccagatttccagtatccaagcccgttattttcttatattcttctttatgacctgtatttttccaaagattgggaagcaaaaatgtcaaggtgatagatgcatatagataggtaaaaagatgacagtcagttttaatcctcattttgcttttctgtatttccaaaatttctacaaggaacatctattgtatttgtaataagaaaaatagtctaatgaggccgggcgcggtggctcacacctgtaatcacagcactttgggaggccgagggggcggatcacgaggtcaggagattgagaccatcctggctaacacggtgaaaccccgcctctactaaaaatacaaaaaaattagccaggcgtggtggtgggcgcctgtagtcccagctactcgggaggctgaggcaggagaatggcgtgaaccctggaggcagagcttgcagtgagctgagatcgcgccactgcactccagcctgggcaacagagcgagactccgtctcaaaaaaaaaaaaaaaaaaaaaaaagagaaaatagtctaatgaaaagcaagttggtgccttgaagttgagtgttttggttgaatgttggctaaggatccagtcccccagaggttagttaaaagcttttcctccagccctatgaccacaggggtaacaactcaactcctcaggccatgaaatttcagagggttatctttgtcctgagcctcagacttctgtggatccaacaagggaagggctgtccggcagtggagacttgacatctcactggctcccaatacttgcagctgcagtgtttcttgagcactactgtgtcacacacggcctgagtgcctgcccccatcttcagagaatggcacccgggtctggttggctcacctcactcaaagtggcaggaccgtctctactgcatgcattttctgtgtggtatgtttttctttctttggtagctcataaaatttccctatctgtgctgggcctcttggtctttaatcttcaacctctgctggagctgtccctatttctttttaattatgcctctttttttatggaagtttcctattaaatttttatgactatatagagctgtggatagactccaacaaaaatgaaatctttatggaatagtcatttctctccaggagcccctgatagatgttcctctgtggatagacacacatgtgtggtgggggtggggaaagtccctctggtcttggctgcagctgggcaggatgcgggagaggcagctgagctgcttattcctcagtgtgagggctgctgggagcgtggggtgcagctcagcttggggggtgggggtgacgtgggatgcagaggataagaagtaaatcttccctaggtgtaatttctttgccttggtgtctgctgaattagcactgctccctaatcccaagccatcaagctacatggctgcatatgagcggagacatgccccgttactccttattcagaaccttcatggccaggcacgttggctcatgcctgtaatcccatcactttgggaggccaagtggcagatcgcttgagcccaggagttcgagaccagcctgggcaacatagtgagacccttctctatataacataaaaatttaaaaaaaaaaaaaaaaggagaagaaaagaaaagaatctcctgcccaggtctgccagctgagcttgcaaaaatgttatccttggggctaacattctgtattagttcattttctcgctgctgataaagacatacctgaaactgggaacaaaaagaggtttaattggacttacagttccacatggctgtggaggcctcagaatcatggcaggagatgaagggcacttcttacatggcagcggcaagagaataatgaggaaaaagcaaaagtggaaacccctgataaacccatcagatctcgtgagacttataaactatcatgagaataacacaggaaagactggcccccgtgattcaattgcctcacccctgggtccctcccacaacacgtgggaattctgggagatacaattcaagttgagatttggatggggacacagccaaaccatatcacatcctaagtgactgtctggggtcactggaccctggcatgcttccccctgtgccagctaccagctatgtggtctgggaatggcttgggatccacagatagctctccaggggggtcacggaccagagttgctgttgcagggtgtgagtccccttgccagggagggaagggacagtcattcacttataaacagatgttgggactcacccaaattgagtgctgggcctagatcagggcaccagggatttctcattcttagtcccgtggagctgatgttcctgaaggaggaaatggagaaaactcaagaaagcttgtaaacgagtgaggtggttttagattgtggtgaatgctggggggcaaacggagatattaagagggctgccaagggaggaggagggaggggttctcatttcaacaatgttcagggaaggctgcctgctggggcgatcctggagctgggacaggatgatgaggggcttgcatactcagatcaggggcagagccttccaggcagcaggaccaacaagtgcaaaggccctgaggtggaatgagtttgtcaagttgagaaacttgtcaagatgagcgtggctgggacagtgtaagccatggggagagtggagagacaggaggctgggtcaggcatgggagatttttaatccttgctaacttactttaaatgtctaaagacaccattttgactgctggacaaagaatggactatggaattgcattaaagtccagaggtccagtttttggaaccaccaggaaggcaacacaatgcgcctactctcaaagggatttggggaatggaagaaggtggggttattgtttcatcaggctgcttggatttagacctgttttcttaagctgcaagatctcctacaaaactggatcctcacctaagtttggaggacaactgagaagtgatagttatgtttgcctccctgcagagaataaactctcaggagaggatggagcactgcagctcttacctatgaaagttgataaggaagggagtctccaatgtgagtgtggcaactgtctactcactggaaggaacagtgatacatatcataatagggaaggaaatgaacagcatccattatgtgatggcgtctatcccatgtgttaggtcctgtaactgacaacagccgccctgaaaagtattattgcatatgagactggagaccagagaggttaagtaaattgcccaagatcacatagctactaagaggcagagctggggtttggactcacgtcggcctgactccaatgcccttgcatctgtcactcgtgcccatagccctagtcaacacccacatgctaaaggcgtcagtggtcccctctaacaaaagctgttatggcttctcagagagactggagtccatggctgggagaggcaggggtaccctgggagaaccatgtgtcatcagggttctttccaggcccttccagccacccacccatgggcataaggcctaccccagctctgcaaggtttcaaaaaaacatgcttgacacttgaacaaaaattggctccaaaacataagaagaaagctgcaaaaccataattagtaatttagatcaataaagaataaggactataaagaagagagtaggggaagtagggaaaaaaaggaacatgatgtatttattaccattgaacaatacacttaaaatggtaaagatggtaaatcatatatgtatattttacctcaataaaaaagaattaaattaaaaaaataagcaaaacaaacgatcttattttaccttcatttatgctttctctgccctgcatctctgcctgatgctgaccccagtttctgactaataaggttttccttctgcctgaagagcttctgcaaagctgtccttaggacagatctactcgctaggaattccctcagtttttgtttgagaaaaatatttatttctgtctcacttttttaaaaattaagctttgttttgttttgttttactataattatctttttgtttgtttgtttgttttgagatacggtttgactctcccacccaggctgaagttcagtggctcaaacatggctcactgcagcctcaaccatctgggcttaagcaatcctcccaactcagcctctcaagttgctggaaccagaggcacacgccaatacatcatgctatttttttttttttacttttgtagaggtaatgtcttgctatgttgcccaggcttgtctcaaactcctgggctcaagcgatcctcctgccttggcctcccaaagtgctgggattacaggcgtgagccaccacgcccaggccaaaattaagcttttttatctggagatcattgtaaattattctgcagttttaggaaataaatcagaaaatatactgtgtgacctttatccagtttcccctaaagataacatcttatatgatagtataatagcactgccagaatattggcattgatatacttttacttgtcctcattgtgtgtatgtgcacacatgcatgtgtatttagttccatgcaatcttatcccacatgtagggtctgtgtatccatcaccacagggttcctcttgctgcctttttatagccatacctccttccatactcttctccttaacccctggcaaccaataatctgttcttcatttttataatgttgtcatttcaggaataatagactcgtggtgtgcatgtcttttttgctcagcacaattctctggagatttttccacactgttgggcacatcattatccaatgcccccttttcttgctgagtaggactctatggagtggatgctccacagtttatttaatcagtcaccgaccacacagagtgaggctggagagaatggcagatgagagaggggaggggtcgggacagggaaagaaaaccctctcagagatgtctcacgatatctgcagtaaaacctatactctcaaacaaaaactttcttggtggactcttttcttcttctgggaaaagaggcaacataaatggacgcagatcacctgccacatacacatgtgcatactgatatgtcccctcgtgtgctcatgtgtacacatttttgcacatgcatacacacacacacacacacagacatgcctgtgaagaggccaaccccagtgtgcagcagctgtgagggggctctgcccctcctctcctagaatggaacatacgttcttgtgaacatagagagtggcattttcttatgtcgatgtaatgtgaacaactcctggtcaccagcccccttgaccactgatgcctcttcatgggtcggtgagtgagggagacacagccatttattcctggcatcttgaattaaacttgaaattactgcccactagaaataaggcctggggcatagagtcttattattaaaatcttttgtggaaagtcacagggctccaatcaccccaaaaacattgtgtctatgggaaaatgcaccttgagttccatcttacaaatggatttgtaacagtttaggtttcatgtaagctgttcacagtatcctagtgatacatgtttatggtaaaaaatcttggagggtaaagaacaaacactgcccataattttttactgtatacacttttttttcttataaaaatgttactctattgcacatagtgttttgaatcatgccaatttttatttggcaattatataaaggcagaactttaaatatcacccccaacattctgtgcctatgcctcagagcctatgcttaaaaagagcaatcatattcatgactacgtatttaatgcaacattagaaaactaatgcagtcataacccacaagcgttttccatgccaatgacctttttgccatctggtttagtgactgcagagtatcccattacatggttgtctcacaccttggcaagcatcccttaaggatggacactaaatcatcatggggtttaatactctcatccacagaagagactcccaagccagtcctcacatatcttgctctcattactagggcagagggttctaagaattttcctcttatgggccaccaccagagcagaccagactcactgtttccatgcctgctggctcttgctgccaccatgccctgatttcaaataaccactccatccatgagctaactgaccttagaaagatatacttttaaaatgcatatcctcccaattttcaattaaggccaaaaggagtagtagagaccaaatatatcctctttcatgaaacaaacaaaaaatggcaaaaatatgtgaatctacgaaaagatactagaactcttaagtgaatttagaaaggatacaagctgttatatcaatatttaaaaagtcaatttcatttatatgattaacaatgaacaatcagaaagtgaaatagagagtgtcatttataatagtatcagaaatataaaatacttagaataaacctgacaaaggatggggaagacctgtatactgaaaactacaaagtattcctgagaggaattaaataaaacttaaataacataccacattcatgtgttcagtctgaattacaatgtctaaagttaaacatactgaccacaccaagtgttggtgtggatgtggaggaactggaactcttatatgttgctggtaagaatgcaacatggtacctccactttggagaacagataggcagtttcttaaaagttaaacatacatttactatattactcagccattccactcctaagtatttactcaagagaaatgaaagcatttgtccacacaaacattcttacatgattgttaataacagctttattttcaatcacttgaaactgaaaatgatccaaaggtatagcaacagataaatggactgtggcatatccatataatggagtactatcaagcaataagaagaaacagacagctgggcagtggctcacatctgtaataccagcactttgggaggttgaggcagatcacttgagctcaggagtttgagaccagtctgggcaacatggtgaaaccccatctctactaaaaatacaaaaaattacccaggtgtggtggcgcacacttgtaatcccagctactgggaaggctgaggcaggaaaattgcttgaacccaggaggtggaggtttcagtgagccgagatcacgccactgctctccagcccgggcaggcgacagagagagactgtgtctcaaaaaaaaaaaaaaaaaagagaaagaaagaaagaaaagaaaagaaaattagcagggtgtggaggtgcacacctgtagtcccagctactcaggaggccaaggtgggaggattacttgagcacaggaggtcaaggctgcaatgagttgtgattacattgctgcactccagcttgggtgacagagtgagactctgtctaaaaaagaaagaaaagaaagactattgatacgtgcaaggatatggatgaatctgagaacaattttgctgagcgaaagaaagcagaggaaaaaacatacaagcagcatgatttcatttacataaaatttttaaaaatgcaaactaacctatagtgacaaaaagcagaacaatgggaatttataatgttaaacacatatgtttattagaaaaaaaaagatctacagtcaatcattcaggtttccatcttaggaaactaaagaaagaggcctaatttaatttaagcctgaagcaaggaaaataagataagtaattaaaaattagaacagaaattaataaaattgtaaacaggaaaacagtagagaaaaatcataaaacaaaagctggttcttggaaaagatcaataaaattgataaacatttagtcaggccaatgaagagagaaaagacacaaattattaacattagaaacaaaagagaggtcatcacaactgatcccatagacatgaaaaggttaattaagtaatacaacaaacaactttatgctcataaatataattaaggtgaagtgcaacaattccttgaaagacacaaactattaaaaccccccaaagagagtagtcttatattcgaagagattgaataatttaaaaccttccagaaaagagagcactaggctcagatagtttcactggtactttcaacagaatacttaaagaggaaataataacaattctccacaatatcttccaaaaaatagaggcagaggcattgcttccaaactcattttatgaggccagttatcttagtctgtttaggctgctgtaacagaacaccacacaaactgggtggctcataaacaatagaaatttatttttcacaattctgaaggttgggaagtccatgagcaaggcactggcagatttggtatccagtgagggcctgctctctgcttcataaatggttccttctagctgtgtcctcacatggtggaggggatgaggagtctcccttaggcctctactataagggcatttaggtctcttctacaagggatcacccattcatgagggctccgccctcatgatctaattacttcccaaaggccccacttcttaatacaatcaccttggaagttagaattccaacatatgaatttgggggaacacaaacattcagaccatagcacagtatattaccctaacaccaaaacctgctaatgacattttaagaaaggaaaaactacagaccaatatctctcataatcatagatacaaaaaaatctttgaaaaaattattgaatcatattcagtaatattatataacataaccaagtgggattcattccatgtatacaaagctggtttgacattcaaaaatcaacgtaatttaccatatcaatgggctaaagaagataaatcacatgactatatcaactgctagagaaagtatttgaaaaaaatcaatacctatctacaataaaatctctcggcaaactagaaacagagggtatctcttcaacttgataaagaacatgcacaaaaagcctgcactaaacgtcatacttattggtgagaggctgggcattttccccctaaaatcaagaataaggcaaggatgtcctctctcaccactcctatcgaacatcatactggaagtcccagctacagcaataagaaaaagaattaaaagaaagatatacagactggacaaaaagaaacaaaaatggtctttattagtagatacactgtctatgtaggaaatgccaaataatctgtgcacacaaaaaaaggtgaaaacctcattggaaaaggtgagtataacaaggacacagcatacaaagaaaatataccaaagtcaattgctttcccatatacaatgaacaattagaattttaaatgaaatttacattaccatttacaatagcatccccccaaatcagtatttagttacaaatttgacacaatctatggaaactgtaggcaaaaagctagaaaatactggcaaaataaaataatctaaataaatggcaagatagtccctgcttatctgttggaagacttggtattgttaagatgtgaagtatttataacttgatcagagcagtccaattcaaaatcccagcaggttattttttagatattgataaactgattctaaaattaatataaacaagcagaaggcctagaatagctaacacaatactaaagaagatcaaagttggagtactcagagtccttcatttcaagaattactataaagctataataatcaagatggtgtggtattggcaaaaaaaggacacataaatcaacaaatggagatgccagaaatagacccccccacacaatataataacctgacttttgacagaagcgcaaaggcaactcaatggagcaagtgaagtcttttcaccaagtggtgctggaacaattggatgttcataggctaaatgaatctggacacagaacttgcaacttacacaaaaaataactctaaatggatcataaacctaaatttaaaatgcaaatttataaaacttttagaagaaaacataagaaaaaaatttatgtgaccttgggtttggtgaggaatttttagatacacgaccaaaagcatgaaccatgaaagaaaaaaaaatagagaagttggactttattaaaattaaaaacttctgctctacgaacaattctgttaagataatgaaaacacaagctgcagactgaaaagaaatatttgcaaaacatgaacctgataagaaacttgtatccaaaatattttaagaaatcttaaaagtcaacaaaaagaccataagtaatccaattgaaaaaatgaataaatctgaacagacacctccaaatcaccaccaaagatgatatttgtgtgtgtgtatacatatgacatatacatatgtacatatatgtatatatatatatcttacaaatgggaaataagcatgtgaaacatcatctgtcattaaagaaatgcaaatgaatacaacaatgagctttcaccacacacctattagaatggctagtatacaaaaaaccaacaataccaattgctatgagaatttagaagaataagaacccacatgcgtttctggtgggaaggcaaaatagtacagctactttaaaagatgtttggaagtttcttaaaaagttaaatattattttactgtatgaaccagcaagcatactcctagatgtttacccaactgattgaaaactacgtccacaaaatacctgcatgcaaatgtgtgtagcaacgttattcataaccaccaatatctggaaaaccaggatgtctttcagtaggtgaatagattaataaactgtagtacatgcatataaaggaatactattcagagatataaataaatgaactatcaggctatgtaaaaacatagataaaacttaaatggatattgtttactgaaaaaagcttatccatttatattatgttctagaaaaggtagaattatcgagatggtaaacggatcagtggtttccaggggcctgtagagatggaagagtagagtaggcaaagcacaagagatttttttttagaatggtaaaattattgtgtatgatactgtggtggtgaatacataacactgcatttttcaaaacccatggaattttacatcacaaagagtgaaccttaacatatgcaaattaaaaaaataattaaagatgttgggggattccaagatgggatgctgagtatgacagaagactaactgtattacaaatgtataaaataattccactgaaggggtgggaggaaagcgtgctgaccaagtggcattggaagtgagtggagactgtaagactaaaaacataaggaactgtccacaaccctgtattctagtagataaagctctttcccaaaaggatataaattctgaagccactagtcacacactctgaaatgtgaagtcactggatggaggatggtgggagccaggtttatctttgttggaggggaggctaccaacaagcaagcaggaaaggttgcagtgattcatatggcagtggttagtgttggggacatcaacgtggaatcgagttcagctcaaaatagatgcagacggatatgtacaatacacttacagatatgggttggtatatatttccttgttctgtctcctgacagggcctgaataagtgtcatcccagtagcaatgagcacacctactgtttacgtcttagtttttgatgctgttcttttttttttctttgtaacatttaataagctcaatctacatccagaataatttacatgaaaggacaatatttatttaaacagagctcagtggggtagccatggtatcatcagagtgcatccagaggaaaagagggaggaagggccgaagaagacacaatcaacggcactcccacacttttactgtttgagccacgctgccagtgaccacatagggtgctgtcttgtggaaatccaatgaggtaacaaagtgttcatacgcattgagggtcttcatgcattgcctgttcttgtaatcccatacgtgtagggtcttgtcatcagcacaactcaaaataaatttccccccagaactgaacagaacttcacgtacccagttaccatgacccacgagggtcatgaggcacatgccggtactgacatcccacatcttaatagtcttgtccctggatccagacagcaagaatggcccagatttaccactattttttagtctcagagcctgttgcttcagagatggaggaatatgagctttctggagcccaggaaatgcattctaccacatgctcatgttctcggagctcacccttgcattgcattgttgctacaacccatacacgcacagtctggtcattggaacagctggctatcagagtgccatcttgatttggttgtacaatatgtacccattctctctgtcctgtgaacatcttcacacagtagccagtttgcacttcccacatttttatagttttatcccttgaggcggacactatatgatctccactggccatgatgactactgaggaaacattatggtcatggggaaccatgactatgcatggttctgatgcattcaaagtcctgaaaatcccatggtttaatggtcatagctgcagaacaggaagccagaaacttgccactgtggtcaaatgaaatgtcctgtacagagtctctatgtccttcctttaagagttctttcaaaatctccagtctcataatcccacaccttaactgtagcatcctctgaagcagagaccataacactgaacacaggatggaaaatgactcgaatgattggactcctgtgaccactcaatgtgtattttttctggcagaaaatacccattcttttgggtcttgtttctgaccaagaggtccacctgacgtaaattcttcttttgcttcatttagcgttgattctaattccataaacttcttttgtaatctaataacagatgtccattttttccccaaaacaccagcctactttatttcttcattcatatctaattcagcttcctttttaaaaactgaatatgcctcttcgtagccatttgaacgaagataatctgctttagcttgatttagttcatctcgttgtctctgggacagcaccatcttggctgtaatgtcaagcttatctcatatagtggtatgtccctcctttgggaaatgaaaaagctttttgatccgtggacgtataatataaatatgacactaagtgtcttccactcagcggaaaatgattcttttacaaatgaatccaactagtaaccagaagatattcaacaagtaagattcattctactctcccggccgctggattctgccactgccccgccgctccagctctgtctgtcacaggagctgccccaacaccctgacgtcactgtgccaccaccgccactgcccccaccaccgcccccactgttcttaataccatttaataaaaggaagtaagccttcctggagaaatggctgattctaggacaggcggggaatgtacaaaatgagcctggaggagcattttacagggccagaaagtaagaacgtgttcagaagaacaaacaataacacacaggtcaaggagacacagtgaccacttgaaaaagctttcaatggcctaagctggaacaatttgagcaataaagtagtattggattataaataacccaagtataaaataaatatgcatgattccatactgatttacatttatatatttagttaatcacatacatatgaataagtaaatggcagagaataggcacatctccagagtggtggaatttcaggtaatttatgtaatagtgcacccccaaggaggtggagcataattctcccctccttaaatatgggctgcacacagtgacttcctttcaaagtgtacagtgtggaaagggggcaggggagaaacttcacagtggagacgtccaacaaacactgcctcagccagatgatcatggtcaacatcacgagtgacgtcatgttgataggatgtgctcctgatagaatgtgatgaaagtagcactttacttctgtggtcttctcccaataatcataggagaaaacaccaggcaaatcccaatgttgggacattctacgaaatacctgactagtgttcctcaaaactgtcaaggtcatcaaaaacaaggaaagtctaagaaattgtcacagccaagagaagcctaaggagatgggacaactcagtgtaacatggtgttctatggtggaaggacagctgggtcaactaaggatatctgaatgaagggtgactttagttaatatgcatcaacattggccattaattgtgacaaaggtacctcattaatgtaagatagtaacaatgagagaaactgggtgtgatatctagggaaactctctggactattctcaacttttctggaaatttaaaactattctaaaataaaaagtttatttttttaaaaaggaaggcaatcccctttctctctcctccctctttctcctttccctctctttcctcatttctcccttttccttcctcctcttcctcctgccccctcctcttttcctttaacaataacaataatgtgtagtccattctcacactgtgataaagaactacctgcaactgggtaatttatgaaggaaagaggtttaattgacttgcagttccacaggctttacaggatgcatggctgggaggtctcaggaaacttgcaatcatggcggaaggtgaaggggaagctaacacatcttcacgccggagagagagagagataagggggaagtgctacacactttcaaacagccagatctcgtgaactctatcaagagcacagcaaggcggaagtccacccccgtgattcacttacctcccactaggcccctcctccaacactgggaattgtaattcaacatgagatttgaggggggacacagagccaaaccacatcaaatggcatcacacatgtgaccagtacgttgtcgtttccagctctcttcccttgcattattctgcaggagcccttgccacagtgcagtgctggatgtggtattcttgaattcacagttgggccagggaggtgaaatgacccacctaggaggtagcagaggtgctagcagcactcccaagactcatagtgaattctcctgggcctgtccgtcaccctgttatgccacttttcatttccctctgatcacaaatgactcagcacacagtgtaagtgctacaattttactccagaatttgacttgtattgtcctacagactgcaggtaccctcttgttgctcctttcccttgaaaaaaaatacatcatctcaaaagaacgcaaccaggagctggcaatggcactggaatcccttcctggtcacagaattgatgctcatctgcccagtgcatggcacttttacaagaaatcttatttggtcaaccccccaaatatcacagaaggacattattattatctccagtctgcagttgagaatgctgaggctagaaagtggttaccactaaaagcaaaccttttctctctttcccattgcctatccaccctgactctgggctctgacccatacccacctgctcaaggtcccaggtaggagttgcccattcttttaagtatgagttcattcatacacatcaccatgtgaggcttgatgtgacctcagtaacaagcaggtctcatctgccctgtgcatgtgaatgtgccttaggaagcttatcaaatcccaaaggagaaattacatcctctaggaaaagtacagtgaggtgactgtcccgtttcctttactggctctggaccacagctgagttcccatgcacgcactgtggcacacgagagtgtgggcagaggcacttctgctgagtgggatgaaacatcttaagtgctctgagggttgaaactttgaagaggttgagatctgtgagagctgaagaacctttgaatctcccttcagctctccctaccccaaccacagcccttctcttgatgtaaaacatgtgttcagatagaaaacaaatgaggcttacttctatgccagtaggactgtttggctttaagcttccccagtggttgaaaacagcaatctccgagatttgcccaaaactttaaatggaagtcactcccatgggtcacatccatggatttgtgagatagggcaggaggctgtgtctctgctacccagcggtgggagcaggggtctgtgcagcctgattgtattggggatgggcccctcgtccagttgcctatgaggataacctgcggagaagatcagatggagatacctggacttatgcagaggcgtgttcgggttaaatagaaatgcccagggtccaatagagggaaccttccaacaagtgtatgagttggcctctcacccgacgctggccacccagatgacagcttcttggacatgatgaatggcctcacttccaccagaacatcttcctgccaggccctgctgctgcttccccagctgtgtggccttggatgagtaacatggcctcttattaaagaaatggatgaaatactttctaaagaatcttccaactctgaagatctgtgacatcttgtcactgaattaataggaaatcagctccttatagatttggtctatgttaggagacaacctctgttgatgggctgaccgaatgtctgaagtgggaaggatttggggaccaaaacaggtaacaagagtagacgaacacaagaaattcaggttgaattaaccttcaacagatatttattgagtaacttctacatgtaagtcaccaaaatctgggaaggggaaatggataaaagtacgattctctctctggaaagcctatagtctaattaattgatgtattaagtaatgctgggtggaggaacaataacccaggacttgtataaacaataggaaactctgggggaagagcaaggctagaagagacattatctgggaggcaattctagagcaggtagatttcaggaacaggacaatcaaagaaaaggagagtggcattcacacatcaagtctaataatatggccttattttatggtccacctgagtactgcagaatttagccctaggtactaccaggtccaaagctgcttctttaagctacactttaagctcctgtcactagaaggggctgtcagggtgccagggattttggtaggttccgtgcggacttccctagtcctagaggacgttggagtcactggggtgtgaggacattggagagacaggaatagagttccacgctgcgatgaggagatggagcctgatgcaaagccacagggaggctggcgttgttggggtgggaggaattcccacccagtgggagagttttacattgaggactacatacctggtcagggtataaggcaaagtgggctcccactcctgacatgttcctctttaccgatgttccttgtgaacttattccccacctaggacagctaacactttaagctcttgactgtcatttatactttattcatgtgaatgagtttttagttttctcttgaaagcaagttgggatactaggaaagttgacaagagtttgagtttctatgttggttgggaaagagtgatgtctccacatgtaatttgtagagggtcccatcagtttccaaaagaggaagtgggtgtttgtcttgcttttgagacattttgggagacttagacacaatataatttctattgagaacaaagtagggttaggatttggagaaggaagacagatatttccttctctctgctaaagagatggtctggagtagaaaacttgtggactgtgtttacaattgtggagtactactcttggttaaaacaataaagcagaatcgatgtctgtagaacagagctggaaggggcctcatggttggttttcaaggtaaactaaccacagacatcagttttccactcctctgcctttttagcatctgggttcatcttccaggaaggccataacaaaactccacaatctgaggatcttaacaactgaaattgattgcctggaagttctggaggatgaaagttcaaggtcagcttgggcagcgtaggtttcttccgggtgccatgagggagaatcattcgtgcttctggtgtttgctggcagccgctggtgttccttggctggcagaagcaccaccccaacctgtctctgcatcttcacagggcattctccctgtccgtgtgtgtgtctgaatttcccccttttataaggacaccagtcatgttggattaggggcccaccctactctagtataatctcatcttaactaattataccggcaatggtactagttccagataaggtcacatcctgaggaactgaaggttcagacttaaacacatgaatgtgggggaggagacgcaactcagcccataaccacattctttctacacagggagttcaagttagagagcccatcaaatcatgcagggaaaggagatgaaatcctctgggtccgtcactgtttgaggcagccctagacacatgctgagctattgtccccactttgccaatgcagactaagcttgtgtccatggaaaagcccagtgtgaactaagatcactggatgcccaccttggtgctgggggccggggcccacacagaagtcccaggcccaacctgaggggagcaggctataccaggccgaggatggcccccttgatttgggtgcacactcaaatgtacaaactactgcctgcaccacagagactggcccggaggtgttatcttcccagagggctgggcaaagggctatctttgaaccagctgttcccactcaggcaagagtggctttgctgggcctccacttcctccactgtaaaacgagggtgatgctctgccctgcccgacccatctagggtcaggtgaagatcaaatgggataataagatagaatgtcttttgaaagacccacacacgaaggtggcatgagggattgtctttatgactatcatgttctatgcagccctgactgttacgtgctagctggctgtctcatctcctcgaggtgtcctgcgtgcctgctgatggggatgattccaatgactaaaaggtacctggccttctccatgcccagctttacatccagtagaggctcaggccaccctcgatggcagcctgcccgctgcgggcctgcttgtctgctcaaagcagaggttgacttgcgcccaggttgcattccagaagtcctggcctgctttctccacatggttagcttcgagcagtgagcttgggagcagcctttctgcgagttctgccaggtgagccagcccgcaggagtagggggtatcccaggcacgcacctgtggctcaggtttctcccttgtggcccgctctctccccactgctgttttccagagcacctccatcctgcaagattgacagctcactcttggtagggaacagagtgtaggaagtgatcgtttcaaacttctcttgcagctccatctgccaaaagcccctctaccagttgccgtatttaccctggctgccaggcctctctcagctgccctaagaaaacagattaccgtccagagcaaagtcctcgtgtgtttcctttctggagatgaatcaagttctgaaagaaaggtttcctgtagcccattacaccatttcagtttgttttatctgtctccacctgcagagcagggaattaacctgctgcccagggccgggccagcgaatgcttggaaggaaagcaaagcgcacgggtgtgcattttttgacaacagaccatggccttgttctcctcagcagagcattgtccccatgaggcccaggcccaaatctgaataggactttgtgtaactcgatctgttttccttcttggctatagtctctgtgccaaatttaactgtggtctgtatatatagtgttgtgggagggtgggggtagaccagggaaggttgggggaggggagtatatccatgcagtttttttcctgtcttcctttttttgtgcttgcctgctttgctcactgtttgctatatataactcaacatgactgtcctcgcatctccagtcattaaccctttagggataactaatgcacctctttatgtaggcccctggctgggaagcgctggcactgttggagttaacgactggcccctggaaagtgaacttccccagaagtgcttgtgaagcaattaacagggccccactcagatagtaaaaatatcccctggcttacaaacaagcagagaagcgcctccaagccaagagtcaccgctgtgccccaggcatgtagtgggcgctccctctttgaaagtcttgtatcttagactttgcagaaatgctacgaaagctggtgatgcagcaacgatttcaggggagactgaaatctattgtccaactgaaagcctgtcagggctgggcctctctcaggaggtgaaccatcccaagggtcatggaaagagctactcattgtgggcctggggtgacagtgacccatcctgggtgaacagaagcctcacttcactttgccggagggagacagtaggctgacaaactattgtggaatctcctaaaattggttgctaaagggagcttctcaccagggccagcttgcctgggctcttctttcaaagggtggagtgttgtctgccagtccccaggctcaggggatgcaagtgaaagggcttcgggctttactgttcatttcctcagaatcatagaagtgccgaaaattacaaaactgcggtctccctgcaagggactcaagatgtcttgggtcatcttaggctatatttagaatggaaaatgtgttggctctgaggaaacagggtatgtgtccttctccaagcaggatgctatgaaccttgccccataggccctcctacccatcctcacagagccctgaaactcctcctccaggaacccttccagccagtgggaagaccccacagataggacccagtttcccctgtgaatcaacttctctagcacgtcccactgcccagggctgggaaggtccagtgtgcccagtgtggcactgttttccagggctggatgcatgtttggtcctccagtgggaactctgctatcgtccctgcttcaccaggagtgatgatggggacaggcacggcagagagtggacacagggatcctggccttagggggcagtcactcatccagctcacacttgtacatacgtcaccatggacacagaggttttcagtatgttaacgatttgcacagtccacatcagcatcccgttaactttctttttgtaaccctcagcatggttttaagaacctggaagtttattgcgtaactgttttgcttgtgaagttgcacatgatttctcagaaagatcaactcaaacccaccttgtcacccctctccacccaggccccacttcctgctttgctggggctggggggtcagaagtaacatagctagagacagatgtccatcatctgtgcttgtgatgacaaaaggaggtaacaggagtacagtcagaccctcactccttggagccctgttgtgagccgctcatggcatgcaccattctctgtcctcacaacagctcagacgggtaggaattattggattctttctctaaacgggaaaccaggggttttaggtgccttatccatggaccctgccctcacctccctcacccagtgcccccctgtgccttgctggctctatctgtgaaatttatccatggaccctgccctcaccttcctcacccagtgcctccctgtgccttgctggctctatctgtgaaatgtctcaagagtccatcctgttgtctcccatcccatgtctcccacttggcccacagtccagactcttacctgtccagactcctactccagagagagccggcaagatctttgggaaaggcacattgagccatgtccttctcccccttggaactcaacagtggcttcctgtcactctgagaacagaatgcagcctcctccctgtgcatgacaagcacctccctgaggtcacagctgtgtctccctgactctgcactggtccagtccagcctcaaggccttaaatttgccactccagacccctggtttggaccctggactctgaatacattctggtcttttcctcagggaggtcgaggcactgtcctagcttgtgacctgctcccatacctattttctcagggtggaagcagacgctccaactcccacactgtgaggctggtaccattacctccaagacccaaagcctgtaggaagtatagcaggcctcacccaataccctgcagttccctcacttgctccaagtgggaggtgggtcttcacgggtccccaagatgagggtcagtggctttcctctttcacaggctacagtgggagcgagtcttccaccatgggacctctggccagatctcagggctctgtggttgggggaaaatggctctctttcatggggctttaagacatgaactgacatgacatgtcctagagactatccagagagcatgtggatcactttttgctgctttagatcaccttctttaaaatcaatgcattgacatactttcagcacttaaattttcgtattctattatcgcatcatctcagaagaaaagtctttcataattaatgaatctcaggttgggttaaatattcagtggctgcccacacaccacttactctattgcttcaaaataattggctttcacttatcaggtctactagaatgactgtcttaaaccagtcacgtggtggaagcgtcaccatgtttcttgctcagaaaataccctttcaagggcttttctaggggagccggaacagtagccaattctagtgggacctttaagaaacaactttgcccaggatgatatttgagccccctaaagggccaataggggtccctctattcaactttccctccgagtcccaccaacctccccactttggttccatacagcttggattattgccctactagttcaaaactgaaagtttcaaataaaaaccaaaagacaaatgttaagtcacattgaattgataactgagacaatctgtcaagcatattttgctttcctgatttttcaaaaaaaccctaatgttgcaccttccttgttgtcagtttagtacgttaacatttttttaattaaacttcagtatcattgaacaggtcatagagtgtgagcaatattgtctttgttccaaaactccaaatgtaatgaagctgccattcacaattgttttccgctgggctgcttattttaaaaaaatgattttgatgaataaaaataggtgcattttcacagcgtggggtccagcaagaatgaaaaccttacggatcacagcccggcccctgggggtgcgggaggaggtgttgtcagatgtcaattttggctgattgtttttgaggtcatgagactgccattcctgtgtcctgtggtgcattttagagactgatgtcacttttttgagataaattattagagaaatgtttatagatgaatatacatttcacagtgtgccagagttgaggagtctaatgaagtttagaagggacactgggatgagggtgctgagctgcggtgcctgtggcctgtgacagacacctcctgcaccaggaggcaaggatcctgatggtcagatgctcagtccccaacaagagggggttcaaagccagtgcagccccttcctcccaccgctgggggcagcaaaggacccacagtggagattgcaaactatagcaggggctgtgctttgtgtttgttttcaatatttgagccatcatacaaaaatctagtgatttctcattctctatacaaaaaccagaagatctgggccacaaggtctgcattttccccagtatcagtctgctatggccccatattagctgcctagggcccctcactcctgctcctgctagaccctgtggatatttgagtcatgaccttgcctcaaggcttattcatgtattatttgtttatttattgttaacataggaagggtcttgctctgttgcccaggctggagtgcagtggcacaatcataactcactgcagccttgaactcctgggctcaagtgatgctcctgttaaggcatatttagatgggaggaaacatctttcttcctttagagcatctaattattggcatggccctggacaaattatcctagagcctggagcctcaatttgctcatctctgtaaggggggtgacaatgcaacctcatagggtggttgtgagtactacatagaaaaagactccagaaggagcacagggcctccattgggagcccctcagccaacactccctccttgctgcctgcacagcctcaagagaacatggagtcctttgggatgctgaaaactgtaaggaagacaactgtgcattctctgtgtaagcagtgtgcacactgtcttcctcctaaatggctagttggaggagtgaagacagactcactcagaaatgggtgattccctggctgcagtctcctctctgataacaaaggactgggcccagattagagacgaggcaggaattatgtgctgcagaaaggcggtggggacatcttgagtttgtttgtagctaatctcaaataattcaggtcttttccatttgcagcaaatctgattccctcaacacatctgtggtaaaatgttatgagtgcatgcggagaccaagtgtggaggggatttttttttccaccaccaaatccatagttaccctccaagttgtaatcttatcatatttaactggttccacataaacagatctatgtatattttcagtagtttcagctgaaacctgttaagaacagatgtgccaatggttccctggcactgatccatttaaatatattttttccacgaacaggtttttctctctccctttccttagaggggagaaaaaatatgaaagtggaaccaccattaaagtggatattacatgcttctgtgttctctgcaaccagtgtttgccattggttttccaacagcaatttggcacatgaggctatgaacacagagtgtgcatttgatggacagtatttgctctgagactgtgtggctgggagaatgggctgagagctctgtagttgctacctaagctagggtcagccagggttagtttttccctgctgctgctgctaagcagcccctgggcaaaggcttcagcaggccgtctgcctctttgagcctttagtttttcagttgcaaacaaaaaaaaaaaggtccagggagtgggaagataaagaactcctataactcagcaacaacaacctgattagaaaatgggcaaaggacttagatagatatttctacaaagatgatatatattaataaatggccaaaaagcatgtgaaaagatgactggcatcactaatgattagagaaaagcaaataaaaactaaaatgagacatcacccccacaccattagaatggctaatagcaataaaacggaaaatatcaagtgttggcaaggttgtggggaaattggaacccttctgcacttttggtgggaatatgaaatgctacagccactgtggaaaacaggatggcagttcttcaaaaaatcacaaatagaacaaccatatgacccagaagttccacttctaggtgtgtattaaaaaaaattgaaagcaagatctcaaataaatatttgcacatccttattccaatatagcagcattgtttgccatatccaaaaggtagaaacaacccgagtgtttacagatggatgaataaacaaaatgtggtctatacatacagtggaatattattcagccttaaaaggaaaagaaacagtgctatatgctacagtatggaagaacctggaaggctttatgctaagcgactgaagccagacaaaaaaggacaaatacactatagttccacttatatgaggtacctagagtagtccactgcatagagatggaaagcagaatggtgcgctaggcacggtggctcacgcctataatcctagccctttgggaggccgaggcaggcagatcacttgaggtcaagagttcgagaccagcctggccaacatagtgaaacccctctctactaaaaatacaaaaattagccaggtgtggtggtgtgcacctataatcccagctactcgggaggctgaggtataagaatcggttgaacccaggaggcagaagtggtggtgagctgagatcgcaccactgcactccagcctgggtgatagagactctgtctcaaaaaagaatggtggcttccaggactggggaatggagagttgtttaatgcctaagaatttcagttttgggggatgaaatgagttttggagattggtcacataacaatgtgaatgtacataacactactgaactgtacacttaaaatggttaagattgttgaaaagaagaaaataggggagagggtctaatttgtgacaccaacctcatcgatgggggaaggattcaaaagagaggtgcacattcagccagacactgagcctgttgcccgtggggattatgcctaagaggaatgagataggaggggttatgttttctcagctttgaatttctttctcaagaacactcctctgtccaccttcccattgcccacacgacagagttcaccaggcctcctagctctctaccagcctatagccatctgcaggaatgtcctcactgggccctttgggccatgccctgtgtctgtgactctggggcctagcactctgacccactggcctgtgttcctctctggttggaagacagtgcaaaagggacctattccaccttcagtggcctccgagtaacccacctgctccagtctgcagatttccatctcactgactttgccctggcactgggaggggggacgtgagggctgcaggtaggagtttgatggcagatgagcctcaggggttcaatgtcagctgggagaagcaaggccacttccagactcagttctgccactgtctggcagtgaggctctgggcaaaccattttgttttgtctctggtaaaagaaggctgtgggcaggattgggctttgtaattgccaaagattccagatctttgaggggctctgtcttcctaaattctgtgcagcctgctagcctctgcaggacagtatcagggaaacttaacatgcctgtgtttcgtagtgaacaggatatctagggttgagaattactgcgaacactgttatgttgtcacgtgagctggggctccatggtgatgcaccctgggctcccagaacaatgtgaagcactgagatgccctgcacctgggcctgggtcagaatcctggtagaggggtctttggcaaggacaggagaggacctccttgggattggactcagctgagcagcaggatgcctggttggcttgggaggtgagattagcttcctgggggcaaaaaggagccatatttgtcttaatgaggagaaaagagcaaaatcaaagcattcaaagaggataaaagaacacttcaaagaggataaaagaacatgttcagttcacaattactgcctccctaaccaggcaagtgtatgatggagaatcctgttatcctaattcaagaggacaatgccaaaggcttctcttgctggctgagaattgttggggagctccctgcccacggagggcctgtttgccagatccccagccccctgcagacctctgatctgtgaggagctggttctagtgattcacacttgcttgtgaaaaccttgatcttcatcaagcttttaaaaaaatctcatccgtattttttcccaattattttcctgcctgctcttttttttttcaaaagtaaacactcaaaagccttcatttctataactaattctggagtttacagaagcaaaaatcaataggctcaaaactccattcctttattcacttggctcagactggcttggggcagcacctctgagcccaagccagaaattgccaaaagggggttcctgtcggaatcttggagctcatcccccaaacttgagattactgagcaagtgagcaagatgtctctgtctggtccaggaagatgtcagccccacactgcccctcccagataaagagatcaacacgggacaggtcagtctctcccattctgtctccacctttgccagtctgcttctagatccccttcatgtactcatgttgctgccctccattcactagattttcaggatctatttatatccatccaccacatccaccactctgttttccaaatattatcacaatcagcgcagtagtgcttccccccgaaagactggcagctctctgacctttcttttcagctacaaatgaaaggggacttaaaagctgtgtgtgcatgtgtgtgcacacgcctgactaatggacacactcctcatgaaaaacaggataaattacagagaatggcaaagtaatgattacagaaaggtatatgaggcagaacccattagtgagctgcattttgttcaaaaccgagatactggcaggcagaataacatgcctttgtaccagaacgcattcagctgtagcaatgactaataaagtagcgaggatctgtgcacattttcccccttttgtgcctattttcataagttaataactcaagcatgaaaattgttttaaggctgaagactggtggtaagatctggtcaaactgtgtgggaaacaacttttgttgttgttgttacttaatttagtttggctgtttttaagttagaggagtggaaatgtcaatgtcaatgtgagtcttgcaatgtgtttttgttaagcccaagagcatttgggattgcatcatacaaagcacatttttaatgactagagatcatagtttctcttcctacaggtgtatgttcctatttggtacaggttgggattgttggggagggaggaggagatggaagcaaaatcttataaatgacatcatcctgggcttacccttcttcagctagaaaattcctattccaccagcaaatcagcctggtgagcaaacagctgccttagacaaatggggttgagtgtaggggtgaaacctgctgcaggattttagtaaattctcagagcaatggaaggaacagaaatatcatgaataattgtcatacctctcattcctacaggactcaggttttgtgagcattttcctgtccatagaaccagagaaagtctaagttaagggtaccagattttgcataactcctctttcttcttgccttttattttctttttattggatgagaagactttgaaagacacagaaaaacacagagaataacataaatacctgtgtagccacattctaggagtaacaactgtaatattttataatgcttactgcaatttattttttaaaaataaaataactgaagcattactgataaagatgtatcatctcctttatctcacagacaagcaaagtggatcagcaaaggctgcagtcaccagcatcttttccaaccttaatgaactgtatcctcaaaagaacactatcagactggtaagacaagcattattgtcccacttcacagatgaagagcttgggggccctgtggatgtgtaggagagtcggccttcctttttataggccttttgctgagctcagaggacagagcagaagacaaagccgaaagcagccctaagcagacactatcccagcccaaggagctatgcagacagctcctgcctagaggagaaacaattctctccttcagccaggcatgtggcacagaggtgaacaggaaatgcttagggagacagttcacagatatatatgtacttcacagggcacaatttaatccataaatcaatcatggatcactgctaaagaaaacaaaatatgctgccactaatttgccaccaccctgtgagcatgattggatgatgtttattttgattaggagattgctccatttataaatcttcaatacatcctgtccccctaaaacggcatctggatcttttgagggttaaaaaaaaaaaaagtgaaattggatgagggatgagagctggacttctgtgtgtcccggggtctctggatccacagcctggtgcctagcatcagttaagcccacgctggggtcgcatcacatcccgcaaagccacgtgctctgtgaggccaacaggagccccgccgggtggaccagctggaatctcagagagcgccgactctgaaaatacccggctctgcagaagcacgctgggcccagggggcttctagactgacagctccatttatcaactacctattggttttaaaaattggagtgtcttttccgcgttgactgattttggctctaagagatgtcgctggtcatttcagagtgactgaacctcccctctaacagatcccgggaattgttttcaggaaaggtaaaaggcagccttttctgtcacaacacaacgctgagccggcagcctggctctgtcaggatctggggctccagcgcccgagaagcccagcctcgccggcggccaagttcaccgcgaggccacgcgctgcctgcgctgcgctcccggacccgcaccgaccgcagcgcgcgccgccggtgcttctcccaccccagcctggaagctgcctccctccgcctatccctgcaggataagaagcccgaggaggcggagcatggaactcgacagttaaaacatttaagagagaaaacctagtgtcttgctggcctgaaatcgagtacgcagcccggggtgatcagggtctcccggcccggatgtgtgagacttgcttcccctgggcaataggcgatacgatgctttaggaggaaggtatctctccctcctaagccccggaggggagaacttccaaagacagaaaaccacagggttcctggcacagagctttccctttatcagctaaagcagaatcttttctggccttaacctggccccttcctctaactgtaggcagagaggcagacagaaaagcacttgctgaaacacaaagttttgttctgtcctcaacgaactgtctagagttgattgctgatagtcgtggtgcattatgccttcctggttttcatttaattgggcaccacgctgcctttcaagacgccttaaaggaaccaacaaccaaatccaagagagctggacagaccattgaacacacagtaggctgtgtctcgtggctttcgttgtctggtgcctcaaagaaaacaccagaaagattgtttctaagctagagccaccccagattgcttaaagtgcaaagctcactgctgttgggggtacccttgtgagacactggaaagctggttttaccgtggccctatgaagaggaagactgaaatttagacagtaatacctttactaggattggaaaagatttggttaatgacagccctgttatttctaaaacccattatcactgtatgagagattcctttgcgctgcatcctcgacagtgcttcctaaggtccgtcttttctattgtattcattttaatgggtgcatagccgtatctcgttgtgattttaatgtgcatctccctagtgactaataatgatgggacgcttttcatatacttgtttgtcattcataactcttccttggtgaaatgtctgtttagatattttgtccattttttttatttggattgtttgatttcttattattgagttttgggagttctttatgtattgtggatacaagttccttattaggtgtatgatttgcaaatattttcttcaagcctgtagcttgttctttcattttcttaacaatgtcttttgtttttaatttcaaagaaatccaatttgtcaatattttcttttacagattatgcttttgatgtaagaaatctttgcctaacctaagtcacaacaatattctcctagaagctgtagaaatttcaatctgtaatgatcaattttgaactcgtttttatatttatttatttatttattctttgagatggagtctcactctgtcgcccaggctggagtgcaatggcactatcttggctcactgcaacttccacttcccaggttcaagcgattctcctgtctcagcttcctgagtagctgggattacaggtgtgtgccatcacgcccggctaattttttgtattttagtagagacagagttccaccatgttgcccaggctggtttcgaattcctgagctcaggccatccacccgcctcggcctcccaaggtgctaggattgcaggcgtgagccaccatgcccgacccagaacttatttttaaatatggtgtgaggcatggagcaaagtttacttttttacatgtgtttacccaattgttccctcaacatttgttgaaaagacatttctccactgcattgttttatgtctttgtcgaaaatcagtgtatttttggactcttgattctaacgttccattgatgtttgtcttgatttatttttttggccttgaaacaacaatttattttcatctctcatgatattggaggttggccaggttcagctgggcaattcttacttgggttctctcatgcatttgcagttggatgatggctggagcagcaatctggaggctcaaggaggctgaaggccacatatgactccttcatttccatatctagcacctcagtggagtaggctggaacagctggggaatgattgagcttctaattctctccctacctcctatctatgtgtctagttttcacttcttcacagtacggcattctcaggaaagtcagacttcttagtagtggcttaccctagaatgacttttccaaaagcacatgtttcaagagacccaggcagaagctgcaaagtttcctgtgacctagcttacacatcctatagtttcttttgccatattctgtaaggaaagcaagttgctatggccagaccaggttgaaggagaagggtatgagactctacctctcgatttcaggagcattattacggagagggaaggattgttggttgcttctgtataagcaatgccaataatagaaggctccactgtcctgattaatgtagctttataacaagtctcaaaatcaagcaatgttagtccttcaactttgttcttcctttacaaagttgttttgactgtgctaggtcccttccatttacattcgaattttagaatcagtttgtcaatttctaccaaaaagaaagcccttatgaaattttgatcaagattgcattgaatttatggatcaatttaatgagaacttacaattcaaattattttaagatcaatttggtgaaaatttacaccttaaaaatattgagtcttttgacctatgaacctacttaggttttctttaatttattttagcaattacattataattctcaatgtatagatctttctatcttttatcacatttgccctattttatacgttttgacccattataaatggtatttttaaaatttcaatttccggttgttctttgcaagtatatagaaacataattgatttctgtacattagccttatattctatatttttgctaaagtcacatttttagttctagtagtctttttttcataggattttctgcatacacactcatgtcatctacaaataaagatggcttttcttctttatttccaatctcaatctcttttgtttccatttcttgctgttgcactggatagcaccttcagtacaatgttgaatttgtgagagtttctgatcttaagaggaaaacactcagtctttcaccattaagaatgatgttacctataggcttttcatagatgttcccttagcaggttgaagaagtttccatctattcttagtttgctagactttttatcaggaacgtttgctgagttttatcaaatttttttctgcatctattgagacatgcaatcttctagtgccatcattttacaagctcaagtgaagtgtagggcacttacctttctttacgtcctactatcctctctgtttataatataattgcttaaatattttctctgcatatatttaggatcacattagatagttataatttttacttcaactgtcaacataatttagaaaagtccagtgaagaaggaaagtctattatacataccaatatttttgcttactattatgttaatatgttctttcttccttactgatgctccaatattccttcctttactgtttgctttttgtttagaaaacttttttttagctgttcatttatagtatgtctgctggtgacagatacttttagttttccctctcctgagaatgcctttatttccattttattcctgaaggacctgtgattggggtggggctgtggtattttaagtggtgtttggctagagtggagcggttattgcccaaagcttttctgtcttgctgggctgccactgtccagctccttaggctggagagagcaggcttttgttggggccttcttggtctcatttggaatttctgagttcagtttcttcaactatatatctgggatatacaagacagaaagaaaccagggcactctccaccatgttgttcctccagtctcaagatctctagacagtctgtcttctctccatctttcagagtcttcttgtgcatgttttttatataacatctacactttttagtggcgcttagcagaagcaatgggacaagtatgtctactgcagctttctggaagagaagctcctcatttctttttttggatacatttcaaaagaagttgcaaatatatgaccctacacatttcagtatgcatatcattaactacagctcaacattagtttatatttttctttttcttgtgtgagatgaaaactatacatacattgccatcaggctttgcccaggcatcagaactcactagacagcagaatatacatctttgagaggaaccacagaaatgtaatgtgcatgctaaggcttttacctgaacatcaaaatggaaacatcagagtattcatattagagagcaaccttacaattataatggatgtggtaaggctttttaaaaaatcaatgttcaaagacatagaatcaaccaaaatggccatcagtgatagactggataaagaaaacgtggtacatatacaccatgggatactatgcagccgtagaaaggaacgagatcatgtccgttgcagggacatggatggagctggaagccattatcctcagaaaactaacccaggaacagaaaagcaaacaccacatgttctcactcataagtgggagctgaacactgagaacacatggaaccagggagaggaacaacacacactgaggcctgccactgcaggtgggggttcaggggagggagagcatcaggaaaatagctaatgcatgtcaggcttaataagtaggtgattggctgataggtgcagcaaactgccatggcacacgtttacctatgtaacaaacctacaaatactacacatgtaccccagaactaaaagtaaaataaaagaaaacaaatttcaaaaaataaaaagaaaattctaggtacattgaaatatgcaattcttacgtgcaccatttgatgagtaccacccacccctctgtcaagatacagaactcatccatcaccccacaagttccttcttcctccttcacagtctaatcccttccccagccacctcgcggggacaaacattgttttgttttgtttttttacacctcctagattagtttcatcttttctagaatgcagtatgaatagaagggatatcatgcactcttttctgtctggcttctttgtttcagcctaatgtttttcatatttagcaagttttataagtcatttgtttctgttgctgagtagtattccgttgtgtgcatataccacagcttgttgatccattcttctattgatggatatctgagctgtttccaggttttggctagtatgaataaagccaaagagagccattttaatttggggcatttaaaaaatggtgtgaataaactttcatctgaacacagggttccgtggtaataatgtttgaaaatatcacctccagctctgacgtgccgagtttgtaattttcgtaaatgatataaaaagtcatttcttcatccattcatttgttcactcaacccttatttagtgggcctattccctgtgccaggaatcattcaaggctcagtggggaagagaacaaatgtaagtaagtcggcctggtgcagttgacatgctagtgagggaaaagacaaaaacatcagttagtgaatacctgttatgacggaaaagaagccaggtaagtgggtagggcattacagttggtccagaggtagtcagggtgtcattttagctctggaagtagggagaggaacttagggagatggtcaggggagggacttatatgatttggatctgtgtccccactcaaatctcacaccaaattataatccccaatgctggaggtggggcctggtgggaggtgattggatcatgggggcagtttcttatgctttaacaacatcccccttggtgttgtcacagtgacagtaagttatcacaagatctggttgtttaaaagtgtgtagcatgtccctctgtctctcttcctcctgctctggtcatgtgaagatgcctgctctggctttgcattctgccatgagaaaaagtttcctgaggactccccagccatgcttcctgtacagcctgtaaaactgtgagccaattaaacctattttctttataaattacccagtctcaggcatttccttatagcaatgtgagaataaactaatacagaaaattggtaccaagagtggggtattaccataatgatactgaaaatgtggaagcagctttagaactgggtaatgggcagaggttggaggagtttggaggactcagaagaagaagggaagatgaaggaaaatttggaactttctagagacttgttaaattgttatgaccaaaatgctggtagtgatatgaagagtaaagtctaggctgatgaagtctcagatggaaatgagggacttattggaaactggagcaaggtcacttttgttatgcattagcaagaggttggctgcattgtgcccctgctttagggatctgtggaactttgaacttgagagtcatgatttagggtatctggcagaagaaatttctaagcagcaaagcattcaagatgtagcctggctgtttctaataacctatgcttatttgcatgaacaaagaaatgatctgaaattggaacttacatttaaaagggaagcagagcatagaagtttggaaacttgcagcctggccatgtggtagaaaagaaaaacccattttcagggggaggaattcatgcaggttgcagaaatttacataactaaaaagaaggcaagtactaatagccaagacaatgggaaaaaggccctgaagtcatttcagagagcttcatggcagcccgtcccatcataggcccagaggcccaggagggaagaatagtttcaggggccagaaccagggtctctactcccctgcacagctttgggacactgtttcctgcatcccagctgctacagctccagctgtggccaagagagcccaaggtacagctctggatgctgttccagtgggtgcaagccataagccttgatgactttcatgaggtgttaagcctgtgggtgcacatagtttaaaagttgaggcttagaagcctccacctagatttcagagaatgtatggaaaaacctggatgtccaggcagaagcatgctacagggttggagccctcatggagatcctctactagagcagtgcagaggggaaatgtagggttggaccccccacacagagtcttctttagggcactacgtagtagtgctgtgagaagagggccaccattctccagaccccagaatggtagagccacaagcagcttgcaccctgtgcctggaagagccataggcactcaatgccagtccatgagagcagctgtgggggttgaaccttgcaaagtcacagtggccaagctgcccatggctttgggagcccaccccttgcaccagcatattctggatgtgggacatggagccaaaggataatattttggagctttaaggtttaatgactaccctgctgggttttggacttgcatggggcctgtagcctctttcttttggctgatttctcccttttggaaagggtatatttacccaatgcttataccgccattgtatcttggaagtaactaacttcttttttattttacaggctcataggtagaaaggacttgctttgtctcagatgagactttggactttaaacttttgagttaatgctgaaatgagttaaaagactttgagggactgttgggaaggcatgattgtattttgcaatgtgagaaggacatgagatttggggaggagccagggtcagaatgatatggtttggatatgtgtccccacccaaatcttatgttgaactgtaatccctagtgttggaggtgggacctggtgggaggtgattggatcatgggggtggtttcttatggcttaacaccagcccccttggtattgccatagtaagagtaagttatcacaagatctggttgtttaaaagtgtgtagcaccttccccctctctctcttcctcctgctctggctatgtgaagatacctgctctggctttgtcttctgtcatgagtaagtttcctgaggcctccctagccatgcttcttgtatagcctgtagaactgtgagccaattaaatctcttttctttacaaattactcagtctcaggcatttctttacagcaatgtgagagtggactaatacagggaccttttaagaggaagtcataggagagtttttggagaaggtaaggttggaagaaggtacaaagaaaaaagcttatgtctttaaatcatcttcattcctgataattcagcacactttagaggcaacttccaagtcagctgttgatggtagtgaagacccaaggcccagagagggagcaactggccctagagttgcatgatgagtcttcagtggcaaggccgagattagaggtctgtactcagcattcagctattggtggacagaactcgtcctttgcttcctaagtgcggcttcagtcctgtcatggccctgcacttccccgattccctgcccactccgtccccacttcttcaggtgcttccccatgggaactggtagaatagtgttagaaagccacatccatagtatggcctcttgaggatttctggtttgtgtgactttgagcaagtcctcccctgatgttggaggattcttacccctgaagttggggaaggagtgaaatcttgatggtaggacatccgctcacatgtcctttgagacttaccacgtttgtcaccatgtatttagcacagctgcctttcatctgcgaatacagcctgggagctctttatgttttatctaatttaattcttataacaatcccatggagttgttaggtagtaaagtgctctctctgtttttacagatggaaatctggagactgagtgaggttgagtaatttgcccgaggttggcaagaggctaaagtagaattctaaaccagatctgtttgattctgatgctcttgcttttagccacaatgttttagcatctgttcaattctgaacagacggacagaatttgcagaggtcagagggaggttctagaataaagctgttctctagtttacaggacagaaatggtggtagtgatatgcctgtgccagttctgggatgtgcagctgggagggaagccttctgtggaccaccatgtaggagggagagcatagcagggtatgatgggaggagcatgggttctggaattgaaaaatcctgtgttcaaatccacactctaccacaaatcccacgaatggaggacatttggacaaattgttgaagccctctaagcttccattttcatgtctgtaaaacgggataataatggtatctccctagagggttgctgggtaggtacaatgagatgatgcaaataaagtacttagacaataccaggctcacagtaaatgcctaataaatgctggctgttgtttttattcgctattgttttgaaaaatggcaggcactacagacatacaaagtgcagagagtggaaagacaacaatgtgttttagggccaggcagcccagagctgcccaggctggcaccctgcccagaagtgggagtgatctagcagaggccagggccttgcaggaggatttttgcagacacccaacttcctgcatcagtggggtcgagtgatctctggagtgccttccgacctggagaggtcatttcaagtctctgcaacggtagcgatggtagctccagcaagggagggagaaggggcttccactggctcttggacactccagctgtcatttttgggaatgtgcttatctgccccagagggaaatagatgattgagaaaggaggcaaccaggggacttaggctttaccagcagtgacctactagctccggtgtgtctgcctcagacagcaggccaaggctagtgtcacggcagtttagggggtcctgcacattcactgtgccaacgagcggtattttgcaaacttattataaacagattatatttcttatcctaatgtggctgttggctacctgcccatgaattttagcctccaggagaaaaacaattgcttgagctgagtgttctgtgcttttactttccatacattactcagggctccttccagttcccccaacccttaatctctctctttctctctctctctcgctttcattctctctctctctccatctttttccttcttttcagaaagtcctctttcatcttgggcataactagaaaatctgtaagctgtgctttctgccatgcattagccaacagggtcctttcctcccaagccagggaagaaagcacaaaaaccaatgtccaggctgggcctctcagggtccacagcatcacaggcaaaggaagtaactgtctccatgcctaccaacggatccacacacatctcgctgggcagcatctctgccccaggaagcagcgcgcttactacactgggcacccagatgtctggtcttgcgtggcaggcagccactttctcctggccttttcttgtcccaaaagtcagaggggcaggccagttccagaatgggattccaggcagaccaggagactaggagtgcatgtgaacaactgcaaggggatgcgtctgtctgcctggtgtccgtgtgttcatgtgcacacctgtgcacgcgctcccccagacttacacactcgtgaacacatgctcacacaagttcatgcacgggagtagctccaagcctctcactcagcactttgctattaatagctcacttttctaaaaaagtctgcttagccgtttgtaagaataaccaccactgcctgtgtgacagcccaggcccccgcagggaggacagggccggccctctgctaggactgcctgactgcctgcctcatgttagaatccagagggagggccaagaggggagatgaaaacccctcctgagtggccagggcagcctccagtgcctgtgcccagggacaaggcaactcactggtaatgtctgcgggcaattggccaggcccctgagagccaagatgccaccttcttcatggtgacagcagggagcatgctccatgaaaccagaatgagcctgttctccactctggggtcctgctgtaaaagccaagaagcagagagccaagctgagcccaccaagagcttggcacgaggctgtcacccacaacttctcgctgatccaaaagacaggctctgaggctggaaattcaagtgtggtggtgctgtgacacagcacacagccaccgtgcacttgtgtccctggcagccgcaatccgggcctgagagggcccagtgtctgtgggtgtttgtatttaattgcagtggggtgagaaaggccaatggttgggttttatttcaaacctgctttgaggagaagtaacattaggtggcccagagctgtgaaatgtgtcctggtcataaatgcctcaccatcaattaacacctccagaatacctaagagttgccagcaacttcccattcaaataacctcttaaaccttcctccacaccacactgcccattccctcgcaggcagacctgcatggtttgatgacgactggtcacactgctggccctatctgtataaaagtccagacagttgggctgtgaggggaaatgcctacctcagagtagcttaagaaagaaagatattggtttacttctgaaaagctcaagaccagctgagtttaatggcatcattaaactcattagacatggggctgggaagtggctgccagcagtttggtgcacagcctgtcctctcagcagcccaggtggcaggtgtcttgggagtggcaatgatgagaccagctgctcatcctgggctggtcattgtgactcagatgtggagtgggctggttagtggttctgggccacttgtccatctctggatctggcagctccatctacacagtgtcgggctaggcatgggagcattctgggccaggagaaaggggattggatcctggatggtgggaaccgcaggtgtccccctccacgtgcctgggtccaagactgctctgctctggaccttctacgccttcagaggtacaagttgcagtgctacccttgctgaacctacaaccctgttcaagtgacaacttctctgagtctcatacgaggatattgaaagaaccttctgcacagggctgttgtgaggattaaccgtaataatacaagaatatctggcacttgcattcagcaactcaccgcttacttgttcaaccaggtaaaaaggttctgatcccagtgttgcaggacagaaagacctccccctctgtagctgcagatgtgacccagcacagaaaaaatggcaggtgaaagacaggcaggaagagcaactaagaaggtgggaggcacctccataagatgcctgaggccatggggatgaccgttcacagagctagtccctcgagcaatgtgttaaatctactgaactgtgataaagcaacttctgggtgaattttgtcctgctacaagttgtcatggaatggcaaggtggcagatctcagaagtggatccaatggtttttttttagttaaagcagaacattcctggggatggtgtcaaactcccttccatactgttgagtctgctgatgattacactggcttctcctctttgccccatcatttcacaggttcccatcttaaagaggaagagaaaggaaggagggaacgaaggaagggagggagggagggagggaggaaggaaggaaggaaggaaggaaggaaggaaggatggaaggaaggaaggaaggaaagggagagagggagggaagaagagagggaaggaagttatcaaacccaagctctgtgcagagcaggagacgtttccatgggacccctagaatagataggttcttgctgctctcctggtggatggagatgcccaccagtagctgtgagagtctccccgaaggcctgattgtggctccaagttccgtaggactcactagtctttttttccctagagggtcttgccattgagaggcaggtgatgtgctgtttcagaaaacaaaattgggacatgtcctgatatgacatccatcaaatatatacagataggtgtcacagcccccgaaaaagcttatctcttctaggccacacatagctatttcctccaactgtgtcagacattacaaagtttctagcaatcaaaacaagtcaaatgccattctcaggacccgttggaggattttttgctttgttttggctttgtacggtatccataccattttccaaattcttttgtccttacatattttgtttttcttaaaaaaaaaaaaatcacctataatcccatcaccagacaaaaccactagaaagaaaccaacattttagccatgtttttctgtatataaaaaaagtgtgtgtggaatttttcataacaatattgggaccatgacatctatcacattttttattaggaaatggccttcaacaatatgcatttaacaatatgcttgatgtctgtgtaatatttcatctaacaaatatatcatgatttatttaagtattccctgattgcttgcttctaactagaaaaaacaatttttctaagtgtcaccactgggttagagtaatctcagccaatcctcctaatagcactgtgagaccagagttatgataatcttcagttaatggacaagggacatgatggtgtggaaggataaataaactacccaaagacaactagctagtgagaccagcatggacagtcaagcccagtgcatgtaatctgtgctcccctgcactgttgctcatatacttggacccttgcatacatgattttcttattcatcttgaaagagaaatgttagcttactgtttttatttgcatttatttcgttgcttttgagtttgagcatctttccatttcttatagaccatttgcatttgttttcctacaaaatgcctgttcatggcttttgcccatttttctgttagccttgtcctatgtatacacacatgtatattattagttcactatctgtcaggtaaattccccagttttcttcttgccttttaatgttgttatggtcatttaggactagaaagttttaaatcttgtatgcctatcagtattttactgtgtgactattcccattatttttatgcttagaaagttttcattcctatcaagtatagataaatgttcagttctactattttattttaactgtgcagtgggttcatttttggcattgaattaattaatctatctggatgttatcattagtttccttctgaaaaagtcagtccaggctgggtgtggtgactcacacctgtaatcccagcactttggaaggcctgagtccaggagttcaagaaccagcctgagcaacatggcaaaactgtgtctctatcaaaaatacaaaaattagctgggagtggtggcacatgcctgtgttcttagctactcaggaggataaagtgggaggattgctggggcctaggaagttgaggctgcagtgagccatgattgcacccctgcactccagcctcggtgacagagcaagaccctgtctcaaaaaaaaaaaaaaatgcagtccagatgtactggaacaagcttgtgtgggatggctacactcctttcctgttccaacacacctgttacctggatgagctcctatatccttatccaggtaccagatctgccacacctggtaccggcatgagccctgtggggaacataccagcagagacattatacttccaccgagacaaaataaagccacattgacttttagtactcatattattgactgacattaaacccatggcaactaaaatctcgttgttgttttttttttattctgggggtgagggtacaacttttagagaaagtatctctccctaagactgccaatcactctaaatttgcatctaacacttctacataactttatctaccgagtaggcagtatttaccgtctgctgtttcatcttgtagcataattttcttttatatttccaggtgtgaaaatattcaaactgacccctaattctcagctttcagagctatctgctacttcccaggtcactttggtttttaagcgctttcacatgctgttgttggacatctgggttattcccaaatcttgttttcacgtaggcagctgtcaagtcaagatagccatggccctgcctgacatgttctttaagattgcattttatttttattattttattttatttttcttggagacaagagtttcactctgttgcccaggctggagtacagtggcatgatcttggcttactgcaacagatcttgacttactgtaacctccgagtcccaagttcaaatgattctcctgcctcagcctcctgagtagctgggattacaggcaccagccactatgcctggctaatttttgtatttttagtagagatggggtttcaccatgttggccaggctggtcttgaactgctgacctcaggggatccacccagcttggcctcccaaagtgctgggattacagatgtaagccactgtgccaggctgcatttttaatactgtgtttttcttgacatatattccaactaaattcttctgggtgttgttggtttgacctcatattcggtcctattgaaatgaatttgaatcattcatgatttggttatttattgcattcattgtccttctcagcttctggttacccacacattagacacaagtgcctttggcatcttttttcaaatctacagatgaggaaactgaatcccagaatggtggagtgatttgacgaatattgcaaaactataatggggagatgagatggggatccaagtcttgtgcccccaaagacagggcaccaggcagcgtagaggtggccagtaccagagcaacagcctaacaatggtatgtatgtcacacacccagctcactcaatcctgaccacaaccccccactgctctgattcctgccccatcagtagcgtctgaaaggacatctccaagttcaccttcaaggacactgttaaggctgggccagtagaaggaatatgacccctggcactgtcccccttcataagacttcaaagttcatcatttcatttgggcatcattttacaatttgctaggaatccctcttatcttattttcatctggtccatattcctccgtttcaaaaacaagactatcctgaaaaactgtcagctgcttgctgaggttatttttggtatacagtacttaccagagtcacctggtcagcattaatcaccccatcatgaaagatttatggttgtttggggggtactgaacccatgttgtaccctatgttttttctgaaatattttcaatctagatggtcagtagttctagaatattccctcagggattgccatcgacaattgaccatttttataaatgttagaaatggaccgtttgcccaggagagggcttccctgtgttgagtttctgtgttgctgccaggtcatcgaagagttttcattgttaaacttgtgtagggcatccaagcaccaccttgctgtcttctcaccaggccaggggtccaccttttggaagagcatctttctaactagaagagagagacgtgaagttgaaattacttggctctgcctccttttttttttttttctcaagtttctacattttagcatctttcctgtgtaatccctttcttgtcccactcttcaaatagctttgaaaacccttctgagatcacgggcctattttcagcctctgcttggtgtgggcttttggtttcccagtgtggttctcacaggttcaggcccccccaaccccggtattgactccatgtcaacttctcatcttctgggtatgcctttctgaaagtctgagatcaccagtggtaccctgtgtggcccacactggatttttctaactatttcctctttttggtcctcactgggcttattcaggattattgacgatacatatgcagaatttggggttttctcctaatctcttttctcacttgggatctgtgtgtgttcagactccctagccccagccctccaggttaatattgtgtggcactaggacattagcctcagtttcttcaatttgatataattgtgtatgataacagaatttacctcctggagttgttatgaggattgaaggaaatagtgcttagttgtggttagtattaatattattatctacctattactgacacactttgtggttataagtgacagaaaactacctcaaactggcttaaacacgaaaagagaatctgttgctcagagaagtttcccctaggaattaccatcaagcaacatccaaaggtagacctggctttcggcacagctgggttcacagccctggtaatgtcctcaggactcagttgtgtccatctggttcctctgacgctctgtgtggaaggaggaggtggcgcagcagcagcctccagcttggcatagccatggtggggagcaggaccccagcgcttaggtttggctcctatctcagcaaactggtgctctgccaaactgaatttggaagacttgctttcccagagaagagagcacatgagccttcctgactgcgagtgatattgctgacacaaactggacacttcctccactctgtagctaaggggcagctgggcctttcaatgcagctcttttctagcaagggagaccccaccagaattgagatgggtaaccccgagccctgtgcacaggtgcctgcttttattccctcattcatctcggtctgaacattcctgaccttgactcttgcctgcgacatcctctgcactcctccacatgctccactcagctcgctcctgagagctggtaattaatcggccttgtctttaccctctgaccccactgagcctcccagatgggtttccacacctggcaaatgaccttggagttactcctaactttgtcccacaggcctgctggattggatttaatgtttgcttgctaacttctctgactcttgacctggtctggtcacttgctgtggttgtgtgtgacacctctgtgttatacacagtgccgggcattgctttttcagcagcctggaatccactgcctcttctttccccaattcgatgtccttttgtggcactactctctcactgggcgccgtcttcatggtaaatccaggtgcttttccccctgcgtggaagtggaaagttgtccacagtgtctcctcccttgccccagggtggtcctgagctgagctgagctgagtggtctcagggggagggacagcaggctgtttgttccctgtagaggcgcttgatggtggagcgctcttgtcccagttgaacctggttctccagctcagaatccagcacccctgttgacctcacaagctccttcatagcttccaattcattcccctccctgcttgagtcagcaagggtcgttccttctgctttcaagagtcctagctcatattcctgtgctgtgctctatcttccctggctttatagatttacttgggctcttttcactcctccctctgaagttaccaattgcactttttctggtctcatgggctggcctcctgcagcatgctctgctcttcccagctttgggccagcacttcctgcttcctgccaggcccccgctgttctgaggtggatctgggctgcagtccaggagacaaaattctccactgtgacaccatctacatgcccagatgttccctccatgtacttcctctttctccttttcttttccaaactcacaaccttccagtgagagaaggaatgaaaacaccacctgtaacaccaattcctccaatttcctccccagaacttcaaagtaaacagaaatgtattgggcttagactgggacttatggatggtcagagttggaagaagccttagaaaccatcacaagcctttgctcccagggctgtctctgatcgtttggttgtggctgactgggttgtcacatctggacacaggaagaaaagtgctgggagtgattcccaatgtctgagtggatgagggaagggggagtgacagcatatgagctagttatttgcccgtcctttaacaatctgctctgtactttacaaaatggggaaactgagtcacacatctatcaagctgtctaaggccacacaggaagtcagggcagatttgggggtagaatccaggttgtccagccttctctatcaacaacaatgacttctctttcccattggaattcactgtcataggatgtcatctaagtccacttcctgacagcatgtgtgtctcccagtctgtgatgtcatgctatactcggccacctctgtacaggacagtgtggcacgaaagggatcctgctggtgcctgtggggctggggctaatactctgggacaactttcagaatcacagttcttctaccctaggacaagagggtggtatacagccaaggaaaggtggtcctgggctctgcagccatggagctccagggtttggaaggtgccgtggaatcttactccttagtttggacttttgtcaaactgcagctggaaaaaaattagaaattgctgctccaaatggaacatactccatttcattccaaatgagaagtaaacaaatagacgggtgagcctccccaaaatgataaaactcttcacacttaagatgagaagtcagttcaagtgcagtcctggcgtgactcactggggtttgctgcaggaagataggggcgaaatgtcctcatcctgcctatagaagccagctccttattttaaatcccatcctgcttgactatcaaagtcagacagagccttcctaaaagctgaaacacacgcacagaatgagaagtccctgcgggagcaagttcactgtggtgagaaccttgcagagcagacagctccaggggccagcggctgcctgcaaacacttgctgagcaagtccctgggagaggggcctttctcccaggccaggaacgccaaagtggggtttcctgataaggaacacagaactgctgtttcttggagagggagttcacacggactgggatccattctcaggctgggccttagtagtgggacagcatcctgttttattaaaagcctgttgctggcagggaaagccatctgcctgctgagtgggcaggggcccaagatcgctgtgggcaattccaagccagtactgggagctgacatcaaaccaggaaagaacacgactgtttttagctgatgtagcagtacattttctttctttccttctttcttttttttttttttaatagttctattgcccggtttcactgtgtacattttgtgtgtgcaggcatgcgtgtgacatcctgtacccagctacagccgaggttcactctgagatgagcccaccccacttattctccccttctccctcctttccccacctccccctcttccccatccttcccccactgacctccccagctctaaaacccctgatagacataaagaacagagggaaacccaggctgtaacctggggttattcacagggttggggtgggtgagagaagaaaaacagacttctttgtttatcttttgagtcttgaaattctaaaaaattcattcatttccaaggaagccttaatttgtaggattccaagaaatttaaaaaaagtaaagggagattcacttcaaaagaaactaggggaaaagctgttttcttttttagctgatttgttcattattcttattttatttaaagttaggtttgttgaaggcaggcaaaggtagtcactttttcatatttgtattacattcttactttcttcctccattgccttatcagttaagagggcaaataatatttcaagagactgatagaatatgttctgcactctgctcatttcatagctctctggggaattggggtttttataaacttttataatcacattttctgctgaggttatagatgactccaagaatcttccattcatgctgtaaattaaagtgactcaaattgcttccacttttacaaattaaaaaaaaatgtacttctatacagatttttaacaattaacaaaaggccattttaacgctctggttggttgcctgtacgtgatttttctggcttttcttaaaatttggagtgaacagctcccatgtcaaatataacatgttaacttattggcttctctttaaccctgcacacaaacaataaacttttcatgtagagccagaaaatggtatatgttgtgaacttttttttttttttaaagatagagtttgtggtgataaagggatttcagaaaaaaaaatgtacttgaaaatatgttacttcacattggaacattcaattttatcttaaggatataaatattcaattttaccacattaatctttgtactgagataagccaaaaataacgtaaactgacaattgtttgctatacattctaatattttacatatttataggagttttccaagtcatgagatatcatataaggcacacaaaaaaagaatgacataaatcatgttaagtgcagtctactttttcctgagctatatctttaagacaaaagatatttaacaaattgaacttgttttttgtgggagggtccactctctggttacttaagagaaaaccagaggattatcttcgtggtgaaggaaagtgtatagaaggcagtattttttttttctgttataaagggccagggctctatccgttggtgcagtgttctgccttttgtgtttttttctggttaatttaaaacattagctccaagtttttaatgtagtagtttcccgtgagtcactgggctgaaagcccatcctatctgtgtcaggcaagggtccaagacaagaaacaaggagaacacagatataagaaagctttattagtgcagctaaacattgataattaggaaagttccagttcttctatggtagtttatttgtagataaatgtagttgtaaccttttggtgccaaaggaaaaactcctcattcaagacaagggatacggaataggaagagctcaaagaaaacacagttttctgtgttacagacaagtatttacattactaatcaacttttggttcaggaaagaagtgataatctgtttagatttttaaaaggaattcaatatcctgttgactaaatgcagagcaggttcagaggaagacgactgttgaataatgcaattgattccttccaagaaagcatagggtgtagtttttattataggaagtgccatcgatagtactttttctgctttctggaaaatcacccaggaaataaaatttgttttaaacattatttttaaaacaggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatggtaagttttctaagttttcttttcgtctcccatatacgctgggctgtgctggaatcaccaacaggcacagaaaaaatgacaacaaaacaacaacaaaacccccaagaatatcctgttgtctttggccaaagttcaggaaaggggagccccaacagagacccagtaggaagctctagcccctgttttgtacaacccagggtccttgcagagagattgatctgccagcagtggcatcagcagcaatagtagcagcagcaaagccctggacagtcctggcccccagtccacaacttagacacagcacatggcctaattcacccacagaagcagccactgtgaagccctgtgtctccccagactccatccagtggcataaggagacccaggccctgcagcttcctccccatcatggaaggctgtccatctacagagtttccaaacataataagcactaaggaaacaacataacatgatatgccgaaaaaaaaaatcacaattaaatcaaaatgaaacatcaaaaaatgtccaagtaaaccacaggaaggcaagaaaaaagaaacaaaagtgtaataaacaaaaggatcaatcagagaacaaataataataaaatatcagacttagtcctaatatatcaataattatcttaaatgtaaatgttctaaatgcatccattaaaatgcagagattggcagagtgtattacaaaacatgacccagctatgtgttgtttacaagaaactcacttcaaattcaatgatataggtagactgacagcaaattgatggaaaaagttataacgtgtaaacattagtcagaaggaagcacaagtggctatgttaacatcagaaaaagcagacttcagagcaaagaaagttactataggcaaagagggaaattacataataacaaaaagaattaattcaccaagaagatgtagctctcctgttgtgatgttatgatatatgtcggttttcatccgtgggtcctggctcataactcccacatcccgtgttagagtcttttgttatattgttgggggtgttaggcctcagggacaggcctctgaccttctcctgccttcctttcactctaatgttctcccacctttctgcctttctcattgtggatcttaagaccctcccatgagacagtcccaccctatatcctgggggaaggaatgctgacatcatgaagcttccataaaaagccaagaggacaaggttgttaagcttccagatagctgaacatgtggaggttcctggagagtggtgcacccagggagggcatggaagctccgtgaccctttctccatacctcaccctaggcatctcttcatctgtctcctttgcaatattttttaattataaacccgtaaacataggtaaacatttctctgagttctgagagctgctccagcaaattaatcaaacccaaagagggggtcatgggaaccccaccttgaagctggctagtcagaagttgtggaggcccagacttacaactggtgtgtgtatgggggcagtcttgggggctgaaccttcaacctgtgggatctgactctatctctgggtagatagtgtcagaactgcattggaggacacccagctggtgtccgctgctatattctagctgattttctccctagtagtcctagtagtcttgagtgtggggagacagtgggggattgatgccccaaccacaattgtggatttcttctttcagctgtcttagtttttgcttcagatatgtgaaagtctgttgtttggttcataggtatatagagaaaactctccctagctgtgtttttcttctgctgtcacaccatgacaacatcaacacagaagcctttcttcatatcgtataagggcacaaaaaaggaatgacataaatcatgttaagtgcagtctatttttcctgagctgttatctttaagacaaaagatattcaacaaatagaattttatttttttgcggtgtggggtatccactctctggttacttaggagaaaaccagaggattatctttatggtgagggagagtgtatagaaggcaatattttttttcttttataaaggcacagggctctatctgttggtgcagtgttctgacttttgtgttttttctggttaatttaaaacattagctgcaagtttttaatacagtagtttcccatgagtcactgggcctttcttctgtgttgatgattgtggtgtgacagtaaaagaaaaacacagttagtgagcattttctctacatacctatgaaccaaacaacagactttcacatgtctgaagcaaaaactaagacagctgaaagaagaaatccacaattgtggttgaggcatcaatccctgctgtctccctgcactcaggacttctaggactactagcaagaaaatcagcaagaatatagaaaaactcaaccacaccatcaactgacaggatctaattggcattcatagcacaatctgtccaacaacagcagaatacacatttttttaaaggtcccatgagacatttaccaagatagagaatatcctagatcataaaacaaacattaaaaagttcaagagaattgaaattatacagactatgttacctggccataataaaatcaaagtagaaatcaaggcagaaagtcaataggcaaatctccaaacccttggaaactaaacaaaaaacatttaaataatccatgcatcaaagtggtaatctcaaaggaaattttaaaaagacaagaaaagaatgaacatgaaaatatgacatgttaaaatttgtaagattagctaaagcagtgctgagaataaaattgataggagtaaatgcttacattagaaaagaggaatgatctcaaattactaatctaagtttctacttcaagaaattagaaaagttgagcaaaataaactcaaaggaagcagaaaggaggaaataaaaaagagcagaaactaatgaacttgaaaactggaaaaagaaaaaatgaaacagaaagttgtctctttaaaagaattaataagattaataacttttagcaagaatggcaaatataaaaagagagaagacatgaatcaccaacatcagaaatgaaataggggacaccacaatagatgtctttagctataaaaagataatttaaaaactgtaatcaactttatgctcatatattcaacaagtttgaagaaatgggctaattcctcaaaaaccacaaagtactaaaacttagccaaggtgaaacagataatctgaatagctgtgtagatatttctaagaattggatttataataaaaatactccccaaaaagaaatctccaggtccagagggtttcatccaagaattttaccaaacattcaaataaaaattaatgccaattctatgtgtatcttccagaaaataggagagaagagaaaattaggaagttcccaattctctttatgaagccgtcattactctgatacccaaaccatctaaagaaagtatgcaaaaagaaagctacagatcaatatctctcatgaactttggatgtaaaaatcaccaatcaaatgtaattaatcaaaatccaacaatgtataaaaagactaaagcaccatgaccaagtgaaatttatgccaggtagacaaagctgattcaatatttgaaaagaaattaataaaatttatcatagcaacaggctaaagaagagaaaccatataatcatagcagttggcaacaaaaaattatttaacaaaattcaacacccattaatgatgaaaatagaaaatcctctcaaatacactaggaatagagggagacttcctcaacctcataaagaacatctattaaaaaactacatcagacattgtatttcatgataaagacagaatacattgccttatacaatccaaaacaaggcgaagatttctactttcatcagtcttattaaacacagtactagaagttctagccactgcaataaggcaggaaaagggaataaaggtcatgctcattggaaaataagaaatgaaactgtctccttttttaggcagcatgattatttaaatagaaaatcccccaaaaaatctatgaaaaataggttgtcctccttctgttggctacattgatcaggcaagtgctgctagttgttcttaggggttctgcttaagtgctgcaggagatggcagcacagaagctgaggcacagcttgggcatggtagaccagggggacacccaactccattactccctagctctatgcccctgaacaccttccttgatccagctgaactttggtcccctcatctgcaatggtgttgatgatagaacccagaggccataattcttgtgagtattaaatgagagcaagtgtgtagtaaatgtgtcattgtacttgctgcgggtactgctgctgttgctgcagttgtatgtgatactgtgctatttgttctgccactcccaggcactgccactggagcccttgttcagtgatcctatgacttgtcagctcagtcaattgctctgactcttactgctttcatttatgaaatggagacaataacccctctctcataggaagggtaagaccagaagagcctacactatggttggaataatatttgtatacagtgatcaagagaatgttctctgaaaccagactctctttaaatcttacctctatcacttattagttatatggctagctgttaaatgaggtcaaaagagtgtgttcttcataaaactatacagaagattaaattaattaaaacatgtacagtccttttaaaaaagatcaagtgaaacagcatacatgaaagtgctttcagcacgctgagaataacaatagcaatggctagagattatggagcactccccactgccagcaccaggggaactttgtacctacaactttttacttagtccacataaccatgaattcgtctcatttatgtagaccgggaaacaaaagcctagagaagtaatttgcccaaagacctagcttacaaagcaatagaatccaggtctggactctcgggatctgactgtgttctaatgcctcccagagaaagtaggctagagagggcaggaatagcttgacttagagatcacttccactggcacggtgggtacaatctgatgtgggaggctctgggtgcagcctgtgatggcagagtggaggagccaggagtcattcttggcctcattgtcactgccttcaaactaacaagttgcctgagagctaaggttccatttgataggacaccgggtgggatgtgcatcagaatatccatttccttgaaggatccaatgattaggctgaggcaaaatgttttagaccattcccaggtctaaaaataactccatcatcacctctaataaggactcagtctggagtgacatcactccttcaggtgcagaaaaggaaagcatgactgtgtgtcactgacttaaaataggagtgaggtgagaggggcagctgggctcatggacgtcaagtggacagtttctcagctggtatttcctatatttcctgttttggacagcaggttcctgcccttctaagctgggggtaggggtgagggagtgtatgttaaaaagctctgtggacttgctttttctcttctccatgtgtgttctttccatcaataatctgcgttcatctttactggctgttcatgcattatctggagatacgctagttacagaaattcaaacaggcaactcttcctctttctccctagctttacactacagatccatgaagttttcttgactgtccctgcctagggtacaacaaggaaaccactatttggataattcccctgattccatggtactgtggaagtggtgggctctccatatgtcagggtattctatgtctatgaaaaggtatctcttttgagaccaagggtggacgggatcctaagagtctaccaatttttaaaataatttagctatatttaagtcaataaattgtattcaaggctgactttgtagtgatgtattccatgaattatttcattcaaaataattttgaaaggacttctggtccagacaaaatagcatagatccatttctgtcttctctcctctcagttaaatgcaattataaagtctagaaataatgcaagaggtaaccaaaggagaactctgaaagatggaaacagaaagaggaattagttagggaccctaagactggaggaacaatagaggtaggatgtcttaccatcaccgcatccaacaagagaaggtgacctaggcctggtattacctgatcccaacttggcaccaaaagacagccaacatagactcattcctcctgcttcctggtgagcctggtattctcctccacttccactgacagacatgtagggtgactgggtggtatcaacaataggaaccacatcataacaggcagcctagtttgggaagcactcttggtctccgtaggcctgagactccttttgcccatctagaggcaccaggtggcccagcccatggaaattccctcagccccagaaaggggcaccagaaaggaccagtgggagctccagtaggctataatagtatgaaggctctgaaatgaagttgccactggacctacagcccactaaactaggctaggaccttaggtgatagcctgaaaaaaaaaaaaaaaaaaagacccagagtcttttaacataaaaaacaggatgtgcaaatacaatgaaaaaacacacattataccaaggactaggaaaactacctaaatgagaaaagacaagtgacaccaacactgagatgaatcagatagtggaactgtctgacagactttaaaacagccattataaaaatgtttcagaaagcaattacaaattctcttgaaacaaatgaaggaatagaaaaatctcagtgaggaaatagaaattgtgaaagaagaaccaagtggaaattatagaattaaaaaatataacaatagaaattttaaaaaaatcactggattctactcaatagtagaattgatatgacagaggatagaatcagtgaaattgaggaaagaacaatataaatcccccagtctgaataacagagagaaaatagactgaaaagctctaccttgaatgataactttgatcacaaactagtagtattaaccacgtggaagaggagttgctaaatcaacttaagagaacaaatagttttaggtgagtgacaaataattggaaaattaaaaagttaaatgatgtcatgtataataacatcaacatacagagaaataaatctaataaaatgtaattaaaaactataaaatcattgtgaagaggcattaaaagaatccaaaatatatattcatggaataaaagacaatatttttatagtcagttctgtccaaattgacctatagagtcagtacaattttacaacaaattttagtggaattttgtttattttatttgaggaataaagtttatattttatttggaaatttaaaggactgaaacaatcttgagcaagaacatttgttaagacttattctgaagctttagcaaataagacagtgtgagatacacacaagcatagacaaatagaccaatggaacagaaaagagagtactagaaaacagaccacgcatattcagtcagttgatttatgacaaaagcaatactgccatgcaattggaataggacagataatgtttgcataaatgttgcagggtcagttggatcttcatacttaaaaaaaatgaatcttgactctacctcacaccacacacacaaatcaatcagatagaatgtagatctaaaagtgaaaggcaaaataataaaacttctaaaagataacataagagaataatttatgaccttggagtaaaatcttttcaaatgtaatacaaaatatactaagcacaaaggaaaagactgattgatgaattggacttcattaaaactaagaacttctgcccgggtgcgatggctcacacctgtattccaagcgcttggggaggccaggaagggaagatccctacaaaatatttaaaaaattagccaggtgtggtggcatacccttgtggtcccagctactcaagaggctgaggtgcaagaattgcttgagtccaggagtttgaggctgcaatgagccctgtttgcacaactgcactccaaaaataataaaaataaaatacataaaattttaaaacctaagaacttctgtttatcaaaagacaccattaagagagtgaagaagcaagcccttgagtaagagaagatatttgcaaatcataaacccaatacagggtttgtatctagaatatttaaagaatttccatgagtcattaataacccaatagaaaacatgggcaaaagatttgaacaagcacttcacaaaagaggctttgtaattttctaataaatgctagcaaggaagtgcaaattcaagtcataaggagataacctctacagagccaccagggttgtccaaaatgacagactaataatactaagtgccagagagaatatacagcaactacagctgccatcctctggctggtgtgagtgtaaattagtataaccacattggaaaactggcaggatctactacagctgagcatttgtgtatcttatgacccagaaattctacaaaaatgttcatgactctctagttatagtaaccaaagactggaaacaatccaaatttccatcaacagtggaatggataagatgtactgagcaatgaaattaaaggacctaatgcaacagacagtaacatggatgaatgtaataaacatcatgttcagtgaaagaagccagaaaaccaagagggtaccctgatgactccatttacatgaagttcaagaacagacaaagctaatcaatggggtcaggagtcaaaggtgatagttattttgggtatgtgactggtaggggtacaagtgagacttctgtggtgttggcaatgtcctacttcttgacctagtcagtgatttctctggtttgcctcctttgtgaaaattcatcagtgtgttctggttattatttgtgtgcttttctctatgtatcttctacttcagtaaagagtttactgaaaagaacatacttgggtttgcagagttgaaaacacccgcaacatcttcattgcctcacaaagactattttacatgatgtttaaaaactttagaagctaaaatgctgttctttcattctgagctgattacagattacagattagtaagaaagtaagtgggctacttgtttaaagatggtctatgttaagtaccctgatatcttcttttgaaagagaggtcagtcttcctttcagcagagcattctgttcacctgcctgcccacctacctcatggaccttacagagcttggttaccctgactctaggcctctcagctcttgtactgatcctcccagctgctctattctgatgccatgaccctgtctggagactagagaggctaggccacattcagctcttccttgtcactgtacaactcacctggtgacttggtttttttttttttttttttttaattccatgccgatgtaccctgacatggagaactaaagacagaattatttagggatttcctctctctcattctgaaaacgtataaatagcctttgctgagttactttgttaaaataaccctgacatttttttaaatgagcaaaggggctctaacatggaaggtagatatactgaaggaaagagcccttaaagacaaagggctagtttatttcattatgagatgtccagggctttccagtcccttaattctatcaatgaaccgagtgagaggtaacaatgagctgtacattttttacaaaacctctctgcgtagtcccagtagtaggttgctgaaattatgttaaagtcaggtggggacttctagaaaacccactgtaaccctcttgtttggatgacattgaggccagggaggggaaaagaacttgcaagttgagcagtaataacacagatcccacaggacagctggcagtgaccccacaacagggatttgaaaacaaagtaaggtcttgttgtacccttggttcctcttctttacttcctactatcaaagtcaggttctagaaacttccctaggaggcggcaagaggcagtctctgcctcctcccagtagcaaattggccacaggaagtcctcatttgggatggactggaggagagaggcagctgtgtggaaagggcaaaccttgaaaacacccaagtccttgattgggcttgcagaaggatgtggcaaagagtaaagatcttgagttctggaggcacaactcataggttcgaatcttttttttttcttttttttttttaaatggagtctggctttgtcgcccaggctggagtgcagtggcacgaccttggctcactacaagctccgcctcccaggttcatgccattctcctgcctcaacctcccaagtagctgggactacagcgccactacgcccggctaattttttgtattttttagtagagacgggatttcactgtgttagccaggatggtctcaatctcctgacctcgtgatctgcccgcctcggcctcccagagtgcagggattacaggcataagccaccgcacacagcccgtaggttcaaatcttacctgcacctcttaacctctcagggcctcagtgtcctctacttgtgaagtagggataacagtcatattcacttcctggttttgctgtgcaaaatgaatagcatgtgatgctgaggcactgtaagtcgtgagggcagatgatcacccgctttaggagccattcttccaaaatcttaagtgagtgaaaaagaagcagagatagctttttgtatttgcgcatggaggcagagttcatctgttgcctgagctaacagtatactattcagcccctagtgaaactctggccccagggcaggaccaactaactaggtagggcagtgatgaaaaagggagagtcttctcagtggagtctggtctgggtagagatgtcaaaggcaaaccatcacctccttgacttgttggctctaggtgatgatgctaacctgacctggagggatagcccttctatggggtgggcaggggcagccagaggtgttctgaaaaccagagaagtctcctcactggaaaacatttattcctgggatctgtcagttgatggcagaaatgttcattgttaaagagccgtttctttggcttattaattggtcctctgttagccagtcaacaatactgtacccagcacagatatccttgagaaatgaaggagaaataaagtctttcctagataagcaaaaactgatggaatttatcatcactagactgaccctacaataaatgcttaagagagtcctacatctggaagcaaaagggctatattcaccatcatgaaaaccctaaagtataaaactcattggtaaagcagacacacaaataagaaagagaatggaaccacatgttatcattacagaaaaccaccaaactgcaaagataaacaaaggaaagaaagaaagaaagaaaggaaggaagaaaggaaggaagaaaaaggattatttaaaattatcagaaaacaattgaaatgacaggaataagacctcacctatcaataacaacttttttaaatggcttaaatttcccagttaaaagatatagactggctgaatggattttaaaagtgacctaactctatgctacctacaagaaactaatttcacctgtggagacacacatagacagaaactgaagggatgaaaaaagatattgcatgcaaaaaaaaaaaaaaaaccaaaagtgtgcaggagtagcaatacttacagcagacaaaatagattttaagtcataaaacatagagaaaaagaggtaattatataatgataaagggatcatttgagtaagaggataaaacaattataaatatacatatactcaacactggagcacccagatataaaaagaaaatataattagagctaaagagagatagatgcttatacaatcatagtttgggactttaaaactcaattttcagctttggagagatcatctagacagaaaatcaacaaggaaacattagacttatactgcactagagactaaatgaagctaatagacatttacagaacatttcatccagtagctgcagaatcacatgcttccctcttcagtacatgaaacattctctaagatagaccatatgttaggccacaaaacaagcctcaacaaatttttaataattgaaatcatatcaaatatgttctcagaccacaatcgaataaaaccagaaatcgatgacaaaaggaactttgaaaactgtacaaatccatggaaattaaacaacgtgctcctgaatggtcaatgggtgaatgaagaaattaagaaggaggtcaaaaaagttctcaaaacaagtgaaaatagagctgcaacataccaaaaccaccagcattttttttttagcaataatctatttttaaatcaggtgtgtatattttttagacataatgctattacatgcttatgggctacagtatggtataagcataacttttatagtcactaggaaaccaaaaaatttatgtgactcactttattgcaatattcactttattgcagtggtgtggaaccaaactggcaatatctcagaggtatgcctatagttaacaagaatatattgcatatgttcacaaagctggaagagaagattttgaatattctcagcatgaaaaaatgatatatctttaggtgatgtatttcctaattatcctgatttgatcattatatgcatgtactgaaatatcactctgtgcaccataaatatgcgcaattattttgtgtcaactaaaaataaaaggaaaaataaaaggcagagccctctgggaggagaagactaattaggcttagtgattgctaattctgggagctgcatgcaagcaggttttaaagaaggcagaaaacttaaggatgtggatgtaaaaggaagttacaatgacaacacaatttacagaaatcacttagtcacctggaggactccaatttcaaatgtgccatgcttggatatttgcttacattttgcacaatgacttttctgccatctcctgtgaacctctgagcaatcctgtaaagcagggatcatgcccattttccagatgaggaaacagagtgcccatgccctgcccatggttccagaatgcagaacagtcatccttgggagatgggggtgtctggtccgagtacctccagtctcacctctgctttgtgtcgcaggtggggaggggtcactgaagacaaaggctccttgtggctataggaagggtctgcccaccaggagaggtgggaggggaggagtcttattcaggctgccaaggttaagcctggttaaccacttagacccagagttaactagcaaggggcacaggtacctgcctcagagcatttgtctctgcctggagtgtttgactagaggtcctgagagcctggaccctccgacgctcaggtctcagctgccacattcccaaaggtcatgatcatcctagaccactcaggtgctctttgttcttcaccctgcttaatttttgttaggagtgcttctgatggcttctggtccatagcctgcctctgtctctgccctgccaactccgtgctctgtctcaacgttgcacctgaaactgtgcctgccatggggtgggtattcagtagccaactgatgaatgaatcaatgaataaatgagcagataaatgaatgggcaggaaagctcctcctgtcactctctacactaacatgtaggaagtgttggagggacacacgttagtggatgtcggtcacttagtcctgataaaacagagtagatggttttcttagtaggagatcttgagggctcttctgtgaagcctcttgtggaaccagtgaagtacctgaaaggcaaggattgggcaaatcaattccttctggttgtggaggagaagcccttctagggttgatgttaatgctgcattttaatgaaagtgacttttcaggcttataattggatgacatcagctctatttctgcttttgcttctagaatttagtgtgattctattttaagagactaagaagaaaaagcaatttttagactctcataagaatactagcaacaatggcaatagctaatgtctctgcagcacttagaaaagactgtgccccctgccaagagcttgacctgggctatctcgttgaatccttgcaacacacagccccttgtatagatgagaaaactaaggcctgagccagctggccactcatccgtcacagcctcctttcctttccagtgttggggacagctcacagtgggctgtaggatgccactgggcatcagcctggcaaggtagcaggtcatctcatttttcttttttctggagggtgaggttatcctgcaaaatggaggtcatggggcctcctgccctggaatttctgcctcatccctgacatcttggatgttatcccaggctgctctggtccagttctggcttcattttctcaacatatcagatgcaagagaggcctggcctgctagctcctgtctccctgctctgctgcattccctccccacgcggtgcaggtactgactcgttctcaaaactgtcagatgggctgccacctacctgggagtttcatgacatgtcctgggatcctactacgccagaggctcaatgcctggcagagtgaacacttagtaagctgcagttgccctgaaatattttcctgttgctgattcatttcctcatctgtggataccatattccaaacttgctgtgccaccctctgaaggggcaagttctttcctaggagtagataccaagagagaggaagcccatgtcatggggacaaccacacaggccaaacacaggtgtcactgcctgcagggacagcctgcaggcatcaggcctcccaggagatagcaggcaggacaggaccatttcagactcatttcagcagtgtgtggacagaaccccactgagaaatgcaagcatgagacctggagtctattcctgtcttgtcctggggttccttccactggatgctcatcaggggaaatcctccctctggatgctgatgtggggaaaatggccaactagttttaaccttaaactcatccaaaacttattttctctccacttgagatagttgtcaggagatctgagttctcaccttccttctgctcttcccttgtatgtgaccttaggcaagttgcttaatccctctgagactcagtttcctctcttgtagctgcaggatgatggctgggctctattctagatcagtgagactcaaacctgccctgtggcatcagtcaggaacagttttgccgagtaggctccagtccagaccaatacatcacgatctgtgggagtgaggcccaggcgattcccaagcactggaagggttggaaattcaggcatatggtttctgccttaaattccatctatgaaagccgaagcgctctctttaccaccaccacctctccttcccacccttgtcttgtttgctgctgatttctcgcctgactcaagaacaaatgtgtttaagccccaagcccctaaaaatgggaagctgtctatttcccttctgtaccagctcccacatgtgtctggacacagactctgccagggaagtcccctcccatagggaccgtgtgcctccagagttgtgtggacaggacttgaagacatccaaagcccccacaagagatgatgacaacaaaactctgtgttaaagagtttccaagatggagaactcctgcctgtcaattatccttctcagacactgattttgtttgtttgttttctggctagagacgattattccacacaggaatgacagacagtccctctgttctttgtctgctggtcctgggggcctcttgcgtcagtgggaatggaaagtatcaactttcttatttctccatgttccctcttgccttgcatctttcttcctgctttcatttctaatttcttgggccctttgactttctcttcatctccctcttcattcttcacacaataatgtttatttaattttggatgttctcttctggccaaaagttgacttggtccagaccaaatggaaatatatgtgattaaatctgttctctgcggagagggactaaaacaaagatcaatgccagatattgtcgtgatgatgaaatgtcagggcagagggcaccaggaaggacagaccaggctcacagaagcgtgccattctttcacagcacatgcagcacacaatatgcagaggcatgacattccaaccttctccaacccaccgtttatcagtgtgtcccctggactggtagtatcagcatcacctgagacttattagaaacacaaattctcaggctccatcccagaccaactgaatcagaaacactgggggtggggtccagaaatctgttttcacaagccccagaagactctgatgcatgtggaagtttgagcaccactgcttctagtgcgtagacgttttgcttgctatcattgaaaactcgcttgacctctttggagaggggcatggcggcccccagatatctgaggaaggctgagcaggaggataaggtgagctgaggaaaagggagggagcaatggggtattcacggcaggggagcctgagatggtcccttaaggatttgcattggttaatgggcagactggtgcaaaagaggctgaattgaataattaggaaactgggagaattcaattcaaagaagaattcttgttcgcaaggtcaatttttatactatttaagtaaaataactctggtaggttctatagcaaatgctaagtaaagtaaccgctggtttctaaattattacgataatctgagaaaattatttctttgaaaaaattatagaactttcaaatatgcaaaaaactctagagagtaatataacaaatgcacttaatagggacaacctttaacattcagcagagaacattttactctattggcttcagatcttgttttgactgcagcttgattcccacagtcctctctcatccccacccatcgtgggtcctcagcctcatctcaccaccctgagttgggtatagaatttcctgtccaggtgtttagaattctatacatttatctaaaagcaatatagggtatcgtgtgttgggttttatatgctgatgtaaaaggagttgttctgcaatttgctttcttctctccatgttattgagctctatcctgttgctacctgtggacgtaactcgttctcattgctgggtggtatctatcttatggtccctttctcatcatcatgagcatttaagtgaagatcgtcttcaggatttccatgtgctcatgtgggagagtaagtcctgaaagtggaacatcacctgtaaatatattaaagacagggttttccaatttaactgggaaagtctccagactcagctggagctacattatctgtttctctaagaaagaacttttctgtccataaactcattgtattagtccattcttgcaccgctataaagaaatacctgagactgggtcatttacaaagaaaagaggtttacttggctcacggttctgcaggctgtacagcgagcgtagtggattctgcttctggggaggcctcagaaagcttccaatcatggcagaaagcaagggggaacaggtgtcttacatagcaggagcaggagcaagagagagtgagaggggagatgcttcacacttttaaagaccagatcttgagagaactcagtaccacgataacaacaccaagagggtagtgctaaactattcatgagaaatccacccccatgatccaaccacctcccaccaggccccacctccaacactagggactacggtttgacaagagatttggtggggacgcaaatccaaaccctatcactcatttttttctcccttcaatcattcaaccaacaattgctgagcaactcctgtaggtcaggcactgtgctgggggctgggaaccagtgggaataaatcctatgggtctctgcccttgtggagattccagagtagggctgcccggatgttcttgcattgtgcacagtgcagagacaggaggctcccggatattctggcctaggcaactctaaccctgaaaaatgaacaagcccatcacattctattcatgtggttatagtttacctgaaacctcaactgctccacagaatcagatctctccgcagctcccaaaagtgtcccaagggttagcactgaccagcttgctgggtttgaaggaaccacaatgcatcgggtgtggctctcttcctgctagctgctccgaagtgagctcctactgattctattcagttggacgctcacattcagcgagtccagggggtttttcatgctttgagcatttttaagagtctgctatttgcccagttcagtgaggggcactcaggatgtatcagtggttcaggctgacttggttcctgcctaggggaagacccacaagaccagtacccaatgcagggatggcatggatggtaggggaggcttggaggccctaacccactcttgaagggatgacagaagcctcccaggctgggattggaaggatgaaaggagcagacaggccagggtagagggcattgagtcccagtttgagcgaagggctggagcaagagagagcctggtctctgcaaagatctgaaagaacctcagagcaggggccaaagggtaagggtgtcagggcagaggctgtgccaaaagaggtgagcctcatcctaaactctgttcttgatttggggtggaagtgtccctggaaaggcagatcaacaaaggaaggagcatgagccaattctcaccacacctcttgtgcttcaagtcctctcttgggttgggtgatgtcatacagggacccacacttgattggactgccctccccaccttttaaacctctcctgtcactgagggggtacaccactggagcctggcaaaggtagccagtactcagggggtgtgcacaaacctcacacccatgtttataaggccattacaaatgctggcccagttggtgaccagacaccaatccttgtccttccacgtagccaacagtgggctagttggcaggtgcatggcaggcgctcagggctatagacaatgcaggctttaatcccatgagtggagtcggtgccaagtctagaattcaaggatgactcttcacccaactgaccctcttacccaacaaaccaatgagaacagcttgaggtctggaggacccgtgcttgatatctgtccactcttgtatttgagtaaggtagtggaggtcacaggctcacatcataaactttgtactttatttgaaacacttttctggctctgttagtggctccaacaccatacttaagcttacttcaaaatgacttatacatctctattttccttaaagtatgcgcacagataagaaaagatggggtgaattttttttttttttgagaaggggtcttgctctgtcacccaggctagagtgcagtggtgcgatctcagttcactgcaacttccgcctcccgggttcaagcaattctcccacctcagcctccgaagtagccaggattacaggggcgtgccaccacacctggctattttttgcatttttagtagagatggggtttcactgtgttggccaggctggtcctgaactcctgacctcaggtgatccacctgcctcagcctcccaaagtgctgggattacaggcgtgagccacggcgcccggccaagatggggtaattttgatgtccagacacaagttgtcatttaagatgaagcttcgattgtaactctatgaagccctgctgaatattaaaagcttatagaaagcagcttttctcccccaggcaaaaagagcccttcgatctgtggtgggactttgcaaaaagctgagctgccactcaaagaaataattccccgctaactgcaagtttctgtcttgtttatggagggcctgttgagaaggccctccaaacctttggttccagggtctggcaaggggaatctgtcatcattcattgcaaactacacctccacccactgggctgaagacctgtgcaaggatagaccaagaacttcctctggggtggctgtgctcatggatgctgatttgacaatttccaacctccctcattaccaagatccccttccttcacctgtgaaaccaaaattccatcttcttctcttccctcctttgtgacagagtggggaaagatggggactgagggaaaggagagtagaaactcagtcccttgagagatgggagctgatgggaaggaggtagaaacttggtcctttagccaggaggctctgcaggcattcaggcctgatctaccatgtaaggtgatttctttctttttggaaagctcccatttcatggggtggacaggtccaaggactgctctggaccacttggtgatcacatgggccgaagtaggggtagaggaccccaaattgaatgtgtggaggggactctgaagcaggtgtgaatgccaggagaggtgggaggaaggacaagggtggtgcatcaagaccacagaagccggcccggccagccttcccacaaagttacttgaactgagctctccataagtacacatgcgcacacacccaagaataaactggacaaatggcagcagaaagagaaagaacagaaaagagagctgatgaatacatccataatcagcactaacacagccctggaaagaaaagcaaaaagaaaaggcaagcgctgtggtgtgcagctcttattgtctaataaaagaaaatataccaattctttggggaatttaattttttctggaaataaattcttggaagaatttatgtgacagaacaccccaggggaacatccttgcgttgggaaggaggccacctcgtctggcggcctcgggcattccagtgatgcaggggaggggcccaggcagctgtgctggtccaaggggctccaggtagaatgagctgtatccttggccagaggatgttgcgcatcctctggggggatatgacgggagaatgatggggggagttggggagatgtccccaggtattacaagtggaggctggggactaccactgtcagttcattgtcaactatgtccgcctcatagacagggcacaagcctatccttagggacacacgtgaagaggggaggcaggaagattcaggcgcgctctccggcctagactggctgaaggagggagattttaatgcttggcataggtggtgaggggtccaccaaaggtaggaacacatccctggggctctgggaggaagaagcgtcaggactgcagctccagcctcttcaggcccagggtcctagggcggaacaaggctggaaaactggtgcatggaggaaagaaaaaaaatgggaagggagaatggacaggtaggaaggaaggaaaggaggaaagggaaacggaggaagaaagacatggaaagctgggaggacagagggcaaggcagaaggtaaaggaggcaaggccaaggctgtgaggaggaattccgcttttattctgctgtctggcttcatgccattgcatggggccctgtaaaataaaaaatgatacctcccagggctattggtttttatcttagaggactctgtggggagatgtggaaagctgttcaagtggcaagccttgggagctgagtttcatgacgatggccgtctagggctgttcaaagttaagatgacagattggcagagtgcagggaggtgagagagtattggggaagttttccatacaggggaccatgtagtgttttgctgggaagatagacctgggtggaggtgagactggtgggtgccacagatgattctaactcctgctccttctcttgtccttccaacaaaccaaccacacatgtaacatagtcataagagcttgcagggaggagaaaagagagatatcaacagaccaagggagacagagggtggagggccatgctgtggacagtgaggggaggaggtccttcctctccgccactgccctcaaggctgcttgaggctcccacgctgaggtgtccacctggctgagaggctgctgcttatctgttccccaacttctccacctgctggtgcagctctcccttgctgtgctaggagagaacccactgggagggtcttggcatctccaagtggggccctcctgctgagacactgggtggctgtggagggagctcagccctcattcctccccgagctcatatctacagagcagcaagtctccccactccaccagaggagagcacaggagagctaggcagctgcctccaccaagacttcacccaaccacggtccttcactcccaccaggacaggacaacccagcctcccgggtcccaggaggacttggcatggctgaggacacccaagaggaaccaccagcctatccctgaaaaagcaaagacactttggggaacagaagaacgtcttaaaagatatcaactttgactcagagatttcaagaagacgctctatccgaaaaccaaagaagaagtgtcaaagctgttgtaaatgtttaaaagaatagccaccttgattgcattttgagtgaattgtgaattccctctccctgggtcttcctcattcttctacatcctccccatttctgtactgaatttatagcagactgaatttggaagttgatttgaatgtttaaatatatgagacactctttgttactttggaatgagtaaggcattaattcttttacgttttgatttttaaaggttttatagaaaattgcatgtttcatcaggaaaaaagttatctagttctactcaaaataacatcttatggaaactttcagagtttcaccagacaaaatgccccaggctttggctttgcagctggtgtctacagctgagcctagtccttgaagtaatcatgactcagcttattcaaaataaactcttcaagaattgcaaactctcctctcagcgcatgccctgtgacctccatgtccctccattacatctcctcagagtaaggcccaatgccactgactcatgggggaaccacaggcagcaaatggccagagctcacacagagggatgagtgcacttcacctgcagtgtgactcagcaggccaacagatgctatcagggaagagcactaaaaaccaaagggtggctggctgcgtctcagcatctgtccgcgagaaacacgatgccatggttattttgtgattttggtggtaggctgctggtcaggtgtctccaagcaagttggtcaaaatgggaacagttgtttctctgggcgggcaggggtcaaggctggtctggaaaaggccgaggcagctgcaccctcttgagccactggccagcacctgtgccctgtctggggctttcctctgcccacaggagacccttctccatgcaggtgctgcgtggcaccaggcatgagtctgaagttccttctgccacaagcaccctcgttatttgtgattgtgcaaaaaaggaagtctctgccaagaaactaactgaatgttagtgcctgttctcaggactttccataaccctgctctactaggattcctttcaccctctttgaaagcagccaaagggttaagtcatcccaggtgcatctcaaagcagggctgcgagcagcaggagtttgagctttgttgcaattagaagttgagtgtgagaaaggacattcaggcacagcttatctttgaatacacatgcaggagtatcaggagcagttagagataaacagctggctaataaacacatgaaaagatgctcagcatcattggtcattagggacaggcaaatcaaaaccacaatgagactctacttgactcccattaggatggcgacaacacaaacaaacaaacaaaaaagaaggtaatcagtgtggatgaggatgtggaaaagttggaaacttcagacattgccgttgagaatggaaaatgatacagctgttttggaaaacagtttaatgtttccttaaaaagttgaatagagaattagcatatgacccagcaattccatttttatgtttgtaccccaaagaattgaaagcaaggactccaatagagactagtataccaatatttattgcagcattattcacaatagcttaaaaaaagtgtaaacaacccaagtttctgttggcagataaacaaaatgtggtatgtacacacaatggaatactattcagccataaaaaggaatcaagttcttatatatgctacaacgtggatgaaccttgaaaacatgctaagtgaaataagccaggtacaaaaggacgaatattgtataaaaacacgtatataaggtacctagattagtcaaactgattgagacagaaactagaatcgaggttgccaggggctggggagaggggagaatggggagttattggttaacaggtacggagtttcagtttgaggtgatgaaaaatgttttggaaacagtggtgctggttgtacaacattgtgaatgtacttaatgccactgcattgtatacttaaaataactgggttaggggcatttatggattttcctctcattgtaggtcactaagaacatggtgggaggaggagccactgcctttataggccccgactgccccagagcttcattcctcaccaggatgaatgacaggattctggactagagggctcttgcctgagccaccagggcatccgggggatccctgtgagcagggtgagggtgagcacccaggttccacagggctctgtcctgggcaggccagcagatgcagtgattgcaaatcctccttgtacaaatggaacaggcacgtgcatttgtggcacactcagagctgctggccactagtgtgctttggagaatcagttgtctcccaggcagggaaggtccctcagacataaaatactcacccatttagaggaatgacaacagcaaacgaaactatattctgctaatttactggtaagagaggaaaaactctgtcatgcatacacagacagaggctctgccaaaagagagaggcagcagatacagatattagcaaatgactcctctccagaagaaacacaccagccaggaacggcactcacacctgtaatcccagcactttcggaggccaggcggtaggatggcttcagaccaggagtttgagactagcctgggcaacatggcagactccgtctctacaaaaaatgaaaaaaacaaacaaacaaacaaaagatcagtgtggtgacacacacctgtagtcccagatattccagaggctaggcaggaggatctcttgagcccaggagatggaggctgcagtgagctatgatcctaccactacactccagccggggcaacaaagcaagaccccatctcttttttaaaaaaagaaagagaaaacgaaaagaaaaaaaacacacacgatttcacctgcttgaaggcctgtgcttctctttgttgtccccatgacactatacccaggccactgtcagggaccctggggggcttacagtggcttactgaaggctagacagtatccccttgcagtatcagttaggattctatcatcatgagaaagaggctccagctcgctcaacggagcaaactggaaggtaatgaggggctcagggaatttgtcctgggaaggcaggaagcacaaccctgtcttatggcagaggccatcagtccagggtcccagctggacctgctgatcctctgtccctgtctcactcattgcagatgccacctcttcggtgagggcctgtgagctagggttaggtcacctaccctaccctgtgtgaccacaggcagggagagacaggatttcacttcctagacttccacggtggaggccaggcacctaagattattctcccacccacaccaaacacagtgggggaaaactcatccccaaaaggaaactggggccaataggcaggggtggatgtggggcagcccaaaaaccaacacacagccaccgaccccatcagccatgatttatatccatgcctttcctggacaaaaaaccaaatcccactgccctgggcatcagcgggcagggcccacacaggcttcatagatgtctcctctccgggaagtggagggtgtgtttgtgcattcggagtagctggtgcctggtagaaaatcagtgcggttttggctttggcagagcagcccaggctccctttgcattcccacaaatcgaggcagctctgctgtgctactatcacagttttggcggctttgaccgcaggtcctcctgaggccgggagactgctggggcgtggtatatcagttgttgggggccgtgcttccccagggcagatgcatgcaggggctctggggcagagtgaccgtggaagttcgatgatgtcaccccttctcatgcagctgatcgttgggtcaggaaacgactctcctggcatgaacctgttcctggtctcagcaacccgcacattgtgctggtgccaggtcaaaggcagggcaggaagccaagggatggggcaggcccagggggcagagaagggcaggtgggtgggatgtcgggggcaggtgagggtagagcatgtgtatttacccaggcaagggtccggccaggctcgcaatcagaagagagagagaagaccctgactccaagccaaacccttcaccgagggaaatgcaccaacactcagagggttcttgtttagtaggtgagcaagcagccaagcattggccttccccagggcaggggcataaggccggtgagcagctgagccaggatttgaacagcagtcacccttggtgaggcagaagcagatgaggatatgaatggggatggctaaggaaaggtgggcttgcttgcactggggagaggccttactggggattcagaattgagggctggggtttgcttccccggagggtaatggtttcagctgcctgagtttttatctcaccccttcttacctcctcctgcaatgactgaccaacttccacttcaaagagatctttgattatgactccatgacatcagtaagctttcaagtcagtgaatttaccttctaatggtgattggaactcaaagccagttcacagcttgacctgcatacatcaagcagctgggtgactgtcagatgtgtcatctcatgtgggaggagaatttgttaaagtagggagagaggacctcaggaagaggcctcttgaaagtctgtgggtgcctgaggctggaggccacacctggcctctggccttcaggacaatcctcaaaaagggattaggattagcccacctggttctcagttggctgattggttaaaaacgtgaacaccaaatattaatttgcttttgtttttatcaagcgattctatttggggtgggatgggggagaacgagaaacattttaaaagttagagtaaaaacccagcgctacattgccaatttcaagatgaagtaataaagaactacctgggagggagaatcatttctaatgaagttaactttgcaaactgagcattatgcatttttcactcttggtggttaatattgggaaagtgtctggtggtccttggggtttagggtgctgtctaaaacctagagctgcctggttgtggccagtttttgtttttaaccacgaattaagcttggatcattcagaacagactgacttactcatcagggatgcaaactccacacgcccaaagcagtctcgagtcttcagtcctgggtctcggcttctttctgtgtttcgcaggcactcacacccccgtgggcttggttctccaaacaagcccttatggaaaccaggccagatgtagggattaaagttcccgaatttcagcaaagttaaataataatagtagacacaaaacaaccaaccaacaccaaaagacataggtgcaaactatgctaatcccagcagtggagaggaacaggcctttgatgatgatggccctgatggatggaggacgatggaatgctctaaacacgaggcctcaggggacagccccggtcctccttgtcagagcctgctctagtttgggatccagcaggaacctcaggagcctccttcactttggtggagaggactgagactcagagcccccaagcgcaccttgggacggtccccacgcttccctagggtgggtctggggcaggcctggggcatttctatactgctgtttgggagagcgccccagacctagtgtcctggctggggcagatgaagccagggcgctctggctggtagaggcaggaggggaggccagccaggccccgcttgaccccgcattgacaggaaggagaacggacactttctttcaaggtgctcaaatgtcccacatcacttctgtgaaaacccaaacacagaagccacccctctcagctgctacaggccagaaatgaaaattactgcaatccccaggagcctgggaagacctctgctgacattccctatgaccactgtgacggtgcccccttcggctgcctcccccctccgtatggagagcgttccagccccaggctcccagcgcctgctcccagtgcctgctccccggcctccatcactccacgccccagggacctaaagtagaaagcttagttttctccttgtttgagtgcagttgggataatttttaatacattcctttttgctcttcatcaacttcaaatgtctcaagatgtcctgagggcaaaagagctgatttagctctcagattaaaagagagtggcctaacgcctcactcattttgaaatactgacattaacggggaaaattactcaagctctcctgttacttcctgtgcttaattaagtggctctgcaggtgactcactcccttatttttcagaatgacatcagacttattttccattttaatagcctggttacttcattgattttttaaaaaatccaatttcactttctagtgcaatttctttatctgattttttttctccacactaggaaatgctaactctcgtagtggtaaaacttcgacttacgaatgcctcaatttttttttgagtctagggccccaaatcagaatttaaagaagaaattagaggtgtaatctttatttgctaattacctaaataatttcacgaagtgttggagttgttaatattattaactattcctgagaaggggcccccggggccaccaaatgaatactttgtcttggaggcaggtctgtgtccctgcaagaagccacatctggctctcggcaccctccacacccacagaaatgcctccacttttgtcactttctccatcaatttgagaaggatgattccaaattcagaagcttgttttgagctcattcaatatgcatcaggtggcggtaacatctggaggtcagtttttcttgcagtttggtaaattctgttgtctaaagagagatgtgagaattgctcatcttcatataccacacttggcactcgtaggtttgtgaagcagcagatgcaaatgtttcacgtggtgcttggcatttatttattgtttatttgtttatattttgtttttggtttgtttgttgggtgtctgggctggccaggtgaacttcattttctgccctcactgagaggttttcctccattcagctctgactctgtttccccataggagccacaccggtgagggcagggagagggtgctggttctgagccaactttgcatggaaggcccagcagaccacgctcattacttacagccagcatcatcggggaactccggcacagacctgtagtcagtgccccacagcgccccagccttctctcccgacaggagtggccaggacagggagcagaaggtgactgctgtgctgcctggagctcttctgtccggaggcttagtgaaactagagaaactcagtggacacactacaagacttcagagatactttttgtaaacccaggaagaatcaaagatatgaaacatgcagtaggcactcactaaatgttaattttcttcctttttaaatatatgcattatgatagttaaattaatgactgcacgactggaagaatacacactctaatgattcttttccctaaaataaatgtgtccactatttgctgtctaccttcttgaacatcctgcttcctctaaataactaaggagattgattctacactaacatccagttgaagcaaagttgcgtcatgataaaatctggcatgggctatcccttcaaaaagttctttctgaaccatcatgaccataaattgcactaggcaggaggtggtgctggagggacaaagaaatgccagccagtccctgcactggagttgccagcaatcacacgggaaggcctctagtctagagagacgggtaggagagagacgggagcacatcagaggagcgcagatgctagtgcacgggttaaatagtctcttacacatctggttaagatcacctcaaattgctgtggggttccatagctctctacagcccaattccaagcttctgctctcactggattagttccacggatacatggtcctctgcattagctgggttctctatcttgggtgacatcaaacctagagatgaactctagcccctcactgatacctcacaactcagtctcagaagacatttttgcatggaacagactttaatgaatggtgggtgagggggtgcctgctattgaatgaataagtatggggggaattagtcacaggacttcatactgagcattagagtccggcgtctttgttcttggaagtcttcagctcccgcccggtccctgaggatcttcccccgactgcttgatcttgcatcattgccctccctccccgagggagcaacacagagcggccctagtccactctcatgatgcctccattaatcccccggtcagggaccttccagccctgcccacagcagtcgatgccttcagtgcatctcagtcttccacccccaaaagccgtggggggtctctgtgcgggatcacccctctcctaatacccctggtcccaggagatggggaggatggagacaaggccggtgtgggaatgaggtggcaggcttctcaggacatgagctgccttgctctgcccccttgggcctcatggaccccattctccctgctggagttgatgttctggcagactgggctgccccttggcccagttcctggaataccaagtaattaggtcatcatcggggcagcggaggccagcctctgatattctgcggcatgttacttgctcttggggcctctgtttattggggctacattgccctttctttgcacagctggctttgtgcttgctactaatttttttttaaactgaagaatccattgtttagagatcacacataaatggtaaattataaagaaaaacaagtggatgaccgacataaaaatcaggaggtttgctagccctggtgagggagggaggaagacaccatgtgagagaaacacaggaccgttttgtaagatgctgcttttttgttttgttgttttgttttgttttgtttagcattgggtgtggatactcaaatgttcatcttatgattattctttaaatcgttcaggtacattttgtacagtcttctgtatgtgtgatgcattttataatatgagtggtatatttcacaatcaaaaacacttttaagaagctcttttgccttggctaactctcgtttgccgtttccccagggccagccagcccggcggagcatggggaggacctgaatctgccccggcactgtcctaccctccacaacatgctcaagtcacatcctgtcctgctttccattgcctctggtcactgtcacttgccaacattctgaacatcccactgccttcaaccctccccacttgttcggcacaatatggaaagtgaaaaaaaaaatgagttgcagagagccttgcttccgggtttggaatccagctccatcttgagtctgtttagagaggtatgagtgctttctgacgtagggcacttatcactttagcacacagggggctgtgtgatggcccagtaagagcctgagctttggagttacagagcctgggccttctcaactccatccctcatgggtggtatagatggttcttccctccctgctttccctgactaggattaacttccccctgagcccaggacacttgttactcttgtgccctaaccttcacgtcatctttccaccatcttccatctgcagctttctcaggtcatccgctccatggaggtccccgttcctaccttggccttgcctttccccctgcatgtaaccttggtgaacttttcacaagagtctgcgcagtcttcttgtaagcagattaatgccgaggaaaagccttggtgaatgcacaccccacctaccacctccaaccttgcacagctggccggggcagtcggtgccaaggatgcctcatggcccttcggactctgaacctgctatgggtcccactggccagacacgtgctttccttttggaagtgcttgtctcaaacatagacgcattgaaccaaaccattgtgtgtgggctattggaaggggtgcacagattcatttgttggttgcagcaaatgcttggtttggcaaatgcttgagggccttgtggctggaatagctccactgcatgtctgcagatctgtcacgaggatcccagctcaggtgggagaggataggggctattggtcagactttctcaggccaccctattcccttcctccatgcaaggcagcgcggtatgaatgctttagatgggcctgggtgcaaatcactgtgtgatcttggggaagttgctcagcctgtctgagcctcagtttcttgaagcatcaaatgaggatgataatctctgtttctcagggtcagcaagggacttaagtgagaaaattgaggtaacccatgggcagagcacagggcactttgtgagcactcagtaggtgcaggctcctttctcctcccctctgcctttctctccccacttactcctgtcaagtaacttcacctctcagaaagcagcaaaaattgtccagtgtctccctcattcccaagacccccactggcccctcacccagtggcctctcagggcactcccccgtcctcagaagtcctatcccagcggagatggaatccacatagctggccctttcctccacacgaccctgccagctcaacccttccccgtatgattacgatttgtttctggttgtttaccatgagaagctcactgaagcaacgaaggcttcctaggtgcctctaaagaagcaaggtaaattttagaaccttggtttaaaaaaatgctgcgctgtgcagagaagcccgtggagagagccccgctggtgaggaagcacggggaccctgctgcagggctggtggagggctccttctgcagacttctgagcttggagcacagatgggcagcacacaggtgaaatgtgatcctctgtggggctgtgttttctgccccaggaagaaagaagagtcaacaacttaattatttcgtcatggttttgtacaaagcttgagaggaggaaaaaggttcccttttttgaataatagacaggagttacagcctgaagggagcctgctcagggcgggcagggctgctgctgtaccattggcatcagagacgtgctgctgtcccgaaggctccgccctcctctgactggctgctggccctggctcctgcactactatggccttttggctcaggtgcatccttcctggaggctggaactcatcccccgcccccggcatcacctccatagccagggggccacccaggaaacgcaagccaacatctggggaggccagccatctccaggcaagttggagaccaagagaattgtgtgaatttagactcttggtagatgctgcctgaccctgggctgcctggagcactgcatccctgttgcctggcacacagtagggttattgtctctgagtagctgggtgaatgtaggtcagagctgggaggcgctgtgggctttcatagtcaaggtcacatggctcattagggacagtgctcgaaacatttcagtagggactcaccattcagtcaacaaattttggttgagcatgtattatgtgcccgccactgcattaggagctaagagtacagtcaggaacaaaagagcattcagtgtactccagacagatgttaaacaaatacatagaagccaaattatgtacagtgctaagaggaatggcatccaggccagggcagggttctcccaggtggtggcatttcaggatgagtgacattgaccacgtggagaagtgagaagagggtctcaggtgagggagcagcttgtgcaaaggccctggggaggcccacactgcaggagctggggaaagggaaatgtggtaagaggtgaggaggagaaggacctgatggtgaggatatcacagtctgatttttattttttaaaggacaccttggttcctgcaaaggtgggaggggaggagaggggcattggtgagtccataggtgatgattgcagggggtggtggcttgtggtgccctgtcactcaccagatcagtgactgtggcaagcaactggcctccccaggctcagcttcctccatgtgacttggggacgcatgcttcacagcactgttgtggggcatatattattgcaaggggctggtgctgggagggagccaacactgccactcttcccatgcataccatcc

SEQ ID NO: 1296 - DNA, 767950 bp, Homo sapiens
agcatttgattcactatttaatgcaattaaaaaaagttttgttttaaaatttaacagaaatgataaaaccagcctaatgatctcagcagctgggtgtacgttgtaacatgacataatgtaatgtgaagataatcgcaggaaaataaaaatttaattttattttatatatcatcactttttttacactctcctttgtcactttaatggtaatctttaaacactctgtccttatgtaattcaatttgttattgccagcaaaaacctatgaaacattaagagtacagaaatattttaacacatgattactataattgattgcaaagatttgaataaataaaaatcgtgggattcataatggtagagagaaaggaaaaaatctgctttgcaaccattgcagttggctgttataactaactgttctgaaagttgataatgaaagggaaagaattaagcatttgccatattttttcaggaagacatgcagttcatctccatttgatgaaggaaaacttgtacttagagaagaatgccagctaataaatgtaaaaggaattgtagaattagaatatcaccattttgtaacctccattgcaataatggattcaaacaaggattgtaaatggatactaacacggttggttgaaagaatattaccatggcaccaacacatcaccctatggattacctggtaaatgtgaaggaacaaatgtacctctactttggagttatttgtcaatctccacctcaatcaagtgattgagtttagcataattagtagtgacatgaaggaatattatgtgcttctagctgtaatacagaatgaagtacgtgatgtcatctaagttttcttcccaaaaatatgaatatttagacctaacttcctgtttataggaaatataggcaatagagaattatattttaaaataccatgagataaggaaatagatagctaggaatggctaaagctttattattattattgttgtttatttatttatttatttgttttttgagatggagtcttgctctggcacccaggctggagtgcagtggcatgatctcagctcactgcaagctctgcctcccaggttcatgccattctcctgcctcaccctcccgagtagctgggactacaggtgcctgccaccacacccagctaattttgtttttatatttttagtagagctggggtttcactgtgttagccaggatggtctcgatctcctgaccttgtgatctacccacccacctcggcctcccaaagtgctgggattacaggcatgagccaccatgctcagccaagcttgataattattaaaactggctgatgggtattcattatcctattctgtttactttgtatttatttgaaattttccattataaaaagtttgtagtctacattctggtttctttaaaaaagtcacggagaaagaaaaaaaggtggggactgttctatattgaaagagactgaagagacatcaccaaatgcagtaatttttgatccttgttaaatgaactttgattgagtcctggttttagaaaactagctaaaaagatatttttggggaaaatttgggaaagttgaaaattactggccagtagctgatgttagagaagtattatttttttcttagggatgatgattttatggtttcataggagaacatctttatttttagaaaaggcatggtgaagtatttaggggtgaaatgtcatgatgtgtgtgcaatttatttttagacagtcagcattcccattccaaaaatcccatatgtacacaaatgcacacatacaaacaaatatggcaacattttcatgattgttggatttaggtgaaatatgtctgctgcattatttcaacttttcttactgaaaatttttataacaaaaagttggaggaagaactaatgcatttattgtagatgaattagggttgacaagaggttttggaggctttgactaatgttaagtttcatttttgtaaacgctgaaatctttgtatctggacactgcttcctcccactcctcccacctaccattaactatttcctggtgagtattgtattctaactatttattggaaaggataaactgaatcattattccaacatttgagggcatatgtgaaagcatttgtgtcctggagtgttgaagccagtgatctttttgatggtaatttttttcccatataattcatatagttagtatagatgtgaaaagtgcatttgatgatatccaagtagttctttgcttctatatcttcatcttaatttctccaagaatggttgcctgtttactagattccatggaagtgcagttagatacattatctcctttatcttaagatcacttgtaagtgtaattgtaagatttggaatttcagtcttttgatctggaaaatatattgttacttaatcttcttgctaatatggagaaagataattttctattttgtttatgaaataatatcaggtatatgtgactccgattttatctgttcattgttttacctatcctgcaagtatttttttttggttgttctttttattttttcatttattctttttgttttttaatagagatgggggtctcactatgttgtccaggctggtcttgaacccctgggctctagtgatcctcctggcttggcctcctaaagtgctgagattacaggcgtgagccactgtgcctggtcttctgcaagtatttagtctcactctgtttcagacattatgctggggctacaaaggtgaatgtagtttctgccattgaaggactcatagcctagaaaggagaacaaacagatcaactgaaatgctgtattctgaatgctgtataataactacctgtccacagagtgatgagagcccaaaggactgagtgccaaagggagggtttttcaaagaagatgctatttgtgttataaaatggtggcagaagggcattctaggcagaggaaatcatagcaaaaagaattatggaaaaagatgactttttaaacttcagaatggctgtacaaaaagagtgggtgtggagagatgcaagtggatgctggcaatatacagaccaaagggccttgtatataaaccaaggaatttggattttaagctgtgtgctgaagggagcttgccaaggattttaaaatggaagcgatcaattttgtgttttgagaagagattgctttgttagcaatatatatataggattgactggagaggagggagactgttgtcaggggcactattttgtgactgttcaggtaaaagattggtgccttggcaaagaaggggtgataaagcagagggagatgtggaaggggttagtgatctcttaggtatcagggataaaagagatgttaaaatatttacttttagaggctgagaggatgggatttcatgaaaggaagttgagactgtaatcggtgcattgtagattttggacgtttcaggttggagcacagctctcatgcatggttttcttcatgaattttcatttcttaaccattaaaatctcccacaactcagcaataaaacaaactacccaattaaaaaattgggcagaaggacttaaatggacatttttctaaagatgcacacatggtcaataagcacatgaaaagatgctcagcttcgctaatcattaggcaaatgcaaattacaaccacaatgagataccactttactaggttggctgttattaaagaaacataacaaatgttggtgaggatgtccagaaattggaactcctgtgcattgctgatgggaatgtaacatagctgctgtggaaaagtttggcaatttctcaaaaagttatacatgtagccaggcatggtggtgcatgcctgtactcccagctgttcaggagactgaggcaggagggtcacatgaacccaggagttctaggctgctgcgagctagaatcatgccttgcattgcagtttgggtgacagagtgagaccccatctcttaaaagaaaagttacgcttagaattaccattatgatccagcagttccagttctaggtatatgcacaattgaattgagagcaggaactcacaaatacttgtataccagtgttttcagcagcattatttatgacagccaaaaggtagaaacaacccatgtccactgacagatgaatggataaacaaatgtggtatatgctaacagtggaatattgtttagctttaaaaagggataaaattctgatacatgccataacatggatgaaccttgaaaacattatgttaagtgaaataaaagagatataaaaggacaaatgttgtacagtttcacttacatgagatacctagcacaggccttttcatagggaaagtggaatagaggttaccagagctcagggcattgggaaatggggagtattgtttaatgggcacggagtttctgtttgagatgaggaaaaagttctggaaatgtgcagtattgtacaagctcacaaattgtactaagctcatcaatttaatgttaatgccactgaattgtctacttaaaaattgttaaaatgttaattttcatattgtgtatatttgaccacagtttaaaaaaaaccacaaaatgctgttaaataataagtgattgccaagtatgtcagttaaagtttaatagcttttcctagtttatattttgtaagatgggcttttaagaaaaggaggagttaatttttctaaatactttttcaaaagtcagtctagagagagtctaagaataagatcaattgtttaatctagagattataaagtttgaataatctttagttttatataggatatagggtttagtatggtttgagccactatttgaatttttgctgcaaagtttctatctggtagattttttgattcttgtcttctctttttgtaaaatttatttttttaatttaaaattttaattcctatggatcttttcataaaatttaattgtaaacgtatttcgtctttccttatcatatttatcatttattactctaatttattttttcttattctttttgttcccatgattgtacatgttgagctgaggaggcaaagttattatgtagatgctattattattatttagatgccattagttaatagatgattatttagatataattttcttaggtaagcattttgttttgattttaggcactgtggtgtgacttcattatatcacaggataagtctgaaaaggcctacagtaagtttctttttgaaattttatttttcttatgatgattccaaatatttatctcattgtatttttcattcaaatgaagtagccactagtaatagtggtttaccataagcatctttatattgtgcattaaataatttgtgctgttaggattgaattcctttgagggaaaaaacatataagtcttgttgtaccctttcttttcaggtagcaatgaagtagaaaaatgcatatgtatattgcaaagctcatgtattaacatgcatagcatagaaggaaaggattacatagcttccttaccatttcaggtaaacaagtgtttcaaattttgggggggttttgttggagaacatttttgaattaattggttttagaggcatgtcttatgtctcatgtttcgtagtagtcaaaaatgttatttttactcaaaataactaaattttggcagctttagtggcttaccatttttctgtacttcacaaaaaaataagttatttaatgaagtaaattaggaagtcttctgtggtatgtgtttgttggtttaaatgatatgtaagaacttttggttatattaaataaggcatatgaataacaccagtctttttttgttactcatcgtctttttaatgcctaaggctattgttaacacattgtcattttgttactgatcctggccagtggcaggaatttcacattgaacaactcctctttattagatttgattttatcttagagttgcttatttgtattactttttaagaaaataccatatttaatgattatgttactttgtaaagctattactaaattggaaaataaaacattctgtaatgtttctttaaaacattttataaaggggtaggttctcttacttctatcttttcccacccttttacctgaaaggttgcaaatgtttggcccactaaatatggattgttgtttgaacgaagcgcttcttcacatgaagtacctccaggttcacccaggtattcattttattcacttcagaatattactgcttgggatttgtgtgtgtgtgttggttctgaggtttatctaaaagtctgagatgatgataattttcatgctgacagcatagatatatgccattttctctcatctcagtacaagttgagtatccctgatccaaaaacctgaaattctccaaaatctgcaacttgttgagctccagcatgacactcaaaggaaatgcttattggagcatttcaggttttggattctcatattagggttgctgtcatcaaaaagataatatgtcatgatcaaatgggttttgtctcagggatgcagggatggtttaacatacacaagtcaataaatgtgacacatcacataaacagaattaaaaaccatatgatcatctcaatagatgcagaaaaaagcattggataaaattcagcatcccttgatgataaaaacaaactaggcatagaagggacttaccacaaattaataaaagtcatatacaacaaacccacagccaacatcatactgaatggggaaaagttgaaagcattccccctgagaactggaagaagactaagatgcctactttcaccacttctattcagcatagtactggaagttctggccagagcaatgaggcaagtgaaagaaataaaggacatccagatttgaaaagaggaagtcatactatcactatttgctgataatatgattatatacctagaaaaccctatagactcctccaaaagacccctagatttgataaataaattcagtaaagtctcagattacaaaatcagtgcacacaaatcaatagcaccgcaatacaacaacaatgacaaagctgaaaatcaaatcaagaactcagtctcttttttttcgagacggagttttgctcttgttgcccagtctggagtgcagtggcatgatctcggctcaccacaagctctgcctcccaggttcaagtgattctcctgcttcagcctcctgagtaactgggattacaggcatgcaccaccacgcctggctaattttttgtatttttagtagagacggggtttctccatgttagtcatgctggtctcgaactcccgacctcaggtgatccgcccaccttggcctcccaaagtgctgggattataggcatgagccaccgcacctggccagaaattcaatcacttttataggagcagcaaaaagccaaaaacaaaaacctatgaatacgcttaaccaaggaggtgaatcatctctataaggagaactacaaaacactgctgaaagaaatcacagatgacacaaacaaatggtaacacatcccatgatcatggatttgaagaatccatattgtgaaaatgatcatcccgccaaaagcaatctatacatttcaccataattctcatcaaaatacgatcttttttttaatagagttggaaaaaacaattctaaaattcatatggaaccaaaagagcccaaaatagccaaaacaatcctaagcaaaaagaacaagtatgtagccatcacatatactgcaaggctataattaccaaaacagcatggtactggtataaaagtaggcacatagaccaatggaacagaatagagaaaccagaaataaagccaaatacttgtaatcaagtatttgatctttgacaaacaagcatacaaaaacataaattgggggaaggacatcttatttagtaaatggtgctgggaaaactgataccttttttagaagaatgaaattggatttttttatctctcaccttatacaaaagtcagttcaagagggatcaaaggctttaagccctgaaaccataaaaattccagaagataaccttggaaaaactcttctggacattggcctaggcgaagaatttatgactaaaacaacagaagcaaatgcaacaaaaacaataaataaatgggacctgattaaaataaaaagcttctgcacagcagaagaaatgtcagaatagacagatagttcacacagtgggagaaaatatttgcaaactgtgcatccaacaaagcactagtatccagaatatataaggaactcagatcagcaagacagaagctcaaaaagtgggtaaaggacatgagtagacagttctcaaaagaagatatacaaatggccaacaaacatgaaactgctcaatatcactaatcatcagagaaacacaaatgaaaaccacagtgagatctcaccttactctttaaggaatggccattattaaagagtcagaaaaacaatagatgttggcatggatgtggtggaaggggaatgcttatacactgctggtgggaacataattagtatgacatctatggaaaacagtatggagattcgttaaagaactaaaagtacgtctaccattcaatctagcagtcccattactgggtatctacccaaaggaaaaaaagtcattatatgaaaaagatacatgcacatgtatgtttattgcagcacaattcacaattgcaaagacaaggaagcagcctaagtgcccattgaccaatgagtgaataaagaaaatgtatatatacaccatggaatactaatcagccataacgaggaaatgaaataatgtcttttgcatcaggctggatgaaactggaggccataattctaagtgaagtaacccaggaatggaaaaccaaatactgcatgttctcacttccaagtgagagctaagcaaggagtatgcagaggctatatacagagtgttatgatggactttggagactcagaaggaggagggtgggaagaaggtgtgggataaacaaactacatgttgcgtacaacatacactactcaggtgacaggtgcactaaaatctcagaattcaccactacataattctgtgtcaccaaaagccacttgtacccccaaaagaattagggctgctcaactgttagtgtaaggtaaataatccaaaacacttatggtcccaagtatttcagataagggatactcagcctgtaagtatactcatgagctctacgcacttggcacttaattagccttttttcccaatctaagtggtaaaattgaatatgcaaataaatggcttcaaaaaagatttggccaggtacggtggcccacgcctgtaatcccagcactttgggaggccgaggcaagtggatcacctgaggtcaggagttcgagagcagcctggccaacatggtgaaagcccgtctctactaaaaatacaaaaaaactagctgggcgtggtggtgtgtgcctgtaatcccaactactcgggaggttgagacaggagaatcgcttgaacctgggaggtggaggttgcagtgagccgagatcatgcccctgcactctagcctgggcaacagagtgagactccatctcaaaaaaaaaaaaaaaaaaaagcagacttaatttacttgaagtagtttgtttcttccttttttaaaaaatgcattcctttgtcagcaggtatgggacacactgccagtaagagaggtcaataaaaaaagactgctttatacacattactccatttgttctgtactgtgatgactgctgtttgcagaaattctctggactatattgattttcctctgttggtgcattgatagaattactctcaggggagagatttctaggaatgaaatagaagacaatgtgaaaaatagtatgtacaaagttcagaagattgcattttgagatagtaggtttctagttgctcgtgtaatctggagatttcttttcaatagaagtgcaaaatttgtgcacagacatactcgtattggtaattaattgattatttgtttattgctagagaatctttacccactatgttcagcatgctgcacccactagatgaaataactccacttgtttgtaaatctggaagtaagtgtgcttctatattcttttagataagctcttttgtttttgttttttttttgactttggtgagggagattataaaggcgcttatatgaaaactgacttataaaaataatgtaatgtaaacatttcacaaaaataacttctattttgaatttcttgaatatcatggtattaactgctcaacagttattttagtaaaaataaggtatataaatcagtgaggaataccgatatatttattaacctacctgtagatgctttgttctttaatagttaataagtaaatgaatgatacttggatgaagtaaagtttattttttgttgttgttttgggtttttttttttgagaggggtcttgctctgtggcccaggctggtgtgcagtggcgcgatctcagctcactgtaacctctgcctcccgagttcaagtgattatcctgcctcagcctcccgagtagctgggatttcaggcacacgccaccgtgcctggctaattttttatatttttggtgcagacggggtttcatcatgttagccaggctggtattgaactcctgacttcaggtgatccacccacctcggcctcccaaagttctgggattacaggggtgagccaccgtgcccagctgctttttatcttctatattatgtcttggcagactgcaggccatgggctaaatctggcctgcagcatgtttttgtaaaacttgtgagctaagaatggtttttttttgtttgtttgtttgttttgttttttttttgttttttaagacagagttttgctcttgtgcccaggccagaatacaatggtgcgatcttggctcactgcaacctctgcctcctgggttcaagcgattgtcttgcttcagcctcccaagtagctgggattacaggcgtgtgccaccacactcagctaattttgtatttttagtagagacatagtttcaccatgttggtcaggctggtcttgaactcctgacctcaggtgatccacccacctcggcctcccaaagtgctgggattacatcatgagccaccgcacccaacataagaatggtttttaccttttaaagggttgtaggaaataacaaagattatgtgatagagtcagtatgtggacagcaaactgcactatttagtctttgatcttttacagaaaaagttcaaattttatgttgttactaattgcagacaacccgaataaacatactagggcctgggattaaatggcatgcagccttttttttttttttttttaagtacaatttccattttattttttctctggagaatagtctgtcttcaatctttttattttcattttgttttttttgagacggagtctcgctttgttaccaggctgcagtgcaatggcacgatcacagctcactgcagcctccgcctcccaggttcaagcgattctcctgtctcagcctccctagtagctgggatcaggggtgtgccatcatgcccagctaactttttgtattttagtagagatggggtttcaccctgttgcccaggctgatctcgaactcctgagctcaggcaatccacccacctcggcctcccaaagtgctaggattacagacatgagccaccacgcctcgccttgtcttcagtgtttaaggactcagctccttacatgggctttggtgggggttgtggggcagcactcctcgaaggtctaaatcggggtgggtgtgtttggtccttgtgggctttacaaggtggattcctgatgacttttctgtgaattgcacatctcacacagtaatttagcttcccatacagcttgggaagcacataggcattgaagacactcgcttcagaaatgtccctgactgctgcagcctccaccacatttcgaatgatgaattaatttctttttttttttttttgagacagagtctcactctgttgcccaggctggagtgcagtggcgggatctgggctcactgcaagctccacctcccaggttcacaccattctcctccctcagcctcccgagtagctgggactacaggggcccgccaccacgacccgctaatttttttattttagtagagacggggtttcactgtgttagtcaggatggtctcgatctcctgacctcgtgatccgcctgcctcagcctcccgaagtgctgggattacaggcgttagccaccgtgcccagcctcgaatgatgaatttcttaatggccttgtccttgggcacgcgtcaggcacagtttgtgcaacgaataggctgcatgtggctgcgcccctttttggcacgattgttgttccttcttttctttgtcttcttggaggcacggactggagggaggagtgcagccattattgatcatatttttgaataatatttagtgaactagaagttgcttatttgtaatgtcaagtaggatacaaaactttaacacagtatgattataattttgtaaaaatgtataaagtgtgtatatatgtatgaaaaaaacaaaaattctctaatgtattaatagtagatattttgagatggtggcatgatttttatttataaagtatttcttatgattataaaatcatattttaaaatttttcaatattttaactgaatgggaaacatttcctgtcaaataaggatatggagaccagtccatggtactttagattaaaagctgaactcactgggaaaaaccttattttgcatgtgtaactagtaaagcagaaacaacagtgtactgttcggcactgtctgaatagtaattatagagtacagctttcatacagaagaacagaaccaataaggaagtcaaacttggcagaatagttgagtgcaatttataaataagtcagttgaagaaatcatcgaccttttacctgtggctgattcgtgtaatggtgagagtcagcacaaatcttaacatttagcaacagcatgtatgtgaagctaaaacttgtaatgctctcatctttaatgtattttaaggaagttgatgcctaaagtaaatttattaaaaattcagagttaattatttaagatagtaatagatttcgtgctctctttggcttggttgttctttatctttaacaattttaagagctccgttcataaatatcagtcttgtaaagcccgttgttctatacctgatttttctattttatttttaaggtctttttggttcattacgggtgcaatatgttgtagatcatgcaatgaaaattgttttcctcaatactgacccctctattgtaatgacttatgatgctgttcaaaatgtgcattctgtgtggactctccggagagtcaaatcagaggtaaggagaaaggcaagtcacttctccttaacaggaaagggtaggctgggtgcactggctcacacctgtaatcctagcactttgggaggccaaggcaggcggatcacttgaggtcaggacgttcaagaccagcctggccaacgtggtgaaaccccatctataccaaaaatataaaaaattagccaggtgtggtggcttctgtaatcctatctactcgggaggctgaggcaggagaatcacttgaacctggaaggtgtaggttgcagtgagccaagatcgtgccactgcactccagcctgggtgacagaatgagactccatctcaaaaaaaaaaaaatgtatgtgtgtgtgtgtatatatatatatgtatgtatatatatgtgtgcgtatatatatgtatgtatatgtgtatatatatatgtatgtatatatgtatatatgtgtatgtatatatgtatatatatgtgtatatatatgtgtgtgtgtgtatatatatatatgaaagagtagttaatacttcataccctcacattttttttttggaaaaatcacttgtgaatagttgttttattattattatcatcatcatcatcatcatcatcatcatcatcatctctagagacagggcctcactctgtcacccaggctgaagcataatggcacaattacagttcactgcagccttgaactcctgagctcaagtgatcctcctgcctcagccttccgagtagctaggactacaagtgtgtaccaccactcccagctaatttttaattttttgtagagatgggatcttgctatgttgcccaggctggtcttgaattccttggctcaagctatcctctcgcctcaccctcccaaagtgctgggattatagatgtaagccacggcacctggcctcatttgagaaatagattgagcttcttaggaaagaagaaatactgtgtctttagtaactgacttcaacttgcattcttacaaggaaattgctattttattctaattattgtttttttttcctctttctctttattttgacttaaggaagagaatgttgttttaaagttctctgaacatgggggaaccccacggaatgtggccactagcagctccctcacagcacatctcagaagcctctccaaaggagattcccctgtgatttcacctttccggaattactcctccattcacagccagagtcgctcaacctcatcacccagtctacattctcgctcaccttctatttccaacatggcagctctaaggtagaagggtttcctggtttttctttctaagctttctgttttgttttgaaggatttagaattgctgttgacagctgtttttaggggaaatatatttaggggagttttttttaggggaaatagccattatcccaattgagaccttttttttttttttttttttttttgagacggagtcttgctgtgtcacccaggctggagtgcagtggcgcaatcttggctcactgcaaactccgcctcccgggttcatgccattctcctgcctcagcctccagctgggactacaggcgcctgccaccacgcctggctaagtttttttttttttgtatttttagtagagatggggtttcaccgtgttagccaggatggtctcgatctcctgaccttgtgatccgcccacctcggcctcccaaagtgtggggattacaggcgtgagccaccgtgctcagccctgagccagttttactaagatttctaagtttaccatgtcacattctttcctgagtcatattttgaagctgcctatgcttgtcctaaggttagttgcctcatttctaccactatgtgggcaacagtttgatgaatattaattcccaaaatattgtggcactattttatttttgccttaatttatgttagtttttcttttttttcttgttatttgatatctaaatgtatctatttctctatatagatatttatttaaatcaccagatatgtatatctggtgctacagggacattgttttgttgatatatatatgtctgactatacagggacatagtttagagctttttgaataatcattcattttccgaaaaagaagatgatctaagttttagttgtaaaagatgagttcttctaataataattctaaatctttagaatatagtaaagcacattgacatgaaccatttaaatagctactcctttttgaaaaattttaatttctgacctggattatgccatgaatgctcttctgtctgtggaattttgggaagtgtcattggagtgtgtgtcatataagcctgccctgctaactgtgatgtactctctcctctgtttcttttgcagtcgtgctcattctcctgccttaggagtgcactctttttcaggggtgcaaaggttcaacatttcaagccataatcagtctccaaagagacatagtatttctcattctccaaatagtaagtctaatggcttctttcttgcaccagaaacggagccaattgttcctgaactgtgtattgaccatttgtggacagaaacgattactaatataaggtttgttatatatattattatattcaaagaaaaatgttgctgaaagtcttgggaaatatatggcattttgtttaaagtttccttttaatgtgatcagttattaatatatgtaaaaatatatagagatatgtattaaggccacctcagtttcagtagaggatattaatgagattaaagtgatcataggctggacgtggtggttcatgcctgtaatcccagcactttgggaggctgaagctggtagatcacttgagcctaggagttcgagaccagcctggccaacattgtgaaaccctgtctctactaaaaatacaaaaattaactgggtgtggtggtgcatacttgtaatcccagctactcaggtggctgaggcagaattgcttgaacccaggaggctgagcttgcagtgagctgagatcgtgccactgcactccagcctgggtgacagagtgagactatctcaaaaaaaaaagtcatcataaaaatattattttgtcatctgatatttcttcctttatagtaataatctctcatttttcaggtgttttttgttctggggagaaacagttaatttctatccgtgaggaaatgtgggttttttagcacgtttcctaagttttatgttcatgttagttgagtgccagctttactttttgggaaacatagcttagatctctgttctgggtgacctttcttcttttatattctctttaataattcacgtgttaatttatatgccaatgtgtgtgctagttaacagtctaataagtcactgtccctgtcctcaaaagaggcagatagctgaaggatggtgacacaggagggactacttttgctggtagggctttgaaaaatgaacaggtatttgctaggcaggtaagtttagaaagaccacagacggcagctgggatcagaacaaaagttctggtgagtgcgtggtgtatttagggaattataaatactcccactctggtttttgcagaggggagggaaaaggctaatgaagaggaggcttcctaggtgcagtggctcacacctgtaatcactcactttgggaggctgaggcagatggatcacttgagctcaggagttcaagaccaacctgcccaacatggtgaaaccccatgtctactacaaatacaaaaattagccaggcatgatggcgtgcatctgtagtcccagctactctggaggctgaggtgagagagtcatttgaacctgggagttggaggttgcagtgagccaagagcacaccactgtactccagcttgggtgacagagtgagactgtctgaaaaaaaaaaaaaaaaaaaaaaaaggaggcttgagagattactgattgccctttaggcctctggtctgtttgatgacagcggtaagaaggcacttcataagtgtgtcggaagtttgggaaacagcagaacaataaatgtggaattgtcagcttataagtggtgattgaggtaagagaattagattagaattgaagaattattgtattcaataattgtgtgtacatgtagtatataggccttttcccaaggagagggttttaacagtccttagattctcaaagggatttgtggcctccaaatagttaaaatccagtggtgtagaattagaagagggctaggaactgaagtcctggaaacttaagatttggggaatggaaagagacaaagctggcgcagagagacaaagcaaaagaagtcagatgggagaagcagcaggaaatacagaatacaaaaaagaacatttcaagaatacagagatgccagtattgccaggtactggtgaagtgtggccctgagagttgaacccagagaggaggtacctgggtggcagtgggttccttggtgaccttggccagagcattttaagctgggagggtggcgggggaaagtggggtagaaaaagtaaatggggactgaggaaatgaacataggcatacagactctttaaggagtttgcctttgaataggaatgaagatacaaaattagagggagtcttggtcaaggagagttttgtttttgctgaactataataaaattagttttcatgacatcttgccccagtattttctttttctttttttttttgagacagggtctcactctgtcacccaggttagagtacagtgagtgactcaatcacagctcactgcagccttggccttctgggctcaggtgattccccaacctcagcctcccaggtagctgggactataggcacacaccgccacgcctgactaatttttgtagagaaaggattttgccgtgatgcccaggctggtctcaaactcctgggctcaagcaacctgcttgcctctgcctcccaaagtaatgggattacaggtgtgagccactgtgcctggcccccaatattttcttacctaaccacaatacaagttttatatccagtcaaattgagaaggtcttttatatactctaatgttgagtctattttatattttaagacttttaatgtgaaatagtaggctatacggactatactcaagggaaagtattgaaaatacagaagagaggaaacgattgatggaacaagtaaccagaaaggtgcacaagtggtgagattagcgttgggataaagaagtgaaggttgatcagatacgtaaggcaggaggttgagctcaagccttagagcctcattttatctgaaatggaaggcaaatgcataatcttagagagaatgaaatgggggataggtagtctgaagaaagtaaagatgtggatacaatgttgaagtagtctctctggcttgtttctcatatatcaaataaaagtatcctacaattatagatcatttttctttaaataacttatttgtaagttgaatatattatagactcttattttttagatttatgggtcttctgtagcactttatttatttatttatttatttatttatttattttttgagatagagtttcgctcttgttgcccgggctggagtgcaatggcccgatctcggctcaccacaacctctgcctcccaggttcaattgattcttctgcctcagcctcccgagtagctgggattacaggattactggctaattttgtatttttagtagagacggggtttctccatgttggtcaggctggtcttgaactcctgacctcaggtgatctgcccgcctcggcctcccaaagtgctgggattacaggcgtgagccaccacacccggccttctgtacactttagaaggaagggtttgggaattagagatacaatttcaaaaagagatgtgaatgaggtctaatctgagaaggagagggggtagataggagaaacagcattatgaaagatctggccctttgcgggataggaattcaagtttgcatgcattactttacaagtaggtggcttagtttgcattacaagtagggagcttagatagtatgtaatttaaaagttcatcagtaattgttaaatttattgtagctttccccagcaaagctgtgtaatgagctcataatcaaagaactgaaaggatcttagagatcatgaagtttaattcttagaaatgtttgtgtctttgagattattgcttgacctaagtagtttttagatttcttgcagaatattttcaaagactttttttttttttctctctctttttgagacggagtctggctctgtcgcccaggctggagtgcactggcgcgatcttggcttactgcaagccccgcctcctgggttcatgccattctcctgcctcagcctccagagtagctgtgaccacaggcgcccgccatcatgcctggctaatttattttgtatttttagtagagacgggatttcaccgtgttagccaggatagtctggatctcctgacctcgtgatctgcccgcctcggcctcccaaagtgttgggattacaggtgtgagccaccgcgcccggcctcaaagacttttaatagttactgtggtagattcttggaccagtgctgacagttactttattgatgtatctattatagagagaaaaattcacaagcctcaaaagtgtttattacatctgacctatgtgggcaaatttcctgtgcttttcagtggagtcccagctccagttatggtaggtgtatgtatttcccattgtttctgtataaataactcagcattgctttttctttttcttttctttccttttttttggcttaagtagttttatttagaaataatttacatgtcataaaattaacatgttttaactgtacaattaaatgatttttagtaaattacagtgttatacaaccatcaccatgacccaattttacaagatttatatcaccataaaaagatttccttgtgcttgtttgtagtcagtcttgttcccatttccagcctcaggcaaccatgctaggcttctgcctttatagatgagtttttctggacatttatatatatataatgtatgtacacacagtgtagctttttgtgtttagctttcacttagcgtgatgtttttaggatccaccgttttgtaacatgtatcattatttcatacctattgctatgtaatagtccattgtatagatctaccaccatgttttgtttatctgttcatcagctgatggacttttggtttatttccacctcttgactgctgagaattaggacagtatgaacatttgaacaaaggtcttgagcaaaaatgtggacatatgtgattttatttttcttgagtaaatgcctaggattgggtcattgggttgaatggtaaattcatatttaactttttaagaaatcaccaaactgttttccaaatagcctgtatcattttatattcccaccagcaaaatatgaaggttaatgtctctttatccttgacaggattggatatcatcacactctttgattgtagctattttccagtggttgtgaaatggctttaatttgcttttctctaatgcattctgatgttgatcatctcatgaagttattagccattcatttatcttcttaggtaaaatatctattcagatcttttgcccatttatttaccttcatattttgaaatacgatagatcacaggaagttacaaaatagtaaacaagtcctgtgtaccttgcattctttttccctcacaggtaacctcttgtacaactataatacattatcataaccaggagatagatgatgtacacactttatttcaaatttcatcaatttgacatgtactcatttatgtgtatgtatggttctatgcagttttttcacatatgtagatgtgtgtaaataccaccacaatcaagatacaaaacatctttatctgtcttacgttaactccttatagtcacatacaccattacccactgatcctggtaaccactaattctccatcttgataatttggcatttgtgaatgttttataaatgggctcatacagtatgtaaacttttgagattgtctttttctgttcagcataatacttttaatacccatacaggttgttgcatgtatcaagtttctttttattttattatttagctgtgtaaagtttcaagagagtaatgataaaacccagctcatctttgtttcagtgaccaacataccagcgaaggatgcagcaccagtggaggtaatgtaggcacatttgagaagttgacaattacgcttcatcagatttttcagtcaaaaaatctattaatttgctcaaatcgggaaataaatttttagtctttttttttttttttaaagaaaatagacaccatgctggtcttggaaggcagtggaaacctggtgctatacacaggagtggttcgggtaagcaataagtagcacttcatgcctttagtaggacttcaggctgcctgcatgaatatttgtaaagttactttagattgatattttaaatttgttatgttcctgtctgcacaatttggcagaagaattttgttaataattctcagtgaagcttcccatttaggtgggtcctaatttggagggctatggctcactgctattaaatgcattggtactctaaacctgtcacagatgggaaaccttcaatgagtataggtagatttttttttttttttaaagttaaactagttttgaaattgaagcatgggtacctttgaaattgaagcatgggtacctttggtaagtactaaagttttggtaaagtttcactatattaaatgtggtgtatgttagctgtattttttttttttttgagatggagtctcgctctgttgcccagggtgatctcggctcactgcaagctccgcctcccgggttcacactattctcctgcctcagcctcccgggtagctgggactacaggcgcccgccaccaagcctggctaattttttgtatttttagtagagatggggtttcaccgtgttagccagggtggtctcgatctcctgacctcgtgatccacccgcctcggcctcccaaagtgctgggattacaggcgtgagccaccgcgcccagctgttagctgtatttttttaacatttgtgaaatgtacatagagaatatacattttacaaatttaaattatgaaatttaaatacatacaatttgaataataataatgaagtgaatattcatctacccagtactctggttaagaaatagaatattgccagtatccttatttttattacattcttttctgattgcatcctatcttcccctgccctcgagatagacagaatcctgattttgtgataaatcagttgtttgtattactagtttttacagttatgtatgtatcactaaagaatgcattatttagttttccttgtttttgaatttttatataaaaaataccatgtactcgcctctgatgtacttattttgctcaacattatatttgttttagatttgtctgtgttgatgcgtactgttgtttactcattcagtgtgatgtatatattcaatagtattccatcgtacctcattttgtgctttgctttattgtacttcacagatactgcatttttttttttacagattgaaggtttgtggcaactttgtgttgagcaagtctgttggtgccatttttccagcagcatgtgctcattttgtgtcactgtttcaaatattgataattcttgcagtatttcaaacctttttgttattagtttatctgttatggtgacctgtgatcagtggtctttgatgttactattagaattcttttggggcaccacgaactgtacccatataagatgaggaacttaattgataaatgttttgtgtggtctgcctgatcatttgacccctttcctgtctctctctctcctcctgcctcactatatcctgagacaaaacaatattgaaattagaccaattagtaaccctgtaatggcctctaagttttcaaatgaagggcagaatcacaagtttctcactttacatcaaaaactagaaatgattaagcttcgtgaggaaggcgtgttgaaagctgagataggtcgagagccagaccacctgtgcacaagagccaacttgcgcatgcagaggaaaagctctcgaaggaaattaaaagtgctatttcagtgaacatggcaactgataaagcgaaacagccttatcgctgatatgaagaaagttttagtgtctggacagaagatcaaaccagccataacattcccttatgctgaagtcgaatccacagcaaggccctaactctcttcaattctgtgacggccaagaaaggtgaagaagctgcagacgaaaagttgtaagcaaacagaggttgattcttgaggtttaaggaaaaaagccctccccataacacaaaagtggaaggtgaagcagcatgtgctgatgtagaagctgctaagataattgatgcaggtggctacactaaacagattttcagtgtggatgaaacagctttctgttggaagaagatgccatctaggactttcataacctgagaggagaagtcagtgcctggcttcaaaggacagtctgaccctcttgttaggggctaatgcagctggtgacttaaagttgaagccagtgctcatttaccattccaaaagtcttagggcccttaagaattatgccaagtctgctctgcctgggctctataaatggagcgacaaagactggatggcagcacacctgtttatagcatggtttactgaatgtgttaagcccactgttgagacgtattgctcggaaaaaagattcctttcaaaatattaccgctcattgacagtgcacctggtcatctaagagctctgagggagatgtacaggagatgaatgttgttttcatgcctgctgacacatctgttctgcagcctgtgaaggagtaattttgactttcaagtcttactatgaaatacattacttaactagagctgccatagatagtgattcctctaagagatctggcaaagtccattgaaaaccttctgggccgggtgtggcagctcacacctgtaatcctagcactttgggaggccgaggcaggtggatcacgaggtcaggagatcgagaccatcctggctaacacagtgaaaccctgtgtctactaaaagtacaaaaaattagccgggtgtggtggcgggtgcctgtagttccagctactcgggaggctgaggcaggagactggtgtgaacccaggaggcagagcttgcagtgagccaagattgcgccactgcactccagcctgggcgacagagggagactccatctcaaaaaaaaaaaaaaaccttctggaaaggattcacctttctagatgccattaagaatattcatgattcatgggaggaggacaaaatatcaacataaacaggaatttggaagaagttgattccaaccctcatgggtgactttgaggggctcaaaacttcagtggaggaagtcactgcagatgtggtggaaatagcaagagaattagaattagaagtagagcctgaagatgtgactaaattgccaagatcttatgattaaacctgaacagaattgccaaacttgaacagaattgccaaaatcttatgatcaaacttgaagagttgcttcttctggatgagcaaagaaagtgggaacatacagaaaacaaacattaaatggcagatttaaatcccactaggccactaattaaatacaatggtctaacacaaataacagagactagcagaagagattagaaaatacagcccaactatatatgttggttataagaagtgttcttcaaatataatgacataggtaagttaaaggatggaaagaagatatattatgcaaacagtaatcaaaagatagctggagtcgctataaagtgggaaaaaaaaaatgaccaggaacaaagagagactttaaagggccaaatcaccaagaaggcacccttgagtattttgtaaatgtcagttcattccatttggttgataatgttgttcatgtcctctccaaccttggcaatttcttttcttctttttcgatacagtatctcgttctgttactcaggctggagtgcagtggtgggatcacagctcactgcacccatgacctcctgactcaagcgatcctcccacctcagcctcccaaagtgctgggatattacagacatgagccaccacatccagcctggcaaactttttatgtaggagttcagacaagtatcttagcctctatgggccgcatgcagtctctgttacatatttgtcttctgtttttttttttccttaaccatttaagtacataaaacctattcttagctcacagactgtacaaaaatgggatacaagccagatttggtcatggaacatggtttgctgaccaaggatctaaatagatgcagagaaatcatttgataaaatcaaatatccgtgatgaaaaaaaatcctcagcatcgagaaatagaaggggacttcctcaaatagacgagggacattcaaaattttcactgtgcctcctgatgaggaggaagggacggccatgacttttttcttggtgtttgcaaaaagtagggcagatatagtgaaaagtttctgtcctggtcggtcattcttttcccaacactttggctggaaagagtaagattttcttagggcgtgttttgtctgtgaacgttggcatgtctgtgttataggcactttgaaagcctgaggcctggttatgtaaggagtcaaaaaaaccagaaacctaggaaattcatcattaggtcattcctgggtctcaggttactagccagtttgtcttcttttcttcactttttcagaatcctctgttagttgcattataaattttattcagttttttttctttctggtgattaatgagggaatagcatggtatgtgcttattccatcttttcgtaaattaggggtttgagatagcttttaaaaaattatgcataattagttctcactgttattttgttttttaagcctaaggattttattggggcaacttctgttattttgttagctgttgagtagtgtgttaacatgaatatgtacgttgttaagatctcattttagttctgagcatctcctttttagtcttatcaagttttcagcctgtacagatgtgaatttctgtttttgctaagtaccctacagatagccaaaataaggagtggttagcacggattgtcaactcattcttttttttttttttgagacagagtttcattcttgttgcccgggctggagtgcagtggcgcgatctcggctcactgcaagttccgcctgctgggttcacaccattctcctgcctcagcctcagagtagctgggactacaggtgcctgccaccatgcccggctaattttttttttttaatttttagtagagatggggtttcactgtgttaggcaggatgctcttgaactcctgaccttgtgatccgcctgcctcggcttcccaaagtgttaggattacaggcgtgggccaccgcgcctggccgctgttcttactgtctttatgaccaataaggtagaagagtacatagtgtacagatttttatataatgtgttgactatattaacattcctctccttgccttccaaaaaagtcttcagtaatgaagagaaggaatccaaccaagagaaattataccaaggtatgagaggtctaggtgggcagatggcttcagcccagaagttcaagaccagcctggataacatggtgaaaccctgtctctaccaaaaaatacaaaattaaccaggcatagtggcatgtgcctgtagttccagctactcaggaggctgaagtgggaggatcacttgagcctggtaggttgaggctgcagtgagctgagatcatgccactgtactccagccacagggaaagagtgagatcttatctcaaaaaaaaaaaaagaaattataccaacatatttgcagttggatagtggaattcaatagattattgacatttgaattgtttctttgctgtgtttggtgagaataaacttagaaatatcaaaagaaatatatgtttatattccttaacattttatttaaggatgtgatgcattaaaggcagtattttttttttccacatgtttttattgcttaaaggtgggaaaggtttttattcctggactgccagctccctctctgacgatgtccaacacaatgcctcagcccagtactccacttgatggcgttagtgctccaaagcctcttagtaaactccttggatcattggacgaggtaagaaaaggactaggtgctgccaaaaagttaacattttttaaagaagtttggttaaatattagttctttccatggttaacttaattttagtttctacttgcagaataaatgttttcaaacagaagtgattcagttaacatacgctgacctcccttgtgatgtatgtgatactttttgaaggtgctggagagatggaaatgatacattcttttccatctagggatctcacaatcgtgtggagttgatgtactgtctgcataagaaattagaatttaagaaagactcatgactcagtaatgtggaaaagagagtaccatcgttgattgactgatgggaagataacatccaatgggaggacatggcaaaatcaaagcctcatctctgagagacatgtcagtcttcgtttggaccttggggatgagtaggatatctgtaggtagaaaggagcattcagggcaaggagaaaccacacaggcacaggcaggaaggccagataatgcggaacattttttaatggatatttgtatcttcatctcctagtcataaggactgaataaatctgtagaataaatacttataaaagtacaagtagtctgtagggtgaggcaggatagggtttggataacaataataaccttttttgagcattttctatgtgctaggcattgttctcagtgctttattggtaataattatttccttagaacagctttattgagaagatagtactatgattcttttttttacaaatgagatagaggttacaaatgaaataaacctactaagtggtagaactgggatttacactcttactaatgtgctcttaaagggagaaaggatgaaaaggtggttttcttctgaatgcaattgacagggcattacaggattttgagaaaggagttacgaggttttggatctgtgttgtaaataggtgtattttgggattcaagataaggagaccagttagcctccaagtgaggttgtctgtgtcagtttaagaagtatgaagagggtctgagctagggcagtatatgtgtggaaaggagggattaatatgagaggccttgagaggtggaaatgagtttgtcagctgattggttttgtgctgctgggctggggaaaggtgatgtggaaggaggctctgaattctctgaacgacctgggaaggtacctggatttaccaagttaggaagcctggagaaaagtggtttgtatttaaaggacatgtgagtgtggatgtttagggacggttcaaagggaaggttagtgctatctgttgtatttgataatgtctatgtcttcattatatttttaaacatgtgccacattgaattttttttccttcaaaccagcacatttgcagaacattcaaagggggaactggagaagtgtcagagtgttttgtgtgatttggaagaatttcttttataatggaaaatggtttccaacttttttagaattctataagcctggtaatagtgcctttttgataggtgtaaggtcatggaaatgatagtctgacacattggctgatggcttttccacttctctggaagattttgctagtagacttagagccaggaccagtggagctgaatttttcctggtgacttttagagtagaatctggaatagaataaatacatcttagtcttgattgtcagtgttgacaagatattcacttagagatatataaattgaattaaaggaatcaaaaaaggatcagtggtcatgactagagattaagattggaagcatctgcatgtagatagtaactaagaccatttaaattttttgtttgcatatctgcagttaagcaaataaatgctgttcctgtatttttgaataaataattgcctataggggaaataccactaaatcctggtctcatttgttggctttttcattactgtcctttcttcctgggctcttagttcctcagctgcctcaaatcacagtttagtcttttgttttttgttttttgtttttttttgagatggagtcttgccctgtcatccaggctggagtacagtggggcaatctcaccgtactgcaacctccacctcctgggttcaagcgattctcctgcctcagcctcccaaatagctgggactacaggcacctgccaccgcacctggctaatttttgtatttttagtagagatggggtttcaccatgttggccaggctggtcttgaactcttgacctcaagtgatccgcccacctcagcctcccaaagtgctgggattataggcatgagccaccacgtgccccggctcacagtttagtctttagccctgtaaggttgctaacagtgctgctggcttctctccctcttagctatgactttccttgcatattgtcagcctttccatatgttcctcttaccaccaaaatttgcagatggccagagcagaaaaagcaaggttctccaagaacgttggcccctttccctgcagttgccttctctcctagatcttggtccctcaagtccaggttgcttccacagcttttccacagccaccaatcagatgttttccttttacctaccttttctagctgtttcctgtgaggaccttggtttgctggtacttcattgtatctggaacaaaatgttttaaacagcctgggtcttgccgtgtcatccaggctggagggcagagactattcacaggctcactacagcctcaaattcctaggcttaagtgattctcctgtctcagtcttctgagtagctgggactatacaggtgtgcaccaccatgcttggcttggagcagaatgtttttgaatcattacatattattgtttgttagaccatatgcaaaaaagaaatagttaaatttccttgtccttaatttctcagaaaacaattcatttgtgttgtatttacgactttttacaggttctcctgttgtccccagttccagaactgagggattcttcaaaacttcatgattctctctataatgaggattgtactttccaacagcttggaacttacattgattctatcagagatcctgtccataacagagtcaccctagtaagtataaacatttggtagctttccaagaagtgggctggcatttcaaatttgacagaatacagaattttgtctgaaaaatgacaacaaacatttctcatgatttaaaaaaatctattgtgtcattttttggcactattttactttttactatacagtaattctgcttgttttctacagtttctgtattattaaaaacttagtgaaaacaaaagcttgttgagtcagttgaattgtaaattgatgtgattttttgtcgtctcattaaaagtaaatgtccttttgatgatggtgactcactgtataaagattagacactttttattaaaacaagcattttggaaaacattttgcaaataattacatttaaagtttctgaaatttggaagtgttcatttctgtttgaaaattgtttttcatttattttattgctttgatgggcaaagtcttgtaccagctatttttaagacattcaaagacttagaatgcacagattttatttactttctcatttgtttccatctaggaactgagtaatggctccatggttaggatcactgttcctgaaattgccacctctgagttaggtacgattgagaagtttcatttataagacatgaagtaattgtgatttacattaataattggggttttaaacattattttgccatttttgaagccactggatcaagttcttagctttgtagaggagccttaaagagctagggagtgctttgtgatgtccactctatgtgtgctctaaggctggagtacaggtgaaggatgtgctatttctgttctctgaggttcttctgttggggaatattgtgcagtataataatatatggacatgcctgctgggcatggtggctcactcctgtaatcccaacattttgtgagactgaggcaggtggatcgcttgaggtcggtagttcgagaccagcccggccaacgtggtgaaaccctttctctactaaaaatacaaaaatcagcggggtgtggtggtgcacttctgtaatctcagctacttgggagtctgaggcaagagaatcgcttgaacccagaatgcggaggttgcagtgagccgagatcgtgccactgcgctccagcctaggtgatagagtgagactcagtctcaaaaaaaaaaaaaatatatatatatatatatatatgtatatatatatatgtatatgtatatatatatgtatatatatatatgtatatgtatatatatatatgtatatgtatatatatggacatgcctcttgcaagaacatctgggaaactggaagcctaagcgactaagataattcttggcatatttaatgtttttttctgtaatgtattaatgatgtttttaattttaaaatgaatatctcaattttcagataaattgtgaaagtaacctaattgccttaattgaataaaacttaatattattgtcaaaatacaatcagaattatcttaataaatattggattctgcttgaattattcctgagatgcaatttcaaaaatgctagaggagaatatttctgaacatagcatagtaaacaaaatgttagaattgaagggatttgccaacaaacgtaggttaagaaaagaatgcctgtatgatataaggaagttcatgacatatcttggtttccaatctaactgccaaagcaagacattggcagattgtagacaagaataactttttcattttaggaattttcactgctggtaaatggtattccaagttgctatagagattccttgccttctaaaaggtatttcgtaatcacaaggccaggtacctagaagtatgataagcctaagcaaaatatataaaaacaaataataatggaagaaattaaataaataaaaacaaaaaatcttacccctttatagccaaatagaagccccatagtttatgcacataagtttatgtactttacctgcaaagggttctcacacactcatgcagcattgggtttacacttattttggattcagctatgacatacttggttatatggtattttaatattatttgcttccaacctgtgctgtgtgagtttgcatattgcaaactgacgggatagaggatatgctgatgagggtgggcccagtggcatgacagtggaaagggaaaaaagaatcctggaagagaggatatgtgagtacacaaacattgcagtttgggattatttactactaaaagcagatttgggtctcttcacagtggtagccctggccactctgaggggatcattgtatgacagtgtagtgctataattgatgtggagccactgagaatggtataaggccaggtgtggtgggctcgtgcttgtaatcccctccctttggaaggctgaggtgaggggattgcttgaggccaggagtttgagaccagcttggacaacatagtgagactcggtctctacagaaagaaaaataaaatcagccaggcatgctggcatgcatctgtagtccttgctacttgggaagcttgagctggtggaccacttgagcccaggagctggaggtgacagtgagctataattgcaccactgcactccagcctggggacagaggaagaccctgtttccacttaccaaaaaaagaatggtgtaaattatgtggtatcaactcttaacccttttaaggcagagagcatgtgaaacattttagaaactgaacgacatcagaaataaagttataaagctttggttaataggcatgttaagtcatttagaacatcatgtaatgctagctaagcattgctattcgtggatgcatatattgaatattatatatttactgaagtatgtaggcagtattttatataaatgtataaacatagaagttgtatgtttttcatagtgacttttttttttttgagacagttttgctgtagtcatccaggctggagtgcaatggcgtgatcttggctcactgcaacctctgcctcccgggttcaggcgattctcctgcctcagcctcctgagtagctgggattacaggtgcctgccacaatgcccaactaatttttgtatttttagtagaaatggggtttcaccatgttggtcaggctggtttcgaactcctgacctcaggtgatccacccgccttgacctcgcaaagtgcttagattacaggcgtgagtcaccatgcctggcccatagtgacttttaatttgtcacccgagctagaacatctttaagagtgaaggggagcagttagtaattgctaggcaatggatgtaaatcaggactgtctctggcaaactgggctatttggttactttatttctgatgcaaaattaatgatcaaaaagctgtccttggccgggcacagtggctcacacctgtaatcccagtgctttgggaggccaaggcaggtggatcatgaggtcaggagtttgagaccagcctggccaacatggtgaaacatggtctctactaaaaatacaaaaattagcctggggcagtggcagacgcctgtaatcccggctacttggtggctgaggcaggagaatctcttgaactcaggaggcagaagttgcagtgtgccaagactgcgccacagcactccagcctgggcaacagagcgagacaccctctcaaaaaaaaaaaaaaaaaaaagctgtcttcagacccctttcaagccctgttgaattcagtagttggttttagtttcagatgatgggttaggtaatgtttgcatctcattggctctttaatgacagttttcttttcataataattggcctttacatagtagaagttaaagaaacttggttattgaaaggggaaaagaaatgcatgcagagtaagaatactaaaattaatctttgcttttaatagtacaaacgtgtttgcaaacaattaagtttatcctgccaaaagaaatagcagttcagatgcttgtcaagtggtacaatgtccacagtgctccaggaggacccagttatcactcagagtggaatttatttgtgacttgtctcatgaacgtgatgggttttaacacagaccgcttagcatggactagaaatgtaagtaaatacaattgttttctttatgagttattctgttaatgtaatggttgcataattggtaatataacattgagactatataataggcgtaccatattcaaaataatagaataatattaaggtttattgtatctatatgttgtaaatcaaatctcacttaatatttaatgttaacattttactagtgattataattactgagctttagaatgttaaagcatatatgactatttctcatttcacctttgtaaaatgactgcaagttatgctaggattagtgatagtcttggttttattgatgaagaaactggatcacaaagaaatcacagatctgtgattttttaaaaactatgactagactgcatcttctgactccttgtttaacattgttttctgaagataagattgtctttttacacacatattgcttgggatgtgaagaggaaggtttgatttgagggagatttaaagtgctttagcctgagtatctactctgttaatggtagaaagccttacctctcaccctcttcccccagtaacatccttacaggcccttattagattatttacaaaatcagcagagtggtgtcttcagtattggtgatctccttctagctttggagatcactcccaggacaactttgcctgggtcactctgaaaaaaaatcactctagactataattaccccttttccaggtagctcagctgtaccattctatatgttttagccttgcacaccaaatccttttttttttttttttttttgagacagaatgtcgctctgtcgcccaggctggagtgcaatggcacaatctcagctcactacaggctctgcctcctgggttcatgccattttcctgcctcagcctcccgagtagccgggactacaggtgcccgccaccacgcccggctaattttttgtatttttagtagagatggggtttcaccatgttagccaggatggtctcgatctcctgacctcgtgatctgcccgtctcagcctcccaaagtgctgggattacaggtgtgagccaccgtgcctggccagcaaatccatttttaaaacttgttttttgtcttaattatgaaaggaaaatgtggaaaatggaggaattaagaaaataattatactactcagagataaccactctaaatatttttgatgttaccttctatataaaaataccaatgaaaatttcccgttatcattaaaaattttttctaaaatatctccatcatttcttcatagtgtagttttatcataattaaccaatagctaataattgtaccttgtgaatctgttgttttcgttattggaatttataaacatcctttttcacgactctttaaccacatctctagttacttcccaagaattgaatcttaaaagagaaactgtgaggtcaagtaatgtttggaaaggggttcccaggtgacattcttactagcatcatttaaaagcgcccatttcaccacagtgtttatttgtggtgtggtgaacctttgccagcttcctgagaaattttatcttatttctctataagtaaatgggaatggttttttcaaaatttcatcagttatttatagttcttattttttgattcgtatttcatgtcctttgtctatgttccagtctcttctcagaccagtggccaaagtaatcctgtttgataacgtcaggttgcgttcgtcacgcctctgcgtagaatcccccagtgacttcccatgtcactcagagtaaaggccataggcctataagatgccatgtgacctagcccttgctcaccttcctggtcttatttcttaatgctttgcacacatcatcccggccacattggcctcagctctgttccctgagcactgccagcatgtttctgcctctgagtgtttgcacttgccattacctctatggagaatgctttccctccgacaagacgtgcttaggtctttattcagatgtcacctcagtgctgcctgtcctgtctctctctatagaattacacctgcctccatacctttagtgccatttacctgtttttctttcttctcacttaattaaatataatatactatatgttttacttattttgttttgtatccctcctcccccaactggaatgtaaattctaggaaggcaaagatttttgcttagttttgtttactactctctctctccaggacctgtggtattgcctggcatagaaggatactcagtgaacatttgttgagtgaatgccgttttccatctgagtgaggtactgtttttaagagtttgtgtctatttcagcacatgaaggaattgctgtctgcaatttcctttagaaaaatcttatgggaaaatagggacaattttcttttcttttctttccttttttaagacggggtttcactctgtcgtctagggtggaatgcagtggcgctatcctggctcactacagcctctgcctcctaagttgaagcgattcttgtgcctcagcctcctgagtagctgggattacaggcatgcacctccacgcctggctaatttctgtatttttagtagagacagggttttgccacgtgggctatgctggtttcaaactcctgagctcaagtgatcctcccaccttggcctcccaaagtgctaggattaccttcttttcttattttaaacaattgtatccaagtgacattatccccaatttttctgttctttattacatgtgaaaagattaagcctcatagaaactggatttctacattatgaaaaagcatgtcagctttctgtagttttgtgtatcattgtccttggaacttgttgatgagtacagattgttgtgtcctagtctctggcagagaacctatgccccctcgcgtttccatgttttggggaggactgagcacctacccattttttcctttgcaaagaaggacatggctctttgacttacttattgcatgataattataaaggaaggaataaggaaatcaattcttgaggccaagttgctttgccatttatttataggactgcgtggttaaacccttgctatcttttgtcctcatagtcaaagcttaggatgaaatggtcctcattggcaaatggttttcattttgctttgttcagatttattctttttgttttcacatatataatgtggtggagtacagaatttctgccaatgactcgttacacaatttttggcatttctttgtgctttctttaatttgctgatgtgttacatgagtgcactggactgtacattgtaggaacagttgcatttggggttaactttttgtggcttttgggctgctctttttttcattagataaatattgaatccctgctgtgggccaggcatgatgccaggtttctcacatataccccagacaaaacagattgttcctctggaattgactgtcttgagggaaacaaataaataatatttgatacatgtgttatgatagatgaagggtaagggtccataggagcatataacagggttggctaacctgagacacattgaaagagtgaagattaaacagatccatgtatggcacaaagagccatccttatcaggcagtttctactttctcataactccaggccttatgaatctgataattatagcagggacattctttttgactgtgggactttgtgtgtgttacattttggttgaagttttaggttagatagttactgttatatttgttgctttgatttcactgttactaccaggttttttataatatatatgagttgggctgttttttatttgaatgcttcacaagcaaatcttctctctcaataacattcggttttaaaaatcactttattgctacctatgtttagtttttatatagaaatcaactctgtttaggtgagtgagttgataaatatgtaagtttttcagcataggaaaatagccattgccatttatagagttacagtttattagttgatggtcaatgtccatgtgaagtagctggggcagcaaagattatgccaggggaaattgaagaagagcaacttgcagaaaactgctttgatgtagttgtactagttaaaagataggctcactattgtaatagaaaggcctcaaaagatacaatggctcaaacacaataaaaatgtctgtcttgtttacataacagggcttagcagataaacaggccacacagttattcaggaacccaggttgatggaggatcttttgtcttcggttcaaagcttgccgttggttgactgcattccagtcaggtggaaggggcaaagagcctggaggagcaggggtaggactggactggtcctggaagtgatgacagtgacttccatttataattaactctgtcaaagggtcacacctaacttcaaaggaggcagacgtatgtatgtagtctggctgtgggttcagtagaaagaggagaaaaaagattttccagagtagctacttgtctctgccatagaattgttagatagtttactgtaggtggactgtaaataaatgtttgcttagttctaacatttgactgatattgggttgatcctttgagacttggtatattgtggatatgcctaaagtttctttttctaccaaagatgtgatgtaatctatgtcgttacagaagtaggagagggaaggaaactaccattaaaatcagtccttaggagcccaggcactgttctagatgtttgcatatattaatatgatttcatttcatctttacagtaacctggaagaaagatatttaaataatgactttccagatcaaaaaatgagttttgatggcttttctcagttttcataattggcagaactgatttccgaatcctttaagttgatcagttgacaggaatgcatttatgatttttatcttttcttttggggttacttttcagtttgactttgaaggatcactttcccctgtcattgcacccaaaaaagcaaggccttctgagactggatctgatgatgtaagcattattatttcttgctaatataaattaatttatggatattcatactattcttccacttctgtggtattcctatcaattcctctatctttccaacacctttcactttatttattttaatactgaatagcaattattttgaagagtaggatctgttacattttctagggtctttaatgattatccaaaaattaatgtatgtattactgcatgatttcagtttgggtttgtagacattttattatcaactgatcacctgaaatgacagcatttaccttttttatgcagtgttttttaaattaaggttctcaatcgtatcaggttccatggtatattcctttttttttttttttttttttttgagacggagtatcgctcttgttgcccgggatggagtgcagtggcacgatctgagctcactgcaatctccgcctcccaggttcaagcagttctcctgtctcagcctcctgaatagctgggattacaggcgcccgccaccatgcccggctaatttttgtagttttggtagagacagggtttcaccatgttggccaggctggtctccaactcatgacctcaggtgatccgcccgcctccgcctcccaaagtgttgggattacaggcgtgagccacggcgcccggcgggcaagacaccctcagagcacagggtgctgccaagagcccggccgagtgcagctggagcgccgacgtcgccaaggatacacagtgctgacgcagtacacaagtgcgtcacagtggtcctccgccggctacgtcagtggctttcaggcgctttcctgttggaattggcgactgctgcggggctgagcgctggtttcacgcgtctcgggagccaggttggcggtgcgatgaggcgcagcaaggcctacggggagcggtacctcgcctcggtgcagggctccgccccgtcgcctggaaaggtgagtggatctcgaagagaccgacggcctcgacctggcggggcggtggcctcgacctggccgggcggcggcggcggcctcggcctcggcctggccgggcggcggcggcggcggcggcggcggcggcggcggcggcctcggcctcggccccggcctggccgggcggcggcggcggcggcggcggcggcggcctcggccccggcctggccgggcggcggcggcggcggcggcggcggcggcctcggcctcggcctggccggacggcggcggcggcctcggcctggccgggcggcggcggcggcctcggcctggccgggcggcggcggcggcggcggcctcggcctcggccttggcctcggccgggcggcggcggcggcggcggcggcggcggcggcggcctcggcctggccgggcggcggcggcggcggcggcggcggcggcggcctcgacctggccgggcggcggcggcggcggcggcggcggcctcgacctggccgggcggcggcggcggcggcggcggcggcggcggcggcggcggcggcggcggcggcggcctcggcctcggcctggccgggctgcggcggcggcggcggcggcggcggcggcggcctcggcctggccgggcggcggcggcggcggcggcggcggcggcctcggcctcggcctcggccttggcctcgacctggccgggcggcggcggcggcggcggcctcgacctggccgggcggcggcggcggcggcggcggcctcgacctggccgggcggcggcggcggcggcggcggcggcctcgacctggccgggcggcggcggcggcggcggcggcggcggcggcctcgacctggccgggcggcggcggcggcggcctccacctggacgggcggcggcggcggcggcggcggcggcggcggcggcctcgacctggccgggcggcggcggcggcggcggcggcggcggcggcggcggcctcgacctggccgggcggcggcggaggcggcggcctcgacctggccgggcggcggcggcggcggcggcctggcctaaggtacttctgttggggaatattgtgcagtataataatatatggacatgcctgctgggcatggtggctcacacctgtaatcccaacattttgtgagactgaggcaggtggatcgcttgaggtcggtcgttcgagaccagcctggccaacgtggtgaaaccctttctctactgaaaatacaaaaatcagcggggtgtggtggtgcacttctgtaatctcagctacttgggagtctgaggcaggagaattgcttgaacccagaatgcggaggttgcggtgagccaagatcgtgccactgcactccagcctaggtgatagagttagggttagggttagggttaggcaagacattggcagattgtagacaagaataactttttcattttaggaattttcactgctggtaaatggtattccaagttgctatagagattccttgccttctaaaaggtatttcgtaatcacaaggccaggtacctagaagtatgataagcctaagcaaaatatataaaaacaaataataatggaagaaattaaataaataaaaacaaaaaatcttacccctttatagccaaatagaagccccatagtttatgcacataagtttatgtactttacctgcaaagggttctcacacactcatgcagcattgggtttacacttattttggattcagctatgacatacttggttatatggtattttaatattatttgcttccaacctgtgctgtgtgagtttgcatattgcaaactgacgggatagaggatatgctgatgagggtgggcccagtggcatgacagtggaaagggaaaaaagaatcctggaagagaggatatgtgagtacacaaacattgcagtttgggattatttactactaaaagcagatttgggtctcttcacagtggtagccctggccactctgaggggatcattgtatgacagtgtagtgctataattgatgtggagccactgagaatggtataaggccaggtgtggtgggctcgtgcttgtaatcccctccctttggaaggctgaggtgaggggattgcttgaggccaggagtttgagaccagcttggacaacatagtgagactcggtctctacagaaagaaaaataaaatcagccaggcatgctggcatgcatctgtagtccttgctacttgggaagcttgagctggtggaccacttgagcccaggagctggaggtgacagtgagctataattgcaccactgcactccagcctggggacagaggaagaccctgtttccgcttaccaaaaaaagaatggtgtaaattatgtggtatcaactcttaacccttttaaggcagagagcatgtgaaacattttagaaactgaacgacatcagaaataaagttataaagctttggttaataggcatgttaagtcatttagaacatcatgtaatgctagctaagcattgctattcgtggatgcatatattgaatattatatatttactgaagtatgtaggcagtattttatataaatgtataaacatagaagttgtatgtttttcatagtgacttttttttttttgagacagttttgctgtagtcatccaggctggagtgcaatggcgtgatcttggctcactgcaacctctgcctcccgggttcaggcgattctcctgcctcagcctcctgagtagctgggattacaggtgcctgccacaatgcccaactaatttttgtatttttagtagaaatggggtttcaccatgttggtcaggctggtttcgaactcctgacctcaggtgatccacccgccttgacctcgcaaagtgcttagattacaggcgtgagtcaccatgcctggcccatagtgacttttaatttgtcacccgagctagaacatctttaagagtgaaggggagcagttagtaattgctaggcaatggatgtaaatcaggactgtctctggcaaactgggctatttggttactttatttctgatgcaaaattaatgatcaaaaagctgtccttggccgggcacagtggctcacacctgtaatcccagtgctttgggaggccaaggcaggtggatcatgaggtcaggagtttgagaccagcctggccaacatggtgaaacatggtctctactaaaaatacaaaaattagcctggggcagtggcagacgcctgtaatcccggctacttggtggctgaggcaggagaatctcttgaactcaggaggcagaagttgcagtgtgccaagactgcgccacagcactccagcctgggcaacagagcgagacaccctctcaaaaaaaaaaaaaaaaaaaagctgtcttcagacccctttcaagccctgttgaattcagtagttggttttagtttcagatgatgggttaggtaatgtttgcatctcattggctctttaatgacagttttcttttcataataattggcctttacatagtagaagttaaagaaacttggttattgaaaggggaaaagaaatgcatgcagagtaagaatactaaaattaatctttgcttttaatagtacaaacgtgtttgcaaacaattaagtttatcctgccaaaagaaatagcagttcagatgcttgtcaagtggtacaatgtccacagtgctccaggaggacccagttatcactcagagtggaatttatttgtgacttgtctcatgaacgtgatgggttttaacacagaccgcttagcatggactagaaatgtaagtaaatacaattgttttctttatgagttattctgttaatgtaatggttgcataattggtaatataacattgagactatataataggcgtaccatattcaaaataatagaataatattaaggtttattgtatctatatgttgtaaatcaaatctcacttaatatttaatgttaacattttactagtgattataattactgagctttagaatgttaaagcatatatgactatttctcatttcacctttgtaaaatgactgcaagttatgctaggattagtgatagtcttggttttattgatgaagaaactggatcacaaagaaatcacagatctgtgattttttaaaaactatgactagactgcatcttctgactccttgtttaacattgttttctgaagataagattgtctttttacacacatattgcttaggatgtgaagaggaaggtttgatttgagggagatttaaagtactttagccgagtactataccatctactctgtacttataccatctactctgttaatggtataaggccttacctctcaccctcttcccccagtaacatccttacaggcccttattagattatttacaaaatcagcagagtggtgtcttcagtattggtgatctccttctagctttggagatcactcccaggacaactttgcctgggtcactctgaaaaaaaatcactctagactataattaccccttttccaggtagctcagctgtaccattctatatgttttagccttgcacaccaaatcttttttttttttttttttttttttgagacagaatgttgctctgtcacctaggctggagtgcaatggcgcaatctcagctcactacaggctctgcctcctgggttcatgccattttcctgcctcagcctcccgagtagccgggactacaggcgcccgccaccacgcccggctaattttttgtgtttttagtagagatggggtttcaccatgttagccaggatggtctcgatctcctgacctcgtgatctgcccgtctcagcctcccaaagtgctgggattacaggtgtgagccaccgtgcctggccagcaaatccatttttaaaacttgttttttgtcttaattatgaaaggaaaatgtggaaaatggaggaattaagaaaataattatactactcagagataaccactctaaatatttttgatgttaccttctatataaaaataccaatgaaaatttcccgttatcattaaaaattttttctaaaatatctccatcatttcttcatagtgtagttttatcataattaaccaatagctaataattgtaccttgtgaatctgttgttttcgttattggaatttataaacatcctttttcacgactctttaaccacatctctagttacttcccaagaattgaatcttaaaagagaaactgtgaggtcaagtaatgtttggaaaggggttcccaggtgacattcttactagcatcatttaaaagcgcccatttcaccacagtgtttatttgtggtgtggtgaacctttgccagcttcctgagaaattttatcttatttctctataagtaaatgggaatggttttttcaaaatttcatcagttatttatagttcttattttttgattcgtatttcatgtcctttgtctatgttccagtctcttctcagaccagtggccaaagtaatcctgtttgataacgtcaggtagcgttcgtcacgcctctgcgtagaatcccccagtgacttcccatgtcactcagagtaaaggccataggcttataaggtgccatgtgacctagcccttgctcaccttcctggtcttatttcttaatgctttgcacacatcatcccggccacattggcctcagctctgttccctgagcactgccagcatgtttctgcctctgagtgtttgcacttgccattacctctatggagaatgctttccctccgacaagacgtgcttaggtctttattcagatgtcacctcagtgctgcctgtcctgtctctctctatagaattacacctgcctccatacctttagtgccatttacctgtttttctttcttctcacttaattaaatataatatactgtatgttttacttattttgttttgtgtccctcctcccccaactggaatgtaaattctaggaaggcaaagatttttgcttagttttgtttactactctctctctccaggacctgtggtattgcctggcatagaaggatactcagtgaacatttgttgagtgaatgccattttccatctgagtgagatactgtttttaagagtttgtgtctatttcagcacatgaaggaattgctgtctgcaatttccttgagaaaaatcttatgggaaaatagggacaattttcttttcttttctttccttttttaagacggggttttgctctgtcgtctaggctggaatgcagtggcgttatcctggctcattacaacctctgcctcctaagttgaagcgattcttgtgcctcagcctcctgagtagctgggattacaggcatgcacctccacgcctggctaatttctgtatttttagtagagacggggttttgccatgtgggctatgctggtttcaaactcctgagctcaagtgatcctcccaccttggcctcccaaagtgctaggattacaggtgtgaaccatggctcctggccttcttttctaattttaaacaattgtatccaagtgacattatcctcaatttttctgttctttattacatgtgaaaagattaagcctcatagaaactggatttctacattatgaaaaagcatgtcagctttctgtagttttgtgtatcattgtccttggaacttgttgatgagtacagattgttgtgtcctagtctctggcagagaacctatgccccctcgcgtttccatgttttggggaggactgagcacctacccattttttcctttgcaaagaaggacatggctctttgacttacttattgcatgataattataaaggaaggaataaggaaatcaattcttgaggccaagttgctttgccatttatttataggactgcgtggttaaacccttgctatcttttgtcctcatagtcaaagcttaggatgaaatggtcctcattggcaaatggttttcattttgctttgttcagatttattctttttgttttcacatatataatgtggtggagtacagaatttctgccaatgactcgttacacaatttttggcatttctttgtgctttctttaatttgctgatgtgttacatgagtgcactggactgtacattgtaggaacagttgcatttggggttaactttttgtggcttttgggctgctctttttttcattagataaatattgaatccctgctgtgggccaggcatgatgccaggtttctcacatataccccagacaaaacagattgttcctctggaattgactgtcttgagggaaacaaataaataatatttgatacatgtgttatgatagatgaagggtaagggtccataggagcatataacagggttggctaacctgagacacattgaaagagtgaagattaaacagatccatgtatggcacaaagagccatccttatcaggcagtttctactttctcataactccaggccttatgaatctgataattatagcagggacattctttttgactgtgggactttgtgtgtgttacattttggttgaagttttaggttagatagttactgttatatttgttgctttgatttcactgttactaccaggttttttataatatatatgagttgggctgttttttatttgaatgcttcacaagcaaatcttctctctcaataacattcggttttaaaaatcactttattgctacctatgtttagtttttatatagaaatcaactctgtttaggtgagtgagttgataaatatgtaagtttttcagcataggaaaatagccattgccatttatagagttacagtttattagttgatggtcaatgtccatgtgaagtagctggggcagcaaagattatgccaggggaaattgaagaagagcaacttgcagaaaactgctttgatgtagttgtactagttaaaagataggctcactattgtaatagaaaggcctcaaaagatacaatggctcaaacacaataaaaatgtctgtcttgtttacataacagggcttagcagataaacaggccacacagttattcaggaacccaggttgatggaggatcttttgtcttcggttcaaagcttgccgttggttgactgcattccagtcaggtggaaggggcaaagagcctggaggagcaggggtaggactggactggtcctggaagtgatgacagtgacttccatttataattaactctgtcaaagggtcacacctaacttcaaaggaggcagacgtatgtatgtagtctggctgtgggttcagtagaaagaggagaaaaaagattttccagagtagctacttgtctctgccatagaattgttagatagtttactgtaggtggactgtaaataaatgtttgcttagttctaacatttgactgatattgggttgatcctttgagacttggtatattgtggatatgcctaaagtttctttttctaccaaagatgtgatgtaatctatgtcgttacagaagtaggagagggaaggaaactaccattaaaatcagtccttaggagcccaggcactgttctagatgtttgcatatattaatatgatttcatttcatctttacagtaacctggaagaaagatatttaaataatgactttccagatcaaaaaatgagttttgatggcttttctcagttttcataattggcagaactgatttccgaatcctttaagttgatcagttgacaggaatgcatttatgatttttatcttttcttttggggttacttttcagtttgactttgaaggatcactttcccctgtcattgcacccaaaaaagcaaggccttctgagactggatctgatgatgtaagcattattatttcttgctaatataaattaatttatggatattcatactattcttccacttctgtggtattcctatcaattcctctatctttccaacacctttcactttatttattttaatactgaatagcaattattttgaagagtaggatctgttacattttctatggtctttaatgattatccaaaaattaatgtatgtattactgcatgatttcagtttgggtttgtagacattttattatcaactgatcacctgaaatgacagcatttaccttttttatgcagtgttttttaaattaaggttctcaatcgtatcaggttccatggtatattccttttttttttttttttttttttgagacggagtatcgttcttgttgcccgggatggagtgcagtggcacgatctgagctcactgcaatctccgcctcccaggttcaagcagttctcctgtctcagcctcctgaatagctgggattacaggcgcccgccaccatgcccggctaatttttgtagttttggtagagacagggtttcaccatgttggccaggctggtctccaactcatgacctcaagtgaccttcctgaccttggtgtcccaaagtgctgggattacaggcatgagccactgcacctggcctccatggtgttattcttaagtggtccaaatatgtttttttaaattgtggtgtaatttacaaaaatgaaatacatcttgagtttacagtttgatcagttttaatatatgcacactcatgtaacctacactcctatatagacacagaatatttttataactccataaaatttccttgtgcggttttttttttttgagacggagtctcgccttatcgcctaggctggagtgcagtggcacgatgttggctcaccacctcctgggttgaagctattctcctgcctcaacctcctgaatagctgggattataggcatgcgccaccacgcctggccaatttttgtatttttagtagagatagggtttcaccatgttggtcaggctggtcttgaactcctgacctcgtgatctgcccacctcggcctcccaaagttctgggattacaggcatgagccactgggcctggcccctcttgctgtttttaatcagctttattctcttcttctagcaatcactgatctgaattctgtcaccatatcttagttatgcctgttctagaacttgatgtaaataaaataatatagtatgtaatctttggtataagatttattcagcataatgcttttgagattcattcatattgttacagatacccgtagtttgtgcttttttattgctgagtagtatgaatataccatagtttgtttatccatccttcttctgctggtagatatctaggctatttccattttttttttttaagtcatgaataaagcaagctactgccaaaattcactggcaagtctttgtggatatatattttctttttttgggggagggggacagagtcttgctgtgtcatccaggctggagtgcagtggcacgatctcggctcactgcaacctctgactcccaagttcaggcagttctcatgcctcagcctccccagtagctagaattacaggtatgcgccaccatgcctggctaatttttgtatttttagtagagactggattttgccatgttggccagcctggtctcaaactcctggcctcaataatccgcccatgttgacctcccaaagtgctgagattacaggtgtgagccaccatgcccggcccgtggacatacattttcatttcttttttaagagacggggtgtcactttttgcctacgccggactgcagtgatgctatcgtagttggctgtaatctcgaactcataggctcaagccatcctcctacctcagcctccaagtggctaggactaccggtatgctccatcatgcctggctaatttttaaatttttttggcagagacaaggtcttactataatatgttgcccaggctggtctcaaactcctgggctcaagcagtcctcctgcccctatctcccaaagtgctgcgattacaggcatgaattttaatttcttttaatttaatttaatttcttttaaattaaaattcacatctgtaattttaatttcttttaatttaatttcttttaaatgaaaattcacgcctgtaatcacagcactttgaggggtaggggcaggaggactgcttcagcccaggagaccagcctgggcaacatattatatagtaagaccagttgtctaccaaaaaaatttgaaaattagccaggcatgatggcgcataacctgtagtcctagctacttggaggctgaggttggaggatgttaaacactctttcatgtgctcattagctgcttatgtatctttttgtgaagtttctgttcaaatctttatcaacttgtaaattagattttaaaaaatttgtaagctggtgaagttcttacatgttctagacatgagttcttgaccatattttcccttagaatgtggctttaacagtgtctttgatgagcagaattttttattttagttatccaatgtatcagttttttattttattttattttatttttgagatggagtcttgctctgttgcccaggctgtagtgcagtggcatgatctcagctcactgcaagctccacctcccaggttcacaccattctcctgcctcagcctcccgagtagctgggattacaggcacccgccaccacacctggctaattttttgtatttttagtagagaccacgtttcaccatgttggacaggctggtcttgaactcctaacctcaagtgatccaccagccttggcctcccaaagttttgggattacaggcatgagccactgtgcccagccaaggatattctttttataacattttcaaaaattaaggcatattgtatatacaggaaaaaaaatgaagcctatgatttatatttacaattgctttgatttaatacaaattaaaatattactgtttatgagaatgagattctaaatgtaaatggaattcacagaatgcataatttttttctcgtttaaagaaatagagtctcgctgtatgcctaggctggtctcgaactcctgggctccagccatcctcccatttcagcctcccagagtgttgggattacaggcgtgagccaccacgcctggccttgtacatgttatatagtgaccattttgcacaagattgtttgccaaatgaataattaaaaaaatccatttagtgtactttcctttaaatattttcacacctggagttaaaacattgtattttataaaatgttattaatataaaaatacttgtaaataaacttgtggctatgtagaatgtagtagaggacttttgcataagcccagagcctagtttctaaaggtctttagaaatatataatagacatagaggggaaagagttgggggaaatcagagggaggtataattctggtctctcgtcgttcagttctttttcattcagttctctcaggcacgactccagccacttagttttatatttcaactggatgttgacccaattaaaacaattcacagctcctgaagatgaaatactatgagtccctgctttggacacatctgtagtagagtaggaaaagataaatataacccaagtaattgttacagaatcttctgaaatatacaaatggtaaaaggttttgtagggcgtgtactggggaaaaagataatttttcaacatgaaccttttaagagcttgtgagtctcaaagagtctttaattgataggtgatatggataatactcccctttgggaggaggtttataatacataaacaacctccccacccttccctcacagctttctgtcctgtactacaagaacaacaaaactccaactagtcagaattgcaagtggtttatggccccccatatagattgaaaacttgctaagagactgcactggagaacctgaaaggatgaggatggaaaagatgattatacttttcatttgcaacagggctttcatttgattctcacattaatcccatgtggtagttaattaaggtagtattacaaggttcagtgaattgtctgagatctcacaaatacaacctagataagaacccaggtattattattttcagtcttgcaatattattttcctacttgcaatattatcttcactcttcattaagtttgcacagcaaagtaatggaataagttctgggctttaatccttgagtagtttggaactgtaatgtgttacatttgagagagagcccttcattttgaataaaaccttggtactgttcctgatcttctaacttgggttaatgctcttcccattttcatgatttttttcatttgtgaaatgaagtagttgcactagatcattttcaattttccttcccacttaaatcagttttaattaaaaaaattgcagatgccttttctcagattggagtacactttttgctccacacaatatctggtgtgtaaattggtatgttccgtggagtaaatacctttcctgactagccattaacttacttctgattcctgaatccactaatttaactattgttgaaattactaaaggaaatttttctttagcaaatgtaaaaactcatatcaggtctcaggtttgatgttgtaaagcactctgactcttaggaagactctttttttcccccaacctctcataaacaaattatttcattcattataaaatttcattcattacattttcattcttcagacttgcagtgtttcctctctgctaagtatagtgttaaacactggcaaaagaactctggacacaacatcatgaacttgctctctgggatcttataatctagttgcagaagcagattggtaaatacatagtatagcacaagtactataatggaggcctgaactgagtgctgtgggggtacacagatgaaggcttctgggagacatcatggcataactagacctggaggatgaataaaactttggccaagtaaatacagagatacatgaaaagcatggataaatggcacaagtaggttcagggatgataaaagtgttagtatgtggagagtgtacaactattttggggaatggggaaacagattaaatttggggccagaccccgaaggatgtggggatcccatcaaagtcttttaagcaggagaatgatcagatgcattttttggtatactacctgggggataggaggaagtggactacagaaggggagatcagtagaaggaagacaagttaggaagcttttcagtcattttcattaaacatgaagcttaatacatattgttctaagatcaggaatacagcaataaagaaaaaaacttgctgtaatgaaacttacattttcttgggagagacagaaaataaacatgaaaaacagatgtgttcaatggtgataaagcagaaagggagatggggagtcaagtgcatgtggggagggtgtttagggaagcacttatgaaagagtaacatttgagcaaagagccctgatacaagacaacaatccagacccaagacatttgaggaaagagcatccatataaagggagtgggaggtagagaaaacctggaccaggaatgagcctggtatgattgaggaaaacacaagggatgtggccagagaataataagagaataaattagaggggtaataggcaattgtatagggccttgtgagccattgtgtggaccttggatttcactcttgagtgacctgggagctaatgggggattaaacagaggagggacaggatcctctatggtatatggtaaatgagtagtatggtaaatgaggtaaatgaatagtaaaaggaactgctgtggtaatttaggtaacagatgatgatggtttaggtgaaagtggttggattgtggatatggtttgattggtgttagaaccaataggatttagtggtggctggatgtggacaatgggagaatagaatgaaccaaagctattgtaaacgtctagaaatcagatgaggacttgacgaaaggcattggcaatgagaaagtagacaggcaccattcatgaggtatttcttagcattgatagagttggatataaatatctggaattcttagctgattgaaatgttagttgaaatgaatgataccactcaaggtatgtgtgtcaagaggtatggagaagagcacagaagtttttggaaaccaagggaggagaaaagaagggatagtcacagagcagtaaagaaaaataaaggttaaaaataggtcacaggatgtacattatcctaagttaaaatattttaaggtttgaatgaaagggtgctgcagggtttgcaaactggtgggcttcaggcctaaaatctgcctatactgttgtttttgcctgacagaatatcttaaaatatctgtatttgaaagcatttaaggcttgacttgtgctctacgctccacagtcttatcgttcatagtttcttggcaaactcaccactcaagctgtgcctcacttatttaggagatctgcctcactagggtagacattttaggtttatgactcttaagttttcacctggacagattggctaacaaaaagaacctcacaggtgggtgaccttgaattcaccaggtcatgccatcagttcagagcggccggagaactctgttctcttgtgcattgatgcccccggagttgtgaaacacagtggccctgcttcagttttttagatttagaaactggtcagtgtcagagcgatcagacacagaaatgttaattcatgttcaaaaataataaccaggctagcatttgtttagcacttgctatgtgacaagtactgttttaagtgctttacatgaattgtttaatcctcacaacaaccctgggaaataggtcctattattaggcgccctttctacagatgaggaaacagacaacagattggtaaatttcccaagatcacaaagtaagtcagtaggagctcaaagtaacctgactccagagcccacactctttttttttttttttttttttttttttagctggttcacgtctctttaatgagatcaaaggctcctgtgtatgtcttgcgggggtaaagctagcacagtcccccaatactgcccctctcctcagggctccagccctttcaggcagattctaggtaggcagggaggggccaaaaggaacgcaaggagttgggactagggctgtttctggtgggcaagtaacccatccaccctctcaaaactacttatgggatgtccccttcactggaagacagccccatgggaaagacctgcggtacagaatctgggggcagtgcacacggggagtagtcctccagatctggcagggtggcactaaccctcacctccttgactggctcagcctcaccggaggcaggacaagggcagagcttaataccggagtcgccagttaaacggcgatagcggcaggaggggggtgtgggggcaggggtcacccctgccccagactcaccctcctgatgagggagggcactctggtgggaggaaacaccttccacatttgttccttcaaaatgggcagggcagctggatgaggaggaacagcaggtttgttcactggaagcagtcaaggggcggcctggggcgacagtataaggcgcggaggcggggggcggggggtggtgcctgggcggtgaaccacatcctcgtaggctgggggcttgaaggtgctgaggaggcgaaggtcaagcagtgaaccggtagggaaaggaccagccccatggcatgccccatgataagccaacaagttgatttcacgctgccgctgctgttgttgcagcctgagtttagctcgtcggtggcggaaggcccaacagcagctaaagaggatgaggacagtccagagcagccagaaccaccagagctcatagtagtaggtgcagcagccagtctccccgcagcagtgaacactctcacagaggtagggctggttgttcactcctgggcacagctctcgaagctgctgttgcggcgcccgaagtgccccccaggcctcctcgctgccgttcccgctgctggcccgagccatacctccacctacagccccctgaggaccacagcctcctctaccgccagccgccccgcccctgccacctctgctgccactgccatggtccctgcccggcccatcttcgctgaggccaccatcactccgcggccggagcttccatccccagagcccacattcttatctgagcatatacatccccatcacaagagaacgccagtttattcaagtaaaataaggactagaaatttacatcagggaatgtattctttcactgtagaatgctgaatggaaaaccaaatttcaatagttgcctactgaacaagatcatgagataacaacaagggagttgattataaatgactagaagttttaaatggcatcgactctgataaagtgataatctcagctccatgatatactcgtcaagcagttacttacatcaatctgccttataggatatcctttctcctggttaatgcttatgtgatagtgttttgtacctttcctttttcactgctttcattactgaccaaactactcacccccatatttctggtagatatatttcttttcattgcatgttagtatcttaaatttagtcctatcttttacttgatcctccgtgcttgacttcctaatctatgttctggtttatgttttagttttacagttgagctttctgaggacattcttattcccagtatctttttttgggtggttgggttctgggaggtggtatttgactgctgctgatgtgtaccaaccaagacagtagtcattaagtgactaacaataatgatttcagcagattattactcttggcaaagagcaagctttctctattataaatgattttatatttgttttgtttttctttatttgtaatttgagttctagcttaacattattacttcagataactgttaatacattttcataaatcatacattcttgaatggcaaataaataaataatcaagttccaagtagtttctaaagagagtaaacattaaaagtaaacataaaactacataaaaatcgatcacagtctattcataaagttggtatgaaaataaagatcctagatttggaaccctcatgatactcaatattttacatatatcagagtttgtaatttccataacttcatttggtagttagacatatagacagagaagataataatatattcattatatatatatttatgtattatattcattatatatatatttatatataatattcatattatatatatatgtctataacatatagacagagaagataataatatattcattttatagtttaggaaacagacttggaagggcaaataacttgtctaagatgactaagcagctgagtgagaaccacagcctatctgtggcattcagtttcagccatctttcccttgcttcataaggatagttactctggtatcagttgctggattgggattttgggcatttataaatgtttttattttggatattactgaatcacagacaatttcatcttagttaattaaaaattcatcttacgtgacacttgtctaaatcttaaaatattaaaattttaatgtataaggatgttaataatctttatattttaagagactatgaagtcaagtctagctaacttagatctgtaagtttttagctatggaaagcaattctattgtgtacaagtttcagcctgtgaagggaattcattgaaaatgtatagagatcagaagaactaacacctttcttgcatggatttttcttgattattggcagttaacaataaaatgttattagatcactggtgcttctgtgtggggttgagttttttatgatatcttctgttagacccataagggaggctgtgagttgttttctacatccttggaatatataagatcctcttttaaaattatattttatataagcacatgaaaatggaatgaaataatgaattgacataggaattacctacatattttggctgtacatttagtgcacaaaatatcccttttttgaatgccaaatggccaagtgtgaaaaccaatatttgttaaagctggagcagaagtcggtatcatcatcatagagtaaacttctggcatatgtgaagatatgaaatgttatccctgaagttattataatttattctcagaaatattagtaatcttattttaagagtaggacattatagtgcagtaatgataattttctcagtgctgcctgttgctagattgttcctatgattgctgtcatgcacatacagacactaaattgagggtcactttccactgaagttagtggaatacaaaataggtggaggaactttcttcctctaacgtctttatatgtgtctgtgtttatatatacgtgtatgtatataaatatgtatacacatatataatatctggagcaaaaatgattatgttgtaagaacttttggaggttttcctcctcgtaaaattccgaagtggtagagttaacattctgcttttaatttatctacaaaaacatgtgaagaatccccaaataagattttctcatagaagattcatggattttgagtctcagaaaaaaaaggaagaaaaaaacttcatggtataaaacaactaaaaattaaatatagtctttagaaatgattttgtttagtataaataatactggtatgacaactgaatgcaattgaaattatgatataaaatttctattctgctttgtatttttcattaaagtttttataattgtcatctgaaaaaggatttaatattcttaaattcattagctaactctctcaatattattacactattatttgcctatttgaaaattgttactttctttcgtacataaatagcattcataatcattgtgacattttcttcttgcattaatgtacatttatacttcatctaattgagaaaattttaacatacaaagtgacacaaaaagattttcattccaagttttatgtaaaacacctaaaattggaaaatgaatattcagatactaagagtaaattttttttttttttttgagacggcatctaactctgtcacccaggctggagtgcagcggtgggatcttggctcactgtaacctctgcctcccgggttcaaattattcccctgcctcagcctcctgagtagctgggactacaggcccacaatgccatgcccggctaatttttgtattttttggtagagacggggtctcaccatgttggccaggctggtctcaaactcccaatctcaagggatctgctggcctcagtctcccaaagtgctggaattacaggcgtgagccactgcacctatatgacatacttgaaaaaatattcttgggccgggtgtggtggctcacgcctgtaatctcagcactgtggaaggtcgagggtggatcacctgaggtcagtagttcaagaccagcctggctaacatggtgaaaccccatctctactaaaaatacaaaaattagctgggtgtggtcgcatgcgcctgtaatcccagctacttggcaggctgaggcaggagaactgcttgaatccaggaggcgaaggctgcagtgagcagattgcaccactgcactccagcctgggagacagagcgagtctctgtctcaaaaaaaaaaaaaaaattctcactttctgttgttgttgtttgtttaatgattaatagacgatttatttaagcaagaatacatagtcatcattgccagacttaatatgacaggttaaatgttggacccaattttccttcccagataagtttttctttcctatccctgtcagttttgaaaacataataccagaagaagaggggcccaattccacacagagctcccaagagtgagtttttaggagtgggtctgaaattaggaaagacacttgctgatcttgcataggtccaaggaatcaaggcaggattttcgatgagccctcggcagttagggtaagcaggtttcagccaggctcttaatggtcaaccacttggcttgcgcctgctgggtttccgaagacatgtcctattcggctggtttgagggcatagtggccaggggtgaaggagtatactttgggaacgacatcttggcgacccagtgcacaactcacttttttttggaaacgaggttggctctgtcgtccagactggagtgcagtggcgcaatctcggcgcactgcaacctccgcctcccgagttcgggcgattgtcctgcctcagcctcccaagtagctgggactacgggcgcacaccaccacgcccggctaaattttgcatttttggtagagacggggttttgccatgttgcccaggctagttttgagctcctgggctcaagcgatctgcccgctttggccttccaaagtgctgggcttacaggcatgacactctgcctggccagatttttgttaccctgtttagatatgatggtaactgaatgatcatgcaatctctgaccatgtgacattcagggataccaaaaatgacttgagatgggccaaggcagaattggagaagcatactttggctgaatacttaggccaaagtataatttggaacatttcttttaaaaaatctactcccctatgcctcccagttgcagtaccttacaattacagttaatctagtagcagatacttgattgggatattaggtatttacagaccaaatgcccattgggatattactcggtaacaggcagtttcactctggttcattgtagattcatccagtaagcatttctagagaactgctatatgaaaatattgtggaaagtatcaactttttaaacttttgatgtcatgacacctagaagattattttctgatactcatattctaagggaattttattttctgagatttgtttctgtggaatttttagttccccagtctgcactgaaagcctaaatcaagaggataatttgaaaggtaatgaaagtaaatcaattctagcttagatacccaagagagtaaatgaaatataaaaataataacttttaaaatgtctcaaaaaaaagctatggtaagctaattctgtttggtttattcatgcaatagtctgtctctgcttatgacataaagtataatatattttaggaatagtgtggttttcttcatgatgtcaaacatacaagcttatggatatatttaaaaattcttaattttctagattaatgttcagcactacttcttccatcttgcattggatgggggcagataattaataattatcagatattttcttatcaaaaacaaatttgttggaaaaaaaattttttttttttgagatggagtctcgttctatcacccaggctggaggtgcagtggcgcaatctcggctcactgcaagctccacctcccgggttcacgctgttgtcctgcctcagcctcccacgtagctaggactacaggcgcatgccaccatgcccagctaatttttttgtatttttagtagagacggggtttcactgtgttagccaggatgctctagatctcctgacctcatgatctgcctgccttggcctcccaaagtgcggggattacaggcatgagccaccgcaccaggcctcaataaaatattttataaatacctttaaggaataatacaaacacaaccagagcttaaataaataaatgtaaatcaatctgcttgctggttaagtaatgagttcagtgtttccgcacagaaagtgggagagatagatgaagaagaaaataaagcttattacatgttgggaaggattctaggcactaagttcctttttttgagacagagtctcattctgtcgcccaggccggactgcagtggctccatcttagctcactgcaacctttgcctcccaggttcaagagattctcctgcctcagcctcccaagtagttgggactacaggcacctgccaccatgcctggctaatttttgtatttttagtagagatacgggttcaccattttgaccaggttggtctcgaactcctgacctgaagcgatctgcccaccttggcctccgaagtgctgcgattacaggcgtgagccactgtgcttggccagttctaggcattaagttataattggttcatttggggactcgaaattctccattttattttattttattttattttttctgcttttgtcacaaaagcacagacattgcttaacaaagaggtctgagacaggatatgaatgttaagctcagggacatagggtcaacacttttgagtgcacagactgggaacctggcagagttttaacaatcccctcccctattttcaccatcccttagtcctgtagaagtagagcagatgattacgtattcactgctgtatggcttattacctttgtaggaattctaactgaagggcttggcatttggcctgactgaatatcagaatccctttatttttcgttccattgcaaaataattttttgtgccatcagtgaaataacagctatgcagtggcatatacagctctggagaccaggcattagaagactgagacaagaataaccagaatgatgataaggagacactggaagtcactttagattgatgaccaaagatttccttattctgaccaggaggtcagatctcaagggtccttctgagtccacttttgattagccaaattgtcttttctttcagtttgactataggttagtcaaccttccctccacattcatcagggactgttagcaatatgtcatatttttttcttggtgtaccattaagcaatctaaagctatgctgttacctgtaaccacttggattaattattttagattagttggttatacttctagggctttatggctttatcttttcagtcagcattattaaccaagttttgatagctttttcaacttttgtaacccccatccagggagatcagtgtcctctcagacacttccaggtaagcatgatctcctggaagacatgagaagtctcttaaattgtctaattattacattggagctacataataactccaatatacctggagttattatgtgtatatgcaagttaggttctaatgaggcaaatataagtaaatatgttgttgattcaggaggtaaaaattaggagagccacgtgtagttttaaaaacaaaagaggaattacttgtaacagaagtaagtaagaaaggaattctcagttatctcttgggtagagataccttgcatagagttcagcaaaaattgcaaaggttgtcataggactatggaggccattaggctaattaaaatttataatattgcccatatatttgtactaagtctcattcctgaaggattttatatttgggttgaggctttgagaaattctaagactggcttgggcagtaaaacaaaccaagtaaaaattgccatggctgtaaatagtcaaaaaggggtaagctaagtttctgcaaactaaacaatttcagagggtgtaagaatgtattggataaaggatgaagataaaaagcactttggagactattgatactcatcagattttaccactgataatttttcaagaggaactgtttatgaaactataaagagaaaatggagatacaaaaagccatccaagatgtaaatgccgaaggccaagttttgagataaacagaaaatcacaaaaactcatgtcaggtggttcttccatggccccagtgtgagcagacagtattttccttgaggagaaatactagtttggtgggggtaaggtagggagttaaactttaaggattaatcaagagaactatacatatgctatttaggttgagggtaaagatcagagtaggcatgggcaacgcctagactcaatcaagttacctatcaagcaagctgacatattcagacaaagcaagactccatctcaaaaaaaaaaaaaaataaataaataaaaagaattccttcattattttgtcatgctttaaggcccaggacaggcctaggcaaaagttttgatggccttttgttacatcccagcctttgtataagggcactggcttttagtatttaacttcattcagtcattactgaaacagttgttatggaagtctgcattagtgagacctggcctgccacaggaggttgcagtgagctgagatcgtgccactgtactccagcctgggcggcagtgtgagactctctcaaaaaagaaaaatgatgcagaaagatttgtttgacacagagtgggcataaactttcaatttgtcaaaaacatagtatctgtgaagtacaataaaatgtagtgcaataaaatgaggtatgcttggatagcaaaacatcatgttgtacctagtaaaggtatacaatttttatttgtgaattatacctcagtaaagctggacaaatgaactgtatttgcaacatggtaggaatatatgacattggacattaatgcaaatggaattttcagtgccatggtgaaaatgttataccactgaacaaaaaaaaagtagtgtgaaatgaagtaaaatgtgaaaatccgtaataaatgcagaaatatgaactgcttatccaaaagagaaaagtcttttgagttcctcaagaagattctctctttggatgctgggcacggtggatgccgggcacctgtatccgagcactttgggaggctgaggaagatggatcactggaggccaggagttcaagaccagcctgtccaacatggtgaaaccccgtctctactaaaaatacaacaattagccgggtgtgatggcacgtacctgtaatcccagctactcgggaggctgaggcacaagaattgcttgaacctgggaggcagaggttgcaatgagccgagattgcgccactggagtccagcctggaccacagagtgaaactccgtctcaaaaaaaaaaaaaaagaaagaaagaaagaaaagaaggttctctctttgggcactccttttcaacatattcagcataaatgaattaatgataccatttttactaggtgagtgtgtttgggcaagttgcttcagtgctcattctcttggtttccttttttttttttttttttttttgagacagggtctttctctgtcacctaagctggagtgcagtggagtgaacatagctcactgcagcctccaacacctagcctcaagagatcctcctgcttcagtctcccaaatagctgggactactggcatgtaccaccatgcctggctagtttttaatttctctttttttgtaagcacagggtgttgctatgttgcccaggatggtcttgaactactgggctcaagtgatcctcccacctcagcctcccaaagttttggattacaggcatgagccatggtacctggctgtcttttgctttccttatctgtaaaaactgaggataataacagtacccttacaaagttggtggaagaatgatattagttaatacaaatgaagtgctaacaaaaagagctttggaacacagcaagtacttgttaggtatggctattgtcatcaacacacttttcaaggcaaacttgtggtttcacctatcacctgagatatatgacttctaagttcatcagatcttctcttttggtttttatttttaaattaattaaatattattattcttattatttgagacagagtctgctctgtcacccaggctggagtgcactggcacgatcccagctcactgcaacctccacctcccacgttcaagcaattctggtgcctcagccatccaaagaagctgggattacaggcgtgcaccaccatacccagttaatttttgcatttttagtagagatagggtttcaccatgttggccaggctggtcttgaactcctggcctcaagcaatccacccatctgggcctcccagtgtgctgggattacaggcgtgagccatcgtgcctggccctcttttcattttagagataggaatctcattctcttccagaggctggagtgcaaaggcatgaacataactcattgcagtctccaactcctgggctaaagggatgttcccccctctgcctttggagtagctgggcctcagaactgtgccacaactactggcttccatcaagatctctgtcctaccatttcatcttcctactaggctatccccacatggatagataaatggtacctcaagtgaaagaaatcaactacctaaaataggattttccactccaaactagattttctttacatgtcatttctgttaatgtgggccacacacactggtaagctcagaatcatctttttcttttcttttattcacatccaatatggttgaaataaaacaaaatgctgtttttccttttttagaaaggcaatacttgttcattatatcaaaatttagaaaatatggaaaaacaaaaaggataaaaaattatccacaaccaaaatagcccaaatttccagttaaaaatatcaacgcatttgatatttgtccacataattaagactgtaatgtttacacaaatgtgagcttttaaaatctaaaaggctctcactattaaaaatgttttgttaaattttgttttaaaagtaagattttaatatccaaattcccaaaatagacatttttgaagatttggaaaatacagacggctgaaaatctttacattattactgttaaattttggtatgttctgttattctgctagtgaaatatatatagatttggggggctattccttttccttttttttttttttgagacaagtgtctcactctggtgcccaggatggaatgcagtggcgctatcacagttcattgtaacctggaactcttgggatcctcccgcctcgacctcccaaagtgctggggctaccggcttgagccactgtgccaggcgaatggctgttcctatatacacagttgacccttgaataacatgggtttgaactgcctgggtccacttataagctgacagaaaatacagtattggaggggcctgcatatagagaggtctgacttttcctctaagtgttccacccgcaggactgactgcgggatttgagaatgcgctttgttttttttttttaggaagtcttactctcgcccaggcttgagtgcagtggcgcgatctcagctcactgcaaccctcgcctctcagtttcaagcgattctcgtgcctcagcctcccgagtagctgggattacaggggcccacctccacgcccgggtaattttttgtatttttagtagagatgggttttcgccatgttggccaggctggtctccaactcatgacctcaggtgatccgcccgcctcggcctcccaaagtgttgggattacaggcgtgagccacggcgcccggcgggcaagacaccctcagagcacagggtgctgccaagagcccggccgagtgcagctcgagcgccgacgtcgccaaggatacacagtgctgacgcagtacacaagtgcgtcacagtggtcctccgccggctacgtcagtggctttcaggcgctttcctgttggaattggcgactgctgcggggctgagcgctggtttcacgcgtctcgggagccaggttggcggtgcgatgaggcgcagcaaggcctacggggagcggtacgtcgcctcggtgcagggctccgccccgtcgcctggaaaggtgagtggatctcgaagagaccgacggcctcgacctggccgggcggcggcctcgacctggccgggcggcggcctcgacctggccgggcggcggcctcgatggctcaggcgtcatggctcccgacgggcgctgctccctggcgcgctctgttgaggcgccggcctcgacctggccgggcggcggcggcggcctcgacctggccgggcggcggcggcggcctcgacctggccgggcggcggcggcggcctcgacgtggcccggcggcggcctcgatggctcaggcgtcatggctcccgacgggcgctgctccctggcgcgctctgttgaggcgccggcctcgacctggccgggcggcggcggcggcctcgacctggccgggcggcggtggcctcgacgtggcccggcggcggcctcgatggctcaggcgtcatggctcctgacgggcgctgctccctggcgcgctctgttgaggcgccggccggctggcgcagtcctgtgggcggcgtggcgcttgcaagcgcaggaagagtcctggggggaccgcggtgggcgggatacctttggcgccggatcttcctctttctcccggtttgttcccgacggtgctcgctcgtgggcccgccctggcccgggctttctggccccatagtacccgcgcggcctagttctcgggggcttgggcacccgggtgctgtatcggcgggtttcttcccatgtcctggacatttactttatatgctgcggcggaggtcgtacctccttggcctggaggaacccagtggggactgacgcagctccgggtgagctttggcggctgtgtcgagtgacaacgtaggcatctcagcacggacatttgcagtggcccgacggcgcaaatgacaggggaagtccccttgttttgagtatgaggtgtttgtcgctgtccctttataagggtccaactccactcatactcacctccctcgccccccccccaccccgcccagaacactttggtagctgcctttgcttaaaaaaaaaaaaattctaaagttcttacaaatcgttagtatggcttacaatttttaaccttttccacaaatgtttttagggtatttttcctctttacaggtaaataatgtgatctattttggattcaataagactttagtaattggatctaaagagtgacggaagaagctattaaaggtggatgtgcacagaatcttgagtcagtttgctttggcttgaataatcacagcactgtcgtttataagctgggtatttggggccagttacacttttcatccatagatggagttgtaacattaatagaatttgataggatgatccattttaaacatttagggtattgcttgacacatagcactaagtgttagctacaagtcactgtttttattgttgatgttaaaaggatattggcggggcgcagtggctcacgcctgtaatcccaccactttgggaggccgaggagggcggattgcctgaggtcaggagttggagaccaacctggctaacatgtcgagacctcgtctctactaaaaatagaaaaaaagttagccgggcgtggtggtgcacacctgtagtcccagctacccgggaggctgaggcaggagagtcgcttgaacccgggaggtggaggttccagtgagccgaggtcgcgctactgcactccagcctgggcgacagagggagactccaaaaaaaaacaaaaaaaaaccaaaaaacggaaactcaacggatgaccatgattataatagtagcataattgtgtctcttatcataactaagcatacgttatcttattttgcgcttccagcaaccctgtggatattgagacctgtagagatttaagatacttgttcagggtgaaataggtagtgcagcagaattttggcagtgggtctgatttagtttctcttgggaacagtggagtaagttacagtctattcctccagagaagaaggatagatatctacttgtacattgtaatttcaaactgctagcatagtataaatatgaatgtgatgatagagtctaaaacagaccttaattgagggttcctgtaactcctgaaattaaagactttaatttttgtgttatttttttttttttaggtggggtctcactctgtcacccagctggatgcagtggcgctatctcgactcactgcaacttccgcctccccagctcaagcgatcctcccacctcagtctcccgagtagttgggaccacaggtgtacccaccacacctgctgttttgttctgttttgtttttatttttggtagagactgggtttcaccatgttgcccaggctgttcttgaactcctgggctcaagtgatttccccgcctccacttcccaaagtgttgggattataggcgtgagccactgcactggccattattttatttttgagacaaggtctctttctgtctcccaggctggagtgctgtggcaggatcgtggctcactgcagcgttgacgtcctgggctcaatccatcctcccaccttagcctcctgggtagctgagactacaggcatgccagctacaggcatgcgccaccatgcccggcttttttctttaatgtagagacggggtcttaccatgttacccaggctggtctccaactcctgggctcaagtgatcctctcgccttggccacaagtgctgagattacaggtgtgagccactctgctcagcctgatttttttttttttaaacaagcttaaaaaaaaaaaaagcatgtttagagcctttctgagattcttagtggggatcttggcttccaaaagattaaaaaccactggtctagacagaagttagaatgttctttcaactacataacgtctccattaaataaagtggagtggtagcaacattttgaggattggttattatgaccacctctcttacacttagagtcttttttttttcccccaaatttaaagtcatttacattagaacctggggatttcagcggaatatggattaactagtgagtaactttggaacatgtgaagctattctgtaaagttaggtttgagtgaaatgacaaaacagggtgctttggatagaaggtaaggaatggagggagaagaggcagtggctgtgaagaatataaagaggttaatattctcccccagtttggcagagactggccatctgtgaactgcccatgctttctagaatgtctgagttttggagtgtgatgatgcgtctgtatatcatatctttctagtcttccattgtgctttcatttgttagtcttctcttgttttgccatttttgtactccctcacatgtgcttttgcccttcttaaaaatattcttcgtctgtaatccaagcactttgggaggcagagagaccagcctgaccaacatggtgaaaatccgtctctattaaaaatacaaaaatgagccgggcgtggtggcagcgcctgtagtcccacctactcggtaggctgagacaggagaattgcttgaaccctggaggcagaggttgtggtgagcagagattgcgccactgcactccagcctgtgtgacagagcgagactctgtctccaaaaaataaaaaaataaaaaaatatataattctttctctagtttttctttttccagatggcttctgtttagtttttctatgttctgtcaagttggtttcttattctgcagctgattcctacttctcaaactctacttgacagctcttatttttatttatttgttttttagaatagggtcttgctgtgttgtccaggctgccatcaaatttttgggcataaatgatcctcctacctctgttgcctgagtacttaggactacaggcaggcacctttgacagctgttagttgttttttctgccctttacatctatacttcatgcttctgagtaacacacacatatacttttgttattttgaattccctttctcccattttagacattttgttttcttttttttttttgagacagagtctcgctctatggcctaggctggagtgcagtgtcgcgatctcggctcactgcaaactctgcctccggggttcacgccattctcctgccccagcctgtagctgggactacgggcacccgccacaacacccggctaattttttagtatttttagtagagacggggtttcaccgtgttagccaggatagtctcgatctcctgacctcatgatccgcccgcctcagcctcccaaagtgccgggattacaggcgtgagccaccgcgcccggccccactttagacattctgtactggctattatgctcctccaaaactgtcctcagacactttgctttgcccctcattgtttcagtactgttattggagtttttgtttaaatgaatatttaacatttatataaatataaggtaaatattttgcatttgaattgcccttgttgtgcagttttgtttttcctggactgaataattgctttattttttggtttgcttgtatgttgtgttactacttggttacttaaactcagcaacttaaaccctcaaatgtggtcaaactggtcacataatccgatcaatttcagcttaaaacattgattgattgattgattgattgattgtctgtctacctggaatacccttactaaccgacttctccaacccagattggtttttcttcctctttgctacacagctgtgctcttgggacttccctttatcaccagtttgagaattcccttcatcttttttctgagttagaccctttgtttcttgtatctcatgtcatcttcatttactttctttgttttggtgtagcatagttcacttgctttgaggaaaagtggatgagaggtttttttgtttgtttttgttttgggacagagtcttgctctgttgcccaggctggagtgcagtggcatggtctcagctcaccacaacctccgcctcccgggttcaagtgattctcctgcctcagcctcccgagtagcgggattacgggtgtgcgccaccatgcccggctaattttttctatttttagtagagatggaatttcaccatactgttcaggctggtctggaaactaatggtatgtctttaaaacatctttacttaatttagttgatcatttggttatcgaattctgagtttgaaataatttttttcgcaattttgaaagcattgctccattttccagaagttctgttgttaggagtctgatgagagtcttgttcttggtaacaaaggttttctggaagtgtcctttcaattgggaaactcatttctttcagttctgtagcgtttcttgtattatttctttgaccatttcttaccctttttttaatgatgtttacctgaaagctggagtttctctaatttttctcttattctcctcttttgtttgttctgccttttgagagatttccttacccttatgttccaggggaagaagattggggaattcatgtttcagtatctagacttttcctcattgtcctgtataatcacggccttcacccttgttgggactccacagatttggagctgatcagatcggtttgttgagaacagcagcttttttggaggattttagggggagggagattcatttgactgtgcaagatgggcgacagagcgagactccgtttgaattaaaaaaaaagagagagaaatttagaactgcataatgaaaaagtaggccacaaatgttaagttttggacaattacaattacatctctatcttactgtgcaagatagcgatgatgtggcatctcttagggtcttactgttcctgttttcagccctgcatcagttcttgatatttggcagcttaagtgaattcaggtatttgcttatagtgacatctgctgtcatgtaaagaagtactgcttgaatcagatattgtcctgtttacataacgtgggctgtgctccttcctagctgtatatctttaaacaaggcatttgcctgcttgagcttcagttcccttgtaaagtgaggttagaggcaaaagatcatacagaagaataatttgtaaagttgtttaattatcttaagattgtctactttaataacatagttggaagcaaagaaggtaatggaattatttttctattatgttttggcattgtaccttgaatctatttcttcattttgaaaagggggaactggccgggctcggtggctgaggcctgtaatcccagcaccttcggaggcggaggaagtcagattacaaggtcgagagaacgacaccatctggccaacatggtgaaaccccatctctactaaaaatacaaaaattagctgggcatggtggcgtgcgcctgtagtcccagcttgtacccgggacgcagaggttgcagtgagctgagatcgagccaccgcactccagcctggcgacagagcaagactccatctcaaaaaaaaaaaggaagcggggaacaagccttgttcctttatgtgctgtcctgactgttgtgtattatttttgttaagattgctatagttcttttttttttgagatggagtcttgctctgtcgccagtgctgggattgcaggtgttagcctggcattgagcaacgttttgtaatttaagcatacaagtctctcacctccttgtttacatttattcccaggcatttttttcatttagatgcgattgtaaatggaattgctttcttaatttccttttctgattgttcgttgctggtacagtagtcccttcttatccacagtattgccttacgtggttttacttacctgcgtcacccgtggtccaaaaatattgaatggaagattatataaataaacatttcatgagttttaaattgcaaacagttctgaataacatgataaaaatctcacagcctcctgctccgtcctacccaggacacgaatcatccctttgtccaatatattcatgctgtatgtgctccccacccgctagttacatactagccatctcagttatcagatcagttgttggagtattgcagtgcttgtgttcaagtaacccttattttatttaaaatggcaccaaagagcaagaatagcgatgctggcagttcacatatgccagagagaagccatatagtgcttcctttaagtgaagaggtgagtttttgacttaggaaagaaaaaagatcgtatactggggttgctaagatctacggtaagaacaaatcttttgtccatgaaattgtgaagaaggaaaaagaaatttgtgctagttttgttgtgacaccccaaactgcaaaagttacagccacagtgtgtgataagtgctttgttgagatggacaagacattaaatttgtgggtggaggacacaaacaggaaacatgtttcgattgatggcaacctggtttgatactgttcatcgttttggacattcactggggtcttggaatttcaaaaataagatgtttgagtggctgtatactctttatcacatggatggaacatactctggttgtatcagcttttttttttttttttttttttttttttgagatggaatcattctgttgcccaggctggagtgcagtggtgcggtcttggcccactgctgcctcccgggttcaggcgattctttgcctcagcctcccaagcagcggggattacaggcgtgtgccaccatgcccagctaatttttgtatttttagtagaaaggaggtttctgcatgttggccaggctggtctcgaactcttggcttcaagtgatccacccgcctcagtctccgaaagtgctgggattacaggtgtgagccaccgcacccagcctggtgtgcatcagcattttggactttggagtttacgtaaccaaggagccaggctgtggaccttgtttattacttgaagaattcaatatttatttctgcctttttgactccttgactgtaaaatactgatctgatctgtagagagaacagtacatgtactattaaggcacagggaatcctcagtgccttaatagatcgtaagtacttacttattctttcccatagaggcttacacatggtaggagaagagatttctggaatacctttcctccccaaagaaagctggtttcttttgtttgttaagtgagagagtggtaccacagggtttccaagatttccaaggctgatgaaaattcttaacttctgttgtctgcttgtcttgctttcttgaatttattttttgtatgttatgtatttattatttagagacaggatctccctgtgtcacccaggctggagtgcagtgtcacagtcataactcacggcagtgtcaacctcctgggctcaagtgattctccttccttggcctcctgagtagctaggaacacaggcatgctccactatgcctggctatttttttccccctggagacaggatcttgttgtgttgcacaggctggtttcaaactcttggcctcaaagctagcctcccaccttggtctctgaaagtgctagaattaaatagaattaaaggtgtgaccaactgcacccagcttatttatgatgacgatgatgatgatgtttgggagatggagtctctgtcgcccaggctggagtgcgatggcacgatctcagctgactgcaacctctggctcactgcaacctccacctcctgggttcaactgattctcgtgccttagcctcccgagtagctgggattacaggcacccgccatcatgcctggctaatttttctatttttgtagagacggagtttcaccatgttataacgccaggctggtctcaaactcctgacctcaggtgatccgcccacttcggcctcccaaagtgctgggattacaggcatgagccgctgcacccagctctattttttgttttgtgataggaaattataaaacatggaattatgcatttgtcaggctttaaaaaaaacttttaagtgaatgaaaatggcatatttgaacataaacttagggcagatttttactacttttgaaaaaatgttggagaatatttctgtatgaaacgtaaaacaacttttaattttttttagaagttgagaggattctattttgcaaagctgtattatgaagctaaagaatatgatcttgctaaaaagtaagtacaaactgtaacatgtattctttttttaaaatcaatgccttttctcattttcttctttgaaataggtaaaaatatgttcttagtagttcttcctaagtgtattctggaataagggatttatcactcagactgatgctaaggaccagcctagattccattgagattgaaaccgtaattagtgttttctgcatgctgctgctttataccaagggcaagaaattgtttggcttaaaacactttttctaaaaattgtcttctgttggagtaaaagaggaccatgcctatatcttcatttgtttttggttagatatctgataccttaatcagatggaaaatagcaatgaataaaaaactgtaattgtaaggcaggagaatagcttgtataaaagatctttaattgacacaatatgtgatgctctaaggctctatcctagggataagaagcttggtgattctgatttcctgactgggagtggattaaagcaggaaattaagagggaggcagggtttttttttttttttttttttttttaggcagtatctgtctctcttgctcaggctggagtgcagcagctggctccatctttgctcactgtaacctctgccttctgggctcaagagatcttcccacctcagcgccccaagtagctggggatacagatgagcaccaccacacctggctaaggtttgcattttttggtagagacaggtgtcactatgttgcccaggctagtcttgaacttctgagcacagcagtctgcctgcctcggcctcccatactgttgggactacaggtgtgtgttactgctcccagctgggaggcaggcttttaaaggcatccaaaggaagatggaaatgctggtaagaaaggaaaatggtggtacataaattatgtaactagcagcactgtgactgttaactcttgtacctttttactgtgagactttaatcccttagtttgggtctggcctaatttctctgatggtaatactgtcaaggaacctagaggatatttacttattttagttgttacttgatttgagaaatggaaatttcctgtatttggtactgtaattagtaatttgtcttctgttcgattttagctggatatagtactgttagaaattactttcttgcttaaagggtaggtgtatttccctttgttgtttgggaaattgttgctgtttagtattttgcattatgataactttaaaaatgtttactataatcacttctaatttatttgcaaaactgttagtgctttattaaaatgtgatcaggaagaaaaagcaatttatatgttcatttcttatgcgtggataacactggagaaaaatttggtaaatgtgacatttaatggtaaaacgagtatgtggtcaactctatgtacgtgtttttaagtattacccatttctttctatgaatacttctgagttatctgcataaatagtggtagttttgagtaacaatataaacgagtttagtggttgctttggtttaagatgtattcttcggttagcatttaaaagtacagttctaagtttaatttacttttgtattacttttgaaaaacagatacgtatgtacttaccttagtgtgcaagagagggatcccagagctcacagatttctgggtcttctttatgaattggaagaaaacacagagaaagccgttgaatgttacagggtaagttataggattcaaatatagcctttgcatagccaaacacatgatgcccagagaaatttatataagtaagtcaaatatattttatgaatatcataaaacaggcattggtatcatagtacaattatgtgacacagcttggaacagatttagaattgtttaacacctataaattgtaagtctaacatggtcagaaatggtgttcttttgtgttcttttgcattcaaatgacacaaatataatttttatttgattcatttccagaaaattccaagacacttttattttaacacctttgaagtaacatgttttctctagaagtagaattttttaagggttggagtgataatttttaacctttatatataagtatataagtatatatactcctacatacatacatacaatttatttactaatctttaatttcttttctgatattagcgttcactggaattaaacccaccacaaaaagatcttgtgttgaagattgcagaattgctttgtaaaaatgatgttactgatggaagagcaaaatactgggttgaaagggcagcgaaacttttcccaggaagtcctgcaatttataaactaaaggtaaacatacaaaacataaagggagaaaacttaagacataaccatttctaatatttggagtttaaattacttttcaatagcaaaccttaagcccaggtgtttgtgtttcctttaacatttttcttttaaaaagtgtattaaaacctttctgagcatctgctgtcttattaggcattgttatactttataagtgacatctcatttacccttctggaataattaatattttagggattttacagtttagtagctgtaaactaagtagagctaagatttacattaagttctgtctggtatacaatttttgcttcattaagtgaaaattacctacaggatgacaatttagggatattttaaagaagagttttctaataactatggtctgaaagtagaagggattgtattttgagatagtaaagttttcaaggaaaagataaaaggtggtttctctagtatataagatgtaattactaaaaatggtaggaagttcttgctagtgtattgactggtcctgatattctttatagagcaaaatatagtttactaagtaactgttctggagaaaatctacacaaatatgtttggcaaacatttaaaatgtatattgtaatattttatatattaatgtatactttattgtgtatgtacaatataaaattataaatgtatatttgcctttagcctcctcctacccccattgtatatgtttctgatagaaatttaaaaaattttaattttgaaataattatagatttttttgcacaggaagttgcaaagattgcacagaaagatcctatatgctacttcatttttccccaatgcttatacaggttgagcatttaaaatctgaaatcctaaatgctccaaaatctgaaattttttgagcactgacatgatgctcaaagaaatgctcattggaaaattttggatttcagattttcagatttgggatgctctgcctgctaagtatcctgcaaatattccaaagtctgaaaaaattcaaaatctgaaatacttctggtctcaagcattttggataggggatactcaacctgtttaacccgaccaaagcacaatatcaaaatcaggaattttgacattggtacaatgtgtatgtatagttttctttcattttatcatgtgtagattcataccaccactactgtcaagatacagagctactctattaccacagagatcttcctcatgctgccccttttgtagtcatgctatttacttctcttcactatgcctgacctctggcaaccattaatctgttctccatctttatactttggtgatttcaaaatgttatgtaaatgtcatcatgaaatgtgtgacttttttttttcttttttcgttgtttttgagacggagtctcgctctgttgcccaggttggagttcactggcgcaatctcggctcactgccacctgtgcctcccaggttcaagcaattctcctgcctcagccttccgggtagctgggactacaggcacatgttaccgtgtcccgcttatttttgtatttttgcagaaacggggtttcaccatgttggcctggctggtctcgaactcctgacctcatgtgatctgcccaccccagcctcccaaagtgctaggattacaggcgtgagccaccgcgcccagccaagcatgtgaccttttgaggttggcttgttcagtcagcataataccatttgtgatccatattaagttttgtatatccatagttggttcctttacttctgagtagcatttcatggtccacaatttaaccattcactttttttatttttatttttttgagacagagtcttgctctgtcgcccatgctggagtgcagtggtgctatctcggctcactgcaacttctgcctcccgggttctcaggtgatccacccactttggcctcccaaagtgctgggattacaggtgtgagccactgtgcccagccttaaccattcacttttgaggggcattttggttatttctaggttttggctgttgttcaactgctatgaacaatcatgtccagatttttgaagctgaaaaagcattgaagatgcttccaaagataaatattactgataagtttttctccccagtaataagcagctggattttaaatattagtctaaaacatgaggtctaattgtgcagatttctttactctcttaggtgttatgcctcaaacataactcccatattgggcgtggcaatccagttaatctggtgtcagtagtgttaaagaacatatgtaatggcaggagattgttttcttgcagtgtaacaagtaagatactttgaagcactctttaaagattttctttaataacttgaaggcactgttaacacctttcctgtatcagattttttttttttttggaattgaaatccatgagatttataattgtcatgcaaagtaattccatttctcctaaaatttaaggcttgctaaggtaaacagtttctgacatttgtttaatgaatgagagtattactgttgagaaggctttttctctcaagtatgagatagaactttttaaaagcactcatagtggttttttaaaaaatgtttaacatagagtcaaagactagggcttttgcaatagggagagaccagggtatcatccatctcatccagaagaggagaaattgataaaggagagaggggaatgaaatacagagtagtaatggacggcttggtcttgagagctggggaaagacgagtttaagtaggtaaggtaaaatggaatttatatgtgatagcatcaggtttctcagtgaaggatgaatctaggttataagttgaaagtgagggtcaaaggaaggtatggggaagttgaggaaataggaggaggtgtgaagtgtcagggagtggagaaagtgagtctgttagtactaaaatggcattttgttttaggcagcaccagtttgatggttgagataatgcaaatgaaatcagttagcttggggttatgatttcccaaatctaagcacacagaaaccagttgggagggttctgaggaaaagagggaattagttgaagggatctgtaagcaaacagtaattatggatataagggattatagcattttttgcctgacagaagaaagtgtgtgtatatgtgtttacaggtgcttaaaacttgatgatgttattgtcttgaagggaacttgtcatgtggtggagaagtatatttctgaaagtaagggtacgtaggccctcagtgaggtggaagaataagaaggatggtatggtcgtttcggtggtatgaccaaaatgcagattttgaagacctgtgtcagtggcaagtggatggttgaggttggagtagaggataacatgactggagatgaggtgattaaggaactgagtagtcagcctgggcaacacggcaagaccccatctctacagaacgttaaaaaaaaattagccgggcatggtggtgcatgcctatggtcctagcttcttgagaggctgatggaagagcatcgcaaatgagaagcgagtggccacaaaccctacttcctctccttgtatgtaagttcagagagaaaaagccatcatggtagtgggggttatcctgagatgatactgtcttcatttaagatcaggaggtgatgacagtgctttgagatgatgatgaaggtaacagaacagtgggaggagaggggatgtgggattgagtcagatttaaggagatacagagcagtttgagcataaggaccttgttgctgaggattgactggggaggtctaggcttctggtggtgactcagatggacagggatgtgtggcaatagtcctggtagtctctgaagagagtatgagctactgcagtaatcacagatgcttttcttcacatacagttcttgaggcttagtttctgggttgtaagcaactctcagaagggacgaataaggtatataggatggtgtttttggtggcatcatcataaaactagacatagtggaatggtgctttttgggagcatgacttgtttaaaattgcacaagtgttactctaataatttttctttttcccctctaaataggaacatcttctagattgtgaaggtgaagatggatggaataaactttttgactggattcagtcagaactttatgtaagacctgatgacgtccatatgaacatccggctagtggagttgtatcgctcaaataaaagattgaaggatgctgtggcccgctgccatgaggcagagaggaacatagctttgcgttcaagtttagagtggaattcgtgtgttgtacagacccttaaggtagataaaagctattgggtctttacatttctatgtaggcaattagcatacatctttttgtactaaagcagcagtgccccgcaggacttaaatttcttttatttaggtagaacagttataaaatgaaatttttaccaggatcagttaaatttataatgggaaagttggggagataactatgataaatgtatatatttttggtgttttcatttataaggttgatgtaaaaatcaatgtagtttcacaaacgtggttagagtgagaaaaggaatttgtaggcataaaatggttaatttcttaacacttgattaagttttgtaacttactattcattccacaaaataggaatatctggagtctttacagtgtttggagtctgataaaagtgactggcgagcaaccaatacagacttactgctggcctatgctaatcttatgcttcttacgctttccactagagatgtgcaggaaagtagagaattactggaaaggtgcgttgactttgaggagaatgctttagtataaattgtagtttttctttttgcagtaagttcattgctctaaatttctttactgcatcattatttctataatgtacctaggagttatagttaatacagtgaaccactaggaggcaatcttatttttcttcttttacggggaagttctaattggttttatatgactttcctttttagagaactcttatagttcaagcttgattaaaattagccttatggttaaatactcaggtttgtcatagtcaagcttaaaatgaatgttctaactgctatttcatattttattttttataatagtataatcttgagtgaaaattaaggttcatctgtcatcagatggctaggttcacatgtactagtataagcacttagcatcactggtatttcagaaaatactgttttagctaagaaacaaaataactcaactatgtgatttaccttttttcctaaattttgattttgaaaaccagtgtctccattttgaaaataaattccattgaacaaaaacatcacttggatttgtataaaaatgttagtttagagcaggggttggttagaacttgtgggccaaatatggcccctgcctaattttgttaatatttattggaatgcaacatgcctctgtttatgtattgtctgtggctgcttacatactacaaggttggaattgagtggttgcagcagagattgtatgcctgtaaagccagattagtaatctcctcctttttgtagaaaaagtttactgattgctagtttaggctgtccatttgtttggaagttaatttatttccccatctggtataaggaaagaagttcatttcactgagtgcagggagtaggtaattttcttgaaaaagtacatagtgtcctaaattggtagggtaagagcagtatctaaaagaactaacataactttaagattattttagaaaacatgtaggatgttttattttgtgttctttgtatactcaaattttttggtcacaagttccttttacatttttcttaaggacatcaaagatctttgtatgtgggttcctttttttctttctttctttcttttttgttttgtttttttttttttttttgagatggagtcttgctctgtcaccaggctggagtgcagtggcatgaccttgactcactgtaacctccgcctcccgggttcaggcgattctcctgcctcagcctcctgagtagctgggaccacaggcgcacaccaccacgcccagctaatttttgtatttttagtagagacggggttcaggatggtctcaatctctctttttttttttttgagactgagtcttgctctcgccaggttggcatgcagtggtgcagtctcggctcactgcaacctctgcctcctgggttcaagtgattctcttgtctctgcctcctgaataggtgggactacaggtgcccgacaccacacctggctaattttttttttttttgagacagagtctcgctctgtcacccagcctggagtagagtggcgcaatctcggctcactgcaagcttcacaatttcctctcaatgctctgaataagagcttatcctcctgcctcaggttgttccccaccaggaagccccaggagggccctgaggacagcccttggccctcagagggggaggctcaggaggggagatgaccatggggatggagtcactcaggggagaatccggaccatgagggggtgactgggggcctgaggggaggaccctgaggaagataaaaagctggtgccaccctaggcagtttcacagtgtggcttagggtggtgggtgacagatggtttgtcagatcagttaatcaggactcatgggccctttgttacccccccttgtgaacctcccaggttcacgccattcttctgcctcagcctcctgagtagctgggactacaggcgcccaccaccacgctcggctaatttttttgtatttttagtagagacggagtgtcaccctgttagccaggatggtctcgatctcctgacctcgtgatctgccctcctcggcctcccaaagtgttgggattacaggcgtgagccaccgcgctcagcccacacctggctaatttttgtatttttagtagaaacagggtttcatcatgttggccaggatggtctcgatctttttttttttttgagacggagtctcgctctgttgcccaggctggagtgcagtggtgccatctcggctcactgcaagctctgtctccagggttcatgccattctcctgcctcagcctcccgagtagctgggcctacaggtgcccgccaccacacccagctaattttttgtatttttagtagagatggggtttcactgtgttagccaggatggtcttgatatcctgaccttgtgatccgcctgcctcagcctcccagagtgctgggattacaggcatgagccaccgcgcccggctggtctcgatctcttgacctcttgatctgtctaccttggcctcccaaagtactggaaggtctcaatctcttgacgtcgtgatccgcctgccttggccttccaaagtgctgggattgcaggtctgagccactgcacctggccgtatgtgggttatttctgtcagtgtttattacattagaaattaaaacaaataaaaaatgtaatccattaaaaatgtaataagccctattgtgtgttaataataatagctttttttttttttttttttttttttatttgagacggagtttgctcttgttgcccaggctagagtgcaacagtgtgatctcggatcactgcaacctctgcttcccaggttcaagcgattctcctgcctcagcctcccaagtagctggaattacaggtgcccaccaccacgcctggctaattttttgtatttttagtagagatggggtttcaccatgttggctaggctggtcttgaactcctgacctcaggtgacccacccgcctcagcctcccaaagtgctggaattacatgtgtgagccaccgcgcagggccaataatagcattttttatgaaaaataattattttccaacagcaaaaaagtagtcagaaaagtgtcattgtttttgcatttttgtaaatctttttaatgtctcgcttaatagaacatagctagattctcatttacttcctctttcagtctgtaaaactattacatgtcatgaagcctctagaaaactcagctcagcgggtcgcggtggctcaggcctgtaatcccagcactttgggaggccgaggcgggtggatcacgaagtcaggagatcgagaccatcccagctaacaatggtgaaaccttgtctctactaaaaatacaaaaaattagccgggcatgttggtacgcgcctatattcccagctgctcgggaggctgaggcagaagaatcgcttgaacctgggagtcagaggttgcattaagccaagattgtgccactgcactccagccttgtgacagagtgagattctgtctccaaaaacaaaaacaaaaaaactcagctctacatacatgagaaaatgagtatgtaatatataaatttttttttggtattattgtaaaagtaattttaacttcatggatcccctgaaggggtttttgagcaccctcagagatctttagacctcatttgctctggttgcgttattgtaagccactttaaaatcatgcttcacgtttaagtgtttgctttttgcttttacttttcttccaaagtgaggatttggagaaacattaggatttagaagaactaatttagaatatagattacaaataataggccaggcatagtggctcatgcctgtaatcccagcacattggtaagctgaggcgggcggatcgtgaggtcaggagttcgagaccagcctggccaacatagtaaaaccctgtctctactaaaaatataaaaaaagtttagcggggcatggtggcaggtgcctgtaatcccagctactcaggaggctgagtcaggagaatcacttgaacctgggaggtggaggttgcagtgagcttagattgtgccattacactccagcccaggcgatagtgagagactctgtctcaaaaaaaaaaaaaaaaaaaaaaaaaagacaatttatttaacgctgtaatgatctatatagtaaaaagagcaattgctgtattgatactcaaatacctgtcagttatttacttataatttggaaatggtatgtctaatttgagaaattacaactgttaattaaataatgaaattatatgatcaggaagaaactacaaaatagtctcccaactttatcctggtttattttgaaatgtgcacctataatcactaatcttatatttatcctgtgattggagggctggaaataactgggaataagacatcatttgagaggttaagcatgaagtataggaagtatgcaggataaaaataagcattagatgattcataatttataacatggggaataagaattattagaagttgaatgtggaagatgaagcttgaaataaaatttttattttgttttgaattaaatgaaccatgattattcacagtgcagtaagtgtgtatcatctgtttgatattttcatattacagttttgatagtgctcttcagtctgcaaaatcttctttgggtggaaatgatgaactgtcagctactttcttagaaatgaaaggacatttctacatgcatgctggttctctgctcttgaagatgggtcagcatggtaataatgttcaatggcaagctctttctgagctggctgcattgtgctatgtcatagcatttcaggtaagtcttccacttgtaggagcaattgacatttcacggagtcttgatgtgttttaaatgaaggtgtgctctggtatgtaatgacaatatgtgaacaaactgtggaattaaaatgaaatagtcaatttgatacagtggaaaataactaagcatacacaatactggtgaggctggtgaaacagggatgttgagtgcactcttgtcgaaagcctgcattgccatgatttgtttgtagacaaatttgaagagtttgatctttttactctgccatttttgggaacatgataaagatgtaatctcgtattatgggtaaagcttgattcaaaaaggtgtgttacttggacaaaatcctaataagtagatgtagggcaatggctttatagcctatgatagaagaatatgattgcaatttaacatgttaattgaaacacatgtatataacatttatggctgtattgtgtatatgtaacagtatatctattaatctttgaaaacataaaaccttttcttattttttatttttttattttttttgagaccaagtctctctctgttgccaggctggagtgcagtggtgtgatctcggctcactgcagcctccacctcctgggttcaagtgattctcctgcctcagcctcccgagtagctgggactacaggcccgtgctaccaagcccagctaattttttgtatttttaatagagatggggtttcaccatgttggccaggatggtcgcaatctcttgacctcgtgatctacctgccttggtctcccaaagtgctgggattacaggcccgaggcactgtgcctggcgtgcctggcctttttttttttttgagacggagtctcgctctgtcgcccaggctggagtgcagtggcacgatctcggctcactgcaagctccacctcctgagttcacaccattttcctgcctcagcctcccgagtagctggaactacaagcgcccaccaccatgcctggctaatttttttgtatttttagtagagacggggtttcactgtgttagccaggatggtctcaatctcctgacctagtcatccacctgcctcggcctcccaaagtgctgggatttacaagcgtgagccaccattcccggacttttttttttaatgagcttgcataacttttgaaaggaaaagaaataagcagtcttccaaaaaaagcattaaaccaggcttagaaaaatgattaattttagagaaggattttttgcttggggagggaaaaaaaaggattcattacttttagagaaggcccctccttctaatataaatctttttttctttttgagacagagttttgctcttgttgcccaggctggagtgcaatggcgccatctggctcactgcaacctccgcctcccgggttcaagcgattgtcctgcttcagcctcccgagtagctgggattacaggcacacgctaccacgcccatctaattttgtattttcagtagagatgaggtttctccatgttggtcaggctggtcttgagctcctgaactcaggtgatctgcgtgtctcggcctctcaaagtgctgggattacaggcagtgagccagcatgccctgcctaatataaatctttttatttttatttgagacggagtctcgctctgtcaccaggctggagtgcagtggcgcaatctcagctcactgcaacctgtgtctcctgggttcaagtgattctcctgcttcagcctgtcacgtatctgggattacaggcacacaccaccatgcctggctaattttttgtattttttaatagagatggggtttcaccatgttagccaggatggtctcgatcttctgacctcgtgatccacccgactcggcctctcaaagtgctgggattacaggcatgagccattgagcctggcctgtaaatcttttaaaaacaccgttgatagacagttcacatgttaaatgctaatattggctcagtagaaacttctgtgttcataaggaatggattagtgaaaattaatggatttagtgaggttcactaggtaatacaaacattaaaaggttcttatagaaattctcaagtaactgatagttcttatttttatttattttatttttttttgagatggagtctcacactctgtcgcccaggctggagcacagtggcacgacctcggctcactgcaagctccgcctcctgggttcacgccattctcctgcctcagcctcccgagtagctgggactacaggcacccaccaccacgcctggctaatttttttgtattttcagtagagatggggtttcaccgtgttagccaggatggtctcgatctcctgacctcatgatccgcccaccttggcctcccaaagtgctggcattacaggtgtgagccaccgcgccctgccaatagttcttatttttaatggaaactttaaaatttatctgtctgtgtgtctattagagtcttgctgtgtcacccaggctggagtgcagttgcgtaatcgtagctcaccgtaacattgaactgggctcgagcttcccagagtgctgggattataggtgtcagctactgcgcacagcctaaaatttttcgatatgtagttttgggaggcagagtctcactcttgctctggctggagtgcagtggcatgatcatagctcactgcatcctcgaactcctgggctcaagtgatcctctcctgcttcagcctcagctcagtagctgggactacaggtgcctgccaccatgcctggctacattgttaaattttttgtaaagacaaggtcttgctatgtttcccaggctggttggtcttgaactcctggcttcaagtgatccttctgccttgccctcccaaagtgctgagattacaggtatgagccaccacacctgactgtgaacttttaatcataataagttagtttccctcttaatccattcactcaggtctcctttcctagatgacagctactgttaggagtttcttgggtgttcagaaatattttttgcatatgcaaatgtgcaatacattctttctctgcttttaaaaaatattgtgcctcaatgtgggtgtgctttacctattgccagatgccttgcttttctgaatgtttcttcattgttccacttcagcacagagatacctacctcagtctttattagctaccacatatttctgtagaatgaatatataatagaaacatcttagatgcttgtattttatttgatcagtttattttaaagcttaatgaacaaatgattataagcataaaatgtaggttatgtgctggcatttgggtatttaagaattggctaacttttatggcaagattttcagactcttaatcagaggaatactgtggttctagtaagtgcatctgcattgcagctaggtagttaacaaagtatcttgaaaccttttagttaagatgaggaaatagccaggcgtggtggctcacacctataatcttagcactttgggaggctgaggcgggcggatcgcttgaggtcaggagtttgagaccatcctgaccaacatggtcaaaccccatctctactaaaaatacaaaaattagccacgcatggtggcaggtgcctgtagtcccagctacttgagaggccgagacaggagaattgcttgaaaccaggaggcggagattgcagtgagccgagatcgtgccactgcagcactccagcctggcgacggagcgagactccatctcaaaaaaaaaagaggaaatagtgaattgagatgatttgattgagtggattcacaactaattaactggtcacagattcaactgttgaataattttgtaaaagaggccgggtttatgaattgaggtcagtttgaaaacaaaaagaatgatgtcaacattttgtttcttactttgtgtgctcttttcaacatatagatgacaaactttgacatgatgtttagaaaacttgtgagtaaaaggataggcgatatgaatatttctaaaattcaaaatcagaagcttttaggttcataaatcatatattttgaaaaatgagcatgtttggaaagaattatatatacatggtttaaaattctggcggctcttaagaatatgctatgaagactcctttctgttccctagttatttactttctccagccccaaagaaactaatgttattgctttcttgtgtgttcttcaggaaatgttttatgcatctccaagtaaacacacatatatcccctgtctttaaaagaaggaggaaaacatttgaacattgcatttactttatttccattaactgtatcttggagatgtttccatgtcagtatatataaagggcattctcattagtttggatgcttgcatattattccattgtatggatgtactgtagttttggagtttttaaaaccagggtcctaaaaccaggacattagcttgcttttacttttttttttaatgctacttcaagtaatttagcaatgattaacttgtgccatgaattcctgaaagaattgcagtatcaaagtatatctgtgcatttataatttttagagctgttgccaaatatctaaccctaaagaggttgtatcaaattacatttccaccaccaattaagaaagtggtgatagaattaaaagccgatgctctagtcacccatatagttacttttggcatgtttctagtaagtgggcattgcctgtgactggacgttttcagtgatgggcattcattacttttcaagatagcccagtgcatctttaggtggtttggctcttggtacttccttatatagaataaaaatattcttcaagccttctacctgttggtcttgtttcttcttttgatgatttcttttataaaataattttaatacctgaaggcagctgtcacgtcttcccttcgccattctattcatcatgctttttttttttccataggttattgcattaggatctctttaatttcctggttgtcccatttattctagtgctatcccctgttatccatactctgaaaatgtgttatctacaatgtggcatttccaagtgtcatttcacctgtactttttaaagtagggtgtcatatctactcaaataggacaacatctgctgttgtcctatttattcagggcagaaaagtaatataattaaattttccatttctctgaatgtaacacgaatgtgcttttagtagaaactaatttctcagagctgctctgtgtatgctttttttttttttttctttttttggagatagggtctcactctgtcacccaagctggagcacagtggcatgatcatggctcactgcagccttgacctcctggatttaagtgatcctcctgcctcagcctcctgagtagctgggaccacagttgtgtgccaccactcctggctaataaaaaaaactttttttagagatagggtctcaccgtgttgttcaggctggtcttgaactctgggctcaagtgatccccccacctcggcctcccaaagtgctgggattacaggtgtgagccaacatgtctggcccctctttttttttttttttgcgatggagtctcgctctttcacccaggctggagtgcaatggcgcagtctcggcgcgctacgacctctgcctcccaggttcaagctatccttgtgcctcagcctcccgtgtagccggaattaacaggtgtgtgccaccacgcctgcctctttgtttttttttttattatttttagtagagactgggtttcaccatgttggccaggctggtctcgaactcctgacctcaagtgatcagcccaccttggcctcccagagtgttgggattacaggtgtgagccaccacgcctgtacctggcctatctttcataggttatataaattccttggttcccagtttttgcagtcttttccaattcagtttaattaatggttaactgtttattcattatcaaaaaaagtacagtgtaatagacaagaccatgttactattagaagtatgggtatcatcaaattaagatttttgattctaaaattattaggttccaagaccaaagattaaattaataaaaggtgaagctggacaaaatctgctggaaatgatggcctgtgaccgactgagccaatcaggtaatagtaatattaaactaatttaatttaaaaagaaaaaggaatttctgttaaggcatatcttatgataaaatcttcatctgtccaggagataatttgtcaaaattatttctttttgccgtatcagttaagagcaataggtatggaagagatgcgaagaaatagcacattctttaaaaaaaatgaatatttgatattgtttgttcctatgtggagaggatttcttaactctttcttcatctggctgctagagcctctagcctgaatatttagtcacttcctgaactaagtataattattgatttgccaaccatttaacaccagctgattctaaaaacactgctgtggggatataaagatgaagaagatacggatctgtcttaaagagctgagagcatagtgaggaagatagaagatatatacttaccttatattaggctcttggaatttgtggatttttttcccccgtttttggcttgggatgaatcctaaaggtctgttgcatattacctgtgattttgctaagatacaaactttaaggtagttagatggccattgaatcaagcagtgaactgaagaaacataatgcttcctataaggagcagttttgatataaaattggatgaattttgtaaagagcaagatgtaatattaaatcaaagttattataagctttggtgtatagttaggctgttggccaaagctcacattgctcttttattccatagcccactttttttgtgggagctaggctttcagtccttaaagtgactttctacttttttccttttctcttttccttctacccttgcagggctctcataagtgcctttgcatggtgtcacagttagatgaaaattgcctgtattttttttttatgtctttgatctgggcatcccgagggtgcctctgtaagtgtgctgagacacaactgtgtagtggtaaccaaacctaattgcccagcagaattaactcaaaggagggtttttaaaaaaagttgaattgaaatataattcatgtaccatacgcttcacccatttaaagtgtacagttcagtggcttttactatgttcatagagtattaccactgtcaccacagtcagttttagaagattttcatcactccatgaggaatttcttacctattagcagttactccccattttacccaaacctctcagccttggcaaccgctaatctgtctctgtaggtttgcctcttctttttttttttttttgagacggagtctcgctctgtcgcccaggctggagtgcagtggcgggatctcggctcactgcaagctccgcctcccggattcacgccattctcctgcctcagcctcccaagtagctgggactacaggcgcccgccactacgcccggctaattttttgtatttttagtagagacggggtttcaccgttttagccgggatggtctcgatctcctgacctcgtgatctgcccgccttggcctcccaaagtgctgggattacaggcgtgagccaccgcgcccggccggtttgcctcttctgaacatttcacataaatggaatcatgtagtatgtggtcttttgtgactggcttctttcatttagcaaggttttcaaggttcatctgtgttatagcatgtatcagtattttatccgaggactatgattttttgattgcttactgtaaacctatggaataaaaatctctgggaacaaggcctggaaataattctttttttttttttcctgagacagtcttactctgtcgcccaggctggagtgcagtggcgtgatctcggctcactgcaagctccgcctcccgggttcacgccattctcctccctcagcctccccagtagctgggactacaggcgcccgccaccagggccggctaattttttttttttttttttttgtatttttagtagagacggagtttcactgtgttagccaggatggtcttgatctcctgacctcattatccacccagcttggcctcccaaagtgctgggattacaggcatgagccaccgtgcccagccggaaataattcttaaaagctgtttaaaggaggattctgatcagccaggttcagaaatcagtgtatcagatcagagaataagagcttgtccctgttctcctatggccacttaaatccagaccttttcatctaaaatgcaaatatgtttggcatttttcatacacattcctgtcttttttcccccttctgctgtcttatgtagatactgagaatattaaacctgtactcttttcatttgctacataagcacccgttttgttgtccagctgtattttttgggttggagggttaggtctgcaataatcatgttatttcccctttgggtatacaaatgagacaacgtgagcaaatacaatctgtatttttaaagtgatggaaataacttaaatttttttttcagggcatatgttgctaaacttaagtcgtggcaagcaagattttttaaaagaggttgttgaaacttttgccaacaaaagcgggcagtctgtgttatataatgctctgttttctagtcagtcatctaaggatacatcttttcttggtagcgatgatattggaaacattgatgtacaagaaccagagcttgaagatttggctagatacgatgttggtaagttatatgtttcagaggaaatggtctccgtcttaattattataaattgcccataatcttattacccagaaataacgacttaatattttcctgtattccttttgtgtgtgggttgggctggggggagtttgaatgtggtgctgtaggggtggcatgtattttttgttgttgttgttgtttttgagaccaagttttgctcttgtcgcccatgctggagtgcagtggtgcgatctcggctcactgtaacctctgcctcccgggttcaagtaattctactgcctcagtctcccaagtagcgggattacaaatgcccaccaccacgcccggctaattttttgtatttttagtagagacggggtttcatcatgttggtcaggctggtctcaaactcctgacctcaggtgatccacctgccttggcctcccaaagtgctgggattacaggagtgagccaccgcgaccagccttgttgtattttgagacagggtctcgctgtgtcacctgggctggagtgtagtggcgtgatcgtaggtcactgctgccttgaacttctgggctcaagggattctcttgcctcagcctcctgagtagctggtaccataggcacatgccactcggcccagataattttttttttaattggtagagacagggtctccctttgttgcccaggctagtctccaactcctaggctcaagtgatcctcctgcctaagccccgcaaagtgttgggattaggcctggcacagtggctcatatctgtaatcccagcactttgggaggccgaggcgggcagatcacctgagatcaggagttcgagaccatcctggccaacatggtgaaaccccatctctactaaaaatacaaaaattatccgggggtggtggcatgtgcctgtagtccctactcaggaggctgaggcaggagaatcgctccaacccgggaggtggaggttgcagtgagccaagatcacactgctgcactacagcctgggcgacagagcgagacttcgtctcaaaaacaaaagtgttggaattataggcatgagccactgcatctgaccatatttttcatctaaatggttgtttatgtatgatttatcttgcttccttcatgaattctctcccatagtctctgtattaaaactataaatatcacttttattggcaatataatcttttttatgaagtagtcataatttgcttgcaactttctgttattgggcatccaagttttctcaacttttccactgttaataatcatactctgataaaaacttcaacaaaaagtgtcttcattgcaagttatttccatagagatacctaaaaacagaattactgagacaaaggacatgaacatctttaagtcttgcaaattgccaaaatgacagaaagattatacctcttcatgcttccagaagcgcataaccttttcttttcttttcttttcttttttttgagacagagtctcgctccgtcacccaggctggagcgcagtggtgcaatctcggctcactgcaacttccgcctgccaggttcaagcaattgtcttgcctcagcctcccaagtagctgggactataggcatgtgacaccatgctcggctaattttttgtatttttagtagagacggagtttcaccatgctggccaggctggtctcgaactcctgactgcacataaccttttcaatattgactttcttgtagaaaaacagatttctttactgtaccgatggattaatatagtggtgttccattgctttaatgacttaaaggaaaacccattgttttggggtttcttattaggttaggtgttctttatttggcttttgtcagttgattttggtttattgagttctagtcagtgtcattttttaagatggacttaaacattcttcatcactactatttttattaaaatttctagaaataatcaagtgagaatgcatttaataagaacatgagattttgcctaacatagaattccctccagctttgatatagaaaagcagttatataattaagatatatataatgtgaattgtttatgttggcaaaactaatggcacaaagaaaaatttcaaacccttaagccaatttttttattttatttcaggtgctattcaagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtaagcaaagattttaacaaattaaatattctgaattttgtttaatttttttttctaacttaacttttccttaaataaaacaggtatttctccttggagtagtatataccagccacttacaattaaaggagaaatgtaattctcaccacagctcctatcagccgttatgcctgccccttcctgtgtgtaaacggctttgtacagagagacaaaaatcttggtgggatgcggtttgtactctgattcacagaaaagcagtgtaagtagtaaaacaaaaatattgctttcacttagtgcgtaggttttaccggggatttaatcctcatgtgaagatttaatttgtcatgtgacccattaacatatatgtatgtaagcgctgaactgtgtatttagaaaacaattttagtaaattgaagtattttttagacctggaaactcagcagaattgagacttgtagttcagcatgaaataaacactctaagagcccaggaaaaacatggccttcaacctgctctgcttgtacattgggcaaaatgccttcagaaaatggtgagttttaaagtataagcatttttaaagaacattaccttaattttttaaaatcatgcactttttattgaaagtttttttgttcagaaaacagcagcttggtcatattatgacagatgtgttttttattgctgcaaaatagttaatgtagttaaatataagcacttagaggagcaatgcctggcacacagtgaatgttacatattagctgagctgttactgttattccttaataattaagttctgataattattcagcctgaaaattaaaaaaaaaaattagcacaaggctttgtaggtaagaccattatagatctttctaaatatttaaggtttgttttgtgtcaccattaggtgaagatggtcagccttttgaacaaactgacactacagaagaggcaggtttcagctatctaaaaatggcaactgttaaaaagtagttgggattgctacattagggtggtatcattagaagtgtttaaaagttgagtgtagaggccgggtgcggtggctcacatctgtaatcccagcacgttaggaggccgaggcgggcagatcacaagatcaggagatcgagatcattcctggctaacacggtgaaaccccgtctctactaaaaatacaaaaaaaaactctactaaaactacaaaattagccagacatggtggcaggtgcctgtaatcccagctacttgggaagctgaggcaggagaattgcttgaacctgcacggcagaggttgcagtgagttcactggtattaaggtggtttagttattacagtatttggaagttgaacaaatgactattgaggtaccatttggttttgacttgaaattttagccagttcttacaacctgtaaatgaactttagatctaatcatgcgtgttccttaaagttgtgtgcttttaactttcttttttagggcaggggtcttaattcttcttatgatcaacaagaatacatagggagaagtgttcattattggaagaaagttttgccattgttgaagataataaagaagaacagtattcctgaacctattgatcctctgtttaaacattttcatagtgtagacattcaggtaacagagttcctttatgaatttattggagatgggaatttccagtttataaacaaagacgtggagctataaactgcttaaattaattgccttgttatttaacggtaatcttgttttctaaattcactagctctcacagataagatatgacagagaagagtaatgagatgtttgtctcttaagatcatataaaatctttggaaaatcatttgggttttatattctgagtataaacaatttgactaaaaactattctgtgtgtttaggcatcagaaattgttgagtatgaagaagatgcacacataacttttgctatattggatgcagtacatggaaatatagaagatgctgtgactgcttttgaatctataaaaagtgttgtttcttattggaatcttgcactggtaagtagatgcagtacttgagctaaaagttttatttatttatttattatttcttttaaaagacggggtttctctgttggccaggctagagtgcagtggcacaatcttggctcactgcaacctctgcttcccaggctcaagcgattcttgtgcctcagctcccgagtagctgggattacaggcatgagccaccatgcgtggccaagctgaaagttttttgttttaaaaagctaatgatttcataaaagcactatttgtatagatttttcacaggaaagcagaagacattgaaaatgatgccgtttttcctgaagaacaagaagaatgcaaaaattatctgagaaagaccagggactacctaataaagattatagatgacagtgattcaaatctttcagtggtcaagaaagtaagtagcaggttgttgtatgtacgttcttactgataacccactggtcagtgtttttgcgttggtcttatattttggtaatttcaaaaatactcagtaatatgttgttattaatgcacagaagggatgtgtgtgtctaaatgcttatatttgcttgctttgtcttaggtttggtgtgtctttttaaacttgggaatctaggtgttatcttagcagtgtaatcaaaacaaatattataacctcaggactaattcttaatgaactttgctgaaattgaaagttgttgctgacaacttaagagcatttcttctcatcctcatcagccattatgaacgcccttgttttcttgctgtcagctgtttgagattgtcatgatgatgttaaattatgttcagtcttctgagtgttttgttgattaatttgtgttactactcttttattaggatttatgttgtctggtgtattgtagcatctgtatttctgtcaccattgaaaatcagttagaaaacatcagtaacttattttgttcacttggaaaagctttccaagttaacattcctctacaattatcatggttaacagaagtaatagaaagagcatggactttagaatcagaagatgttagattgtacaacacttttctgtgttcatgaagaaaaaaatagaataaagacaaaaaaataaaaataataatacaaaacagcagaaaaacaaagaaaaaagataattaaaaaacactttcacgtgtattattatttaaagtgtaaagtgcttattaaaatgacaaaaatgtaaataagataaaatatatcattttagagtttttacttttggaattttttgcaaatgaaagcccttaattaatgtcttttatttttagttgcctgtgcccctggagtctgtaaaagagatgcttaagtcagtcatgcaggaactcgaagactatagtgaaggaggtcctctctataaaaatggttctttgcgaaatgcagattcagaaataaaacattctacaccatctcctaccaaatattcactatcaccaagtaaaagttacaaggtaaacaggaaagaatggaatcatttcattgtgaaattgtttctaagtgttttaaatgctcttttgttatttttatttttttttttagtattctcccaaaacaccacctcgatgggcagaagatcagaattctttacggaaaatgatttgccaagaagtaaaggccattacggtaagtcacttaatttctctagctgtactttttattccaagattccttccctggccactctctcactttttttctgaagctggtcagaatgtccccttgccatccaaatagtatggcaaggggacattttggtctttttttttttttttttttaaggcagggtcttgttgtgcaggctgcagtacagtggtatgatcacagcttactgtggcttcgacctcctagctcaagagagcctcttggcttagcctgccacgaagccaggactacagagagtcacacgccactaggcccagctaattgtattttttgtagagatgggatttttccatgttgcccagggtggccttgaactcctggctcaaacaatcctcctgcttcagcctcccaaagtgctgggattgcaggtgtgagccactgtgcccagcctacataccttggtcttgaccctttaccatattttgttttgttttgttttgagatggagtctcactctgttgcccagtctggagtgcaatggtgcgatcttggctcactgcaacctccacctcccaggttcaagcgactctcctgcctcagcctcctgagtagctgggattacaggcacccgccaccaggaccagctaatttttgtatttttagtagacacagagtttcaccatgttggccaggctggttttgaacttctgacctcaggcgatctgcccaccttggcctcccaaagtgctgggattacaggtgtaaaccaccacacccagccctttactatatttttgaaagtactttatgtgtctctctcctcatcttccacaaaatttgagaccttcaaaggtagaaactgttttatttaaaatataagagttcctgacacagagaaggttcccgagtgattgaactgctacagtgtactaatcatactctggtctatgagttcattctcagattagctgtggattacatgtgtttcaaatgtatagctaggaattgaaaagtggtctgagcttcaaaaagtcttgctatattttaatacttccatatgaatttgacttaattatgtaaggaaatagttatgtatatatatcttattttaacaatagggttcaaaggagcttgacttttttggaattggaaataaaagtaggttctttcatgtttatcaggcaagaactaaattatactgctaaagttacatcaaggatatgctgatgtgtggcgattattacagtgtgatcagcagtatttgcaaattgagagaatactatttggtggggaagacatttttgaatttgcacaaaaatcttgaatgttaattctgtgtagtcatggcctatgacaattacatacaattttgacttaacatacaggtttcaggctcccaacattgtattctgtggaagtatagtggagcactagtccatgagcttgaaaagcttggtactagtactgactctgccattaattaatgatcttgggccagtcacttccttcgtgactggcttcttatctttaaaatgagagaattattgaagccagttctcattacactgaatgttaaaaattacagttacagcagtgattgcaaattcaaagctctggtgcggataccaacagtgaccataaagttttctaggtgattccactagtttcttatttcttggatgtgtatgtgtagcatctggactaggcactgtagatggatgagtgggggaaattttatttagcttgaaaattgagatagttttggacctcatggttaggtctttctgggaaatttttatttgaaacacttgtagaaaaagaaagcagacatgctagatctgtccctgacctcacttgttagaactggtcggattcctgggctgatacagagaagtttgaaacttttcaaaatttacctgttttctgataccactacaatttctttggaaaaagaatttcctgttaagtgtctgttttgtaaggggacattttgtaggttctagggttgggtatggtgctgtcatttagttttcttcagcagagatcaggtagccacatagctacactagatggcattgtatctatctgccatcttgtcaaggcagcagagttgtgttaagagaacatttttggagtcagatgtggttcaaattccagctgttattccctgcatccctttctctcattttaagataggagctaatattgtttacctaacagtgtagatagtataaaaattaagagtttaagtgcattggacgtattattatatacataataaattatctgcagctactgcttttttccctttcctggtggagcatttgaacgtcacctggagaattagttgtattttgtttcagcatggggttaagtgaaaagctaatttggggaggtgatttggaatgtcaggtagtccagattgcagtatagaaagaacacactgaaaggatggtcagtgtaatgttagaggactgtgaaagttggggaaagaagtttagtttgtaggtacttgtttttttgagcagggaattgtcttggctggaggtgaatgtcagaaaggttaatgtaggcaagtgtagaatggaaatgaaggtgtgatcatttaggaggttatttgtttaggtgagagagttaatgaattaggttttgtattaacgaatgaaaatgggagcagataaatttttaacaaattaagaatcatattttaaaatcagcaccaggtacctagaactcattggcaaatagaaactttcaaaagatataatcaggtccgggcgtggtgggtcacacctataatcccagcactttgggaggctgaggtgttggatcacttgaggtcaggagttcaagactagcctggcaaacatggtgaaaccccatctctactattatacaaaaaattagccgggtgtgctggctgacgcctgtaatcccagctactcgggaggctgaggtgggagaattgcttgagcccaggaggtggaggttgcggtgagccaagattgtgccattgcactccagcctggatgacagatcgagacaccatctcaaaaaagaaaaaaagaaaaaatcagttatttaaatttaaaagagtaagtttccccagcactgtttctggcatgatataattaaatgattaaaattatttgatttttttttcttccaatagaaactaaatagcagtaagtcagcatcccgtcatcgttggcccacagagaattatggaccagactcggtgcctgatggatatcaggggtcacagacatttcatggggctccactaacaggtgagctggcaagtgcataatcgcatattttagtaaaactactttacttccctcttttaagtagataacgtgtgaaatcaccttgtttatatatgtttgttaatatacatgtcaacgtctgtttatatgtgacttcaaaagctgtatttggtgttacggagatttttataatcccaagcagaaaaaacgagccgtatgtgatcacgtgtatataaaggcttaaagaacacttaatccacacctcagatgagctgagatgagattattccttaaattgaaaaatgttattgaatagagttatgcactaagaaatgcttaattaagaacctacacctctggggaattattttgatgataatgatgagaggcaggacgttatataggaaatcttacttaatttgaaatattatggttatataaagaaagaaaaggagtttggacctgaatcatacagggtttttaagttctgctctatcacttactataatagctgtgtaagttaacctgtctgaaatgtggagataatacttgccttacataattactatgagcatttgtgtatgtgcaggtgggcgtgggtgtgtatcagacatttattagagtatacagtaaacagttaatgaactaaggttactaatagtgtttactgtgggttggctatgtgcaaaagtgctttgtgaatgtaatttgatttaattacagtaacttagaatggccggtaccattattaatcccttttttataaataaggaaatggataaagaaaggttaggtaacttactcattattatacagctagttattgatagagccgagattcacactccagtggtgtaactccaaagcacttgccagtataatacattgctcccaggcagccagaaataaaaaaattgttccttttacgtacgacagacttctgaaatggtagtagtagtgcccttttttttttctctttttagcccaggaaagatttagaataaaatctagtttagatgagcacatttgtgtgatggttcctatagttaaggcaaccccactagccttttgtgatagtatcttctcaacacaagcaaaataacagaaaatctttgtgaagtcaagcttattaaatgtcgtaagtcatagataagtatatgaaatgtctaacgttcaaaccttgttttcttaaaaccttacacatcatataggtccttgtaagaggataaacaaaccggctagcctttcctggggcttttttagtgacgtgtgcagtcagttatttggtgccttgtgggtcatgatttccatttcttctgtgtacaggcataaaaggtcttctgttcttatacaagcatgtaaatccaacattctcattgtctcattttattcttgcaatgaccctgtgaaatgtgtagaagcagcatatcctcattttacaattgagaaacatggagactccaaatggattatttacaggttcacaaaacagctttgtggcactgaaagggcgagagccaagatctcctgatttctgttcctgtgttcatagattctttttccttaataaaagtaaacatatatcaagatggtccttgtttttttaaaataagatgattaaaattaaagattaatgagctcataggagatactcagaagtactgaacagggtgaagaaaactaaaaactaaccaccttattaacatttcttatatttgagagcatttccttctggttctttctctatacatatagtattttttatgagattgttaccatgttactatgttgtgtgtagatgagctagcctgttttttaaatgttactttagttctgagcatttttaaacttaaatgttttttgaatattaatgagttcatggtgtcccatcacatggaagtactgtaaattctgttcctttatttatgttgtttctggtttatgccattacaaattctaggacactgtcctagttttgtagggtattcaaaatattcagtttatgctcttaccactagtatctgatagtgccattttcgcacttttgctaatgctgacttactagtttataaaatcctttgccaatttgtaggaacaaaagttatatcaatttttaagtttttttaatactagtcatgctcaacaattcatgcaaatggcagttggtagttttgccatcttcaacgtgggtaccttccagttgtttggtttcttggtaaaactcacacaaaacagatggagaagagtttttgtatatcaacatgaatgttaatgtgatttttttaaagccaacgaacacatttgtgttccttgtgagatcctgtgcatgaatttgtcaggtaatttttttgacttgaacattctcataatagcttcaatttgcacaatgcaaccttgtcattttgcagattttcaaggctcacttcaaaaacatgttccttgaggcctattaacatttctttcctaaattgtctattcatatggtgctttaaaaaattagattacttttagtatatttattagagcctcacagtttagagtcagtagtcaattaaagtccctacttaaacttcagactaagattttttttttatttaatattttattttttctttttgctttcatgcagacagacattttgcaagactttaagattcttgggccatttctgtcaggttgttctgtgttctgtgcctgcttcctccccatagtaatttcaaaatagttatcctcacctctgtaaggtttccaaaatcaaacttgggcttctggctagccttttctaggtcttgatttttcagtgctttccagaggcaattgtttggaacctcttcgcacagtttctgtttcttcttccatgtacaggcataaaaggtcttttggttgttttctggtaaaactatcataaaacagttcaagcaaatgactattggtagttttgtcattaacatgggtgccttctagtcgttttgtttcctggtaaaacagaccaaacagagggagcagacagtttgtacatctgtatgagtgttgatgtgctttttattttaagccagggaacacattttatgttatttatgacatcctttccatgaatttgtcaggtgatttttgagctgaacattctcagtaatagctttagtttacaaaatacaacctagtctttctgcagattttctaggcccacttcaaatgcattgaccatcagatggcatcttggttccttacgtcctttctgtgactgaatgtccataattccacatcatactgatctttcttagaaaaggcaacagttactttctcctttattccttttttaatgcttgtgaggtagttcttgttgatcacagcgatgctattctcttattcttcatgtcatatttagcaatttttttctagtttgtcatttgataatcttgattggtatattttgatgtacagaaatttaaaatttatgtagttaaatctttctttaatttctattgcttttgtatttatagctcttgcctagatagtcttaactgtagtatagactttaacagtgttttctttcttttcttttttttttttttagttgcaactactggcccttcagtatattatagtcagtcaccagcatataattcccagtatcttctcagaccagcagctaatgttactcccacaaaggtaacaaaggaataatttatacatttataattattttctttttaaattgtttagggttccttcaaataaattcaagagagcagttcactattaaaacttttatgtcccttaaaatgtagatattttaaatttatctccaaatacagaaattatccttcttagtcaccttatttttgtgttaataagtgtgaatatttagaatattttaaaaatgggagtggtggtggtggatccttcatcgttctgttttaacagaaatagaactgtaatgcccttgctgacccactatgtggtaagtactttcaggcctgatacagctatatatataacaattgattgaagactcaatattacagtggtagttgaatgtgacagctttgaggacagagtgttggggtgcatttagacccttgttcttctgcttattttgaccacaggcaagtttcttaacctctcaatgcatcagttgcctcatatgtgaaatgagggtaataataataccttaattcatagggtttttgaggatattaaaatgagataataatgtaaagtgcttagaacagtgcccagctgacacattaataaatgctcaataaatgttatcatcatcatcatcatcattattgttaacatcatttgataaattgtttaggaatgaagaaggtatttatttcatgactattttgggcatgtggatcaagaaaattcaccttcatttatgtttcagggttcttctaatacagaatttaagtcaaccaaagaaggattttccatcgctgtgtctgctgatggatttaaatttggcatttcggaaccaggaaatcaagaaaagaaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctgtaagactgaggacagcgatgacatccattttgaaccagtagttcaaatgcctgaaaaagtagaacttgtaacaggagaagaaggtgaaaaagttctgtattcacagggggtaaaactatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaagggtaggtactttgttgttaaagttaagcacaatttttctttcttttaatgtttagcttgatgcagactctttgtgggatactaatgttgggatataaacgatgctttgtgaacacccccaaaatatttgagcaattttttttctcccttaataagttcacggtgaggtttcaaagagcaagagaacttagttaaagacatttcagtaactggaagatacttctatcatgctagggcagagcaaaagaacttggtacagtgtatggactcatgcttgaatcatgcgcattaacgtgagtctttttttaaagtgttcattttcatttgttctgtttcttttgtcactcagaaaacatgatattgaggctgggcacggtggctcactcctagaatgccagcactttgggaggttgaggtgggcagatcacttgagctcaggagttcgagaccagcctggccaacgtggtgaaaccctgtttctactgaaaatacaaaaatgagccgggcgtggtggtgcgtgcctataattagcagctactcaggaggttgaggcaggtggatcgcttgagcacaggagatggaggtagcagtgagctgaagtcatgccactgcactccagcctgactgagtgagactttgtctccaaaaaaaaaaaaaaaaaacaaaaaaacaaaaaaaaccatgatattgagatgttctcattttatgtgttgtatgtcagtcttgctcatgtattaaatgagcaaagaatgaaactacagggataaatgaatatgtaagacagtcagattggtggtataaattgagggattctggctttttatgttttaaaagcatattcattttgtttcctaaaatgttaaaaaatgaaatattctttattttctaggatttaattttagcctttttaaatctaatcccatggccttttggactagcaccccttcctcacagcctgagagcaaaggtatagaactagcattctcagtatgagataacagcagtttttagcagctggtagcccttaggaaagtattaataactgtggctgtatgaaatgaagtacttaccactacaacatgaatgttaaagaatgccagtttaagcaaagtaccttttgactggtggcatgacacccttgttggtttgttttttaaaatgtactgggatgctgatttgtaatgtacttcattgctctgctatttcaggtctgctcagtgaagacctatgttttatctaatgtttatctttagccactaacgtctgccagtattcacatgtagtggcaacggcatgtatacagtatggaagagtgtccctgtagggctgttcttttgtgcatggtttagaaaaatgttgtatttgaaaatggaccccatttttaacagccagcattctacagcttgcatattatatatgttgcacagatcatttttagaagtgtggctactagagtggaacaagaagtgggatctgttgaaggccttcaagaacaggttagggaagtgaaacctcacccttagtgaccagtaacacatcttagccatgccaaacaagtacaatgataaaataacaatctctgatttttttttgagtataccagttttattaccagctaaggtagctcttaatcttttattttaaagatacggtctttgagaaatgtgaaaagtgttaacttaaaagtggatgtatacttgcgtacagtttctgtgagctctaggttaggaatccctgacctaagaacgaatgtgcctatacactactgtagaacatagagccttattctgttttgaatctgataatgtcattgtcccaagggaccttagaaatgaagactttagacatgagtaaactgaggccaagagaggctatctgatttacccaagaggtctttactgagtaatagcagaagtggaacaagaatctgtatcttacggtgtactgttatttctcctagctaggaaatgatactaggttttcgtttataatgaaggagagggacaaatttaacattgtaaaaggaagggcactggttctgcagagcagtgtcatccaatagaaataaaatataacctgtgtatgtaatttaaaattgtcatttggtgcaatggcttgtgcctataatcccagttacttgggaggctgaggcagagggatcacttgagcccacaagttccaggcttcagtgaactatgatcacatcactgcactccagctctgggtgacaaagcaagaccgcatctcaaataaatacataaataaataaattttctagtagccatattaaaaagaataaaaagaaacagttaaaaagggaaacagatgaaagtaactttatcgatagatttgatttaactcattatgtccaaaatatcattttaacttctaattaatataaaaattaatgatattttacattattgtttttcaccaagtcttcaaaatccagtgtgtgtgtttacacttactgttagcatgtcttgatttggactagccaccttgtgaggttttaatagaatgtggctaggctaccatattggacaccatagctctcagaatgtttccctgtcaccagttggtatacatggcatgcttcataactggcttactttattaaactcctttagccagaagttgttctttacattaatagatcagaacaggttgcatatagaagttttttctgtttctaattttttgccctttgcattgatggtggctggggatgggttgttttcagccatatgaatggtcttagattttatagtgttagctacccatagagtaacagtttttatttaattttatctagtatcatgcttgaacacaggcaaactagatgcaactctagtcaccttccattcttggcaattgttaactttccttacaggaactaatcacagttggctttggattagtttcatatgtatactaatacttgcttatgttttaagatttttttcaattgctgcaaatgcatggatattttggtaaactattgtatgctaagtatagttaggcaacactttaaaatttttaacctttttaaattctagaaatttgtagtaattcttttcaatgactattaagtaaacacaagatttttttgttttctttcgttttaaatagattctgtgttcacttagggtttttggtagaaaactaaatcaggatgctaattctaattcatgattatcgtacatctctgcatcaaagtatatgtgttttttatcagtatgctgttttaacctatagataggttccatggtttttattttcaggtagagtattaacgtcaatacttaataccttatctttgtcaatttttttgactggtgttacagcaaaagagaagaaaaaacctgaagattctccctcagatagtctcggtctcctgacctcgtgatccacccgcctcggcctcccaaagtgctgggattacaggcatgagccactgcgcctggctgacacatgtcttaattctggtattcaccagatttgtttcgtgttctccgttgttagtcatcaaatttgtctactttttaaatagaaacattagctagagcaaggaacttagaaacactcaagcagcactgaatgtgtagaattgcataaccaatatagcttctttgctttcatatttacaattagttggagttttagttcagccgtacccagtatcttccattctgcttccaggaagaaatggaaaaatgtcagccatgatgatgcagtattttagtagcaagttgatggtgttttggtttcccatgggaaatattgtcactggagcattagcagctatcggtcacttattagggtaaaaaagcaacttcagaagaatttaacatatgccaaagaatcaacaaaggaagtaatcagccagggcaaaggtcgcacaagagattgtaatctagcaatcagcagtggaataagcagtcagcttaccagaaacccaggaaaatgctttagaaagggcagtcaggactaaggcaatttaatgaaatgcaaaataaatgaaatctgaagtttaaaaatctagattacaattctggtttctaactcagttatgagaccttgggcaaagtcattaaatttctctgaacttcagatttttgggagtcaataaaccaatacatgtcaaagggcccgataaactttacagtttagaccaggcgtggtgtctcacccctgcaatctcagcactttgggaggccaaggcgggtggatcacatgaggccaggagtttgagaccagtctgaacaacatggtgaaatcccatctctattaaaagtacaaaaattatctgggcgggatggcatgcacctggaagtcccagctacttgtggggctgaggtgggaggatggcttgagcctgggaggcagaggttgctgtgagccaagatcgtgccactgcactccaacctgtgtgacagagtgagaccctgtttcagaaaaaatatagtttatcagcaaacaggaaagtcttgctaggcaacgtaattgattagttctgtgccctggattctgggctcttaactgtatgagcactgtaggtgtgagcagcaacaattaagaagctgcagaggtaaaggtataagggcagtgattgaggatgtctaccaagcagatttcggcaagtgtgtttcaagaagtatgccgcaatctgaaatacctaatcctgaaaaattgctagaatctagtcttttaattttggccagtatttagcagtagtttggccctctactctaaattaataaaaaataagtagtactatattatgagctgtgttatctaacagtttatcttagctagtagcaattaatttatagctgctattaaaatgactaacgtagttaaaagtttgatgactaagtttttttttgtttgtttgtttgtttttttgagctggagtctcgctctgtcgccaggctggagtgcagtggcatgatcttggctcactgcaacctccgcctcctggcttccagcaattctctgcctcagcctccccagcagctgggattacaggcacctgccaccgtgcctggctaatttttgtatttttagtagagatagggtttcaccatcttggccaggctggtcttgaacttgctgacctcgtgatccacccaccttagcctcccaaactgctaggattacagatttgagccaccacgcctggccttgatgactaaattttaggaaatgttttagcaattcttcatacacctttcacttatagttacttaattcctctactcttatcatttgatattttcattttattgtgtatctctgtaaggccgaatcaatagattttgaacaatctcacacttaacctttaaaaaaaatctaataggcccagtttcctctcagcaatctttgaagaaccttcgagaaaggagaaacacagacctcccgcttctagacatgcacactgtaacccgggaagagggagaaggcatggagacaactgattacggagtctgtgtcttccgccagcacatacacacagtctttagagcagctgcttaattctcccgaaactaaacttggtctgttactctgtctaaatatgttcttcttctttaatttcactgtcttatttaattactattacactaaggtacatatgcttttttgggctgctccaataaaatttctttcaatattccactacctgtttgtattagggttctctagagggacagagctaattggatggttggatggatggatgagatggatggatggatgcttattaagtattaccttacacgatcactaggccatctgcagactgaggagcaacgagagccagtccaagttccaaaactgaagaactaggagtctgatgttcaagggcaggaagcatccagcacaggagaaagatgtaggttgggaggctaggccagtctcgccttttcaggtttttctgcctgctttatattcgctggcagctgattagatggcacctaccaggttaagggtgggtctgccttccccagcccactgactcaaatgttaatctcctttggcaacaccctcacagacaacactcaggattaatactttgcatcctttaatccaatcaagttgacacccagtattaaccatcacactgtccaaatggaaaaattattaaacaaatcttttttaaaataaaatgctagctcttgccctaggcttgaaccataaataagtggtgggaagtttatagtcacaaataggtggtgggtattagaaagcaggataaactatcctctcacccttccaagaaactgacagtttcagtttattcctcttgatgaagtaatgctaaatttttgtagtgatgttttggtatattttattacctgtaattaatattactgttcaaaatttagggggaatctgtcatcttcctgaaacttcagaatcacctggagtaagggtcatttgtattcatggtcactgaccacatggggtagaaactgcaagtcatggttccttcaggcaaagttaatagtggtgacacggaggcatcatgatagagcagcagactccagaagccaatttgactttgtgatttctgaaaaaattacctgtcaactgtgagcctgtttcattgtctgtaaagtttgaataatgatacctaccccgcctgatagaagattcttatgagggaacatgatacgtgaccagtaaatgttaatgctttccttatacgtgaaatgacataaaatcttggaatattaatagatgggaagaagatgtgtaataaaactgtctataaacacaattctgacaaatttcagaactgggactcatagggcttgtattcagttagattacatgctttacaacagagatactgttttatttgtgtcacctacaacatataatctgttgattgaggtatgttgaatagatgaatggcaaagaaagcagacctataaaatatcacatagtaagatatttatatttagatttttcttatttagaatcttcatctgtaatgtatgattttgaaaattaattcttggaacaacatgttgcagagcctccattatggcatgctgaatttaccaaagaagaattggttcagaagctcagttccaccacaaaaagtgcagatcagttaaacggcctgcttcgggaaacagaggcaaccagtgcagtccttatggagcaaattaaggtgagatcagaaacctggccactgtgaaaaccgccagtttggttttctggaccctccatacacatgcacccaagtttaaaaattcacattgcagatgcatctataacgtcttgatctttatattagattattagattcctgatggtgagaaataaatattgccttttttttttttttttttttttttttttgagacagtcttgctctgtcacccaggctggagtgcagtggcacgatctcggctcactgcaagctccacctcccaggttcacgccattctcctgcctcagcctcccgagtagctgggactacaggtgcccgccaacatgcctggctaatttctttgtatttttagtagagacagggtttaccatgttagccaggatggtctcgatctcctgacctcgtgatccacctgccttggcctcccaaagtgtgggtattacaggcaagagccaccgcatccagccaaaatacttcttttacacctattacataaagattatttcttaattcctacttttcctaagaaaccgtaatagatttagaaactagagagatgttcacaaatcattgttcacatatgcttaaataaaaaatgggtgtgagtctttgaattctaaagataaccagtgaatttaaattattcaactgatatttatagtactgaactactaaacagttttcaggtggagatggcaaagtggcatgggaagtttttcctgtttaaagtagacaccagaaacatctaggaatgttgcagaacagttgaggattactcaaatgaggtatttccaccctggctcactgataaatcacccctcagaatatagtcatactgcttattgaggagttcttatgacccaggccctgggctctacatacattatttaatctcatcactggttgagagaaaaattgaagctggtaaatggtggaacaaaattcaaactcatagctgtctgaaaagtacatgcttttcccctgtactttgctgttcctagtagatctgtcctgccactgtgcaaggccactagctatccttgtcagattattttaaagccgaattcagttattttcagtaaattgtatatatcatgacattccaccattaaatacttcagtatgcatctctataaaatagcattttcccactaataaaaacattatcatagctaacaaatcactaactagcccagtaaacctaaatgacttatttaaatgttatattttcttttttttttttttttgagatagtcttgctctgtcaccaggtttggagtgcagtggtgcaatctcagctcactgcaatctccgcctcccaggttcaagcgattcccctgcctcagcctcccgagtagctgggactgcaggcacgcaccaccatgcccggctaattttttttattttactagagacacggtttcaccatgttggccaggacggtctgaatctcctgacctcatgatctgcctgcctcagcctcccaaagtgttgggattacaggcatgagccaccacgcctggccaaatgttatattttcataaatttatactctcttcatgatttctttgtcttctttattgtcacttttttaaatggtcctaggtttgaggacaaagttcgctaactttcttgcctaacctaaaatgaaaatatactaaaagctatggcttggtttcaacctggaaatcttcctcaaagacttgaacatgatactaccttttttatatcgttctttgcctcatttctctgatagtgttttacattgtcttatattcctgaattttcactgtgtctgaactttttaagtgccgttcactgtggacgtcttaactgcctgggacttcaggaacagcgtaggggcagggggttagtggaggctaccgatgttcccctcagcccattttcagagccccatgccatactggcttagtttctatcaaaagtagaaggcagagggaacatcttggtaccaacccatggctccagttagttgctcctcatggagacgttccatcagttccccagctttcaactccatttccatgataccctgtgcttctgagacaagaactccagtatttacacaggatgcatcctctcctcttgtcagtgatacttggtaagctgctggactgactcatttccacctcttcatctgtttctcgtgagaatgtcttgacgttatctcatctactttttctcctcttgtattagcttgttgcttttctacttcacccctcttccttccaaccccaaatagcttaggacaatggagtcatatagcccaacacttggttcatatgcagcaatccactttctaggcaaatgcagctttgaaactatctcatagttggagttccggttttcatgtcaaatggattttatacggtgatgtcataaactcctttgaaatgcttcacatgcagctgctgtagttaactgaattccttcctttattgccatatggagggaagggggaaatttggggggaagagaagaaaaatacatgagttcagtctgccatatttaatcagaagctcctaaagcccatttttaactcatttctctaacaccagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtgggtaaaaggagagtctcagaacttctgacttctaacttaaactaaacagcctggtggttgagaagttgtctgtatgtgtaacttttcaattttgctcatttgaattgggtctgtcatatgagtaggccgtgactagatttgaaaagctgactttttaacatcttgaggcaactgtagtacatttatataattttaacattcagcaaaatacaataagtgcttagcttgatcttctagctctttgaaaattggatttttatcctggtgttgagttctggtgttcagctgaacgtggttttgttttaaattctactttttaaaaaacatttattagcttgttccttttctacttcacccctcttccttcctccaaccccaaatagcctaagacaatggagtcatatagcccaacacttggtctatatacagcagtccactttctaggcaaatgcagttttaaaactgtgccataggccaggcactggtggttcatgcctataatcccaccactttgggaggccgaggcaggcggatcacaagatcaagatactgagactatcctggccaacatggtgaaatctcgtctctactaaaaatacaaaaattagctggacgtggtggcatgtgcctgtagtcccagctactcaggaggctgaggcaggagagtcgcttgaactcacgaggtggaggttgcagtgatctgtcacgccactgtactccagcctgacggcagagcgagactcccatctcaaaaaaaaaaaaaaaaaaaaaaaaaaaaaaaaaaaaaaaaaaaaaaaaaaaaactatgatgtagttagagttggtttccatgtcagatggatttaatactgtgatgtcattaacttctttgaaatgcttcatatacaactgctatagttaactgaattcaagctgcatcttaagaattatggtttcatttttgttttagttttaaattacttttatttttgacatttacaagcacaaggaagacgctataatctctcttgagttgtcacccatctctaacggttttcaactcatggacaatcttttggcgtaaataggggagagttagagacttaaatcccacacatcatttctttccccagtgaataattcaatgtttattggatttctctgtcacctatacctagtttatgttcattttgcctgtgttattgtgaatgtctttttatagtatcctaaatagggctcatatattgcatttggttgatgttccttaagctttattttgttgttgtgtttttgtttgtttgagacgtagtgttgctctgtcaccctggctggagtgcagtggtccgatcatggctcactgcaacctccgcctcccggattcaagcgattctcctgcgtcagcctcccaagtagctgggactacagatgcacgccagctaatttttctatttttagtagagacgaggtttcaccatgttggccaggatggtctcaatctcctgaccttgtcatctgcccgccttggcctcccaaagtgctgggattacaggtgtgagccaccacgcccggccattttgttttttttatctataacaattacatatataaatatatttttaatgtgccacttattaattgaagaaagtggtcatttatgctatagcagtcctatatttggtttttaatcattacagggtaacactgagcttgttctaattgcctataaataggaagatccaggtgcaattgggtgggatggtggacaaaaatacaccatagatggtattgtgtgctttctaagacatcaggaggcccagaatgtccagacatcttacttttgactgattgaccttatctagttggtgctctttaacatgttccccatcccctgtaaatcctaataactaaactgataagagtcatcctcaaaattgagcaggcatctgaatcatctggtatacttactaaaattccaattgctggtccccaatttctgacccaagattctgcatttttagcaattcgttgctgatacttctggtctggggcccataccttgagaatccctggtctagaggcctgataagattcaggcttaattttttttacagacatacttcataagtagtattgatagtttctttgaatctggtttttaataatctttctaatgatgaaggaggaatgttctcaatactgacagtaatctcagttcttcaaactataggataggtttctatagccacaatagtatttttgtcacaagggcccaaataagaatacatcatgtatatttttagtagttattcaaattacaggttcactgtctttaatttattctaacaaaagtaaacctaattttatagttataaaaaagaagaaatctacttctagtcacctaagagtaaaactgcccctataaaaaacaagacagaaatctcaaaattataactaattttatagttataaaattaaccaggactttaagaatgtttgcattttaaaattaaagttttcaatacaacaatgatattatctcaaaatactcagcatgtctaacaggtctcttttaaaagctcagcatgtttaatgtagacgttgctaacgtccaggtggctcctataagttaagggtccattgatttagaagttctaaaagagactaacctaagggataccaagaacagatatttttaaagaatttcatagaggagatacacattagaaacccagaactctaagatgtgcatttggtaagtcctgtaaacagacaggaaaacacatttaaattagtttgccctttaaagattatttcctacttgtctcttatcaatgtgagtacataaaagagaccttattacaattaaaaactgatggtttagcagcagatttagataccttacattttctctttaagagagagaatgtaaggcctggcacggtggctcacacctgtaatccagcactttgggaggctgaggagggtagatcacctgaggtcaggagttcgagaccagcctggccaacatggtgaaaccccgtctctactcagaatacaaaaattagctgggcgtggtggtgcatgcctgtaatcccagctacttgggaggctgaggtaggagaactgcttgaacccaggaggcagaggttgcagtgagccaagatggtgccattgcactccagcccgagcaacaagagcaaaactcttatctcaaaaaaaaaaaaaaaaaaaaaaaaatgtaaactacaagatagttcaaaagaaattacacagaattcagcatgggagaaacaaaaaacaagagtgggaaaagacatcaaacatgtttttactaatcgaagttctaaaaggagagacaagaatacagcacagataatatatgaagagaatggctggaaatctttcagaactgttgaaggatatctatccacagattcaaaaacccaataaaatctcaagcaatattaaaaaaaaaagaagaaatctacttctagtcacataagagtaaaactgcccctaaaaaagacagagagaaatctcaaaagcagccagagaaagaagacacattgcctcacaatagacttctcaacagcattggtgtaatactatctcatgtactaaaagaaataactgccaaccttttatattttccaagatctcttctggaaaacaaaaactttaagaatctgccttcactgaaaattcttaatgatgtacttcaagcaaaaagaaaatttcctaggtaaaagttctaagatgccagaaagaaagacatgcaaaggaaacttaccaccatattacagatatggactgtcagtctgactggtcacactaggggcatttggttaccaaggccttgaaaataataaccaacactgcatacatgagggatgccagaagaaaggtctgagagccactcttcctggcactgaaggaaacagggcccatcagagcaaacaagtaccttttacctctctccttggaagcaaatgtttataatctctggttttgtgtaaagtttataacagtatttttcattcaggttgctacctattagtggatggtgaaattaatttggtggatcacattcagaatatttttttaaaatcaaaagaatacaagctggggtcagtgactcacagctgtaagcccaaaagtttgggaagaccaggcaggaggattgcttgagaacaggagttcagaatcagcgtgggcaacatggcgagaccctatgtctacaaaaattttaaaatataccagatctggtggcatgtgcccatagtcctagctactcgggaggctaaggcagcaggattctttgttataaggagtttgaggctgcagtcaaacttctggtcgaaatcctggtcatgccactgcatttcagcctgggcaacagagtaaaaccccatctttaaaaaaaaaattaagaaataaaaataatatgtgaaacattagaatatgttgaatctagtaaggataagcaattatttcttgaaactctacatatatacatgagtgttggtaaatacctgactgtatcatcagctctagatataaaatgtttatgatgttggctgtgagttaatgaggaatagttttcctttctgtgggtttgggtgtatttgggaaacattagctaagggggtaaagtaggttacccaactctgaaaagcagcatcaaaatctttataataaacacatactaggggcccaacttaaatttcaagcagatgtcatgagctgctcagagtagcatgttacaactctgcgttataaggtaaaatgacacattgcctcacaatagcctgccagatctgagaacacagcaaaatttttattttgtcaaaaatctcatattcagcttacaccattcatttcaggtgaacatacaacagtgcatttcagtttagggaaatgtttacagtcatctggttctctttattcctgggaacaaggttacctcacttggaacacataaccagtgccaagttgtccatccctaagcaatattgcttccttctactttctagaagttcttcagattgtggaagagaaacttttcagagttctttgccctcattccctcctccagaaattcatgcctttgtataatctcttccccctgagagccagtaggctaacctaatgagttatttttaaccagtagaatacagcaaaaatgatagattacaagagattgtggcttctatcttgctagcggactctctctgtcttctctgcttgcacactttgttgaagcaagctaccatcccagaggcaaggaacacaggccatcagtttagcagccttgaggaactaaattcttccaactaccacataagtttggaagtagattcttctccagtccagccttcagatgagaccccagccatgccaacatcttgattgcagccctgtgagagaccttgaaatagaaccatttctgatctcctgacccacagaaactgtgaaataaatatgtgttaaggtactaagtttgtagtaatttgttacacagcagattgtaaataacacgtagataaaaccagacagaacagaaaaataaaatggctttaaacctagaaagtttccccatgtaaaattttgaaaatgctactctgcctaaggtcaaaccgtcatacatatatacgtatgaaaacacagaaaggtgtctggaagggtaataccaaattaaatctttatccaagaggaatgaaaaccagtattcacacaaaaacctatgcacaaaccttgtgaatatattaaaaaccagtgacttatgcactttaaaaaggtgaattatgtggtatatgaattatatctccaaaacatttaattaaaaacctgtacacaattattcatagaaactttctttaaaattgctaaaaacgaggaagatctcagttatccttcaactggcaaatgaataaacaaactggtacagccatgcaattgaatactgctcagcaataaaaaagaatgcactgccagtacagcaacatggataattctcaaatgcattatgccagttgacagaggtcagactcaaaatactatgtacagtgtgattctacttatatgacactgaaaaaagcagtactataaggacagaaaacaggttagtggttgccaaggagtgggagaagcagccagggagaactttgaggaggtaaaaatgtgccaggccttggtcggtggtggtacataactgtgcatttgtcaagactcagtgctatacgctgaaaagggcaggttttactataagttgtacctcaataaacatgatttttaaatgattaaaactttggtttttgtttgttttggttcagttttaaggtttaccataaatctattggttttagattctaagttgtatataagcttctgttttaaaagaacttttttaaaaatcctcttatcatcaacaatatttagttgtgctggaaattttattttggaattgtttaatagagaaagacaataaataatgttcaagaacagacattgattcataacatcaaagtatattgtgagaagatggtatttcagaatagaggaagaatttcttatgtgctggtaagattgtagataatcatttctgcataattttcatagctggattgctttaataaagccacttaaaggttaagttctagattgcttcatgttgcttatcaatgttttaaagctaaaatagaaaattagctgttaagttggctcaaccggaaattcagtatatcctttaaaaagagaaatttagtaagcagtgtgtctaaagaatgacatatggttgggtacagtggctcgtgactgtaatcccaacactgtgaggctgaagtgggaggatcacttaagcccaggaatttgagaccagcctggaaaacagcccagcccagcccatgcctggctaatttttttttttttttttggattttagtagagacaaggtttcaccatgttgcccagctggtcttgaactcctgagtgcaggcaatccacccacctcaccctcccaaagtgctaggattacaggtatttggttttttgtttggttttcaagcaacctttctcaattttgctatgctcactctttcttcacatgttggtactggctagatacagattttgctttcctattggagactcttttgagagctggctattccctcttgctccttttcttttttctcttccctactttcaagtttcttgctctttttcttaccccataagttaccagaaattcatacccccttgagagggctttttctttgaacttcagtctttagtttcatcaacttttctaaggaaattgatctgttaatgaaagttggcttgcttgacttcagaatatctgtattattcaatgatgtgtttttctggttgctttgtttgagcatagtgtaaatatcacccattgcatagctatggcagtgacataaatctagcagcgtaagatcgagaaaagctagaagtcccaccacagattgtatttcagtgaaagggattcattttaactgcttataaaactaaagaaaacttataaacatggaaaacaattattaaacccaccatatgctcatactgatattaaatggtgtgccagattctagaaagagttaccttttggtaagagcactgcttgttaactatggttggttgctttagatgtctagtgtgtacacaaaagcatgaattttattccttataaccaaagtagaaacctactctgagcaatttgacaaaaggtttacattatttattttagtgtagtttaagattacagtaagatgcaattcccaaagagtgaaatataaggctgggcatggtggatcacgcctgtaatcctaacactttgggaggctgaggcaggtgcatcacctgagatcaggagttcgagaccagcctggccaacatgacgaaaccccatctctactaaaaatacaacaattagccagatgtggtggtgcccacctgtaatcccagctactagggaggctgaggcaggagaatcccttgaacctgggggggtggaggctggagtgagctgagatcatgccattgcactccagcctgggcacactctcaaaaaaaaaaaaagtgcaatataacttttcacaaaatatggaactgtggtagtctagaacaatgtctcaatatacctcctacacgaagtataatagtaaatatctgtatttggtggcataatatgctcttagtataaaccaaaaacacatgctgagcattggacattgtccaatgtttaattcatatgattcattctgagtttctgactgagatcattctttcagactgtgtatttctcctgggatccataaaatatgcagccctaacatgatttcatttttgtttcctttcctggaaaaggagaaatcattcagatcagctttcatattgccttatagacgatgacttcaaaatagttttaaagggactcctttgttctagaactgctctaacacagtagccactagccacatgtggctattgaaagattgaaatgtggttattccaaatcaggatgtacagtaaatataaaatacacaccagatttcaaaggcttacatgaaaaaagtaatgtgaaatatctcactagtagtttttatagtgattacatgttgaaattttaacattgtgaacatattagtttaaataaaatgtattgtgaaaattaatttcatgtttctatttacttttgataaaagtactactagaggctgggtgtggtggctcactcctgtaatcccagcactttgggaggctgaggtgggaggatcacgaggtcaggagaccgagaccatcctggctaacacggtgaaaccccgtctctactaaaaacacaaaaaattagccaggcgtgttggcaggcgcctgtagtcccagctactagggaggctgaggcaggagaatggcgcgaacccgggaggcggagcttgcagtgagctgagatcgtgccactgcactccagcctgggcttcagagcgagactccgtctcagaaaaaaaaacactactagcacatttttaaattacttgtagtgatctcatttgtaacacattacatttcaatcgtatactgcttttctaaagagtcactgctaagccctgaaattaactccaaatacctccctgggatacagtgccaaggaaggggcttccttgaacttcaacctctaaaagtaagcaagaattgagaaatatcttctgctttgaaaaatattcactccccaacgctaatacatcaattacatattatttgggggctaactaagctcctattttaaaatgtaaactgaagaaatcaggccagagtcattcccatcttagtgccaatcatataatcagataattagattgctctttccctaaagcctgtttagtttttttgtttgctggttttgttgttgttgggttttttaatttgtttttgttgttgttgttgttgttgttgttttgagatggatactcactgtgtcacccaggctagagtgcagcggcatgatctctgctcagtgcaacctccaactcctgggttcaagcgattctcctgcctcagcctcctgagtagctgggactgtaggtgcatgccaccacgcccgtctaatttttttgttttttggtttttttgtttgttttgagacagtctcgctgtttcccaggctggagtgcagtggcacgatctcggctcactgcaacctccacttccgaggttcaagcgattctcctgcctcagcctcccaagtagctgggactacaggtgcatggcattatgcctggctaattttttgtatttttagcagagatggggtttcgccatgttggcaaaactggtctcaaacttctggcctcaggtgatccagccgtctcagatcaaagtgctgggattacaggcatgagccaccactcacagctcgctaaggccttttgccaagacaaattagctcttagagaaccacaggattccttttgtaatgtattacaaactaaagtcttacctactcttgaagagtagaaaacatggaaaagttctatgttagcccttagaataattaaaaattcataagctctgaaataaagacaggtaataaaatcattgcgtatgacaaaacaaaagtttaaattggcgtttgtaaactctgcatgaaagccaggtttctcactactagaaaaaaagttataaataaaccaaggagaattccagaatgaatcctgtggtgccaaatatatgttaactacaaggaataacagtgaccttacactggaaacaccttaaccatgggccaaggttaaagatataacagcattctcacaccccttgcatagctacccccaatgttaacataactgttaacaaattatcaaaactaagaaattcgtcttggtatagtatcactaactaaactccagacctcagtcaggttttcccagtctttccttcagtgtccttcctctgtttcaggattcaatccatgatccttgacacttggtactttgtcagatgtcccgctgtatgggtttgtttgatgttttcccatgattagggatagacactgcaagactcagagctactttacaaagaagcctctagggagctccccagagaagacaggggagacaacacaaggacactagaggaaattttagcctctgacatccatgactatatagcaaagagtaaacaaagcctaactcctagccagagaaacacaaaatctcatactaaagccttatttaactcagttcgtttcacccagtacatcatatacagcctcaaacaaaaaattacaaagcatactaaaagacaagaaaccccacagtttgaagagacagagcaagcatcagaaccagactcagatatgaaagaaatatcggaagtatccaaccaggaatttaaaataactaagattaacatgctaggggctctaatgtaaaaatggcataacatgcaagaacagatgggtaatgtaagcaaagagataaaaacactaagaagaaataaagatgaaatactagaaataaaaaacaccataacagaaatgaagaatgcctttgatgggttcatcaaaagaatggatatggccaatgaaagaatcagtgagctcaaagagatgtcaatagatacttcaaaagctgacacacaatgagagaaaagaatgaaaaagaaaaaacagaacaagagtcaagaactgtgagacaattacaaaaggtggaacatggagactttttggaaataccagaaagagaagaaaaagagaaagaaagccaggcatggtggcttacgcctataatgccagcaatttgggaggccgaggcgggcagatcgcaaggtcaggagatcgagaccatcctggctaacacggtgaaaccctgtctctactaaaaatacaaaaaattagcggggcgtggtggcaggcgcctgtagtcccagctactcgggagactgaggcaggagaatggcatgaacctgggaggaggagcttgcagtgagctgagatcgtgccactgcactccagcctgggcaacagagcaagactctgtctcaaaaaaaaaaaaaaaaaagagaaagaaacagaagaaacatttgaagcaacagtgactgaaaattcccccaaattcatgatagataaagctatggtctgaatgtttgtgtctcctcaaaagttatattgaaacttaatcctcaatgtgatagtactgaggtggggcttttgggagtcaatcaggttacgagggctctaccctcaggacagagattagtgcacttatgaaagaagccccagggaattagctagcccctgacaccatgtgaggacaaagccagaatgtgtcatctatgaggaagcagggcctcaccagacactgctagtgccttggtcttggacatcacagcccctagaacggtgagaaataaatttctgttgtttataaactctccagtttatgatatttttgtcacagcagcccaaatgaactaaggtagacataaaggaacagatccaggaagctcaaaatacatcatttcaataatgatctttaaaactttgtttgaaattatactgatcattccgctgactgctgaatgacctggcaccgtctcagggttttagtctggagtttttgtttatgctcatggcctcacggagaacaatattcacctgaagtgacggcgcttctctttttatgttgttgagaagcatgattggctctttttttgcaaaattattcacaaacttaaactttgattcagaattattgaagtaacatggtgaggcagagtaatatgtgacttaaattttatggagtactaaggaaaacgggcagacttaatataaaagtggtgcattggtggtgcttaagggcaaataccgataacatggtgtacaaataaaggatcccgatgattcaaacaggtggaagtgatgggagaactgagttgtcacacagtaccatatccacactgtcacacaaatctcacctttatttattcccttttgcactaacgtagccagaaatgtgaaacgatgacagttttttcagtaggtattttttttttttagtttttatcattgacctttgaggtgcactattaaattgctcagtccattaaaataacggattgctgatttaaaaactggttccttgcttagcttcagcaaaacagcaaagtctaccacattaaatgtatattgtttatttgatttttattgactttgttgtcttattttaactacttaattgcaaatctgtcttggggttaacactgtgtaagagttttaagcataagaagtctgtacttagagtttagatgtagttttatatttgtacatgttgatgtaacattttaataataataattcaggtctgctgggcatggtggctcatgcctgtaatcccagcactttgggaggctgaggcgggcggctcacctgaggtcgagagttcaagaccagcctgaccaacatggagaaaccctgtctctactaaaaatgtaaaattagccaggcatggtggcacatgcatgtaattccagctacttgggaggctgaggtaggagaatcgcttgaacccggaggcggaggttgtggtgagctgagatcgcaccattgcactctagcctgggcaatgagagcaaaattctgtctcagaaaaaaaaaaaaaatcaggttaattctgggatctgagcaaagttttgctcctttccgagaggtgaacacgttacgcaattattaataatatccctgtgggaaggggctttacaacaaattattttacaggtgaagggcagaaatgaaaacattttctagagccactcctgcccttcacactcaggaatgtcgcagtagtcatctctctgttctggatcagtagtatagcaccagggcccctgcgcatcgttgtctggattcctccagtccctctgaggggtgtgtagcaggtgagaatctggggaggatggaagagaagcacttagactatattctaaaaatcagcttgctattagcaaggcagaaggagatgctctcgattcccatctgagattgtcatccaaatgcatttcagctgggtgctgcagcatttgtgtggtcagattttcaatttctctattgataggctgcttctggcacagtagctaatattaccattgctactgtgacagccaagtcttagacagagagccaaaatatttttattgcacagtcaggagaaatataaaggcctcaaaagcctgccatggtcttaattcattccaaacacctgcttttgtcagttgcccttttctctgtaaaaattttcgtagttaacaccattttgtccatgtgaactatgtgccaggaattccactaacatctttccacacattctctcttttagtcctaataaaaaaaaccatttgaggaaggtgttattatccctgttttacagatgagaagactgagtggcaacgtaaaacaaaacaaaacaaaacttgcctaagcataaatagctatgaagaagcagatcaagaagtcaaagttgatctgtctgattccaaagtcctggttttctctgaaatgcagcttgaattattggggatggaggagggatttaaacttattttcagttctagagatgagttgctgtatagagacaaccatttagatgacaatcacaagacttacagtctagaaaggcaggttttatttctggttcttctgtgaacctatttgggtaacccccaccccccaagacctcagttccctcatgaagatgagcctagactacctcataaaaatggcccagagtgtctccatggcccccgatagtctctgacttcgccatttggttgaatcagttttcattaactcacggggaatatttgatctgctcatctcatagggatatagcaaaggcaatttgttgagtgttgggggaatggataaaggtgagtaacactaagttcctatttgataagtgtcattactgagaacttaaggccacctaacaccaaactgggaaaagcacaaaaaaatgcactaaaataaataataggcaagttgtgacatttgaatttcacgtatcttcattttcatttttatattttatttactattttgctccacaatttgagtcaaacatgtgatgagagttctaacttgatatgtttacttcagtcccaaacatagtcatctttggtcttttctcagatttggcctaaaactcgtagtttcattgatttttttttttaactaggcattcttctatgttctaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaagatgagagaaaataacaatatgacaataaaacataatacaaataaaaacaatacagtataacaacgattacatagcatttacattatattagggattgcacaagagaaggtatgtaggttatatgcaaatactgcaccattttacataagggacttgagaagcatggattttggtagccacaggggtcctggaaccaatccctcacagacacagacggacactttacagtagatgaacacaaagatgaaaggaaaagtctgacctaggtttgcggggagaagtggaactccatttttgacaggtgatgccattttttgttttggacatcgtccctctgtagttctttccattcccagtcttgcactctgaaagatacactgaaggaaagtccacacagtggtcaaagtctttcacaagacaccacgtgaaggtctgcacagcacagtcacattgagaaaaagatctcatgcaccagaccccctgtttctgctttctaaaagatcatcttttgcacctgcaaaaaggctgcagtaaactgggccattccatactttgattcatgtattcaaatgctacttatgagctctctgtgtattgagccccaccaggatgctggggacacacggggcacagtgcagccagaggcttggccatcatagagctcacattctagtggaatcagacaggggggttacaggaaatattcaagtaaacaatataaaatgagatcacttgatgatacatggatacatgttacatacatgatgagacagagtaagagaatggggaaagggtttttagatgggggaatggcaggcttttccgaggctgaaagagatccaacccacttctatttcttcaggctcccagtgatatgaaaaagtgccaaacaggactataaaattgtggtctactgtaaatggtttgcagtaaaagttctcaaccagcttccactcaaccaactcaccagttagacaatgggccctctcctgtgtttaaaacagtccggtgcccacctgggtccacatgcagctggcaggtgtttgctagtgtgcccacccatgtctgttccccccacgtgagttatgtgcttacaacgagtcgtttctttgcattttccaactttcttacatttatatttaattaaagatgatctaaactgagaaatgaatgtgaaaagaaacaaagctcttttttgtttggtttttaactaaattaaatgtttttaacaagttgaaacgtgaatcatttaaaaaattgctatcagatccacagagggcaatccactcatatagttgactataaagcttgaggaggaattcataaaaatctaaaggttttacacatgcagattgattaataaatgtcgagatatggtccacttcaaaaataaggaaagtaattattgtagatgttgcactagagcatagtttatgcaggaaatgcaccagagaccttctactggtgaccccatattcgaagaaaaaaagcctctgctctacatcaagaggtgtcaagtacacttgtgttttcaatgaaaatataaaatgtttaaggtatatttgcaccatcatttaaggttacccactttagccatttttaaattcactgatcaatcacatggggagtactcctaacgtacctacagcaaactaatgcttttaacccaatactacgtattatgattgccagtacatcttcattgggacatagtattacagtagacataagacactcatcaaagtgtaaactcaaggtactttgtgaaagggaggtctaggggtcaaggaagatttgcaaaggaggtgatgattgagctgacacctaggcgataagaaggagctggcacagcaggacaaaggtgaagagggtcccaggcaggagggcgtgtgcttggggtggtgaaggaacagaagtaaggccagaaactttgtagaaaagtttagcaagccaagcaaacagcagccgggggttacgtaaataatgccgggccctggcacatttgggaagtctttgggtcttattttaagggcactaggaagggctttaaacagggaagttatatttcttcgagatcaggtgtacagctacaagtagccccaaccagtggtgatagggtcttggactcggtgaaggcagtgtggctggtggcaagtggcagaagtaaacgtgatctaacactgactgttcctggcaaaaccctggcaggtaagttagcagcaggtcaatatcccacagcaactgtatgtacccaccggagtttatataaccttttgctcccttctgtcactttgaaaacaagcaaactaagccttcaaacttcacacttcaaactcaacctacagtcattcccatgttccttctggttaacaatttacaaatgacatatttaaatgttagcattttgtagagagaatcaggagaatcagggttttttgtttttgtttttaaatctggtacaattaggtcatcctatttagtttaccgtttgcttgctacttgtaagaactaataactttaccagataaagtttagatttcatctgtactttaatctcaagaattcgagataaatagtggtaaggaagaaagtacaatgcgtacagctaatgaaacccaggaagatgagtcaatgcatagaaataattccaacccaaataaatactatttaaaatgctacttggagttttgccgtgatactagacacaatatggcaaatcatcctcaagaatacaagaactaaggtgtttccagtcctctttaacacctgtgatgcaggatatttggagagctaaattgttattattaacagtcttaatacctggccaccaacacagtagaggaaacagtttttaaagtgtcatacatctcttcaaatattcatacgcttaatgaaacattcgcacatctaaaaaggcatgcaatttctattgaaatcctgtgtgcctcttattctaagcagtgggactattgacccacattttaaaataaactatagaaaaggaactgtaacttttacacatttttaaaagacaacatatcagaaatctgagaaaaatatagaccatgtcccccaaaatgtgaaaaatttaagagtaaaaaataagatttgtgtcccaatctaaatgtttctgaggattaaaacacctcagtatttctgttttacaaggcttcgtccagatgttagggcccaaggaccatggtcaccctgcagaataagaagccaagaccaaaaggaatgcttagacttcccatctccttgttaaatataaaataatattttaaaaatcttattttcagggtcatagaggtagaagtgattttgtaaatctaatcctttcattttttgaacaaaaaaaaattaaatctaggaggtgaagtaatatactcaagctgacatggttagttagtaatcaaatcctgtcctaactcagaattcaattttacaacaccatagcaccttcctcctctggtctcataaattaaagatagaatagagaaagaggaagagtgggaggatggggaggacagtaggaggaggaggaagaaaatgtactcactttacttttcaaataaaactgcatctctcatcctaatgattatggaggacttcctgttttcagccattatcacacattgttgctctttactgtgatattggaatgccctgcagaacgaagcaggaaatccaataagtatttttctttatttaaagaaaacaaatgtttattaataaatgagaaatgctaaagatcattgactatcttgagggaccagagagctcagaattgctgcctctttcagttatttgggcatggcattgatgaagtactgaacaaaatacaccaacgtggcagtaaatcttatctgcccttaccttccctccctcataattttctctttctttctgtttcaactgttttacttcttcttcactcatcttcttaatttttgtttttgggtcagaaagaagcaactctggttgctttgaacccattccccaagatagtccatctccatgacctcccaactctgatcagttcccctgaacctctgtcccacattccaccccaccctggcccctgacccctcccatctccatcccgtggtcctgctatgggtgctcagtctggcatccatagctactttcccaggctcatcacctacacaaagtctctgctttagtcaacttgatctcttaatggtccccctcagaaagtgcagggccgcatcttcccctgccttcctggtgcttttcaagagctctctcaactccaaacccagctcggttcccacctcctccctgagccttctctagctgcctcaaccttaggcactgttctttcttctggatctgggtagaacatgcattgattatgcctgtagctcacttaggctgtcttttttttttttaacattatatccagtcaccttaaatactgaagggcaggcactggatcttgtagctataagtcattgctcagatctatctaggacactttcattcatatgatcctcaacaaacatttactgatgatgatgttaaaaactggagctcagaacaataactgctaatgtttatgtccggtgtaaaaacaaataacttccttttagggtatttttctaatgaagactccagtaaaccttaacaagaagctgttagtatggcttcacatgctatgagcaaatatagttccaaactctggctccataaatttctctttcctcttaaatcgttaataaatttgtgagtaaattacttgccatctgaattacagatttctgggtaggtgcaacgacgatgaaaatacctgcaggtgaattctttgtcctcttcacattttgctgcacattcttctctgcttcctgcccccagctgcttcttagtgacactgaacagtgaaggcccctgggtattcacatagtcatccaggggctctccttgacctagaggtgggagatccaagtggaataaatggtcagtaaatcaatgccaatgtctaattgtcatgacttccttttaatctatttggttagcattaaccaaataaaacttgctgtttactggaagtagaatgggtagctatgaatcaaaatgtttagttaagaacacacagttgggcatgtggacataaataaagatggcaactaaagacactggggactaccagagaagggagagagggagcgaggcaagggctgaaaaactacctatttagtaggtatttagctcactacctgggtgatgggaatcatttgtaccccaaagctcagtgtcacgcaatttagtgatgtaacaaacctgcacatgtacccctgactctaaaagttgaaattataaaacaaagaaaaacagtttcattaacagattgcaagatagtaaaagattaactggattgataaacaggttagaactatggaaccactactatgttaccatattagtggatataaatccttaaacaagaacaaattttatgtttgctatcaattgtgccatgtcatgagagaagagtaaggcaccatcagtggcagttgtgttaccaagattgatgttgatttgttcatccctgggtagaaatggaacttggaggccattgtttgatttcctacaatatgcgctttggttctgacactgtcacttgaactggtgggaagcatcctctgaatggtccctccttgaggcacataaattttggtgcatagatgatggtggaaataaacaagaactgaactaaattatgttgccaccttggacaaaaattgggcaaaacactggagggtaagaagctccccaacaaagaaggccatttttgtactgggctgatgacagtcacacaacactactaactggggagaaatcagtttttccaaggtgttgacaggtatctggatttcggaggaaattgtaaaaaagcagaacctgggacaaatactggtcttggtttttctttgagatcaaatctgagacaacgaatctgtccgaaagctgctttctgcctggtcgtggcagagggtggccaagggggcctcagctgtgctcccaccacaaggctacagggtgttcccttgtcctgaggctcttccggacatctggctgagctttggtaggtctattccaagcctggagatgccagctccatccttcgcacagaatgctagtgattttcacaggggtaagaggccaaaagaggctaataaaatgaagatagccaagctccatggaattagacaacaggacaaccttgaccactttgaggggcgtggtgggggctgcaggcagagggagtgggttatagagtgacgaggagagcagtggaggcggcagcgggagacaagcctggctctgaagacagcgagccctccagggaagatgcggtcaggggaggttctgaaagatgacacactgcagagcacactggtttgtatgctgatgacaaatatccagtaggaaggcaaatgaacagattctcattctcagaaaggcccgtcctgacctcctgagggtacacagagcacagggaggaggatgcacgctcatcaattcatgcaaagtcctcggccaaagtccccctgctccccacctctgggacttcgtccttcctcaatttaagacattccgggctggaaaaatggattattgagcaggagttggctgatgcattctaaacctaatccactaaaaagcacttgagagatgtatcaaaagatcacaaagaaatagatgctttaggcccatatccatgtctttaccccgcactttctgccaacttgaactctcatttccaagaagagttgtgttttggttaattctatagctcgcagtgtgacttcaaaacacacaataaatccacaaagtgtgtcctacggtgagttcagttaaactttctgaagagtttttttgaagtatagcagagcaggctacaattgatattcaaaaaaagaaaacttccatttatttcccccttcaattaagttctctgtgtcatgttattatacttcatagcacatcgctgctgagatcccctccccagctcctgtccctaggaaatatcccaaaacagaatcaaactgttttctttttaatttgaaataattttcccccattttttttttctcttattcacctctaggactcatatggcaataggatttgatagggcttatttgctggcaaggaaacatcaaatcttttagtggaaaaatacatttatattataggcaaaatgcagatgtatattgctactgatgcaaatgtattttattaatggtgtgagaatttcttcctcactgtggtgtgtgaatgtgtatgcatatttgcatgtgtaaaagacttaatttgtgaaatggaagatgtttctccacttcccactaagcatggctgtaaaagaaactttttcctctccccgggcattgcagcacactggaaagatgatacatccacagaaagcctggctttccaaaagagcttatgagagaatgttccccccaggttggttaaaacattggtaatcctgtggcggagaagtttgttctagcctttgggtgtagcccactgaataagttcacagtgatctatgtcatagtttccatgcattgaaatataatattcacacccccaacatacaccaatttcttacaaaaatttctttaattttctcctgctctgtattttgtttgatagctccttgaatggcttccactaaattcaaatgtatttgactctaaagtgcaacttgtaaaattttatctggtaatttatagattgaatttcaagtatacattatttacaggaagaactactagcaaatcgtatgattccgttcgtatgaaatgttcaaaatggcaaagatataaatacagaaagtagattagtggttgccagaagctgcagatcgggggtaacagctaaggagagtggagtgcgtttttgggggtatgaatagttttaaaatttattctgatggtggctgcacaactctcaatatattgaaatccattggattgtatgcctaaatgggtgaattctatacattaattatatctcaataaagcttttttttaaaaaaagaaaaagaaaaagaactactaggacatgtttagaatattatttcaaaggcttaaacaaagctgaaaagtgagaagagccctagattccttctgggaaacctggcttaaatccagttttctttatttcccagatttgagaatttggtcactgagcaaataacatgattttcctaagtctagatttctttgtttataaaatgagggtgaatatgctaccctacctataccgcgagctaaataagctagtatttgtaaaggacacacactcacactcacattcacacacaggtatgtatgtatgtgtaaaaatgtagcgacctaacccaagcactaagtgagtatttgttgaatcactgtctgcacacagcatctggcaaatggatgcgtgtgatttttccggggattagaggcaaacgtatactgatggaaagccttcctcaggccataacaaagggagaaatgctgaatccctgacgctgccaccaccatgaactggtgagagaacagaatatattcaaagagaaatttcattgttttaacttgcaagtgaggggagcatgacaccgtaagagagattatataaattagtcaaactgagaaccaggcgaagagcttagccgtcctttgcatagttagctacattggctctttttcaattagactggccattatgtgggtgcactcatttagatttgaaaaaccacccattattttctctgcgcattcattccagcacgctgacaatcttcacaggaaaactaaacttatttcttgaagaattcctcaatcttatacaagattttcaactgggagtttcatgaatcaaaaattaaatgaattgcacataaagccatggcatatgtatttgtactgcattgtgggagaaaaaataattattataatttaaaaaaactatgtcttacctgatttcagaaataaaagaagtagaagaaccacttccttatgttccattttgggactggccagcagtgcccagaaagtgtgtcccaatcccaggatgttgttgacttacatgagagtaaacgcatccacagaccagatagtcaaattaagttaatgattctctcagacacccacgccactggctcagcagggttcaaacacgaccttgaataaagggtccttacaaaatgattgagggtggaatctgcaatagatgctgggaagtggtgaaagcaatctcccccctcagctgctccatgctgccttcatgtctccttactccttccctcacctttgtactttatctctcacaattagtcttatttcctcccctcttcttttattccctttcttttggagaaaatgaaatcagaaaagtatctcacatttgctggaaccttccatgacgagaccctctgccaagcgctgcacgtccatagcctccctcaagcttcccaacaggcagtgctgttctcattcctgctgtacgagggatggggctgaggccttccccaaggttgtgtcgctacccaggggtgcagctgatagacaaaaccctttcaggtcctggatgacaaacttaagttaggtgtaaatgttaatatctccacatcctacaccaaatgacatagaaattacgacataagtgaaagtatcttattatcttcaaaatttctttattcccagtgaactcacatgttttctgtaattataaattataagacatcaatctttcccccaaatgaacgtatggcatattattatattctcattctcatgaaataaagcaagactggtagcactaagtggaaagcgtctatctcaattttaaatgttgaatctgtacttttccctggcttaagtctagagcaaccaggtagtatatatgttgtaaaacttctattttagtgttcaaagatatttagcaataaatcaattgacctctctattttagatgtgaaataaggaccagaaagcattgttcctctttccaggcagtgaaattcctgcctattcattaactggcaaaagagtagaggtgggagcccaatggtcttgggtggaacgtcctgtggaattccctgggattgaggaatcatgcagaaccctcaagaagaaaccacactgggcaacaagagggtggccccatgtgaggaacagggggaccgaatcgcatttcctgatttcctattctagcctcactctcttctctcctcaaattcttaccactccctttatcctctctgactcacctcgtggcccagttcattaaaggggacagaaggtggaggcaaattgagaaaccagcagtgggcagacgttttatttttaatgtgaaatgtctcttagggggcttatgttgatgtgcttgagaaagtactttgggggaaaaaaaaactaactctactaatatataatgcttccagcatgtatttatttccacttaaaatattattgtagcagttcctcttggataaggcatcttgggaatgatgttatcagaaattctacatccacataattttcttttcctgtttttttggttttgacttgggtagtgttggtatagcttttgcccacctttcccctggtaggtgttagatgcattaaattctacaaatgcgattttataaattagttgccctcctaatggcctcctggctgtacattcttccctaccttcataatccatcagcatcgtgaaagcacagagggacattgagcagagttctgtgctggcgccaccgcactctgtagcctgtaagagagcagcaaagaggaatgagttgctcaggtatagacaggggtggatgcatagagacttccactgtggcacggcccttcatgtccagggtaggcatgaagcaatggactattccagattgtgcataggaaaccacactgcactcttagacggatttttgctctaaagacaactaattcaaaataaggtgctttctacctgaaataatggcatgaactgagaaaagagatatagagagagatctctgtgtactacgatcaggttgcacatattctgagatttatgtattcttatttagttcaattccttatttactgaccacttactgtgtacaatattgtattagattcttttaggattacagttgacccttgaacaacttgggggcttggcacactgaccgtacacagtagaaaatccaggtataattctgattcccccaaacttaactactgatagcctgctgttgaccagcaacagttaataacatgtattttgtatgctatatgtattatatactgtattcttacaataaagtaagctagagaaaaggaaacgtttctaaggagaaaatacatctatggtactgttatgtatttatccatacagtaagtttacaccgcctgtttacaagatgaatcatctgtctgaaatggaagcaaccccagctacagacctcagtctctgttacatatcaagcaaatcaagtttttcttgtaatgtcaaatgtcatgacttttctctgcttcttgggagcacttccagcatcactagtgccacttcatgtggatcccatggtgttattcaaggtttacagtacagcacgaaacaggacgaaaaatacatgtgaacagggagagggcactttttactgggatgcgcaattcactggggatgacctgctcatgatggaatgttgagtatcacagaacgttttaagtggatacttgcaacacctgagctcattgcaacagcaacaggaggaggctatgaacttattaccgtactgtggtatgcactacggttaaatttatgcagttacaatttaatactgcatcttgatgtttgtatacacttctctcaactgagaatagcaccatatacgatctgtgagtgtgtacataagttttactaaattttaacttttgcaatagttttgttatattttatggtagtaaataataaaatagactaggtatctacatacattttatgcattcatgacatacttaactttttctatttttgttgatatttctagctgcatggtttgtctttgagttttttcaaattgttgcaaaactccaaaacattttctaacacatttattgaaaaaaatctgtgtgtaacagttcagacgtgtgttgttcaatgatcaactatatgtctaaagagtacaaatcagtctgtaaccttccccagcctctccatgctaaaggaactacaggaaactttcgcactcaagatgtgtggagattctgctgctgcacttgtagcaggcataagaacgttcaaataggccgggcgcggtggctaatgcccgtaatcccagcattttgggaggccaagacgggtggatcacgaggtcaggagttcgagaccagcctggccagcatggtgaaaccccatctctactaaaaatacaaaaaattagccgggcatggtggcatgctcctgtagtcccagatactggggaggctgaggcaggagaattgcttgaacccagcaggcagaggttgcagtgagccgagatcgtgccattgcactccagcctgggtgagagagcaagactctgtctcaaaaaaaaaaaaaaaaaaaaagaacattcaaataagattggagacaaattgaatttccttagctctgcccagcataaggcctgcaatcaagatccactcaggtcctcttatgaaggaatagacgtctcttccagcattaaaatggtaaattccttgcaagtatttacaaagaaagttataaacaccaggaaacatcaacctcaccaggaggtgaggtagagttcacccttccatctcacctgaagtggaaaatgcagccaagtcacaacttcctaggtgatgcacgtccatgcaagctggactgcattgctggcctgacatttgcacctggcagctcctcgccaccccctctttccaccttccttgagcccaggctctgctgcccgggaactgccattctaggacagctcatttcatcaagatgaacttctctgaatagccctaagaggacagtatcatttccaactggaaatagcaagaacttaattaatctactaaggattcatataaagcatccctctgtcgtggtaagggtcctcggcaagtttatctgtgccctcgatgccaatgtgcaggttgtttttactgctgttttagtgtattagagcatatcagcgaggagacttctactaattaacctggaggtggctcttctttctttagttgctcttttccacatgttagcctttgttcatcagtccccaggaccatgcaatgaggtgcttatcagccctcatgtcccgtaaagagatagcaggctatctctcaagttagcacagtggttaaaacgtaatccactagggggcattttcctttcctttctttctttctttctttttttttttttggaaacagaggctggctctgtcacccaggctggagtgcggtggtacaaacacagctcactgtagccttaacctcctggattcaagcgattctcccacctcagactccagagtagctgggaccacaggtgcacgccaccatgcacagctatttttttttttttttttgtattttctgtagggacagggttttgccatgttacccaggctggtcttgaactcctgggctcatgagatcctcctatctcagtctccagaagtgctgggattacaaatatgaggcactttgcctggcactaggagacactttctcagtgagacctaactcatttggggctcagtgaggtgatattttcttaattgagttgtgcttgaaaaaatctagatatctattcatctttgaaaaaattaattttcattggctgtctcctcatcattaataagcatggctgtgttacatgcttaagacaaatattagcagagaagaagaaagtcagacccggataacttagcagcctgcactgaggtggcaccaggactccccagaggagagacgagggtccttctgctctgaggtccagactcaccatggataaaacagagttgcaccaaatcatccttcccatctctcacattgattgttctctaagctcattcagagaaaaaaaaaatcttatctcacagtatgtcagggagataagtcatgtagaaaaaccttaaaatattttcaggaaagcaaatgagtgcacaaaaaacctggtgaaatctgagcaaggtctgcagactagtttctgatattgtgccaatggcaactttccagttgtaatcatgaactatagttatgtaagatactgcctgagggaggcggggccataggcacaaggatctctcagtactatatttgtaacttgttgtgtttatacttatttcaaaacaaaaattatatgtatatatttatatatgtatacatgttatgtttgcaacacatgtgcctatatttggatacatgtgtctattttaggaggacctaggatgatgtaactgctttcatactagttaagagaattcccaaatttcagggaaagtctaaagttatagagttcctaactcagggtgcagaactcggactttggctgattctcgtgagctcctgggatgagtgggtgggacagagaggcttctccaccaccacactccttccctggctggagaccagatggttaaggactgatgggtgccagagagcagcagccctccatgtgggtccagaacccagaggctggagtagttcatgcctgctcctgcctcccaggtattcaagggaaacccaccatctccacacaccagcaaaacaccagcaaaacagaggccccaagtaatgacttctcctttctcatcttatcttgccacctgaccagctcctgggctcctcaatccaaagttggggaagagagaagggaatgtcagtggaaaccacttttgctataaactctcatccttcagatgttctttcagtgggtacagtgtttagtgctgtgctaggtgctggggaatcaagagtaaataagaggccatctttgccctcagggagtttttggtctcatgggtttggggcaatgcaggtctgtaaactggaattgtaaaagtgaagtggcccaggtcccatttgttgtagtggtgcacagagagacagtcttgagaggtgaggagacatttcccagaggaagtaacatccaagttgagacttagaagacagctggaaggatgagaaaggagaataattctgtggagtcctaattaggcaaaaggaatcaggctggtgacactgaggaaaaaagaaagagaaagcagataagctgtaagtttgcctttcttcatggtccaggaccatagccctcctgcacaaatagctcacaatcttcctgtgcccagctaccatcaggccctcagctgatggaaaaatgcaggttatcccactgcaaccttggtgttatcagtactgcacaaagctctcttcagcacgcagcaaaagcaacatcctataaaacccccagcaagcctttgtctcttggcattcagttcctctcttgctggcctgcctgttgctgccttgcaacatattttcatactttcttcaataaatctgcctttatctacaactgtcttggtaaattcttcttactgcccatggtatactggcctcagatagttgcttcacctgctacacattctttaagcagaagaaatatatgtgcagggtcccagaggcaggaggagcagacagatgagaggaatttggctaacatggggaaatggtccaattgcgcaggcttctcactctgtttcaagaagtttagacttcagccaaagaaaggcagggactactgttactgaaggcttttaaaatccaagggtggcttgatccctctgattgcagcacagtgaggaggtcataggaggtgagagatgagagggggtgaaagaaggcagtggagaaagagaaaaaagaatggattagggggatgttgagaaagtagaattgacatgattttgtgactcattgaatgtggggaatgaaatcaagtatgctgcctgaatttctggcttggacatctggtggacagtggatcattcattaagaaggaatgcataggagggaataagatgaaattggctggggacaatgttatgtttaggaacttgagaaaacccaagtggaaatttccagaagggagttgaatattctggtttagaacaggagttggcaaactatagcccatgaagcaggcttatttttataaatcaagttttattggaacatggccacacccattcttttactattttctgtggctatatttgcaccaccttagcagagttgagcagatgtgacagagacagtacaatgaccagcaagccgataaaatatttgttatcatcgctttacagaaaaagtttgccaattcctggtgtagagcctaggaaagaggtctgagctggagatgtggaatcagcagttgtcagcagataggtgggactgaagcaatgggggtggacaagcttgctcagagagaaaaaaataagccctaggataaagccctcaacaacacaaggacccagaagaagagaattctgtagagatgactgagaacagttagccagaggggaaaattgacagtgtgagtccagagaagccagcaaaagtgaaaattgtaaaaaggtgggagtggtcatgggtaccaaagacttgtgagaaatcaagtgagatgtatcctgtgtatgccagaaggtaagagcaaatgaggccaacataaccttaataataccaatctcaatggcccagactccagcaaagtctactctagctaccgctaccactaaacatatgtaaaactcagtaaaatagcaattttaattaaacaaattcctgacctatctctgtaatactcctttcccaacatttttgcctgcatattctttgattgcctcttcaataatgttgtaatatcatagtctatgagagaagagaataataaactattttggctctagtattttattattgatagatttaaatttttcttctggcttcatagctcaggatcgataatggaagataagttttcaggattcttggcacacttaggaaaatctttatcaaactatttttatgtatgaactgtaagatttggaataattcccagatgggatgagctacactcttttctagctttgtacatttctatttttcttattcaacttttattttaagttcagggataaaagtgcagggttgttacataggtaaacatgtgtcatgggggtttgttgtgcagattatttcatcacccaggtattaagcctagtactcattagttatttttcctgatgctgtctctcttcccatcctccaaccctgatgggccccagtgtgtgttgttcccctcgatgtgtccatgtgttctcatcatttagctcccacttataagtgagaacatgcgatatttggttttctgttcttgtgttagtttgctgagaataatggcctccagctccatccatgttcctgcaaatgcacatgtcatgtgacacaatcgtgatgtaatctatggtcttgcatatttacattacaccaccaggtaaatcagcacgagggaggtgaagactattctgaatctgttttacacagggacagctagcaataaaatacacagaaatgactccataccacataaataaatcccatggaacccaaactcaatgactcaattcttcttttgctggatcctcaaaatgcccacatccactccaccaccacccaacatgagggcagaaagagatcagaattttagccaattacagctaaaatgtctgcttttgtcaaaagcaaatgaccaaatggatacattgccagggcccctccagagcctcagaaagggcctgctgaagttgccttttgctatgggatgaatcaaaccaaaacacagtggcttaaaataagatgaattattttatttctgaattctgaaggtctgctgggcttggccaggtgattctcattcttgtggtctcttatgaggtcagtggtggctagggctgaaaccatctcaaagccttcctcactcacatctcatgggtgatcccagctgttgctggaacctcatctgggactatcggccaaaacactcagaacttctccatgtgtctgggcttcctagaagacactgttcaagtagagggcaagacaatcaagaatctcaagctctatttcaaaacatttcttcccactccactactgctctatatatttttcacaatactttataccttctaacgtaatagttattatagaggtacacgtatgtcttactataacataaactccatgagggaagatatttttagttttgctcaatgaaatatccccagtgccaaggaagcactgccctacacattcatccaaatagtaaaataataaatatctatttttaaacactttgttaattctgcacacatttactttttctaaagggagaaatgtggaacactgaaaagctccttgaatcttagaatttgtttttaattaatagacttaatacatggcataacatgttgtactcaacttactcttcatgcaacgtgtaagcataaatgccaaagatcttactttcaagcatcagcattaatatagcaagttaggaaggtagacggtttggtaattacaaaagctcttgaagtaggcaaaaaccattgttttacatggtagccaagatcacactaatgataagtatttctggcttaaccagtcctcacagcaatatgctaaattaatgaaaacaaacatgggcattgtttgggtgttactgacatcaactacaaaacagaaatgaacagaaattgaaaactatattgtcaaatacaattaaaatagccaaatacatttctaggtaaaatctttataacttcaaatactgccagttttctttcaaaaacttacagtacttgaaagaacgaaaatcagcttaatccagcacaggggaaagaaacacatgagataactgaattttacaaccaaggtcagagaggatatcacactatcaccgtgggaggaagggtgagtgggtagaaatacctgttattggtttttaagtagatcatagccaaagctagagtagcacctggacaagtcacatccacatttatggtatctccttcctattgaaagaagagtttatgcatgtaaaagagttctaaatttttataaaattcctctgataagtatgcttaaaattaacatatttaccaatgtcaggatgaacactagtattttccaattaacttcccagcttccagacttttgatctattactttgctgtgtacttactttgatttgataacttggtgatttatgtttctccctatgcattcctgtttgaaagcgcctatgtcctccaaccatgtactgatagagctgctcaggcacattgagatcagacatacctatcaaattgctgccgtgctggaaaagacaataacagacgagtgaaaagaaattttatggaggaagatccataacacatacccataacaaatataaaaatgaactaacttcaaagcaggttatttcgggttttgttttttttatttccaacttaaagcaaacattaatcatgagttaataaatattaataattctcataaaagttttaatacatgaatgttcaactttaagtactgtcttaaaatacataagagctttagagttagttacatttaacaataaagaaaaatattagttatataattgaaacctgaactgtaaatatctgaatactttcattattgtacttaagaacttttccaacaataactatgataataatagtaatttattaaatgcatgctctgtgtcaggcactattctgtgtgtttaacatgaatgaacagccatatcaaatagctactattaaaaccctattttataaataaggaaagtgtggcaaagagggattaagcccaaggttatacagctattatagtaagttgcagggctatatataaaacacggccatctggttcaacaatccatgaagctgattaagcaatagacaataatgtagttaaatgacttgactcactagttaggaccagaattcaagttgcaattccctgtgtgattcctttcttttttttttgagacggagtctcgccttcttgcccaggctggagtgcagtggcacgatctcgactctctgcaagctccgcctcctgggttcacaccattctcctgcctcagcctcccgagtagctggaactacaagcgcccaccaccatgcctggctaattttttttgtatttttagtagagacggggtttcaccgtgttagacaggatggtctggatctcctgacctcgtgatccgcccatctcggcctcccaaagtgctgggattacaggcatgagccaccacacccagctgattattttccattataccaccagcctctttagctcacgtgccaatgtgaattcaaggccctaatagatggtcaaccacgaggtggattttcagaacacacatgagaaaaaattccttccactacaacttttttttttaagatggagtctcactcttgttgcccaggctggagtgcaatggtgtgatcttgattcatcacaacctctgcctcctgggttcaagcgattgtcctgcctcagcctcccgagtagctgggattacaggcatgcgccaccacacctggctaattctgtatttttagtagagatggggtttctccatgttggtcaggttggtctcgaacccctgatctcaggtgatccgatcaccttgccttataactttctttatatcatttagtttgaccataagaatgtattggtggtttttcaaggggaaccacatttcaagtgaaacaatcatttaatgaaacatttctggtaattctgtacacatctcttggatggagttaaagatgggtcaatctgatactgcattttgtcacaaggaagatgctactgggacaacattctgggatacacagtgaacatcactatggcaaaagggggttagggtttgtttcaagcagctactatagactcttaaggctcctgatcatatacattttcactattctctgttttcagtcatagtgggctgtcacttattcattctatgtcttgaacactttaaaaaaaaaactttattccctttagtttgttcatgaacactgtaagctggaggaaaagaaatcttaaagtctcactcttgaccacagtttctctcaatttgcaaatctggtaccttgaaaaatatccaaaaagacaagagagctgggcagaagattaagtcgtagtaagggacaatattcaggtttaggtgtcaacgttatttgtctcaacatgtagatgtcctaactgaagcatgggaaggcataggctatgcttacccccaagcagaccatgcccagggccaagccagcagctaaggagtatgactttctgtcagtgcagtattccatttcaggaccaggaggccgtcctgtaaaaacaaaagcaacacagttcaaactagcttctcaaaatctcatctcataaaaatcttagagttaactttctagcaagttgcactggagatacgaatgggatataactattcagaaagttatgacactataataaatgatgtccacaactgtaggtttacctaccaaaaaaaaagggcccaaaatagttctttttaaattgccaatttaagtctttataagcaatgatattcaaatactgtgaaactttgagtcttatcaaaaaaattaccaagtagtagaaaaaaattttaaaggaaaaaaggtaagagtattcaaaaaaaagttttattattttttttaaaacatctcggccaggtgtgctggctcatgcctgtaatcccagcactttgggaggctgaggcaggtggatcacttgaggtcaggagttggagaccagatggccaacatggtgaaaccctgtctctactaaaaatacaaaaattagccagggtggcaggtgcctgtaatcccagctactcgggaggctgaggcaggagaatcgcttgaacctgggaggcggaggttgcagtgagccaaaatcaggtcactgcactccagcctgggcgacagagtgagacaccatctcagcaacaacaacaacaaaatatcttacattttgttttcattactttcaaatccacacatcacatgtggtgaaacatgttcgaatgatgataatgaataaggaggtcacttacttacgttgttaagctgttaaatactatgtttagacatttatttcgagtgtatataataatgagccctactatggtagaatttctgtgtactgatcctagaagtctgactggatacaaaattcacacttttaaaagcaccctataactctaacactaccttgttgaaaacgacaaaatgtactatgtattaaaacccttccctctgaaaaaatgttcacattcctgaaattttatccctataggaaaaaaatgcaatttaaaaaaaaagaaaaaaggctgggcgtggtggcccttgcctgtaatcccagcactttgggaggccaaggcaggtggatcacttgaggtcaacgagttcgagaccagcctgtctgacatggagaaatcccatctctactaaaactacaaaaattagccaggcatgctgacagacacctgtaatcccagctacttggtaggctgaggcaggagaattgcttgaacctgggaggcagaggctgcagtgaaccgagatcgcgccactccgctccagcctgggtgacagagcgagactctgtctctaaataaataaataaataataaaaattaaagaaaaaatcacacacaaaggtaatcagtgtaatgtttatacataacaacaaaggattattagaaacaatctaaaaggttctaaaagttaaaaaaaggcattttacagaccatcaactcaatgaatattatacaaaatgtgttttaaaacccatttataacaatgatctataaaaacaatttttaggctgggcacggtggctcacgcctgcaatcccagcactttgggaggctgagacaggcggatcacaaggtcaggagatccagactatcctggctaacaccatgaaaccctgtctctactaaaaatacacaataattagccaggcgtagtggcgggcgcctgtagtcccagctactcggaaggctgaggcaggagaatggcgtgaacccgggaggcggagcttgcaatgagccaagattgcaccactatactccaggctgggcaacagagcaagactctctcaaaaaaaaaaaaaattttttttaatgtacattctgacagtaattatataaaaaggcatatacatatgaattaaagatgaaatcttctatatacagtgtgaaagaggtatgccgcagctgtgagactgtgcaatgacaccattagacatcatcatgatatagccaaagaagggtagactactttgcagatgaacatgctttaacaaccagtgttgaatattttcagaataagcgtttttcagatctctgacttatgctaccatgtattgtgatagccaaaacatttcaactttgggaataatttcatttatcattatagtagactaaattatgggtcccaatcttcactggttctctcctaggtttctatcaacaccacgagagaaacacaccctccagcctgggtcccagaatgaggcaggtgaggcagaacggcagcagaacagccggctacacatctacagcctaaagcagagctgcctgggccaatgctatgcctgtatgtatgtagcatcactgtggcaatagctatctgatacaatgatactaaagaataatacatctttaacaatatattcacaaatccatatagaaaagatcttgaataggacatataagtatgtaactaaattgttgagcatattaataatgccaatagcatttccatttggcagaaaaagatgacaacacattaagatttccaaaaagtttggacccaataaaaaacagagacaatgttcactaaagtgagtgtgtggaccttaccatttccaggttcatcaccaacatacccaccagcatgtaaaggaggaaagcaggagtccattacttgacttctattggaagtgctgttatccaacacagtaaacactgtgatgtgtttagtttagtgtctctcagggaccaaaacaatctactctgagttttaagtgcaggccactgctagacactgctggtaaagccggataaacagcatactcatagctgattaaaaccacaggtacctcattaaatgtgaccactggaattcagtaatgagctagcaaataaacatggaggttaataacctgcagttacattagccttggataacattacttagagttttgttgttttttttaattagtactagatcattctttgctcacaaaagctaccattgtctttccttaatttttataattttactatttaattgggttaatgtggagtggagagtacatgcctatgaagattcagcactattaatcccatacctatctcagccaacaggacttctgcagtatgtctgtgagctgtcccttgatatacaaggccaatgccaaccactgcagccacttggacattgtgaggaacatccagctctgtggacgttgggggtaagagagcaggaatgcgaatgctaagaagccgagtaatagacatatccatggtgcctagttttgcagcagaaacaccaagtagcagtccaatgcttgtcatttcatggccctaagatagaaacaaaacaaatacatagtttaaaataaaatactgcctgccactttcaagaagtacttttatgttgacaggcaaggtgagaggcactgagaatacagcagtaaactaaacaaacatggtccttgctctcatggacctaatgacttaataggaaaaaaagtgttaaattaaaaaacataaacaaatatattattaaaaagtagtacaataagaaagtacaaagtattatgaaagagtattttaaaatagcttaatttagattgggagggactagaggattattagggatgaaatctctaaagattatacaaagaaatttatattaggacctgaaggatgaaaacaaattagccaggaacagtggcaggaaagaggacactcaagtttagaaggtgaggaagactgtttcaggtgataaaacagcatgtaaataaatggctctgaggcgattcagaaatgaaccctcacattaacatcaactgaccacaagggtgccaagacaattcaacaggtaaagggcagtcttcaaaaaacagtgctgggacaagtggaaggacacattcaaaagaatgaggctggactcaacacaatataacaagtgttggcaaaaatatggagagattggaactctcatgtattgctgatggggttgtataatggtgcagtcattatggaaaacagtttacagttcctcaaaaagtttaacagagttaccatataacccagcaattccactcctaagtatgtaccactacttaccattacttcattactcttgagtaatgaaaacatacatccgcacaaaaacatgtatacaaatgttcatagcagtattattcgtaatagctaaaaagtacaaataacccaaatgttcatcaacttatgaataaaatgtacattcataaaataaaacatttattcaacaataaaaaggaatgtattgctgatagatggtacaacatggatgaaccctaaaattatcaggctaagtgaaagaagcccatcctaaaataccatattttgtatgactccgttcatatgaaaggtccagaaaaggcaaacccatagacacggaaagtagattagtggttggcaggaagtgaagtgaaggtgggggggtgaggtagaggaatggggagtcaccactagtgggtacaaggttcctttatggggtgaaaagatgttctaaaattaacagtggtgatggatgcacaactctgtgaatgtactaaaaaccactgtaccacacactttaaacagtgaattgtatggtatgtgaattttatatatttatataaataaagattccttaaaaaaaaaataacgctgtgaagtgaaagagtttagtttgccagagagctaaaatagccaatctgtatggttagagtgtgggggagcaagaagagtggggctgggtgcagaggctcacgcctataatcccagcactttgggaggctgaagcgggcagatcacctgagatcaggagttcaagaccagcctggccaacatggtgaaaccctgtttccatcaaaaatacaaaaattacgcaggtgtggtagtgtgcacctgtaatcccagctactcagaaggctgaggcaggagaattgcttgaacctgggaggtagaggttgcagtgagacgagatcacaccactgcactccagcctaggtgacagggtgagactccacatcaaaaaaaaaaaaaaaaaaaaaaaaaaaacgaagaacagtggtaccacctagggctggagaagtgaacaggatcacaccagctcctagaatgtatattaagagcaatggtcgatccccctttgccctctggtgttgggaattttggccttgttctaaaccagtttcccttcacagaagttcagccatcgtgtgggatcagaataaggtcctggggcaactaaaggtatctggccaagggtacatccgaaggaccctacaccggcccccagtccccaacagcctgttcaggtgtcggacaaagacttccaatctttcctatcatgtttttcctactgctcttctgagaaatgttacttagttatgtgtctctttgagaaattgcttcttttcagggcaggatgctgggttatgcttgatgaagctaaataaactgccagccagatgagaattatagacaaataatatgcagggacccccccggattcatcttagtcttgagctcatatagaattcagagaaatcaaaggcagttgacaaggagggtcaaggctgagtgcaagtgaacgcaactactcctgctggcttgatccccccctggtcatgaatggtggctgcgcgcacatccacgaccaaggtaagcctgagagacgccttggactctagcacagcagagggaaagactaaggatgcctttttctcccctctctctttctaaatgggtagcctgcactcctctcaagtgcgagacattgggactcctttgatcctcagactctgaagaaaaaatacctggtatttatcagtagcaaggcttggcccagctagaagttggaagatggggagacctagtcagctggggaaaataacaactataatactatcctatagctagatctcttcaaccacagagaaggaaaatggtccaaaattccatatgtataggccttttttgccctgcagaataaccgcaagctctgtcagcaatgtataatagaccttgcacttatagcagtgatatccagccagacttaatccagacagaagggaaaaaacagtctgcctccttagaagaggagacagaggcccctgcaccagcccaggtcccagctcctcttggatcatctcgtcccccttatccaggcccccttttgaacctcatcctgttagaagagttcgacctggatgcgctccagcatcacttcttcctttacaggaaatgcatagtgaatatggtcctatcaaagtacaagtccccttttctttacaagatttgaggcagataaaaagaaatctaggacaattgtgtcgacctggataggtatattgaagcctttcagaaccttaatcaaatgtctgagctttcatggaagggtatcatgttacttctcaactagactcttagagcttcagagaagcaggcggctttacaggtcactgagacatttggagatgaaatgtttatcttattatggcacctaccaaaagggggaagaaattagggagccctttctgacagccaagcaggcagcatccaccaataatcctcaatgggactcagacactgctctaggaaagtggccgagaaaacatttttagggatgcacagtggaagatctgaaaactagaggcaaatctctcaattacattaagttatcaaccataaaccaagggtctgaagagaacccttctgttttcctggaaaaaactgagagaggctttaattaaacacacatctctctcctgactctataaaaggatagttaattttgaaagacaagtttataacccaagcagccccaaatattggaagaatgctgcaaaaagttagctattgcaccagacagtactctaaagaaaatcctgaaagtcaccaccttggtcttttataatcgggaccatgaggaagcccaagaaaaagggagaaaaggaacgagaaaaaggcagaggcactaatagctgccatacaggcatataaacctctcgatcccagggagcttctcattctatgaccgactgttatcagtgtgggagcactaaaagagagtctgcccccgaaatcagaagcagcccccacggccctgtccaatctgtaagggagactactggaagacaaactgcctccagaaacatacgtcccaaggttcagagccggcttctcaaatggtccagcaggactgatgggtcccagggctctcctccccagctctgacagcccaggctgcattaccatccaggagtcccgggtgagtctggaggtcaaaggactcagaggacagacttcctactcaacaccagagcagccattcctgttctcctctccattctgggcctcccctcctcccttagcacaactgtgaggggcgtctcaggaaagcctctgactcgatatttttctcaatcccttagctgtacctagggagacctttcgtttacctatgcctttttaatcatacctgaaagcccgactcctctgaggtagggatattttagctcacatgggaaccaccatccttatggctccaggacagactctttgcctccctctggtggagactgatattaatccaggtgtttgggcaattcaggaaaatactggctgagctacaacagtctcaccagtccaaatccatctcagggatctcatctccttccctaattaaagacaatatcccctaaaaccagaagctaggaaacaactagaagccatcattaataacctaaggatgcagggccttgttaaaccctgtgacagtccttgtaatatcctaatattggaagtacagaaagaaacccaacagggaatggagactggtccaggatctccacctccttaatgagtaactggtgtaattaaccaatttacccagtggttcccaatccctatactttgttaacttagatacctgaaggaactaaatggtttgcattcttggaattaaaagatgctttttttctgcataccattataccccaactcccaaaacttgtttgcattcagggatccctccaaccagactacccagctaacctggatggtgttaccacagggattccaagacagcccccacctgtttgggcaggcaatctcaaaaagatctctctgagttctttcaaactcaagttagtcttaatatgtagattacactctactctgtgccccaactgaggaaatttctcagaaaagcaataaggctcttcttaattttctaactgacagaggacataaagtttcaaagtccaaggctcaactccgtcagacttcagtgaagtacctatgcctggtcttgtcagaagggaccaggacactgggcgaggagagaattggatccattttctccttccttctccccaagaccctcagctaactaaagggattatcaggcattactggattctgcagcctatggatcagaaatctaattaaaagcattgcaatgcctaattataacatatctaataatctagggggacatgcccatgacaaccctattttgcaaaatcctggaatagaacagtccattttcagaggttttcttcctgtcctttctaggtgtccctaatatatgggcatggattttcccccttttagttcctctttgtgttctcattgtaatactcatatttggtccatgtgtacttaacctccttgtaaaatttgttttttctcgcctagaggccatcaaactccaagtggtcatgcaaatggaacctcggttgatggctctcttttaccaggggacacttagataggcctctaagagagacctgactgctgtttcccaaaacaacaccctctgtcagcatgaagcagaacagtcatcacccctatccgaacagcagttagatatacctcttcagagcggggattgatggcggtaggaggcaggtaaattctcagatgaaactcaaccttcaagccaaggacagtcgaaagcctgaaaaccaagctacaagttctggataaatccatggactagagagctctcattcctgtttggcatgctctctcctgattggtccttatccttcacctactttacatatacctgcccttccccagttggtcctctacactatcgtgcctatttctaaatggtgctttttcaagcatacccacagaccaatcagcatgcacttcccccatttcaagcccataaaaacctctagactcagcctcgtggctggcaacccaccttcgggtcccctctcgctgttgagagctttcttgtcactcattaaattctactctgccttactcagggaaaaaaaaaaaaaaaaaaagcaatgggagatcattaattaaatggctttgaccagggaagtgacatactctgatttatgctttagaaagattattccatgtactatgagacaaatggacttagaagtacaagaatgaagaaagaagagcaaatagagcaattaggagctactacaatagccagccaaggcacaaagccaggcactgggagcacaggtctcaccttggtcaagtagtcatggatattgagagtcgccagcttggtaaggtgcccattcaaacccagagccatgagaaagccagcatactcattggccaactcagcatgcttgggcttattgtaaacaatccaagctgagtcgatctgggaggcaggagctatcttcaggccagcagccacaccattatgaaagctggcccagcttgtcatgttgggaggcacatcgatgtttccactattaaggtctactgttgtgttccgaggaggggcacgccctatccagccaaacgaagaacattgagagaataaaaatccacaaaaccaagattgttaaatttagatctttgagactaagattacttacgttttctacattcaaaaccattaaccccataatgcctggaacgttaggtctctatgaccacttaaaacttttgtacatgtgagtcaaacttaatggaactggaaaaaccttcactgtctaaacagttcattgtcctttttgttaaaatgtatgaggctatataatgagataactgataccaatttaacattatacagagatgactgggataatcactcattttttctttcaaacagagagcttaaaaaccaaagtgaagactaacatcactgttaaactatacaagttataaatcccaacatctgatgacactgatgttaatttcaaatgttctatcctatattttcccctagacattaaggaaaaatgacatcttaagaaaagacaaaagccaggcctggtggtgcgtgcctgtcccagctacttgggaggctaaggcatgagaatcacttgaacctgggaggcagaggttgcagtgagccaagatcatgccattgcactcccacctgggcagcagacagagactgcatctcaaaaaagaaaaaaaaaaaggaaacaagaaccttaataaatctgctacaggtcttacctatatatgcccccttctctctctttttttctctctctctctatatatacatacagatatagatatctaattatatgctatcgtttaaaatgcttagagatagttttgtaaaaagcatccttttatagacttgagtcacccagggaacttcaaaagggcattcaccagattatacttttacggtccatttatttaagaacaatgtaaattatatgttcacaatgctatatgttccctacgaattttttcttgattcttttctttttgatctacattatacacagcaaacattgaatctttttaaatatattttgaatattgtcttaagtcatggataaaataattaacataaatattttaattactgcataaagttatccatttcactgcagctttaaaaataccatttttaaagagttctaagatgttatgtaaaataaattttaagtagatgcaaagtgtcttatttgtagcatgtacacatacacacacaaagcacaaagtaagacttatttgtctttactatatgctttttgtacctaaaagctaactcaactgctagtgttagcaccacaatgagtaataagttcataagttacacttgtactttctcaaaaaaggcagacatatcaatatgaaaaaactgagtgacctttctgaaacattcattcatcatatgcaagagacataatatttatacacgagagaaaataaaatgcaaagggtaaggtaaattttcttcaatgagaataacaacatacaaaagtacaacaggccacatcagtgtgggttaagcaactatttaagaaaatattctttcctaaattaagaggataacctttctttttggcctaccagaatgactaaaagaataaaatgttggattaatgtcataaacacattttaaatcatgcaaattcaattaaatgtattcagaaaaaaagatgcatgtatatattttttaaacccacccaagtatcacttgagtgctaaatcacccagattgaatacattttaacatttgccaattttgcattagattttctttttaatctgcacttagtatatgaaatctttcatataaacagttggaaagactactaaaatgaacatctatataccatgccttccatcaagaatcaataattgttaaaattttgccataggtgctttacctctgagacaatttaaatattaaaagccactctgctcactatgtccctcagtgagattagggctcagaataagcatggtatggagatgggaatgtgttctttcacttagtcaatctcatttcctgcatgctgctcaaagcacaagcttttcacaaatctgagtggaactctggattttttaaagtatgcaatttaaaatactgtataattatgtttgcatatattatgtactatttatcatatattaaattatacattatatgctaccacatatactatacactactacaacatacattatacatacattttgtataggtttcacaaaaccatatatactataatagagtttcagtgataatttcaactatgtaattgtcacctttagaacacattcaaatcagcattagggggacatgcactataaaattcattgtaatcaagattataactacagttatatatggcagaaataaaaacttgtgccagccagaaaggcaatttgacatgttccttaaaaccattcatcttgctgtcctaagagttctacttctaagcatttagcctaaatacacaggacgaatacgccccaacaatgtttataataccaaaaaactgtaatttccaacaataccaggctgcttctataaactatggtatatccgctgaatgaaatactctgaagcaaataaaaatgaatgtattgattaaaaacacgtgtatacaatacatacacataattataaacacatacatttatttgctagatataaaaggatgttcactgtaaatttttaaaaaaatctaaaatagatataaattttctgataattaaacaaatataaaattataaatatgtggaaataaacttagtaaacatatatactaaaatgttaaaaggagtgatgcagaagagtgggagtactgcaagtgaccattgtttctctttttgcttagtacatttcttgatttatacaatgatcatctgtttaaactatgacgtaagacattttaaaactaaatatttttacatattaaacttaagattatttaaaattcaagtctcatcgttatcaataatatctttctgaacttctccaagtgactttttagatcttgaaatcacctcattaaaaagcaaaaatgagtaatgaactatattctgcttctctcaaagtttagtttcacatggcatttgagctttgataaccactacagcagctattaggaaaattttaaatcactggggatagagggagcatttcttttgttttaactaatttaaagaactacacttaatgcatgtacttaatcattttcctttctcattgagcccagaatttaacataccagtcagattcaatttaggaataggcaatggctctgttggaacaggatggtacgaaaacaaggtaaacattcctcgtcctacaggaagagccatagttcgctgacacaattggagcaatctgtaattaaagtaaaaaccaacatgtgaaaatgtttaaagcaaagagcaattgaaatatcatctgtaagtatttcaaaagaaggtgtactgtataagatgaagttgtctcaaagtaaattcatacacagatgtgagtgaactacccaaacatgattattttcattttaatattcttgttcctattacactcttagggagagacatatttcctctgttttgtttcatatttacattgaatgaaaaccacctggcctataaaccaagccgactctctctaggcattcaaaaaaaaaaaagaaatttaaaattccactccgatggatgctaaccttctcaaaggaaaatacagtacttttggggtttttatcactgtgttaatttcagtctagctgtcctcagtacatgtgggatcctcctcccatcccttttgccaatacagcctcagaagtaccatttctgtggcctgtacacaagaaaagaaacaaggtccttgtgttagaggtgaatggatttcatggtgtctccaagggaaatacagattggtttcacttacatgatggctagatttataggactaataccattatgtatcaggtatgttcaaggttaaaatggtttctgttggctctactgtgaaattaatacaccactcttcaacttcttcctatgttaaaatagcttaacattccatatagccacttaaaaaaaactaacagaaattttggaagtagggcatttataactaagaaacgcctatacaagctatatctgaagacacagaaatatcccttcagaggctgacaactgacaaacattttctctgcagacaaagctattcataagcatacaccctccttaactggacacacataactgcttttctagctaactggaaagaaaaattttgctgtcttaaagattctctgggaacacaaccgcaacattaatttgggatcaggaaaattcaaagccaagagtctgttgcaacccatagaatttttttagaggaaatcttacacataattcacttcaactttgcacaagtaacaaaattataatgagaacaatattatatcccctgaatataagatgccactcataagatgtatcattatttcatgagaaactaagaaagaaaaagcactgccaattaaactatgacgcctgttcactgaaatacacaactgatttcagagatattaaaaagtgaaaaaacttgcatcttagaatcaatgaactctactactaataatggctgactgcactgagctttactatgtattgagcagtattctaagtgctatgtaaaaataattcacttgatacacagcaccatcccatgaagtatgcctacttttacaaatgaagaaactgaggcaacaagaggtaaagtaatttaaccaaagtcacccagcacagcatggccatgcctggctctagaggccatgctcataaatcctatgctctaaactcaacttctgtcactccatctttttattcacaggtgactaataactgggtacatgtggagaggaaacagttaatagggaaatcacaactaattcagatcttcagcagcctgtggctaagtgtgggtgatggttcccctcaaaacagtaccataaaaaaagtaaagagaactagaaaacagtggcagatgaatgatagatgatagagacaagcagataaaagaacaggagagaattttaaaacagaagtgtcccaagagaatagctctggaatgtcataggcatgtgagtcttataatgtatcaagggatgtatcctgtgcaggggagtggcagaagaaaggcttatctatttttatttggagtatcatctatcatatccaaaaaaaaaaaaatactcatataagtttaaactacactaaaaaccccactaacctcaaaatctattcctgatcaagacacagaaaaacaagtccagtgttttctttgtttgtaaattcttaaggtaactatcaggcaaaatagttttacattcaccttttctaaagagtaaagtgttatatgtatttcaagaggaggacgatatgaaatacaacaattacgtcctcaaaagccaaagacattttgctaacacacgtggtttgttgaagttggatgaaaacttaaaacacagggcatattttcacttgaaagtatcttttaaatctctttagggttttaagtgctaaaaacttgaaggaaaaacaaatatacacaagacacaaatgtaacaatgaaacatgacaagagatagtgcacgtgttttctttcacctgttttccttttcctcgatgaactcgtggtcactgagctctgggtactgcactacattgacacggacaggatgcgcactctgaagaagccttcgcacatcctgcacccttaaatcttcactccatattaatgacatgacctcgtgattcatgtcattcatgccgtcatcttcctcctcagtttctgttcctgaaggaacatctgatgagagcacctgagtaacagactttattgtaataataatttcaaaagcagttaacatgcacttgctgaacatgaggatatataggctgatgtgtcatgactatactagcacagagaaaatatgttttccaaagcaggcatgggttggagccgcaatgtatactgggactctaatctacaaatctttctaaaaagtactatattgctggccgggtgtggtggctcacactctgtaatcccagcactttgggaggccgaggtgggcggatcacccgaggccaggggttccagaccagcctggccaacatggtgaaacccggtctctactaaaaatacaaaaattagctagccagacacagtggcgcacgcctgtagtcccagctactggggaggctgaggctggagaatcacttgaacgcgggaggcaaaggttgcagtgagccgagatcgtgccactgtactccagcctgggtgacagagtgagattctgtctcaaacaaacaaacaaacaaaacaaacaaacaaacaaaagtactacattgcctacttggaaatatttggaaatgacggggagagtttaaatttaggacaacagtcaaggggctggatacaaacagagaaatattctgaataaactataaaaaaaaatctaactcatcctgatcattttaaaaaagaaattattgcaagtagaatatgaatactagtcactgctaataatgctaatttaaatattgtctgttcattaatagaaggagaaggaaaaaagcctgaaaggatatacaccaagggttgggggaagtcacacaatgaaatactttcttactttactacttttaatagacaggatcatggttggatttcattattaagtttttttttttttttgagacagggtcttactctgtcactcaggctggagtacagtggtgtgatcatggctccctgcaacctccacctcttggactcaagcgatctttcaaccttagcctcccgagtagctgggactacatatgtgcactggccacccagctaattttttttattttttgtagagacagagtcttgccctgttggccaggctggtcttgaactcatgacctcaaggagatccacccacctcagcctcccaaatagctaggactacaggcacataccaccacacctggctaaattttttaaaaaattgtttaagtagagatgaggtctcactatgttgcctaggctggtctcaaactcctgggctcaagcagtcctccgccttggccaccccaaagtgctgagattacaggcatgcgccaccacacccagccagttttcactattttttaaaaaatgtgtttccaataaaaatttcttagaaggaaaagtactgaactgcagcgaaacaagtaagagggtaaattccttgattgtcatcatgttctaagcccagcatgtgctttaatatggggcttcccagtccaaataattaaatctaactgcaacacagatgtgaattgcatggaatcatatcatattctctcaaaaacagtattatactcttttaacaaaagaataactccaagttgaaatgttaaagttttgcaacatttaatgtgaaaccaacaaggtcagcctgaaaaaaaagtagatacgaccaaataatcacttttagttcctaaaaattcatttttagttcctacaaaatatctaatttaaaaaaaaaactgtattctaatgggtgagttagctataaaacatagtctcaaacagtgacaaaataaatttagatgggattaattataaaatgtagcctcaaataactgaacaaactgtatttagacataattacttaaaatcacgttcaaatacagattaatgttttaatgctaatggtgctgaactgctctctctcacaggaaaatcattttataagcaaaaagatttgttttctgtttaaaacaggatgtaaatactaattcaacgaagagctgtgatagaggcgcagattaaaggagagagatgctgggatgaccctgctggagatcagatgcccatggaaactgactccggcatgggtacacattaggcaactctgaggttaggaataagttttgatataggctctgaagaagtagtaataagacctaaggtgactcgtagttacaatgtactgattattatgtattgattcaaaagctactaagaggcaaggccaaattcccactgtcttctcagggacatgaacataaaagagtcaccaggagtggaattattattcctgaatcctccttgatgagattctactgttcattttttaaagttacctagaattctagaataagttttaaaagtttcattttcaagttttgaggatgatttaaaaagataattggagagtaatgaaataatttaactttctacttgcaggattcctagaactcatttaaaaaaaaaaacagacttgatgactgatgaaagacagtatttcgggagggatagcttaagacatgtttttaaacaactctactgaaaaaaacacattttttccctggggctgcagttttatgtgattaaacaaatatgtttacacctatttaaaaggttaaattcaaaaaattcaacacatcaaaaaatatgcagtagaaaatacttatatataattactcatccaaattcaggatatatgtgctctcccttttcctatgtaataattacaaagtggttaattactaatatggtacaagtagggaaatagccatggtagtttccatgactaccctcaggacttgtcctgattcaaggcaaagaaagatccaggcacaagacagaacattcacaaaatctcctgctcctaatgctcatcttaacaattaataagacgcgtacaattacaaaccccgtctggcatataatataaaagacaagctaatatatatacttagaaaaagccttaaaggaaaatgaagaacatttctactttatgattttatttaaggctaaaattggaactctgaactttctatgttgatactcacagacttccctttgggtaagtttccttcgcaggcctgcttggaaagatcctgacgtccaatcaagagacagacagcttctggccagtctgaggcaggctgttcacgacagtgataaattgcatctctgatgggaagagcaattccaaagggaagagtttccaaatctcttaaagtgaatcctaatggttaaaggaagagagaaaaattttaatttagactcgccactgtcccaattatcctgactgaagttggcaacaatatctatcctgacaaataagttcattttattcatcttactaccagactaatgtcttgacatcaaggactagtataggaagtctctttgaaagaacttgtaaaaacctgaagaaaaaaagacaatctaatagaaaaatataaaggacaaaaagacatttcctagaaggggaaacataaatgggcaacatgcatatgaaaagatgctctacctaattagtgatcaggaaaatgcaaattaaagctactgagaaatataaatgtcaaagccaatcaatactaaatgttggcaactatgtagagcaataataattctttttattcttttttttttttttttttttgagatggagtctcgctctgtcgcccaggatggagtgcagtggcgcgatcttggctcactgcaagctcctcctcccgggttcacgccattctcctgcctcagcctcccgagtagctgggactacaggcgcccgccaccatgcccggctaattttttttgtaattttttttaagtagagacagggtttcaccgtattagccaggatggtctccatctcctgaccttgtgatccacaagagcagaagaagattctgatcatcatgacaggacaaaaaacataaactaggaaacagggacatacatggcatatatggtcaccctaccagctgcagaaagcataattggtgaattatttgcccaactgctccagatcctggtcagtagcccacacactagaattatagttgctgagcccatccccccttattccaagaatctctgattggctgccttggaagctttagctcttctcactgtcataccacctttggttctactgtccaaatgctgaccttctgttataactgcaggcagcctggtggtcaagcagatgtccccaagaacttcctggggttctctctgaactttgagccatttagaatcaccaggatgccttggtcactgtcaacatcaaaatgtgaatcttcttagacaccaccggtagttaccgtacctctagaggaactgagggttcttcacccacaaatgaagaccatctctaaagtgccccatcacattctagaaggatacagctgctggaagaaaataaagtgtcccaccaccactcccacagttcttaagctcatacacaccaacaaccactccaggaaccaactgaagacttcaaatatcatagtaccagagagggttgatgccaaacccacttctaaaactgtgttcactctcttggagttaccaaacaggcttcacaacctcaaagccatttcacaatctccccaaagtctcaatctccccacagtctccccagtcacaatctccccaaagtctgccttcccagactttgctggtgactgccatcactgacataacaacgtggctggaaccctgctgctgccaaaaccaccctccgactctctggccaagtcaaacccctcacaccactatgggagtagtgagaactctctgaaaggccactaacacttctgtaagccacaactaccaaaacaagtcctctgagcccatgccactcacagtcttgtcataccacacctaccagtgaacagtattgccttataagcatatagttctgactcaagcagcgtcaagcctagccttttcacaggataatttctaacagttgggtctacccatgagttacacgaaccactctccagattcaatgagcttctattacctctgttacaactatcactcttgtgagtacagactaagttaactcataagactgtttagaagatgcctttgctacaaagggcactcctcgaaagttcttcctaccctcccagacatttacgatgtgtgaagagaaatgccccaaccagtcacaatctccccaatgtttgaagtagtcagaggtatcacacagtaaccttgaactacttctcttaggtgccaataggactatgaactccatgaataaaatcagctggtactaaaaatggtaactgcttataagtcaaccaccaggtcaaagatggcttactcaaaaaatgtcacaagaaaaaaaacatcaaatcaaagtgaccagcctcactgcctagcaaccaacccactcactcattcacacagaaggcaaaattgaaaggtagctgggacgcccataggaagaaaacagttaggatgatgcaggggagactgatacaaggctgttattctaatcatcccataacagagacagagtcacagctagggaattattcaggaattaggaaaagttatttctggtaaacaaactcccacatactgggttaaaatttctttggaactttatttatcatgaccctaggagctctagtcatatatgcaaatggataaacaacaaagctataaaagcagagggttttaattttgcttttattttttaaataatagcaacaaggaactttagtaagaataacatagtaaaactagacctgtaaaagtcatcaaaagcaaacatgacaggaatagcataaagtaatttgtgaaagctagtattatcaaagcactgacagaagaaaaagaatgatgctaaaaaatacaaaacacttctttcaataccataccttatcaatggcttttccaacccgagaaacactgctgtggatgtctttgtggtcggaggccaatttttgaacagtatcctttattcttttacagcactgtgtcaaaacaagtcaaagtgtccctgataattcagcatcttggcctataaaaaaacaaaggaaggattggttactcacttaagcaaacccaaagatggcaagtttctaatgggccttttggaccatgaaagatggaagaaaagtgaagaaaaaccagtatctgctttgaagctgatggtcacattcatagatgtgatttttcaaatggatactcagaaagatataatttttttattttttggaaataagaaaattttactgtgaaaggaatcatttttatcattacaacaaccagcacaggctgtgaataatactgtcaaggcagtattatttttgagaaaatatgtctaagtgaataaactcacttattaaacccagttacactgttcaagtcattctcaaaacgttctggttgttactaaatttcctcaagagagatgatttagtgcaaatgcttcatattccatataaagaggtagaagaaaacaaacttccctgggtaccacgatgtgcagaaaggagttaacacagcaggtcatagactactacccttagaaagtcctgcttacaaagtcacctcttggctggcatatagaaacctgggagtttgggagtgttcccatcactccctaactcagtgttccccaacctttttggcactagggaccagtttcgtggaagacatttcttccacggacgagggctggggggaatggtttcaggatgaaactgttccacctcagatcaggcgttagttagattctcctaaggagcacgtgagccagatccctcgaatgtgcagttcacaacagggttcatgcccctatgagaatctaatgctgccgctgatctgacagtgggtggagctcaggcggcaatgctcgttcaccgctgcttgcctcctgctgtgcacggcctggttcctaacaggccacagaggggtactggtccatacccgggggtttggagacccctgccctagctgaaaagaatggctcattgtgcctaaactgttgtacagtgtgatttatggtgaacatctgctttccttctgggaatctagaatgttgatacatgctaggcagtgagtacctggctttctcctggcttggagaaagcttccaatagtcctctcccagtgaagtcacatggaatatgcttaattcctgcagccatggtttgtgagaagtgttaagtgttgcctaccagggaagctcattagaagctcagtgcccagggtttttattgggggctggtcaccagggcacccactgcctaactctggactgcctaactttggactttggacttctgccccatgagtcttttccctttggtgattttgctttacacccttttgctgtaataaattctagctaagagtatgattatatgctgaattgtgtgactccttttaatgaatcactggaacctaaaggtggttttgaagacccctgacacacatgagatcaaccaaaagttactacagtttacatcctttccctgagctacctccctccaaattttgttcctatagcaggaaaaaaaggaggagaagggagaaaaacagacagataaaacaaacccagttatggtatttgtcatttctctctctatctacgtattcccacctgtaagcaacaggcctggtttctgaaatcctaaccaacattatatagaagagcttcttgaattttaatttacatcagaatcacttaaagttaaaacaaagtagctggaccccatccccagagtttctcattcaataggtccgggatggaacctgagaatttaaacaaggagcccaagagtaaaacagccctaggatgcctgctcatttaaccaatatttattgagcactcactatatatgacaggtacagcagtgaaacaaaataaccaaaaatcccttcccaacaacttaacttctggcaagagacgtaacacacaaaataagcaaattatatactacgacaaaagatgatacatgctacctgggaaagaaaagcagggtaagagagatggggagtgtgtgtgggtggagcagccgcaacttcaaaacagtgctggcatggtaggcttcactgagtagatgacactggaggcaagacttgaaaaaagtgaaggaattaccatgtggctggctactttggggtaagcatgccaggctgcggggagaaaagccctactgcaaaaatacacctagactattcaaacaacaaagaggtcagcatgtcaaaagtggatttctggccaaggaaaatagaagaagaggtccaagagataatggtcctggtttggtaggatctctttggcattgtaaagacttatgcttttactttgactgaaagggaccactgcaaggttttgagcagagaaggcatgtaaactaattaaaaaaaaaacccacaaaaaacatttttttttttgagacagggtctcgctctgttgcccacactggagtgcagtggcacaatctgggctcactgcaacctctgcttcccgtgcttaagcaatcctcctacctcagcctcccaagtagcttggatgacaggcgcccaccaccacaccggataatttttgtattttttgcagagacagggcttcattatgttgcccaggctggtctcaaacttctgtgctgaagcaatcctcctgcctcggcctcccaaagtactcggattacaggcgtgagccaccatgcctggccgataaaacatttcaatatggtcagtctaactggcaacgggagtaccagaactgagcaggaaaataagaggctgtggcagcaatccagatgagaaatgacactggctcagtccaggatttcatgactggacatgagtgaagaaaaggactcacagatgtctccaagatttctagcctgggtcaactagaaagatggagttgtcttcagttaaaacaaaaacaatctcagcacttcaggaggccaaggcaggaggatcacttgagcacaggagtttgaaaccaaccttgggcaacagagtcagaccctgtctctacaaaacatacaaaaattagctgggcatggtggcacacgactgtggtcccagctacttgggaagctgaggtgcgaggatcacttcagcctgggacgtctcggctgcagggagctacagcactgcactccagcctgagtgacagagcgagacctcaactccccatcctgccaaaaaagaataaaggctaagcaggtatgaggggagaggagagagagaaagttcagtttggggcttgttaagtttgagacattgagtaggcaccgcagtgcataagtggaggagttggtgagatatacaaacctggagttcaacagcagtgttagtgctggagatacaaatttgtgagtcactgacattatatatatatatatatatatatatgatacttaatgcatgggactatatgaaatcaccaggggagtcagtacagacacagagaagtgataaaagaactgagtcttgagaactccaagtttatgaggctgggaagaaatagaactggaaaaggaggctaacaaagactactgaagcactaactgtgatggaggaggaaactcaagaaaagtataatgttggggaaaccaagagaagaaaatgtgtcaaggaaggaggagtaaccagctgtgttgatgtgctactaggtcaagtaagatggggactgagaattggccactggatttacaatgtggaagtaatcagtgacgatgacaagaatagtgtctctaaaattctatgaaaagaaatcctaaaaggttacagggaactgtgaagagggactatattaagtctggttcaatgacaactactgagataaatgaaaagataagaaaaaagctttccttatctctaaatacagttgcacaaagtttctatcaagtgtttccaacttccaataacacaattaggcttccaacttctaataacataatttaggctaaggcaagacttggtacttcaagaaaatttcaaaatctgtttaaaaggtgttccacagatttcttggaccaaaagcatctaattgcttcagcagctctgttctggccatttctgatctttctgtacctaaagcacacctaacctcaacagcctcatcttctctatgaacccatctgaccacagacttactccctcttctgaattcctggtaacttctgatctctcccctactcccccagcacttaattataacccattttaacaatttcatgtatatataccgtcatcagtctctactaaacataagcccccaagggaagaccaagtccttattataaattgtatactccagttttatattaatagtgcctgcaaatgtgcaagacatataagtatctgaattgatggtaaataaagtgaggaaaaaatagtttttgtttttgcttttgttagagccatattcaacaaatggtgctgagacaacaagatatccacatgcaaaagaatcacataatatataaaaactaattcaaatgagccaaatgcagtggctcaagcctgtaatacaagcactttgggagcccgaggtgggtggattgcttgagcccaggagtttgagactaacttgggcaacatggcagaactccatccctacaaagaatacaaaaattagcagggtgtggtggtgcacgcccacagtccaagcttctagggaggctgaggtgggaggactgcttgagcccagaaggtagaggctgcagtgaaccgtaagcatgtcactacactccagcctgggcaacagagtgagaccctgtctcaaaaaaataaaatcaaaaataaaaattaactcaaatggaataaagacctaaatgtaagagctgaaactatcaaattcttaaaagaaaacagatgcatttctgaccttgaattaggcaatggtttttcagctatgacaccacaagcacaagcaaccaaagaaaaaataattaaaatggacttcatcaaaattaaaaacttgtgttgcaaacactatcaataaagtgaaaagacaattcatagaaggggagcaaatatttgcaaatcacattctgataagggtttagtatccagaataatataaagaactcttaaagctcaacaataacaagacaaacaatgcaatttaaaaatgggcaaagcacaaggcacagttcacgcctgtaatcccagcactctgggaggccaaggcaggtgaaccacttgagcccaggagtttgagactagcctggacaacaaggcgagactctgtctctacaaaaaaaatacaaaaatgtggctgggcacagtggctcatgccagtagtcatagcaactagggaggccgaggcaagtggatcccttgagcccaggaggctgaggctgcagtgagctatgattgcgccactgcattccagcctggatgaaaaacaagaccctaactcaaaaaaaaaaggtcaaggatttgaatagacatttttcaaaagaagatatacaaatagccaacaggcacacaaaaagatgctcaatattattggtcattatgagatgaaaatcaaaactacaatgagatactacttcatgcccacaagattggctatcaggaaaacacaataataactgttggaaaggatgtggagaaattcaaagccttatccattgctagtggaatataaaatggtgcagacaccatagaaaacaatttggcagttcctcagaacgttaaacagttactatatgacccagaaattccactcctagttatatcctagttatatacccaaaagaacaacatgtccacacaaaaacctgaatcagaatgttcacagtagcattattcataagacaaaaactggtaagaaaccaaacctccaaagaatgaatggataaacaacggattatccagtcattaaaggaaatgaggtactgatacatactatgacatagatgaaccttgaaaatattacattaagtattcaataagccagacacaaaaggccacatattgtgtcatttcatttgcatggaaggtacagaatagacaaatctatagagacagacatagattaatggtatttggagtgggaggagacagggtgggaatggagagtgactgttaatgagtactggatttctttcagaaataaagaaaatgtttttaaaaagaagtcatacctcctatccatccagacacatttatttctacaaccagcagacaacaaggtaggaaaaacacaaaaaataaaaagggtgccaggtacgatggctcacgcctgtaattccagcactaaggaaggccgaggcaggcggatcacttgaggtcaggagtctgagaccagcctggccaatatggtgaaatcccatctctcctaaaaatacaaaaattagctgggcgtggtggtgagcacctgcaatcccagctactaaggaggctgaggcaagagaatagcttgaaccctggaggcagaggctgcagtaagccgagattgcgccactgcactgcagcctcggtgacagagcgagactcggtctcgaaaacaataataataaaaataaaaaaggatgaagccaagctggaggaaagaggtcacctagaatttaccactgaacttccacgcaccaaccttgaaatccaatgatattttcaaatcgtagtaacttacatatctggagtttggtgctatttgttacctccttttcttcctttaccatctacaaattcctctaatttttggttttcaattttatgaatgacagatacaagcagtttatggccaattaattaatactgagagttctcagaatgctccaaggaaaaataatttctgtaaggtatttggaaactcaagaaaagcagaatggaataatctgaaagagaaccctgggaaagccctgttaagagagaaagagttcactaatgcattttcaaatggactcagtggaaagcagccaaaggtttaaaacaggtttgaaaattgctataatgaccagactgacagtcaaccaaacttctataagtcctactgggagagttctaacgttcttttgatttctctgtatgaaaacacaacctgcttctaggagaacctttatgtgaaagaaactggattcagttcctagaagaaaagctggggaattactgtgacagccatctccaccataactacatccaggttggccactgcggtggtcacttgtcacccagaagaaagtcctgcactaactgtgtcttccaatgtagtaaacccagggaacccaggcccaatgcatgagcctgaaagaaacaactctgacgcaatgctcactcatcactggagggtcacaagtactttttaaagtcagttttatgattaaacaagtgtaagaattagcatgttcaatataagcaaagaacgaacatatgtagaccatctacgtgtgttgctttattaagttaaaattttcaataaaatagaacagcaccttttatcatataaacagattttaagcacgacactcaaaattttcaagttctgcccttgagcctcactgctttgccattttaggatgtatgcccactagtttcacagaaacaataaataagaaaaatgtttgtttccatagcatcctatacttccctatcagagtttcacactttgttgtaaatagttatttgtccattactcccacaaaattaactttagtaggaaatatgaccaatccccaacgtttagtatagtaactggcaaatactacacgttcagtaactagttaccaaaagaataaatatgaaaataattaattatgtattacataatctcaatttcaaacccagcattgaagactgtctggtactaccaacaccctctgaaattgccagcagtttcactcagcagttcactgacccctcactctctcacagaatgtttagcatctgctacacagtaacactgcagcctaagttctgcaaataccaagtaagttaggaaataatactgttcctgtctgtcaataacattattgcctaagtagaaaatcccaaagaatctacacacaaacacaatccaagaatagatgagagttcaacaaggtcacagtacccaagatcaacacaaacatacaaacacacatatgcacacatattttcaaataagacacattcacaaaagagtcccctggcatcagttataagttccttctctcttccaaataatgacctctcccaccaaccccaggaattaatgggcttgtgctctgactcaagtcacttttgagacagtttcttttttacaaaactatttccacatttgtcaaagatgcaatgaaacatctctaatatataatgtgaccctataaaagtatattctaagtcagatataggaaggtataacaaacgtacacattaaaagggtgactggtttgcacaaagctaaaaactataaaatccctactaataccttggttacaccttcaatacacttttagcattttgtacatacatttgttttactttcttccctactgatcacaagcctcaaaaaaaagcacgtctcgtgtccagctccgtgacaagatttacccactattttggctcaccttaatacaatctagacaaatatatcattaatattgacaagtacgtttctcatccctactcagtatctgcacttttaattttctgtctgccacttatttttatgatatggggggagggggttcaactctgcacaaacacactgttaaagatagcattgctaaaactaaacagctggttggtaggcagcacaccatgttgcagcctgaaatgtctgccatcaggagataataaaaagttctaatttggtctataaaaggcagtttaaaggtgtcaattacaccatgaaatacatgctgcccacgagtcaaacacatgagagatgagacccaccatacttgagagcactctataaaaaaatagggaggcacaatataaaaaagtattgttatggtgatgattttcaagaaggttgaaagtatcaccacctaagactggaatatttccacagaaataagattccgcagaaatcactaagacctggcttgacattttaatgaatatcctataggcagtaaaaatttaaaatatccaagtttataaatattacatgtatcgcatttgagctcttctgagttatgaaaagttaactccactttcataagatggacagagatcttaaatttagaattaagtggaaagcaaaatggaacacaagttttgatgcagataaatacaaagaaatccatttaggaaacaaacctaactgtacctaaatgaaaactcagacctcatagagatatactccagaattcattctagattagctatttaaataaaaacactaaaatcagaaagctaaaagagtattaggcatcactaagaaggctggtggggggggaaatctatgatataccactcttataaaagccttgatgccttaaaatacaaaatgaaaccaagaaaaaacagaaaaaaatgtaaaagggagaactatgacatttagagtcaattaacatttattgagtgctgaaggcctgtgtcagcaatgttcaagatacttttcccatgttaccaatttctacacagatttaagaaatttagaatgggaataaagtagataaaggataaaaagatctaagactgactctagaaaagtcactgacaaggtgaccatggatatccttgcgaagtactagaatagaaaaacttgaaacttgaaaaggtaaggttggaattttttaaaaataagggactatttcattttgtctgtagtaaaataaactgcggcccattgaaatttgggattcttgtgagctacttcagcacctaggacacagcggctgcttagaggaaagagaaaaggcacaaatagaacacattcatttttttctggaggaggtaaacactgaaaacaaaatttttccagtatattagtagctggtaaatctgcaaagtaaaagaaagtatggtatttggtgttcaactcctgacctttcagagaacagtagactgacagacacgtgttctgatccagagagattattaaagactgtgcatcaaattagaggcacagtgtgctgcaaaccaaacatgaggggaaaaaaacgaaataaagttaatatttagagtgaaattacatggtacagactaatagtgctcctggagcaaagaacagtatcaatgactatcatagagaagacaggaaaggcttcaaagtatatgaggcaagaattgcagagagaagaaaaaagatacaggcacaagattttaaacatatgtctgtgacagtcacattttagagaacctattcactcccttcaaattccaaatataaagacttaatctctaggcatctcatttatctctgaaatgaatggtggaaccacattaggtttcctgtagcattggaatctggatttcatatttaaaaatcaaactcaggccaggtgcagtggctcacgcctataatcccagcactctgggaggccgaggtgggtggatcatttgagttcaggagttcaagaccagcctggccaacatggtgaaaccccatctctactaaaactacaaaaattagccaggcggtagtggcgcatgcctgtaatcccagctattcaggaggctgaggcagaagaaacacttgaacccaggaggcagagattgtggtaagccgagacactgcaatccagtctgggcaacagaatgagaccccccctcccccaccccccaaaaaaacaaaaacaaaaacaaaaaaaaatcaaactcagatttccaccttcccctctcctaaacttcctattttctacctggttccataatgatctacccatcattcatgtttaaaaccttggattaacctttggtttttcctgcccttttctcctactctgccagactccatctgtgcaccaactcctggtcattccttccctcagaaatccctttcatgtgtccctttaaatttctaccaccagtacccaaagacaggtccctatttcatcaaatctaggttgacacttagccttagctaaccttcttgcctctagtcaaacctcactcccaactccaaaccaacctaaatactgctgacaactggtctctgatcgtgtccctgtcccctccctattcaaaatgtccccaccccaccccaaagtaattcaatatcttcccagtctactactttccctggtatccatggctttacaaaacctgattccaatttaattttaatgctcttatcgcctttcccctgcaatctggtccttcacctctcactcctctacacctttgttcttgccatcctcccctccaggcactccatatagctctttctgctatccatattcaatttctgctactaaaacttcccataggtaaaaagagtctctccttgtctcaaatcctacccctttttgtccacaccactcatgtagcatctagcctagatacataaccgtgcattacagggcactgcttttgtttgtgtgtttgttaaaaaatgccagtctcatctccctaactggacacaaagttcttagaggatgaaaatgcttgttctttgtaactcctagaagattttgcttagttctacctataaatggtgattaataactactgatgaggtgatctaaagttcagttgaaataatgcccatctactcccatgcagttctttctaagggctctctctcttcactggtgtctgtactaaccagaagcactgttacacactgtgtgccatggtcttgttttttccccctttcaaatatgagtctggtctctccaactaacttctaagttccttaaagactcttataccttttaagcattctttacaatgttaagcagaccactggacacagagtggtatttaacataaaccagtaataaagacacctaaatattacccaaaatgtctcaattaaacagtgcttgggcccggcgtggtggctcacgcctataatcccagcactttgggaggccaaggcaggcagattacgaggtcaagagatcgagaccatcctggccaacatggtaaaatctcgtctctactacaaaaaaaaaaaaaaaaaaagtcaggcctggtggcatgcgcctgtaatcgcagctactcggggggctgaggcaggggaatcgcttgaacttgggaggcagaggttgcagtgagccaagatcatgccactgcactccagcctgggtgacagagcgagactcagcctcaaaaaaaaaaaagcttaacaccacttaaggcacagactttataaataacacgtctaccctgttttacaaatttcaaagccagttcacgtctattatttatttcactctcataactctgtgatgtcagtttactgaaggaaaaactggctaagcaagattgtaggatcaggccgggcgtggtggctcatgcctgtaatcccagcactttgggaggctgagacgggtggattacttgagcccaggagttcaagatccccctagccaacatagtgaaactccgtcactactaaaaatacaaaaattagccatgcattgtgcacacctgtaatcccagttacttgggagcacaagaatcgcttgaaccctggaggcagaggttgcagtgagctgagatcacacaccactgcactccagcctaggtgacagagtgagactctgtctccaaaaaaaaaaaagattgtagaaccagtaaattggcagtgcaaggattcaaacccagacctcctgggcccagggtcaaaattttaggtactattccacaaatacagattcaacttctcaattagcctccaagttcctggaggaccagggccatgaataatttcttttaaaagattctctcctcaactcctcccaaatgtcttcatgtatcaataagatgaattaaacctatatgaattctgcagatacaacaaactcatcataaataacacacagcctgacactacattgtgcccccataacagacgaaatcaccatccaggcctccatcttaagtggagaaagacttggtaatataagcctatggcctctccaagcgacattcccaaacaaccattttgagctcagccacacaatcaccacacccatataaggtgaaagcatactgtatttctcaaaatcctcgagtcctgccagacagtctagtctttgttctctgaagggttgagttaacatctaatctaaagagaatggccagaagtgtctgctactctcagagctttcaaggaaacgtccagttagagagcatcatctcctggaagtaccacgggtctccaagtacacatagctcagagccagggccctccataattttctccctaaactgcatttttggatcatttttaaagactttggaagccttacagatgaagaagcagggccctaaataaaaataagttagttttaatattccaagtgaacagtttgctaaaacaccattttcatcatcctaaagactaagagactaagacatgaaaacaacagaaacttctctattagctctagtatgacagtatcacagaagtgttggcaagtttctccttaccaatgttattatccagagttagaaactactttagaaataaaataactttaggaaaattactttactatgtcaagcattaaagtaatttcaaaaaagttctagaggaacatgaaccaagttgtattctctagtctatagattaagtcatactaacaactcactacttgaattatatgagcattatagttaggaggccaggcaaaagctgagaaggcgaggctagtcaggaaaacatctcagagaatgttactgatataacatgtagctgttgcactgtaatagacatatattactctgtctgggtttaagtgttcctttctagaactgtctctttacctgatgaacagtgtattataaggccatatacctcctgagggggtgagcacagctcaaggtggccagaagacctcactccctggtcccagttactgattcagggaaaggatccataacggaataataaaggtactccctggagtatctccaacaaaatggccatgttcctgtcttttgagctccattggtcatctctaccccatgtgaagaaaactaccctgaaaatgaagccaacagttgacagaagagaacaagatcagtcctgatgacatgcctggtgcccctggagccagcctagccctaacctcagcctatttatacatcaacaaattccattttaatgaaaactattatgtcacctgccagtctaaatgaatatggtgccaaataaaaaagaattaattatctccagagtacgtctggaaaaagaatggctaacaaagttaaatctacttctaaacccaactggaaacaccaatatactgactttttattcttaccacctaaaatggcctaaataacttgagaaccagtccgttcttctcttagaatgtttgaacaatgtccacccaaacttttatttatgacctactgatatactattttccagactagatgttaaaaacagatatcaaattgtattcaaaacaaagtcactattctctcaagagtgtcttgttagtatttagcaaaagtctgggtaacaaatgggcaacctggctatgaggcctactccatgcacaccaaagaataaggctaaaaaggtaaacaagctacaagtctaccaagccccgatataatacatttactttcattcaaaacaatatattcaacactggtcggctctgaaaaagcacagatcattcatatatacaaataagcatacttttcaacacatgtgtttaatatacacaacccaaattctagattggaagattatacctaacatgcgaccctcaacctctggtttctgtgtactgatgcaatatcataccacagcaatgagttaaaaacgtgacctccacaagtttctttttttgtttttcatgttttacttgcctacttaccttctcatttgttaccttcacatttttaaaaagacagcagttctccaactggtaaccaaagtttcaacagtttctttgattcaccgaagagataagggtaggagttatggtttacatgagttttactactagaagtcacaacatacacacacaccaaaggagttttaggtgctaatacagtatatgttgatcactcccacagatgaagacatctttaccaacttgcaaagtgagataacactaagccttaatcatagtaaatggaaatacatatccgatgcgttaaagaaaaaaggaaaagtgacaaatcgtcatttcactggattcttttaaaattttttctggaggtcgggcgcagtggctcacgcctgtaatccctgcagtttgggaggccgaggcgtgtggactgcttgaggtcaggtgttcaagaccagcctgacccacatgttgaaaccccgtctctactaaaaatacaaaaattagccaggcgtggtggcaggtggtgcctgtaatcccagctactcaggaggctgaggcaggagaattgcctgaagccaggaggcggaggttgcagtgagctaagatcgcaccactgcactccagcctgggtgacagagggaggctgtctcaaaaaacaacaaaaaaattttttttctggagactggcatttatgtctgtgaagtgggcaaccaggtggtccaggaacaagagtagaaagatttttcaatgggtgtcttttttatcatttgagtttataccatttgaatgtactattcactgggttatctttttcattgtttgaatggataccatttgaatgtatgacttactaaaaattaataaataaattttaaatttagaaaattccttgaaagtcactttcagaaaccacattagaactccgttagtctaaaaataatcagaaaagaatactgcatgtcctttactcttacaaaaactgcaattttcccaagtatacttttaaatgtgtcctgaaaccattaccaactgtttctgcctaattttctttcacaaagtatgagtgcagaataccagcaaaacatgataaatagttcttttctgtttttcccttccaccacagaggtgctaatgggaaacaatataaatttgccaataggaaaaaaatgctaaaaggcatatactcacaaatcaaatcactaaaagttaaccatacagtagttaaccctgttaagccagggttatccaaagcaccgctcccataccactgatgcgaatggtaattttagctagtatgtaaactaatattttaattgttatgaatttattttaacatgtagtttattatacctaatacctacataccacatgtaggactacacaaatatcactgcctaagataaatctacttaagtaaaatcgtgaatccatctgaaaaataagagtgcacatgtgtatgagtgaagttttagaagcaccagtgcactatacaaattagatcgaggcacactgggaatgaccaccagcctacattaaccacaatgaacttagaccaaacttcgtgctcacagggaaactctcactgaaaggctggcacaactaaatgacagaagctgtgatctctattcctcttaccttggacacctcactgcaggctctggatcactccccaccctcctatctaccaccctaaggtttctaattccaaaggcatgaagagaagtctagagtcagtctccagggagaggaatgtcttggcctcggcagagctcttcagtattctccctggttcttattgcctcttcatatttctattacacctatgttgtccctgaaccaccaatattccctaactgtctatggcaccaagtcgaagcctgcacttccctctcagagccttatattccattattgttctctgctgcaggcctgataccagtccaaccccatttaaaagaaaaaaaaaaagatattcctgttgtcaggctgatggatttggccagaggtggattaaatggcagagcacaaaccaattcaccaggtatgagagaccagcccatactatcctcatttccccaagtgtatctgcattaacaaacttgcattttaaaaaagattaacgagagaaattttatgtaaaagaatttcaagctacttaaaggtgatttagaccacctgagaaattttagggctcactgcaggactatctcccagccagcaatcaggcagtatttacaatctggaataagggtgctgagactagaaaagggttgtcaatgggcttactaactaaactcttatttatgtatgatcagtttccatcacaaactatcctaacagctcatttagtatatagctgtctgctcacaacttcagagatgaaaaaaaaattttaacataaaacattcatcctcagaaactgaaccaatccctttaggttggctaaaggatgcttctgcaacagtcattcaccagtatgatgcaatgatgtgttctatatagtcctcaaaaattctgttttattcataccagattcttgcaagtattaccacaagtaatctcagagaatgaggtccaaagtcctgacagaggggtcccaattagagcctctcaggttatcagaatcatttgcccagacaggtatattcagaagcccaaaaatcttccctttaaacttgaaaatagagttccaaactcagttttcagtaaaatacctttgagaagggcatatttaagtttcaatgtaatatctaccacatcacctgccgagaactttaatttagaaatcatctgttttcaaaaataccatagcccagatgccaaagcatgatgtttacctttacacaaaaaaacaccaaaagaagaaagattttatttgggaaactagacctggcacttgtggtatttattttctttcatgttttataactacctttagtcacttaatcctattattgaagaattaaaggaaatcaaagagataccaatataagactagcaatttggtagacaagagggaaaaaattaggaggctgaaaaaggaacacacaaactcaccaactcagactgtttttaacagcatagcatactgtgtggccaatacccctcaaaccataaattctgagaaaagttccctagtacccagtggagagtcaaaaacaaattcctgcctcagcaatttctcaccatcattttatccatctgagcctggccctaaattttctaaaacaaagctcacaatcacatcccccttcaacttacatcctctctcatggaagaaaggtactttctgttccatcattttcctctcaaactctgcctatgacctggtccctaaaaacgaaatgttccttccacctctccaagtctaggcccttcattctcttcctccactggttccttggcagggccgggagcacagagggaatacctcccaccgctgtactggatttcccacaccgcggttcacatcgaatttttcttcttaacccccagtaatctggcttgtcttagcaattctatgaaactgcaagcacagagggttactgactcccaatagccaaataaaagctgaccaatctctccttttctaagtcctcgcccttttcgatttctgctggctctatctagccttggctctccactcgccaaggaaaattcaagactgtggttagactctagtctttcttctgtgcaatctaagtgatcccctccactgtcctcctagaaatgacatcagaaaacaatcttagacctatgcatctccagccaccagtaaataggaaagccctcgattctatcttcattaagcccttcaaccttacttcacatgtccaaaaccaaattcaaagtcttcccaggattcctgtcccattccaccttcacttccctgtatctaccaactatatcatcatcgccacgtcagtcaaatttcccttcacaggcagccaccaaggtctgctcgtttttccatactagtattgcaactcctatgagaattaatacggtttttccatattaaaatctcatccactatgactgcaggtttgcttccttcctggagttcaaaaatgactgcagtgtccagaatgagaagctgctgtaagactcctttcccatggaccagcacccatcctcaactgaaacgcagtctgggaaagtgtgaaaaaatgaaggagaaggagagagacactcagctaacgccactgccctcatctcacctgccacaaataatctgcatcttcccccagctaccaaaccgtccttcacataaatttctgttcagcccacaagctgaaaagcctcctcagcctcttattaaagacccactaaataagtcctttacttcttgatcaaaaggaatcatcgctgtgacttctaaactgtaagaaaaccaaacctttaaaagtacctgtcctcagggcttggggcagtaaaaaaaaaaaacaatctaggtgaaacgtcttctataggaaaatttattttttttgaacgaacttaaccaggcaaagcaagtaactagcaacatgtgcaccatttacttgggcaaatgtcgcccgttcctcctcggtgtcatcaaaaggtacactgggagaacagaagggttgaattgagctggtttccaaggaaccatgtcagagccgctgcggagttaagagctgcgtccacacagcagccaaatcatgaagttgcaggagcggctgttgttaacccacagctaagaataacgctcgactttccaaaataaaacgaagaaacgaagtcccctggccaatgattcggggcggcacagaggggaaacggagcttcctgcactgccctcatcactcagaacctggggtcccaggcgattcagtcaccgcccgcagaacagcgccgcgggcaccacgtgaaactcccggggccggctgggggcgggggacgaggggcgcccactcgggggtcggcagtttgcaggtgcgatgggcggccccctcacccacgtttatccggactggagcccgccgctcccggccgggtttccgggtggttcgcgctccttctgaattggcagcgaggtcgcggcaggttcgaggtaaatcggacgaagaggggaaaaagtctcaggggtctgggggcctccgcgcctcaggggaggcaagggccgggccagaggcgcgagggtgggtgagggattcccgccgcggggccgggaccggggctcgggcagtgggccctgccccgcgcgcccacgcgggccgccctaccgtggctctgcaggatctcgtgcttgagaccgccggtgtagtcgatgagctcctccaggccgcgctcgcacagctgcccgtagcccgagaacttgtgcagcaccttctccagctcgcgctccaccgtcacgcactgatccatgccggaggcggcggcgctcggctcctcggcgcccaggtgtccgcagccgttcggcccgggccccgccgaggccgcgtcctgctcctcgttccccaagcgggcggcgcgggaggctgaggcggccgaggcggcgggcgcactagccgcggcgccgggggagccccgcgcagccggagcccgcctgccccatggcgccctagccccctggcgagtcgccgctgctcccgttcgctcgctgcactcggccccgcgtccccaggccccgctcgcgacgttcgggtgcctgcgacggcgcggccgattgtttttgttttcacgggaaccgaccgatgacctggttctcccgggcggcaccaagtgccgccgactggggggagggggatggccacccgggcgaggaaaggaggcggagcgggccgtaccaagtacaccctcggggtggggggtgcgacccggcgagaacgggcggaggaacgcgacgggcgcccacacgcgccgccactctaatggtgtgcgccgtaccacacggaaggcgtgcgagggagagggcgagggtggagcgaggccccaattggcctgaggagctaaatagggaactttggagacagccccagcgctcggagagcgcaacaactacgcgctccataaacaaggaggcggaaaccggccctcaccactccgcccagaagcggggaatcccaaccaatgggcgcggggagtggtaagaagccaatccctggccgaggcgtaagccttcagccaatccgggctgaggggccaaaccaacgggctcgctgttggagggggtgacttggagagcgtaccgagaaacgagtagtttatggaaagccttgggggaaaactagacaaaaatacaaagggctgttttccataggacgtagccctgatcccaatttatttcgtctcctcatcgatcttaagggaaaggggtaccgtcattccgaacttttgggcgacggatccatctcccgggatgaaaaaccaagccaggccgcccgggggctggttctgcgtcggcggggggtccctaatgggaattaaaggcgggggtgattgggcccgggtgaggggagccgcttgctgctcgcgaaaggcccgcgccggctgtcagcgctgccccgggcttgcgacacccaggaggtcatgtccccatcccccgcggaccgtggccctttggccccttggcctggaacctctcctgacggtggcctcgccccagagccatgtgccgggcagcttagccgggtggaaagaacacgcgctggagagccgggcagcctggcccttgctccctaggaagccttatgctatcggatcggatcggctttaccccctcgggtaaatccttcccatcgcttgctatggcgtctgcagccttggcctagacctccttgatcagcatcggctgcactacctttgcatttcttcaggagcccagctagttcgtgcctcagggcctctgcacttgccctttccttggcccagaaaactcttcctcctacctttttcatcctgaagttcttctcagctcacttgtccccttacagagtcctcccctggctgaccacactaatgtacttcctccccaccgttaataccataacacattttattatttccacaccacttaaactctgaaatgatctgatgttttatttttctgtctgcaccacttacataaaaccatgacggcaggccccctgcttgtctaaattttttgcctagaacagcccctggcatgaggtggtaggcaattctttttcttaaattaacgtgataacgtttttgagccttaacttccgtataactgagaaataattggaattaatacttaactaaattgttagataaaggagaatatatgtaaatacccataataggctcatgataaccacatgataaaggtggtagtagtcattattagggcagccccaactggtattatttcagatctcccttctccccaccccatttttcttccctcttggcagatgtctctgattcttcactgagattaaaaaaaaaaaaaaaaatctagctccagcaacttctatcactcttttccaagtattgctgtgtaccacccattttgtgaacattctcatgtacccaaaggaccaggagtcccttctccctttccaagacagccgttggggcctgcgggctgcctctcacccctgtccagatcttccccctctttctctgcagtaggttcttcctttctactttcagcccaaatgggtttgacctacctgggggaggaaacttaatttaaccctcctcaagcactcatttctttcactgccaaactgcctagacaaatctatgtttattcctcccttttcttcaaggatctccttgataagctcagtcacccttttctcagtctttttttttcttctccttcaaagggttgttatagtatgaaatattccatttaaggcactcaacaaaatgcctggcacaaggtaagagccatgataatccactgatcacaaataatcaatgactcctcattacctacagcttcagatcctctctcaaggacatggtctgccctgtgtagcaacacagcacaaacccctatccaggcatgaagcactttctcaccctcagtgtgacttgagtacagcccattcatactttgccttcttctgggacacttttctttattctgtttttcgaatcctccctttcttcaagtaacacgacaagtcttactttaactagtgacaccttctagaacctaggcctgcactcttcaataccataatcaccagccacaagcaggttttttttttgtttgtgtttttttttttttgagatggagtcttactctgtcaccaaggctggagtgcagtggtgggatctcggctgactgcaacctctgcctcccgggttcaagtgattctcctacctcagcctcctgagcagctaggactacaggcacacaccaccacgcccagctaatttttgtatttttggtagagacagggtttcaccatattggcctggctggtctcaaactcctggcctcgtgatccacccgcctcagcctcccaaagtgctgggattataggcgtgagccaccgcacccgacccacgtgtagctatttaaattgaaatataagctagataatttaaaatttagttccccaattgtgctaaccacatatcaaataataaccacatgtagctggtggctactgtattaatcagcgcaaaataaatatttccatcactgtagaaaagttttgttggacagtgctgatctagaccatgaccacagtaaagttaccagccctacctttaactgctgtaagacctctgtgtaagtcatttcatgccttagtgcatactgcccccatatttttagttaacttttccaacatgtgcctttttgactcaactagactatcagttttcagatctgggctgacttctttttatctcccatgatttaatcagcatgaaaaaaagtgtttgttaaaggaaaaagaatacgcagattagaggagaagaggcttcagagttagctgggagagaaaaatagtacttgtaagggcagagatttatgttgcttcttcactttgtattggccctttctacacagtgcctaattgccttaagcctaaactgtgaattgtcaaagaagcacctctagaaacaacagggaaagaaatttagttttcagagcaactgcaaattagtttgtttttttttgttttttttttgagccagcctctcgatctgtcgcccaggctggagtgcagtggcgcgatctcggctcactgcaagctccgcctcctgggttcacgccattctcctgcctcagcctcccgagtagctgggactacaggcgcccgccaccacacccagctaatttttttttgtatttttactagagacggggtttcactgtgttagccaggatgatctcgatctcctgaccccgtgatccacgcgcctcggcctcccaaagtgctgggattacaggcgtgagccaccgcgcgccgcgcaaattagttttctataattgcattttcaccacacaataaggaagaacacacacacacacacacacacacaaaatcccactttagtatcaagtggactcctgcccccacatgctgttcagcctggagaagctttaattgatactcattctggactttgctcttgtcttcccctccactccagatttgactctgtaaaatgtaagtaaacatcaaaaaaagacgggaaaaagaaaaccttttgtctttcagccaaaatacatatttattgtaggaaaattagaaaatacaaacaagtaaacagaaataaaagtcccatgaaagcccaagacccagaaaaagaaaatcagttttaacattcggggtgaatttccacagatttttttcttttttgtgcatacacataaactcatatgcacatttttatgaaagaacgctctcattgtatttactattttgtaaacagcttttgttgtcctcttaacattcctccaacaacaaaaacagtttttagaactgcttttgacatctttttaaaatgcttaatagctgttacactagcttatagcttattcaacatatctcatacatattttcactttgaattattcttagaagactgaaaccagagagagacaagatagaaaaaggaaaaatttcatctcttaaatttgagaaattatatttttaaaaaccttctgcttttatgcaaaacacactttcagataagggtaagaaggactacatttataattctgttaataaaaatgaatcagcgaggttggcaaagaactaactaatttcctgactactctagctcacaactaatataaaagtaaaagtaaactgacaaaatgtgttattaaaagaaattctgaattgcaaaaaatagcatttcttctcatttaaacaaatcaatttttatcttgttttgttttgttttgtgttttaagagttagtgtctcgctgtgtcacccaggccagactgcagtggtgcaattatggctcactgtagtctcaaactcctgggctcaagcgattttcctgcttcagcctcccaagtagttgagattacaggcatgagttacccactgcgcctggcacatttttatcattttcaagtaaaatatatatatctatctgagacatttctgggaattgctgctatgaccagttgaagaaatgggtgaaagcacaactattagcaaaaagtcttaatctgaatattttctacatcttttatgtcacctgtgtggtttggggcccgtttgctggctggattaatgatacttgctcgccattatgactgactcttagggattggatatgcagtattgacagtattgcacttctgtgtccaccatctccgtctttcagctccactgtttgtagaagatagcctctgctcagcggcatagccctcctcactgtggccttcaccactcatgaagtccagggcagttctagtctggttgactaccagttaagttaccccctaatagacttccatgaggacctcattgacttccttgagtatagtttgtaggcactgccctcgtacctgggtgcttagcctatagggggttatttataacttttgaaacctgctctctcaggttttattgtctgagtcttttcctttctggaatctggatgtttttcttaggtttgtttcctgctcactgttggtgtgctttaccagctgtagcaggaagagtgctagcactgtaatcttgtaattcattcaacccctctcagcctcagatgctttatctataaaatgagaagcttggaatagatgacctttaagttccttccagttctaaaattacagagatgccagggcttattaagtaacatgtgaggtgcaacacaaccaaacaggaatagacagaggcatctttcctgttttcgaaagcttggagtctgaatcattacttcctcattatggaaacgtgatgaggtttgtttttttgttttggtttggatttttgatttttgattttggttttaataaatagctacaatttattgagtgcttataacacgctaggcattctgctttaaatgtgggattatctcagtcctcaaagcaaccttttaaagtaaataatgccgggtgtggtggctcatgcctgtaatctcagcactctgggaggccgaggctggcagatcacctgaggttgggagtttgagaccagcttgaccaacgtggagaaaccctgtctctactaaaaatacaaaattagccaggcatggtggcgcatgcctgtaatcccagctactcgggagcctggggcgggagaattgcttgaaccccggaggcagaggttgcggtgagccgaaatcgtgccatttcactctaggttggacaacgagagcaaaactctgtctcaaaataaataaataaataaataaataaataaataataaaatttaaaaataaatagtatttggattattatccctgtgttaacagatgaagaaattgaggcacagaggggattagtaatttatccaagattacacagctgataaagtggtagagctggaatttgaattcaaatctttctgactctataacttgtaagtcattgtacttcaaaaggcgaaattatgctccatgattacttgttaagcatgctatgtccagtagaataaaggaagctttaaccaaacttcattgttttgttttgttttgttttcaataacaaagtctactccacctaccttgcaacattgttgagagaatatatattaatgttgcaaggtaggtgaagtaaacattgttaaatatgtatttttaaattacacatatatttaaaaatatacacatatttttatatatatgatttttttaagtgctcataaaccatgaagccccacagaagtgcagggtgctattatttcctcttatgatttcactttctgtctttcatttcttagcatatgaattgtacttcttttttcaactttttttagtagttgccctaaagttgcaatatacatttacaactaatccaagtccactttcaaatagcactgtaccacttcatgggtagtgcaaatactttataataatgaaatatccctaattattccctccagtataactgctgtcattctttgcatttatatataaactataatcattcaatacatcattgctatcattttgaataaactatcatctgttagatcaacaagaaaaagttaagttttttactttattttcaactattctttctctattgctcttcctttctccatgtagatcagaatttctgacctacatcattttccttctctctgaagaacttcttttaacatttcttgcaaggcaggtctactggcaacaaattccctcaattttcatttgtctgagagagtgcttatttctccttcgtttttgaaggataattccacaggatacagaattctacgttggagggttttttctcaacagttgaaatacttcattctactcccttcttgcttgcatagtttctgagaagtcctgatataattcttacctttgttcttctataggtaaggtacttttctcctctggctcttccaagaattttttctttatcattgaatgctctggcatatttcaaaataactttttcctttctccttccagaagcatggattttttttctctgatattcactgtgagaacctaccaaagctctaagaggtaaaacccacacaagtgtgagaagcttccatgacagcctcgccccactgccccatcctagggtttttaactctcagacttgtccactgtgagtctcagcatttcttcaattacagtttaggttttcctcatgagtactgcttcactcagagatttctgtttctgagatgatgctccagcatgttgcaattctctgtatctgcttatctgaccccccagcttaggaggcagcagtttgccctgtgacctcacttctgtgaagaatctaagaatactggcctcagcaatatggtggaaaacacctctacaaaaaatgagccaggcaaggtgatgtgcgcctatagtcccagctatgcaggaggctgaggcaggaggataacttgagcccaggaggtcgaggctgtagtaagccatgattgtgcccccgcactcagcttaggcaaaaagacaccctgtctcaaaacaaaatctaagaagagtttgttcagtttttgcttgtggttagaatggagtgatgacttccaaactccttacataaactggaaactggaagtcttcctatgtatttgattcaacctgtttatatatcttatgcatctgtgcagggtaaggtttgggttgtaaattgataaagtacacgattcatggcttttgacaacctggaggagactctaggcggtaaactaaagcaagtgtttaaaaatggccttttgaggccaggcactgtggctcacacctgtaatcccagcagtttgggaggccaaggtgggcagattgcttgaaccgaggagttcaagaccagcctgggcaccacggcgaaacgccatctctacaaaaaatataaaaaattagcagggcatggtggcatgtgcctgtagtcccagctacttgggaggctgaggtagaaggatagcttgagcccaggaggtagaggttgcagtcagcctaaatcacaacactgcattccagcctaggcaacagagccacaccctgtttcaaaaaataaaataaaataaaaatggccttttgagacttctggttccaccaagatagagtagtcccatttttcctaggccctctcagaaaaacctggatataacacaaaaaacaagcataggaagactttgaaagttggaaagaagtcagactgcctagggatcccaagacttgaggaatgacatgtggtaaattccctagtttcctcatttcctcctaaatgtcggacaaggcactacagaattctgcagccctgcaccatgaataggcacagacaaaacaaagacccatggaaagcctgttttcctgagtcaaagaatagaaaaaagtgtggcccaacaatgaaaaacctcatcagcttcttccctagtccaaccaaacactgatggaacaactgcattccccaaacctcaacccccagcacagtttcagcagagccaaccaggaagttgatattccactctaccccttaacctatggaagtgggaggcagctctccagttccctgtgggtgactttggtaggtctgactgggagctgaccttttattccctaccttatagaagcagacaatgctccagttcccccagcagattgagcaaggagacaagcttacatccccaatcagaggcatcaaggtggtcgaagttggtgccacactttcactgggatgttgtcagtggagcaataggagagctgaacttccagcccaccatttgcaataagaccatgtgagtcagtacttcagttttgccaagttactgtcagtggggcccagagggaaactaaacatgcctgtgaagaagaagaaggaagaaggaagaagaagaagaagaattattaaataggatacaaatccaaactcttataatatgctatccaaaatatccaggatacaataaaaaatcattcatccaagaaccagaaaaatcacaacacggatgagaaaagcaatcaacggctgtcaaatgatgagataaatcaagtgttcaaattatctaacaatgatattaaaatagcatcataaaatgcttcaacaatcattcaaattctcttgaaacaaaaatttaaaacccagcaaaaaaaaagagaatttattaaagaattaaatgaaaattatagaacagaaaacaagtacaagtaaaattttaaaacttgctgtatgggctcgatagtagattgaagataccataggatagaatcagtgattgaggacagacagatagaacttacccaatctgaacaatagagataggggaaataatgaacagggtctcaaggatctgcatgatatttaaaaggaaaaaaaaattcaaagaatagctgaaaattccccttacttggcaaaagagatgaaacttcagattcaggaaactgaacaaatcccaagtaggataaactgaaagaaatctatgatgctaagacatgtgataattaagcttctgaaggttgaagataaagaaaaaatattgatactgaaaacagccagagagaaatggtgcattattgataggggagaaccaattcaagtgacagcagatttttaacctgaaaccatggagaccagagggaaatggcataacattcttcaagtactgaactaaaagaattgtctacctagaatccaatgtccagtgaaaatgtccttcagtaatgaaagggaaatggagacatctcagatgaaggaaaggtaagagaatttgtcaccagcagacctaccaaaaagaatggctaaagaaatttcctaaacagaaaggaaattataaaagaaggaaacttggaacacgaaggaaaaccacagcaaaaaaatatgggtatatacaataaactttcctcctcttgagtttttaaaatttctaaattgatagtggaagcaaaaattatagcattgtttgatgtagttctaaatgcatgtagagaaaatatttaagactattataaacagggtgataatgtaaagggaggtaaggtttctatatttaaactggtaaaaagatgacaccagtagactctgatgaatatatataatgtaaaacctagagcaaccactaaaaagatatacaaaggggtgcaataaaaacgttgtagataaaggggaaggggtgttattgtttaatgggtagagagtttctgtttggggtgatgaaaagattctggagatgaatagtggtgattgaacaaataacccacaggctcgcaggatacaggaaatcagataaatgaaaacaaagagaacacacagaaacaaaaaaatggcatacataagccctaacatgtaattacattaaatgtaaatgtacatttgcaaatataacaattaaaaatgagattggcagagtggattaaaagccaggtgctgtggtgcatacctgtaatcccagctactcaggaggctgaggcaggaggatcacttcagcccaggagtttgagaccagcctgggcagcatagcaagacccttactcaaaagaaaaagaaaaatgtcccaactctatgatgtctgcaataagttcatttcaaacataatgatacagacaggttaaatgtaaaaagatatacaaacataatcaaaagaaaacataaatggctatattaataccacctaaagaagacttcagagcaaagaaaattaccagtgacagaattggacattatatagtgataagagggtcaagaagacatggcaattcaaaatatataagcactagacaacagaacagcaagatatgtgaaataaaaaactgatagaactggaaggagaaatagatcaattcaaaataatagttggagacttcaacacccatctatcaatgattgatagaacaactagacaaaatcagcagggatttgaaaaaactcagcatcaccaccaacagacatgatttaatcaacattatagaatactccacccaataacaccaagaatacacattctttttcagtgcccatgaaacatataccaacatagatcatatcctgagccatagaacaaaactcaacaaattataaaaaattgaaatttgttcaatttgttcaattgaaattgaagttatgttctgtgagcacaatggaattgaaccagaaatacataatacaaaagtattatggggctcaggacagttcagaaggagaggagccctgggagaaggctgagctcagatggttggggcagttgggggaaagaagtgagctggctctggagggccaggctactccatatggcaccctgctgggcagaggcagctccatgccagggcacaggacttggtgaggggaacaggagctggacctcagtcccattggccccctggctgggtgccctcttacaggggcccaactgtacatggtgaccctggatgttggcctgggaacctgtgatcttctactacatctggggctgacagaggactcgggggctgagaaggagacatggtctcacgatttggagtagagagaaggcttgaccagaagggactggctgtgcagcaggatagctggaggcctattggctgggcatcctgtctactgggtcctgggccggtcttggcagcaaagtcagggcagatagcaccagcaagccacaaccgtcctgctccacagagcgctagaacagccactcatcagttacagcaggactataacgatgaccaagaagagaagacaaaacagaagagggtaggtagaccagaaagagtgttcagaaagaagcttgaaagaggagaggagagacactcctgagtagtagcaccaacctaccagctagatttgtaacctccaactactactttctggcctcagttttgtcacctgactaagagggttggaataaaacgaatttaagtctcttttacctttgactaggactgacccaggctggcctttcaccagctcctgtccccatttccaagggaagctgggtggggggtagagggtgtggatgacttagtgtggtccatcctcagaccaaaaacccagctaggggcccacacattactgtctgaaacaccatgctcaggtgtgaacaaagatgcttggttactgtggacttttagttccaaggagggctgtgtctttcttaactcaatggaagaatcaaattaggagcctggctgggcatggtgactcacacctgtaatccagcactttgggaggctgagacaagaggatcacttgaaatcaggagttcaagaccagcctgggcaacacagcgagaccccatctcttaaaaaaaaaataggagcccacatcttcagattcccagggctgagattctgggaaactcagccaaactccagagctgatgcaagtagcaaaggaccttttttttggtcactggagcctggaggacagacaagggcaagaggcagagaattccagcctttacaggtcacagagaaagtggaggaggaggaggtagctgatgcctccacacccaggagggagggggaaatgatgagcaagatttttcaccctttcagtaaaacaaaaaaaattatttctcctatttccttctctgagattaatgataaactgtctatcccctaaaagaaaatgataaagactctaattttacttggaggcttagaaatgccatttctacgcaaaacagggagcccataatcagacttgagcggggcagagctttgatagaaaatgttttcctctctccctctatttcttcccctccttccccttgcaaaccaagatgcccgacagctaagaacaatgctcaataaaatgaaataatattttagtcaaaataggccaagactgctcccagccaactgtaaattagcattttgagggcaaatatgcagacaatttgagataatgaagcctgattattcaatccaatgaatgttaactagggagcagaggctccactgccttatctcactcccttcgatttatttttttaatcgtttcacatttgaactctttatttgtttctgttttatgcgccccctcccttcctctgtcacacacacacacacacacacacacacacacacacacacacacacacacacacacagagtctccctcccttctctcctccattcctgcccaggctgcagaaggggaccgttgcaggggccatcagtctttccacccagcctggccttcgggatggggtcagcacgcctcatggagcccctactgtgtgcatggtcctttgtagagttgcagggatttgggggtcaatgtgcactaaacagatgacacacaccctgcttcttagaacaggcctgggtgcaggagctggagaatggcaggtttataaaggaacatgccaggtacatgtggggctcagggaagtgggggtggaaggacattgcctttcatgtccttcaatccaccctccatgaaaggtcaatgtggagcacgccctgtccccaggagtcatggaaaactttcttaaattatcctttgtcccaggcaggactcactgcataatttgcaggacccagtggaaaatgaaatgcaggggaacttgcccaaaaatcattgagaatttcaagatagtcatggcagagcattaggacaccaagcaggggaccttctgagctcggggcctgggcaactgcgcacgccacacacccatgcagctggcctgcctccagcagctaaggggcagcctcaggccagtgggaggtaacataatgaggccttctgaaggagggttgaagcccttctcaagtgaagagagaggtttctgagacgctggggagggtcccagctgactggggctagcccctggggttgcgggttgccataggcaggagccccaatgcctgaacagctgtcagcatggtggtttccccttggaggtacccatccttcagcctagagatgatgtttacttggtggcggaaagaacagctcccaactgggcgaggctccccgctgttacggtgctcacctggcctcaacctcctccttgggtcctggccctgctttttccctcacgagtgtggcctcccagtccctgccctgtccccatgagctcctgcctgggtccagcccctgcagctgcccttccctcggggcccccttaccactcctttcagtgtgtgtagcaggaagtccccgcctgagcatggcctcccaccttgtctgctctgctcctcagcttgccctctccccaccagacctcctgcttgtcgagtgccctgtccatcactctcatcttcccgctgcctctgctcatgctgggccctcacctggggggtcttcagcccccttccacctcctatctcctctccacccatttcttcacacccagccaaagaaggcagctctgccttttaccggatgtgctcttgagtgggtgatttcacctccttgagctttagtttccctgtgggtaaatgggattgtagtggggcctgtctcgtgaggtgagtgagaagaccaaccaagctggtgtaagtaaagccccgaccccgggctggcccacctgaatgtgcatacctgttagcttgcactctggggagcctctgggaagcttcagaatgctacagccagttggaacagctgccctcctagaacttccgtagcctttggaatcctggtcacgcagtgtagcctgcattcttacactgtttcctccacctgatagaagtttcccaagagtagtgtggtgagcacttaggacgtgctccctcagcctcctgtgccaccctccttttgtctggagaggctggaaaattaagagctgcatctcccagattcccttgcagctaggcttctggaagtgaattgggtgatactgatcagttagactcctgaaactcagaaggtggacatgagactctttcctgccctgggtttctaatggctatcaagatagtagaaacacaattgcctttttctgcaccagattcccattgtccatcctctagcttctgggtgtcaagagtcaaaaactgttgttttggtttcagtaatggcttgattctggtccttcctacccttccttccttctttccttccttccttccttctttcctccctctctccctccctttctttctctttctttcttcctttcctttctttctctctccctctttctctttctttctttccccttccttccttctttccttcctttccttcctgtcccttccttcccttcccttttcttccctcccctcccttccccttccttccttccttctttccttccttccttttccttccttccttccttttccttttcctttcttcttttcttttttctttcaagatagagtctcgctctgttgcccaggctggagtgcagtggtgcaatcatgactcactgcagcctcaacctcctgggttcaagcgatcctcccacctcagcttcctaagtagctgggactataggtgccaccacgcccagctaatttttacgttttttgtagagagggggtctcagccttctgcttcagattactagtataagccactgtgtccagctgattctgggtttcttgatctctgtattgcagctacagtggtttcaaactcaattcaaggggtggtctcagaggttgtagtgccactgggagttagttcagaattctggaattccttcctggatgttcaggttagaacctaccattctggcttttccaaaaattttgaaagtatctaattctctgttaagtctctctttggtgggtcagtgcagtggatcatgcctggaatcccagtattttgggaggctgaggtaggaggatcacttgagcccagaagtttgagaccagcctgggcaatataggaagacctcccatttctacaaaaaataagtttaaaaaattagctggggccaggcatggtggctcatgcctgtaatcccagcactttgggaggcccaggtgggcagattgccaggtcaagagattgagaccatcctggccaacatggtgaaaccccgtctctactaaaaatacaaaaattagctgggtatggtggcacctgcctgtagtcccagctactcgggaggccgaggcaggagaatcatttgagccctggaggcggaggttgcagtgagccaagatcgagccattgtattccagcctggtgacagagcgagactctgtctcaaaaaaaaaaaaaaaaaaaaaaaaattagctgggtgtggtggtgtgtgcctgtagtctcagcttcttgggaggctgaggtgggaggatagcttgagcccaggagattgaggctgcagtgagctatgattgtgccactgcactctagcctgtctcaaaaaaaaaaaaaaaaaaaacaaattagctgggtttggtggtgtgtgcctgtagtcccagcttcttgggaggctgaggtgggaggatggcttgagtgcaggagattgaggctgcagtgagctgtgatcatgccactgcactctagcctgtctcaaaaaaaaaaaaaatctctctttggttaaaaatgcccagatgggctttctacattaaatcctgacaggcacaagaataaactaagccatctctttctcctgcacccccactgcacagcacctagtgtaggtctccctcttcctaagaaagccgcatgtcccataccagctgacccggcaccatggctggcctctgagctgcccgagcacatgctggacatttgcctctttgtgcatcgttcatttcctgccgttgccctgctctgtcctgtaagcaggaagctgactcctgcaaattacatttcccttgtccacatgcacagtgccttgtccactggtttcttgttgggttcaaccaatgcaaagcactggtgagaaaccggagggtgagagacggggaaggccagagtatttcctgtcctctctctgcttccagtggcatctattttgtggagccagcttctgccaggcaacacctgcaccacggcctcccagctcccagccattggcccctccacagttaaagctctgccctggcaccccagctcctggagtcatgtaaatactatctccctgctctgactgtctagatctatgggtagtagcagcttcctgaaattgctaatcttcgagttgcctcaccctcccctgttttcagcttttccaacactgtcgtaactgggttctcaaatgaaatcacctctctagtgagctacctggtgagctgggttttcctgacagtgtggttcctcctatctgctacaagtggggttcggggccttgagccacgtcttccctccttgtggacacagtctgtctcccctgcggcctccctggccattttgtcctggcccagcctgaagaaacatctgggcaaaatccttcggggtccctttccccagctgaggagtgggggggcgcaggggaggagccagggcgaacggcagctttcgccaacacctcactgttctcttctcgacatgtttactcacaggctgtctgggaagtgagaatcctccctaatggatgtttcacccaattaaataattaactccaagtgttgctaagcatcctcgcctctcaccttccagtcctggaggcgtcctcatgccaggctgcggctgctgctgagacaaggagcctagtgggaggagccaggagtgggggacagtgcccctgatgcttctgtacaggatgagggagataaatgcacctgagagggaaggtaaggagggctgttcagataggaggctgaggggaggctgagactcacaggaagtggcattagaaccttctggagcctttctattgaatattaagtccttgaaggtttccctctcccccaattcttcccatacgccacagcagggtccttgttccttcaaagaaggggaaaggaagggacacaggcttcttcctaatgggtagtcttgcgttatgaggagttacagagctgagctgctctactaaccagacagtcacataaggaaccccgaggggagaggctaaatacattcatactgtggaatatcactcaaccgttaaaaagaacaagatacattttcctgtatagataggaaaagatctgtaagatactataaagtgaaaaaatgcagataccagtacatgcagtttaatttaagtaaaaataatgtgcacatgtatgcatatacttgtctacctgtggaaggaggactggaactagggacaccaaactattccgaggggtgatatatagaacaaagctcctttcatgaaaaattgaactcacatttctgcagtgtaatcacacattctatctggatttattgtttaattgttttctattgtcaaacatgtctaagttattgacattagaacagagaaactccaacagagaaagggagcacagctacattttttttcttaaagattatatactatttctttacatggatgtcttgattgatttagttattgattcatattacaatggaaggctgaatcaacttatacggctttgaattaattgtataccttctattgatgagtgaataaatagttttttaacattcaccacaaaacatataaacattaacaattttgtgatattttacataaaacgtgcaagaaattctaaatttgaaattagtatttattttatagaacatattatgaaatactttttaaattagtaatcagaaaaaagatgattaaatagtaaaaacaatcatttgtatttttaccagatatcatcacttttaaaagtttggtttatattcttccagatagaacaatatactaaaataatataaataggttattatgtcaacaaacatttatatatatttttacagctggttacccccatgcaaaaacgtgccatatgtaatttttctatctaatatatttgaaaatgtatgttatttaaaagttttcctattgtaaacaatactataatgaatattattaaagacagtcttaagttagcaaagactgaaaggacatgttctctagtttagagtgtatgacattcaatcaagacctagaagacttatgccatcccccaagaatgtactaaaaatcatctgggattatagaaggaattcagggaaccctatctgcaagattatttacatgccagatccagtaatttatgatcttcttggtgtctgtaaagtcataaaagtcacaggattacaccatagtcatttgcttgaaattgcattcaagatatctgcattccattccttagatgctttccaaaataataaaatacctggcaggattctgtgtggaatctcagtcttcctatgtgggatgatcacatgtagcatccttagtgccaaacctaataaaacaagcttattgtttttggttttggcttttttttttttttttttttttttggagcatggttgaaaaaacttatgatacccagaacaggtttaataaatttttctaaactggatattgattatcaaagccaattatatgcctctaatatattgatttggagaatttagaaaatcaaatatttcaaatatatcagaaatctacatactaataaatttaaatgaaaaaatttctattaactaatgtatgtcagcagcttttattgacaaactcattttatttttccaaaggcatacaaagtagtttctataataaacctggcaaaaatagatatctagctagcattagcccaataatacaaataaaatcaaatcttgaaagaaatggaactttttaccattccagatagtataataaatgtaatagtataataaattcgcatagctctataacgcagatttggctaaatatgactctataaaatgacatttaaaagaacagtgttgtatacagcatatggatgacatagtttcttacaattttatagtaaaataataattacctgaataaggtaacatcaatcacattcatttaaaatagttgatttataaactagcttgattttaaaacaaataaaagaaactatctactaaggtaacaatgagtatcaattagagtgtcacttcacaaactttaatgttcatacatatgatggcatcttgttaaaacagagcctctgtttcagtagttctgcaccgacctgagaagctatgcttctcacaaacttcaagatgagattgatgttgttcttctatgaactatactttgagtaacaccagattatgagattattaataattcaaaaaataagcttattttttaggaaaaagtataaaaaaatcaggcattcaaactccacaaaaatactttttaagccatattacaaatagaagctttaaaatacatttcttttctctgcatggtttatgaatcttcatttataggactggctaacattgacacaaagttcacagtgggtattatatccatatatctacataagatgttcagcttctctcattctcagcaggtatggtctcattaacacctgtgattttaaaagcctgagtttctcccagcaagatgtagttttattaatatgtgttatatttatatatctctcactttgctatgttataatgtggaaccaaacctatagctattgctctagtatctgtttacttcataaatattgactgctagaggtgtgaatcctactagggtcttttgcataattatatgagggtaagcagtaaacaaaaatgactgaagaataaatgaaaataataacttagcttaaatgtaaagtaagatgacaagaataccatgaaataagagtcacagaaagaatgtttgctgctgttatttaaatataaatgttattatttttgaagaaataaatgtgtatacatctatctctttcagaagaattgtgaattgtttacaaatatattttctgaaatatcttttttttcttagtactgaggtctgatggtaaatgtttagtaactagctttgtataataaaaagccagatttatggtgttttcagattttcatggtgtaaaaattcccagtggccaatttcaaactactgacatgagatctcggaacatagcattaggaaaagatgcagaaatgggcttttttagaagccagtgcataatacttccaacacaacagtgacttagcagactgagcgtcactttactttaatgattaatcacaataattgtcaactgacattttttatttaatgacttataacatggttccaattataaaatgtggaaaatataagtaaaataaagacaaaattaacaataaatctaacacccccaaaatgattgttacacatatgtatatatcctttgagagcttttattaaaatatttatacttgtatttgttacaaaattgaaaatgtgttttatttcactttggcattctacccaaactgacaatatactataattttctacaattattacttattcctttaaaagtacatacaaaactgaatgaaactctatgctcccaatatactaaaatcaaatgattttattctctatagtttatagtttatattctataaaatctatagaatgattttattctctaaatatacatatttagaatgttttgaaaattattggtcaatgaacattctgacgcagaaatccttgtaaatattacctctgcttctttagggtaaatacctaaaagaggaattattgagccaaaaagtgcaattactttgagggtttctgataagtgtccctaaattgcactcaggaaaatttgtgtaagtttaaactcttaagtggagttgctggagaccctctttcacctgattcataaaacaatcttaattagaaagaagaaacaatccaaatgtctttgaggttcaagtacaccacatactatcgcatttaatttttatagtctttaattttattagttcaatttttcatatttgaattgcctgttagcattctttttcttttaatttatgtaggactatttacataataatgccatcaatcatttttatatgtgtgtcaagtttatcttctattgaataatttatcttcataattttgttcataatatttattgaaattagaatgcataaatattaaacttaaaattatgttatatagtataccatgcatgattataaatattatgtcaaatgtataaagtggtttttgctgtcagtttctgatttctccacccgatataattattttatattacctctaatacaacagattcaattctggataatttggggaacaacataagaacagtagtaatcaaaactaaataaaataactacatgcagtttacaaaaaaagttcacatcctatgaatatatttaaattatacttcacttaaatgtatcatttcactatgcattttctattgatttcataatcatattcctttattccatttttccccctctgctggcagaaagtttctattttctgttggcatttagagtatcctaacatttacaacatgcattcatgatgtattaaactataacatgaattaatatttgcctcaatttacagcaaaatgaagaccttctaaaattgtaactccatttatttttcccttccaacttccatgctatttttataatacattttagtatatgctatgactcccaaaaacattgttattgctattattatgctacattgtaaatattcatttaaatttacccactggaatacaactttgtgtttcttattacttcctgaatctataaactaccacttaataccatttcatttttgtttcaaaggtaaccatgagtgtgggttctgtcttagtgaattacttcagttttcagtgatctaaaaaggtttttgtattatcttcacttgtgaagttttaactgtatatgggattgaagattagaaattattttctttaggccgggcgcggtggctcacgcctgtaatcccagcactttgggaggctgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggaaggagaatggcgtgaacccgggaggcggagcttgcagtgagccgagatcccgccactgcactccagcctgggtgatagagcgagactccgtctcaaaaaaaaaaaaaaaaaaaaaaaaaaaaaaaaaaaaaaagaaattattttctttcagtgcatagaggttataattctattgtcttttcacttacattgtttcatttagcaagttaagagtctaaaggtgttcttttaaaggaaacgtgtttttcccctgactgtccatgatatttttctcttttactctatgtttctgcaattcctctctgtgtcatcaggttttgaattgctttctgtgtttttctgctttggattcatgtttccctttcaattaatagtttaattcatttagaagcatatcttccttgttcttgctctactttcttgagcccgtaattatatgtaagacttttcattaacctttgcactctacaatattttctatccttttctttactatgtttgattctacatattttattctaacatacctgctagatcattaatttccttatcaactgctctcaaacctatcttttgtgttttttatattgtttccttttcacatctgaaatgccaattttaagcattccaattatttaataaaatgtttatattttgttttttatcttcagaataattctactacctgggataattctactagtgatgcacaatttttgttccttagctcagctagttcagattcttgtctcacaaccaggaagaattagacaagtggacatcaaagagtgagtggagtagaatttattaagtgaaaggaaagctctcaggaaaaaagagaggatgtgggggttggttctcctacccaaagacaggaaagttccccaatatggctgagcccagggttttttgtgggctgaatagggagtgtgtgctgattggtttgtgagtatgcagaaaaggttaaagcaaagacaccactcaaaggtgggcatgacaacatagaaaaccaattaggcggctgggtgcagtggctcatgcctgtaatcccagcattttgagaggccaaggatagtgggtcacctgaggtcaggagttcgaggccaccctggcaaacacggtgaaacttcatctctactaaaaatacaaaaaattagctaggcatgttggcacgtgcctgtaatcccagctactcggaaggctgaggcatgagaaacgcttgtacccgggaagtggaggttgcagtgagccgaggtcccaccaccgcactccaacctgggccacacagcgagtcactatctgaaaagaaaaaaaaaaaataggtaaaataggtgaaaaagggggatcaatcagaggaaagcacacaaaacaggaaggtgggtcctcaatccaatccaaagatttacccagcacagtttccagcttgaatgttggatttcacggggaactcatccctatctgccttgggatttgtctgcctcctgtctctatcaatcactagctggccttttctgttattttgctctttttccttgttttctttcattttgttttgcctccttctgtgctaggttatcttttattttatgctggatttatatttgaaaaatttattttgttcacttgcaatactcattacagatacaaagaatggcattgttttatatttttataatttatttaatgcctgacttaatataagacatgctgatttattagatctacttctgctttcggtatgttgtgatatcatacattatgtagtctctggaaaactctacttactttacacatgagagagaaagagagagagaatgaaaaaatcaaataagatcttaatattgttatattatctcaggacctcatccctttgcctcttgagagtgggatgttaatggcttcacattgctcctgattcactattttttgtttgtgccattaagtttgtcaaaactattgaaaacagtagagacctcacttatacagccattgacatttattcctctttttgtaacattatgaatgctaatctcaaaagcacaaagtttgaaaaatcgttgcttttatctttaaattacctgggtcttcaatctttcatccctttggacaagtggaaaattccatacttgtagtttttgctggtaaagtatctgaaactaccctgtggtaggcaccctctgagataaaccctaataattcccgcctcctagtattcacagccttaggtcatcccatctttaccttaagtgtgacgtagactggcttcaaaataattctgagaaactatttcactttcaaaattataggctatgaaaagactgtgatttacatcttgggtactctctctcagatggtctcttgaatggctcactctgtggatagccagctttcatgatgtgaggcagtctcagatggtctcttgaatggctcactctgcagatagccagctttcatgatgtgaggcagagtcttgtggagtaatccacagggtggtggtgttgaggtccaccaaaaagcacatgagtgagtttagaagaaggtccctccaccacctcctttgaaatgaatcttcagataagatcacaaccccaactggcaactgcacagcaaattcaggagagcctttgagccaaaggtgcccaaaagccatgcctgaattcctgatcctcagaaattgagataataaatgcttgtttctttaagatacaaagacttgtgctaataagctatgcagtagtagatagttaacacagtcttctctttcctggtttatcacatttgtgccaaatattctctttgctcaaactcaagcccctacttctaaaaatacaaaacattgcatctcttctctgaatctttcttgaggcaggttcttaaatttctatacctccatatgcacacaaaacacatattcctcctgacatctttctatctttcagaaccgttgctggtgaaaagagtgaaggtcctctgcgtacttttttcctgaattctcatggacctctctgccttttccaaataagggcaatctcctttccttgagtcattgttttcccacaaatcttctacttgactgaagtgttcagggcacataggatgacttcaatatgcctgaatttacaaaagacctttatcttgttttttatttttgattctattacagtatctgaggaaaggagtcaagagattgcctttctgtgttatatgaattgagagaaagttctgttacacacacataaattaataatttaatttttcacctcaaatcttttcttaaaaccaactaactataattttctaattacagaacaacttcttacatcagaaaatggctctacatttctactcagaactctctcagtttaggactaatcttactaactcattaaaagcttactaattcattattaaaatgctctggtttccctttttataagttgttcattacagtccatgtccaaatggaatggacctttctttgtaattctttacacactgtcttaggccagttgggctgctataacaaaaatggcatatactggatggtttataagaaacacatatttatttctcacagttctgaaggatgagaagtcaaagactgaggcactggcagattcagtgtctgggagcacccatttctcatagatgacatcttcttactgcacacttacatggtgaaagggtctagttaattctctgtgttctcttttataggggcactaatcacagtcatgaggatttgacccttatgacctaatatccacccaaagtcttcacctcctattatcatcacactgggggttcaaatttcagaatatgaatttggtggcgggggcacaaatgtgttatgggggacagaccataacacatatatctgtaattgttttattttttcagaaagtgatcgtattatttctgtgacatgttatgccagaaaataatactacctttacgcttgaatcacaatgtagctatcaaatataccttttcctataaaactccattacatagcatttaatatttaaaagtgatatttgaggcaaattattgcctcacagcttaatcctttcattccacattcaaagcatctcccatgattgtcctcatacaacaacaatctgtctgtgcacaagtggattaattcttatctattttatactttaaacacttacacttctaagtgttctctacatacttccgattagactgcaattacttctgcaccaacctaatacaaaataacttgtttttttttaattttgatcccacaggccttaatttgtatcaatcacttttaataaaagtgaggttaagtaatattttttgagtctctacaatttatttagtggcatatacactgcagatctcattctcttatctttcacattagtgatgcagttatatattagaacaggaccttattaagataataatgaagatatttttcactgctccagtggtcacgattggattttcatcattcagatacctaagaacagtggtccacagcctttttggcaccagggaccagctttgtggaagacaatttttccacagatggggcacggagtacagtttggggatgaaactgttccacctcagatcaacaggaattatattctcataaggagcacccaacctagatacctcacatgcatggttcacaatagggttcatgctcctgtgagactctgatgccaccactgatctaagaggagacagagctcaggcagtaatgcttgctccccactgctcacctccggctttgcggccccattcctaacaggccatggactggtacaggtccctggcccaggggttggggaccgctgcctaagaacataaatatggaaatatttttgctcaaatgcacctaaccttcagatggctaaaaaccttttagcacccggggtgtaggattgagagtggagattactggctgagagaaacagcaaaaaacattcctcccattgaaattaaatcactctacaattgggtttaattgctggacctacctggtaactaacaaaaatactaaacataattgattgcctcatcatttgaaaacaagaggtcactgaatcaaataaatggtaggaaaatttagaaccaataaaacaaaacattttggataaaagttatttctctcttagacctgttgccatgagagtcccataaatgaaccagatttatagttagcagactttctcagtcacttataaataatgaccactgacacataaaatgcattcacaagtagatgcttagattaccacaaaggccttaagacctaaaacatcaataatgtaatgagctttgttttttgctacagacaaacaaaaaatacaccctgcaattttataaaaaattcaggattaaagatttatgtacgcttatgactcaaatgtaaccattattgtaagaatgcatggtaagcatgacattgtttcactagtcttgctacatcttaaaattaattcgttcattcatctgtccatccagaaaggatgttactatgatatacagcttctaaatggcccccaaccaatccccaaatcttgtcattgtggaatcccttcctcttgagcatggactagaccatgtaactcacttcaaatgaatgcaatatgaaaaaagagatgttacttccaagactgattataaagggattgtgactttttctctactaggccctattttactctctctcttttttctttttctctccctttctctctttctgtctgtctctctctctgttcatctgtctctcactctttctctctgtcaaaaccctgattctaaggaaaacaggaaggtatgttttagtgaattctcataattttattttggcccagcatccattttgaatataaatctaactttctcatactagaagcaggactcagtcacacttgacagtttccagttctttaaccacatccaccctcagttcccaaatgtgattggtccacatatttgcctgatacaactgctccctggtgaccacttctacttccctatgggacagctagacatagcctacctgactgaccccactgaccctcagacctcacatggactgtacagatatgtcacagtgactacctgtcagtcacagcactacgtcctggaactctaaaacttatgtttgcttgctttaaacccaccacttagaactccctgtgggtaacctatttagataaggtcctggatccaataaaggcattggctgatagggttctctctctctctctctctctctctctctctctctctctctctctctctctctctctcctctctctctctctctctccctccctccctccacactccctgatctcttcgagtggcctccagcatgcagtgtaaatctcaagacctctaagtaataaaatttttattttcatcttgtgtcttgccaaatcgttgaaagaatactctctatcttaaggatcctaaattaaaatacatgctataaacagccctacagagagaggcacatgtgccaaaaagcttatctttctggctaactgccagtaacaaccggagggcagccaacagccaaacaagtgaccttataagagaattccacccccagtggagactttaaataatcacaaccctggcaaagaccttaactgtagctttatgagaattctgaatcacaggtgcacagctaaatagtgcctggattcttaattcagacaaattgtgatataacaaatgcttgttgaataagttcttaagattgggggttattttttatgaaacaatacataaataaagcagttaagtattaatacatagactctataatcaaatgacctgtgatgaatttctggctccataattcttagcttctttatcttagtcaatttatacattttttatatatcaatgtccttgtttataaagcaggtataataatagtacctctcacatcaagttctttcaagtttaaaacccaaatgtacatacagagatcttagagcagtgcctgattcacagtaggcacttaaattttagctactgaagctcatttatttgaacaataatattaagactataaaaagttactaatacactttgcgaaattgagcaggtgacataatcaccttgggtctcggtattctttcattcattcaaaaatatttaataagcaccaattctgcatcaacctgcgtatatatttataataagagggagagaaagcaacaggaataatagtgctgccactaagtgaaagaggaagactgcaggagaaacagatttcagggagaatatacggggcagtcaaataccaagagtgaagttgtatgagctgtcaatgcttgtgcagttaatatgttatcattatctaaggagcattatctaaggagcagtcattctcaaacatttatgagcatctgatatagggcccaagaagttgcatttcaacaaaatgacaaataatactacagctgctgctccaggaatcacactacagtccattaatgtggaatatgttaaaacaataaaaaaagtgagtttgattattattatcatttataataatcggggaaaaaatgcttgtccccctaaatgtaaaaccgttcttggtttaattgagaaataattgctatggttgctgtggaatttagtaaattttataagtataaaatataaccttccaatcaacacatttttcctacataaatttaataaacattgcattgcacgtggaaattaataagtggaaatcttagttacactgtcagttccaaaataaacagacttagcttaaacatttgtttcaggtttaagttactagcgacatagaagttatccctatctatttaatgttgtgcaatgttaattaaaattgtatttaaaaattttttttcaaaggtttattcctactatgtattgactttgtattggaggccgtattaaatttccatatttgctcttacatttttaatatctttcttaggattttctacataaatagtcatttgtaaacaaatgtgttacgctcctttatttccaatcagtatatttttaaacgttttttcttgcttaaatatattagctacggtctctagtagaatgttaattggaagtactgaaggcaaatgtattttcgttcttcaaaaattaggaaggaataatcaattttctaccattatgtatgatccttactgtggaatttttatagatagcctttataaagctatttatatttttctgaaaatatttataacgaataaatttttaattttgtcaaaagctttttctgcacttcttaagatgaccatagatttttttaaattatagcaatgtggagaaaataccttaattgattttgaatgctaaaccaatatttcattcctggaataaaatcttttttatgttgccagatttgatcgttaaacttctataaaaaaatctttgcattatgtttaaggggtactcctctgtatttttaaagttttgacataatatggtctacaatgatgaattcctaaaatgagttttaggtattttccactaattttttggaaaaattttgtgtaaaagtattattttttcttgaaatattttatataatttaccaatgaaggtaattagcccaggatttttcttttttggaagatttttatttattaatttaatttatttaacagacatggtgttattctggttttatgtttcttcagttatactgtagtttatattatttaaagcctttgcacatttcatcaagaatgtcaaatttgacaaagatttattgacactttttcctttttattgttgtaatacttgtagtagagggtagcaaacttttcttctgtaagaggccagattggaaatattttaggcttctcagttagtgtagtctctgacataactcttcaaatctgttgtaatgtgaaagtagccatagagaacacaaaaataaacggatgtggctatgttctagtacaattttttttttcacaaaaacaggctataggcaatacttggttttgagaacttaatatgctgattctaatttagagatatctagatgtataaataggatcaactacaatgtgccctgttgtattacagatattgtcaatttgtgttttttcttttttcctcatccgattgtctagtggcttttccttttcatttatctatccaaagagcaaaattttggtttgatacattttctctatctatttttttggatataactttcttttctaaaagtttgggtgaatatttaaggcatgcgttttaaaccttccttcttttctaatacaagcactcaagatttataatttttctaagcatatagaaggaatttgtaccccacacgttttaataagatatttaaaaatctttttcagtttgaaatattttctaaatatccttctgacttcctctttgattagttagttatgtaaaagtgtgtttcttatttttcaaattgttctgaaattttccagatatatttttgttattggtttctatttaaattcctggtaatgagaaaccaaactctatataacttcaaatctttgatatttcctgagacttttaaaagaatcactcaacatatgttccatctcattaaatgatccatgtatgcttgaaaaaaatgtttatctattgcaccaccataattcagcctggacgacagagcaaaattctgtctccaaaaaaaaaaaaaacaaacccttgatcttatcctttttgagtatagtttttataaatatctgttaggttataaagttgtttaaatcagttttgtctttatttttgtctattatatcaattactgagaaatagatgttaaaaatctctaaatatatttatgagtttctgcatcatggattctgaatatctttattggttttgtcttcattggcattgtcatatcttttaaacaaatttactatttttaaattatgaagcactactttaagacggtgagtggcagcactcaccgtcttaaagtgtattttgtcggatattaatgtgaagacattagctttctataagtggtgtttgcatagtgcatcttaaattttaattttaactataaagtgaatattttatgatcagcatataattgtcttatcatcctgataagctctcattttaattggattgtttggtatctttatattttgtgtgatttgttatatgttttctattatgcctaccatattgttatttgacttccactgttttctggttcataacttttctaaaaggaagtcagtaataattcataatgctgttttctttatttaatgtcatatttttctagctgcttatacgattttttcaacataccttaaatgttccattatattatatgtgcttgaggttctctaaacttattatgtctataaattaatatcttttagcatatttggaaatttttgcctttttaagtcttctaaaaaaaagtcatcaaatatgttgttattccacaaatatctcttctctttctctaggatatcaagtacactgctcttaaattgatatgataaacctcttaaacccttaaaatgatatgataaacttcttgatatagtcccacagatcacaaagattcatcatttttctccctaatggtccctctatgctcttaaatcagatatttctattaatttgtctttacatttgctgactcttgtttctatcatgtttattatgacaatcagttcattcagtatttgtttttaattttagaaattttgttttttaaatataatttgcttttggtttaaaaaatcttattttggctaaattatatattttcatttattatgaacatgttttcatttatgtcatttatcattactatagtagctactttataattttttctgttaagccaatatttaattcatctcaatgtatattgcagttgattgcccctattttttgcaatgtaggtctgctatggtctagatatttatgattcccaaaactcatatgttgcaattctaaccccagggtgatagtattaggaggtgggaccttggcatgtgattaggtcatgataatggagccctaaagaatgggattgctctgcctgtaaaggagacctcagggagatttcttgctccttcacccagtgaagtcgcagaaataaaatttagctctgaaccaaaagcaggccttctccagatactgattctgctggtatgatgacattggacttcctagcctttagatatgtgagaaagacatttcttttgtttataagctacccagttgatggtcttttgctatagcaacacaaatggactaagatagggttatatgtgtttttaaaatcacacatagcctaactatgaaagaatgaaaaaatatatattcagtaaacaaaaacagccagaatggccataatgatatcagacaaaaaagactttaagccaaaacatgtcacaagagacaagaagaacattatataatgataaatgggccaattcacaagaaagatataactattataaatatacatgcatccaacatcagagcacaaaaatatataaagcaaacattgataaaactaaaaaaagaaatagcaagacaacagtagtagcatatttcaatattccattcttaataatggataaaacaactagacagaaaaacaaaaaagtaacatttaacttgaacaaaactctagatcaaattaaccaaagacacatatagagaacatgccacccaacaacagcagaatacacattcttttcaaatgcacatagaacattatttagaatatatcacatttggcaacaaaatatgttttaacacatttaagaagatagtaatcataccaagtaaattttctaatacatatggaatgaaactagagattgatagcagaagaaagactggaagattcacaaatacgttgcaattgacaacacattcttgaacaaccagagtcaaaaataaatccaatgggaaattaaaaaacatcttgagaccaactaaaactgaaacacaattcaccaaaacttatgagatgcagcaaaagtagtagtaagagaaatgtttatggtaataaatctctatgttaaaaacgaagagagttatcaaaccagtaacctaactttacacctcaaggacccagaaaaacaaaataagtccaagacaaatgaagaaggaaatattaaagcttagtatagcaataaataaaatagagacaaataaaatgataaaaaaatgaaaattagttttttttaaaagaccaacaaaattgacaaacctttggctagactaaaaaaaatagataaggctcaaatgaataaaagcagagttgaaagagaagacataattgatgccacagaaataaaaaatgacagtaagagactgctatgaaaaattatatgccaacaaattgagtaaccgaaaaagaaaatggaataaaattctgaagcaaaaaacctaccatttgtaatagcattaaaacctgaaatataagaaaccagatttatcaaaatatgtgcaagatatttacattaaaaactacacaatattgctcatagatattaaagaagaccaaagtaaatagagaccatgctccttggttgaaacagaatattcttaatattccaattctccccaaaatgatctatagagctaaggcaatcccaatcaaaatctaagctggctttaaaatagaaactgaaaagccattaagaagttcttgtgagtgtggctggttggtctagggctatgattctcacttagggtgcaaaaggtcctgggttcaaatcccagaggagcccaacttttagttcaaaagttcttgtgaaaacaaaaataatctagccaaaaatattcttgaaagaggaagaaatttggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaagaaagaggaagaaatttgaagatatacacagtctgcagccagacacaaaaaaattacatattggatttttcctttttatgaaatgtccagaaaagagaaatatataaagaatacataggcctgtgatttcctggtctgggagtagaaaggatactgactgtaaataggcattaaggtatttgtttaaagtgaagaaagtactctaaaactggattgtagttatcattgtgtaacaaatatttgtgaaaacaattgagctgtttgcttataataggtgaattttatagtatttacattatacatttataaaactttttaaagtatttttaataaagctgtgtcattaaaaagaccaataatctgccattcctaacatgtttagtaaaaaaacatgaaacacgcagcataaggattttaaaaagatacttttttgccaggttaattattttattttaaaagcgaagactatttttttcaaattaagttagagaatcacccaacattataattctctgggaaaatgtgaagttgtgacttataagtaaaaaaacctgaagaccatgactccagaaaaagaaaatctaatgcaaagaaattctccttactccaaattttgagtcccacacattttaaagattttttttcaaatccttttatattaactaatttatgatacttaatgggtcccagattatataaaaattcttattctatttgattccaaaatctgatggagcacagaaaacaaccaccacaatatcgatgagaagaaaacacaacaagatgttatttaggaatatcgggggaaactttattacaaagctgggaaattgaattcattttatattaagaatttaataagctcttctgaagatgaattcatttcatgaacatttcagcttataaatataaatacaattattctgtgaatggtacagagtgaaaaatttaatgattgtcttgatagtgatttaaaaattatataaaagtatataaacatctctatatatacgtataccacacaagcgttgagttgattttactgtgaggcatccacattaacatttaaaattcaaaaaacaattttttcaggcatataaatggtttaacatttgtttccggaaattctaacaagtgaaacttgacaagaaaacaaaaataagtgttgtgattattgaaagaaaatcaacatatacttctatttgctggtgatatgattattctattgaaaagaactgttcacgtttaaatgaatagcattaatgtgatacgcacaaaatagtaagcttatggcacagaacttttttgagaggccaatgtagaaaacaaattgttattaccctgatgatatttttataagagaaaacccactaatgtgttgattgaacagaatttctatcaaaatctcaatatacattttgatttaataattcaaaaaatatttacaaatactcaattagaggagataaaaatagattattcactgaatgaatgactttgatgcaactttctaacgattcagggaaatttaaagttagattcctcccccacatttactgaaaactaaatttatttcatagcaagtatatatatatatgtggtaagagaattattacaaatatagaatattatatgtaaatatgtataaaagtttggctggagaagaactgcctagttgtgacactaaaagtggagacaatttaggaacctatttaaatatgtaacaattaatattaaaaagcaaataattttttaaaaattataataaatgcaaataaaaagcattactatttcataaagagctcttacaagtcaataaaaatttaaccggtagaaaaatggataaaagttcactgaaagtaatctctaaaataaataatttgaataattaataagcatctaaagaagcattgcacatcaatacattgtcaaattaatacattttttaaaatgacaagctgtcacatttttctgttcaataatcaaaactaaaaatatgttgcaatatccagcagtgactacaatgaactgatataggcactatcctacatatttttaagaaataaaaactcgcaaattttctggatgtctacttgctaacttttaaaaacatttagcaaatggaatgtgcatttgttttactaaactattcctttcaatgaattaatcctaaataaataataaaagtatgacacagttacagggatctttataagttatgtttataggagcaaaaattagaactatacaagatgctaaccctctattaaagagtcatatttcctccatacaatggagaactgtgagcccattaaaacctgataatgtcatgatctctaatacatagtcaagtgtaaaaataggtagcaaatcaaaattatcttctctcaatgtacatctgtgcaagtctgtatatgctcacatgtgtgtgcataaatcagtatttcatattaatataaaatatctaggtgaaccacatgttgaccgtggctttgcattgggtttatttttatttttgtgtgtgttgttacaatagaatttgtataacaagaaagaaaaaagtaaatatgttaaagttaaaatatctacaaagtacaagaaatatgaattaaggaaaagtagagaaatggaatcctgagtcttataaagaataacaagaataatatctattgtgacccaaacttaaaaatttccctcttttgaccaatttctcaccctgtgtgttattagtcttcttttgatatctacctctaatttatgttggattaactgaggtaaagacacagacacatttctctgtgtcatttgtattctggcacctctctctatttggctcaacattagactgtcattttcattttctcaggtaattagtgataaccgtgtaccaaatattaaatatataattcatgacaattacagaacaatttcctggggatacaaaatatctgaaatataatttaccctctctgagtgttgccagttgaataaaagagtttaaagttattatgttgccttggctatgtccttatttctgtcttgcaatgcaattcacttttggattcttgcctgtattcctccaacagatcaagcaacacctaactaatagcgtaagaatctggccctctaattcaattcttgtacattttctggaaattaaacttgagaaattgacttctattgtagacttgatcttagattactgtccatgatctctggagtttttactcttgccactgggatcctaaatttgtccccttcctagtctatcagaaaagtacacccagcacattggggaataataacaattaattaaagacagaggataaagcctattgagacataatacttcctctatattaatgacttgggaaatgtatttttatgtaatcaacagaagcattgagtctctattacctaaattatctttatttgattagagacattactaagaaccttaagctttgtaataattgaacccaatattttcaatatgtgaaaagtgactttagtccttgaatattatttatttttgttatggctacacaaatgtatgcccaaactgtattctaacagatattgtggtaattatttgataacaattacaaattgaatggttttcatttaggaattttaaagccagttggagtgaaaatgtcctcatcttctctgggacaggtaaggaagtaaccagtaagtttgaaaaatatttggaaagttacatttaatttcgtaatcagtgtattatttcctttatgtttagcaaaatttgttggttcttgtaataagtttggggtcttcccccaactgcataaagatacataaattgggatttttgctgactcaagaaaccttagccaaatttcattgatatttcttcaccattcctctattaacaaagtttaaaaaaagataagaaatatgaactcaaagtatacttttatgattactattttttaaaatcacctatttttgtgactgctttattgaaacactgaatcacttcatgtatctgcctagtgactcaaaaagtgttattacaattcactttaaatgaaagtgccactcacaatcttgataattaatgcaggtaaccggctgtgtgagaaagttaacatcagccttaacctcatgcactgaactgtttttcacatgtcagataggcatttcattttgaggaaagccatgtttttgttccttttgtggttggaatttataattaattatacaacatggagatgctgtattttaattataaaacattttaatgtggaacacatgagacctaggatacagaatgtagcaatcaagttgtacaacaaataatcaaacctctaattatgaaagctacagtggttcctgaaatctaaaagcaaaagtcacaggatggtttatttaacaatagaatttattatattttatatcttcttcaaagcttactttgtttttcctcttataggaaatcctttttacctacatagaaaagttacgttattggaatttacatccctcctccataagaaaaaagacatcttctcttccaaatgtccaccatgctaattttatctctttcttattatatttaactttaaaaatcttgatcattataattgctgtgggtcgtatattcactgtgaatattctgtgagagatgacagttttattcttaataacctgcatattaagaatcgccatgcctttttcatggttagtgttcaatccacatgttaaaagaatgaaaaatgcattactgaattatcttatattacccttttttgcagaatcattctttgtagtgttagtgaaatatgccgaatattaaaataggaaccaaactttttataaaatgctgcctctgctgtctcacaatgcctaatgctacctctaaacgatagttattattcttttctgtcatataaagaaacatagtcatgccaattggttttttgccactatatatccagtgggaatcacacagagaatcaattcattacaatgataaattacaccattaaatagtatattatgccagaataatctagaaggtcatgaaagaaagattaagagatgacaagagaatctacaatgtgtaagaaagtgcatgatacatgaaaaaataggttttggtttgatatctaccaaatatgttaaatgaatatataaccctgtaaaaattgaaaaattacatacttgtaaaatcagaataaaacttgagatactcatcttttgtataacttacatgaaattgtaccaagtgatgactttttaaatacagttctagttatttcatatttctactcaagtaatgtggtttgctccataggagttatttgaaaataaacctcttttcaaatgctcaaatctattattgttctgtcagttgtgcaactcataaatactctttcctattctcttcaaaacacagaagtaatattaaaatcagtgggaaatattcttagacaagtcattgatacaaaatattaaacatatataaaaagtaaactttaatattcaccatgtatgttattattttatattcaattttataatttgttaacacacaaaagtattatgtcctgaccatatcacactatcaccgcgggaggaagggtgagtgggtagaaatacctgttattggtttttaagtagatcatagccaaagctagagtagcacctggacaagtcacatccacatttatggtatctccttcctattgaaagaagagtttatgcatgtaaaagagttctaaattattataaaattcctctgaataataactatgcttaaaattaacacatttaccaatgtcagtatgaacactagtattttccaattaacttcccagcttccagacttttgatctattactttgctgtgtacttactttgatttgataacttggtgatttatgtttctccctatgcattcctgtttgaaagcgcctacgtcctccaaccatgtactgatagagctgctcaggcacattgagatcagacatacctatcaaattgctgccatgctggaaaagacaataacagacgagtgaaaagaaattttatgaaggaagatccacaacacatacccataacaaatataaaaatgaactaacttcaaagcaggttattttgggttttgttttttttatttccaatttaaagcaaacattaatcatgagttaataaatattaataattctcataaaagttttaatacatgaatgttcaactttaagtactgtcttaaaatacataagagctttagagttagtgacatttaacaataaagaaaaatattagttatataattgaaactggaactgtaaatacctgaatactgtcattattgtacttaagaacttttccaacaataactatgataataatagtaatttattaaatgcatgctctgtgtcaggcactattctgtgtgtttaacatgaatgaacagccatatcaaatagctactattaaaaccctattttataaataaggaaagtgtggcacagagggattaagcccaaggttatacagctattatagttaagttgcagggctatatataaaacacggccatctggctcaacaatccatgaagctgattaagcaatacacaataatgtagttaaatgacttgactcactagttaggaccagaattcaagttgcaattccctgtgtgattcttttcttttttttttttttttttgagacggagtctcgccttcttgcccaggctggagtgcagtggcacgatctcgactctctgcaagctccgcctcctgggttcacaccattctcctgcctcagcatcctgagtagctgggactacaagcacccaccaccatgcccagctaatttttttgtatttttagtagagacggggtttcaccgtgttagccaggatggtctggatctcctgacctcgtgatccgcccatctcagcctcccaaagtgctgggattacaggcatgagccaccacacccagctgattattttccattataccaccagcctctttagctcacgtgccaatgtgaattcaaggccctaacagatggtcaaccacaaggtggattttcagaacacacatgaaaaaaattccttccactataactttttttttttttaagatggagtctcactcttgttgcccaggctggagtgcaatggtgtgatctcgattcaccacaacctccgcctcctgggttcaagcgattgtcctgcctcagcctcccgagtagctgggattacaggcatgcgccaccacacctggctaattttgtatttttagtagagatggggtttctccatgttggtcaggttggtcttgaacccccaatctcaggtgatccgatcacctcggccttataactttctttatatcatttagtttgaccataagaatgtattggtggtttttcaaggggaaccacatttcaagtgaaacaatcatttaatgaaacatttctggtaattctgtacacatctcttggatggagttaaagatgggtcaatctgatactgcattttgtcacaaggaagatgctactgggacaacattctgggatacacagtgaacatcactatggcaaaagggggttagggtttgtttcaagcagctactatagactcttaaggctcccgatcatatacgttttcactattctctgttttcagtcatagtgggctgtcacttattcattctatgtcttgaacgctttaaaaaaaaaaaactttattcccttcagtttgttcatgaacactgcaagctggaggaaaagaaatcttaaagtcccactcttgaccacagtttctctcaatttgcaaatctggtactttgaaaaatatccaaaaagacaatagagctgggcagcagattaagtcatagtaagggacaatattcaggtttaggtgtcaacgttatttgtctcaacatgtagatgtcctaactgaagcatgggaaggcataggctatgcttacccccaagcagaccatgcccagggccaagccagcagctaaggagtatgactctctgtcagtgcagtattccatttcaggaccaggaggccgtcctgtaaaaacaaaagcaacacagttcaaactagcttctcaaaatctcatctcataaaaatcttagagttaactttctagcaagttgcactggagatacgaatgggatataactattcagaaagttatgacactataataaatggtgtccacaactgtaggtttacctaccaaaaaaaaagggcccaaaatagttctttttaaattgccaatttaagtctttataagcaatgatattcaaatactgtgaaactttgagtcttaccaaaaaaattaccaagtagtagaaaaaaattttaaagggaaaaaggtaagagtattcaaaaaaaaagttttatttttttgttaaaacatctgggccgggtgtgctggctcatgcctgtaatcccagcattttgggaggccgaggcaggtggatcacttgacgtcaggagttggagaccagatggccaacatggtgaaaccctgtctctactaaaaatacaaaaactagccagggtgccaggtgcctgtaatatcagctactggggaggctgaggcaggaaaatcgcttgaacctgggaggcagaggttgcagtgagccaaaatcaggtcgctgcactccagcctgggtgacagagtgagacaccatctcagcaacaacaacaacgaaatatcttacattttgttttcattactttcaaatccacacatcacatgtggtgaaacatgttcgaatgatgataatgaataaggaggtcacttacttatgttgttaagctgttaaatattatgtttagacatttatttcgagtgtatataataatgagccctactatggtagaatttctgtgtactgatcctagaagtctgactggatacaaaattcacacttttaaaagcaccctataactctaacactaccttgttgaaaacgataaaatgtactatgtattaaaacccttccctctgaaaaaatgttcacattcctgaaattttatccctataggaaaaaaatgcaatttaaaaaaaaagaaaaaaggctggacgtgctggcccttgcctgtaatcccagcactttgggaggccaaggcaggaggatcacttgaggtcaacgagttcgagaccagcctgtccgacatggagaaatcccatctctactaaaactacaaaaattagccaggcatgctgacagacacccgtaatcccagctacttggtaggctgaggcaggagaattgcttgaacctgggaggcagaggctgcagtgaaccgagatcgccccactccactccagcctgggtgacagagcgagactctgtctctaaataaataaataaataataaaaattaaagaaaaaaatcacacaaaggtaatcagtgtaatgtttatatataacaacaaaggattattagaaacaatctaaaaagttctaaaagttaaaaaaaggcattttacagaccatcgactcaatgaatattacacaaaatttgttttaaaacccatttataacaatgatctataaaaacaatttttaggcggggcacagtggttcatgcctgcaatcccagcactttgggaggctgagacaggcagatcacaaggtcaggagatccagactatcctggctaacaccatgaaaccctgtctctactaaaaatacacaataattagccaggcgtagtggcgggcgcctgtagtcccagctactcggaaggctgaggcaggagaatgacgtgaacccgggaggcggagcttgcaatgagccaagattgcaccactgtactccaggctgggcagcagagcaagactctctcaaaaaaaaaaaatttttttaatgtacattctgacagtaattatataaaaaggcatatacatatgaattaaagatgaaatcttctatatacagtgtgaaagaggtatgccgcagctgtgagactgtgcaatgacaccattagacatcatcatgatatagccaaagaagggtagactactttgcagatgaacatgctttaacaaccagtgttgaatattttcagaataagcgtttttcagatctctgacttatgctaccatgtattgtgatagccaaaacatttcaactttgggaataatttcatttatcattatagtagactaaattatgggtcccaatcttcactggttctctcctaggtttctatcaacaccacgagagaaacacaccctccagcctgggtcccagaatgaggcaggtgaggcagaacggcagcagaacagccggctacacatctacagcctaaagcagagctgcctgggccaatgctatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacaggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatcaacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaaagtccaacaatgatagactggattaagaaaatgtggcacatatacaccatggaatactatgcagccataaaaaatgatgagttcatgtcctttgtagggacatggatgaaattggaaaccatcattctcagtaaactatcgcaaggacaaaaaaccaaacaccgcatattctcactcataggtgggaattgaacaatgagatcgcatggacacaggaaggggaatatcacactctggggactgtggtggggaggggggaggggggagggatagcattgggagatatacctaatgctagatgacgagttagtgggtgcagcgcaccagcatggcacatgtatgcatatgtaactaacctgcacaatgtgcacatgtaccctaaaacttaaagtataattaaaaaaaaaaaatttcaaaaaaaaaaaattttgtctataaaacaggtaacaatttgaatgaagaaaacaaaaatttaatgaatggcataaaaataaatttcaagaaaatgaaaggtgtgtatgatgacttaattaaaagaatgtaaaggaaaaaaaaaaaaaaagattttccagagtagctacttgtctctgccatagaattgttagatagtttactgtaggtggactgtaaataaatgtttgcttagttctaacatttgactgatattgggttgatcctttgagacttggtatattgtggatatgcctaaagtttctttttctaccaaagatgtgttgtaatctatgtcattacagaagtaggagagggaaggaaactaccattaaaatcagtacttaggagcccaggcactgttctagatgtttgcatatattaatatgatttcatttcatctttacagtaacctagaagaaagatatttaaataatgactttccagatcaaaaaatgagttttgatggcttttctcagttttcataattggcagaactgatttccgaatcctttaagttgatcagttgacaggaatgcatttatgatttttatcttttcttttggggttacctttcagtttgactttgaaggatcactttcccctgtcattgcgcccaaaaaagcaaggccttctgagactggatctgatgatgtaagcattattatttcttgctaatataaattaatttatggatattcatactattcttccacttctgtggtattcctatcaattcctctatctttccaacacctttcactttatttattttaatactgaatagcaattattttgaagagtaggatctgttacattttctatggtctttaatgattatccaaaaattaatgtatgtattactgcatgatttcagtttgggtttgtagacattttattatcaactgatcacctgaaatgacagcatttaccttttttatgcagtgttttttaaattaaggttctcaatcgtatcaggttccatggtatattccttttttttttttttttttttgagacggagtatcgctcttgttgcccgggatggagtgcagtggcacgatctgagctcactgcaatctccgcctcccaggttcaagcagttctgtctcagcctcctgaatagctgggattacaggcgcccgccaccatgcctggctaatttttgtagttttggtagagacagggtttcaccatgttggccaggctggtctcgaactcctgacctcaagtgaccttcctgaccttggcgtcccaaagtgctgggattacaggcatgagccactgcacctggcctccatggtattattcttaagtggtccaaatatgtttttttaaattgtggtgtaatttacaaaaatgaaatacatcttgagtttacagtttgatcagttttaatatatgcacactcatgtaacctacactcctataaagacacagaatatttttataactccgtaaaatttccccgtgcggtttttttttttttttttgagacggagtcttgccttattgcccaggctggagtgcagtggcacgatgtcggctcttcacctcctgggttgaagctattctcctgcctcaacctcctgaatagctgggattataggcatgcgccaccacgcctggccaatttttgtatttttagtagagatagggtttcaccatgttggtcaggctggtcttgaactcctgacctcgtgatctgcccacctcggcctcccaaagttctgggattacaggcatgagccactgggcctggcccctcttgctgtttttaatcagctttattctcttcttctagcaatcactgatctgaattctgtcaccatatcttagttatgcctgttctagaacttgatgtaaataaaataatatagtatgtaatctttggtataagatttattcagcataatgcttttgagattcattcatgttgttacagatacccgtagtttgtgcttttttattgctgagtagtatgaatataccatagtttgtttatccatccttcttctgctggtagatatctaggctatttccattttttttttaagtcttatgaataaagcaagctactgccaaaattcactggcaagtctttgtggatatatattttctttttttggggggggggaggacagagtcttgctgtgtcatccaggctggaatgcagtggcacgatctcggctcactgcaacctctgactcctgagttcaggcagttctcatgcctcagcctccccagtagctagaattacaggtatgcgccaccatgcctggctaatttttgtattttcagtagagactggattttgccatgttggccagcctggtctcaaactcctggcctcaataatccacccatgttggcctcccaaagtgctgagattacaggtgtgagccaccatgcctggcccgtggacatacattttcatttctttttttttttttttttttaagagacagggtgtcactcttttgcctacgctggactgcagtgatgctatcgtggttgactgtaatctcgaactcctaggctcaagccatcctcctacctcagcctccaagtggctaggactaccggtatgctccatcatgcctggctaatttttaagtaagaccagttgtctaccaaaaaaatttgaaaattagccaggcatgatggcacataacctgtagtcctagctacttggaggctgagtttggaggatgttaaacactctttcatgtgctcattagctgcttatgtatctttttgtgaagtttctgttcaaatctttatcaacttgtaaattagattttaaaaaatatgtaagctggtgaagttcttacatgttctagacatgaattcttgaccatattttcccttagaatgtggctttaacagtgtctttgatgagcagaattttttattttagttatccaatatatcagttttttattttattttattttatttttgagatggagtctcgctctgttgcccaggctggagtgcagtggcatgatctcagctcactgcaagctccgcctcccaggttcatgccattctcctgcctaagcctccccaatagctgggactaacaggtgcccgccaccacacccagctaatttttttgtattttttttagaagagatggggttccaccgtgttagccaggatggtctcgatctcctgacctcgtgatccacccgcctcggcatcccaaagtgctgggattacaggcatgagccagtgcacccggcccagttttttcttttatggttagttctttctgtatctagtccaataatttttaatttagaataacacactgtattaagccttataaaaacaccagtaaattccaagatctggaaatagcataaaccacattctctgaaccaaatgcagtaaatcacaagtagaaccaaaatagactgaacatttggaaaatgtagtccaatcagtctgaatataaaaatcagttgattattagattatattagtagccctggcatcttatacatgtggaaagatgaatacaccagatgaatgcaggtggaccttccttcttaccaaaacacagttcagtgtagtggccactaacttgccatctacttttcctataaaacctagcctgagataatcttaaattttctctctcaatctctacctaaatagtataattcttctcccaatgtctttcctaaaagggcatgaaaagattttttttaatggtttttaaaggtggcttgccttaacgtttataactggcttgctattttatagttacttcattcttagcattgtcttttttttaacatactcttagatcaacttaatgtgaaaatgaaacttgaattgttttaagtgaattaattttcttatgatattataaggaggtattatttttaaaaattaatattctttttattcttctcaggactgggaatatttactaaattcagactaccaccagagtgttgagtctcatcttttgaacagatctttatgtctgagtccttcagaagcttcacagatgaaggatgaggatttttcacagaatctcagtctggattcttctacacttctctttactcacatacctgcaattttttttgttcttcaccttgtgtatgaggagcttaagttgaatactctaatgggagaaggaatttgttcactcgttgaacttctcgttcagttggcaaggtaaatttgtttgtaggttagaaactgccaggaagtcctgagatgactgtcttttccatgatatcatatagggaccttgtaaatacgtttctgaaatctgccttctcagaaaactaggacatctctgtaaaccacagagttgtttgaagatactggttttgtaagggcctgtgagccatgcagggatttttagtctttgtcctgagattagtggaaggtcacgaaaaaatggagatgacctgctcagattttcattttgacaggatgactgactgactatactgtggtgggagttctagaataacatctgctgttttgtaatatccacattcaaatagtgctttatagttgacaaaatcatagtttacatataaagtctcaaacaaggtaagtttcctattttagtgatgaggaaacttgcctaaatttgtttcctgggatatgagtgtttgatagttgtggactcattttgctatgctatccttgttgcagtctgaggttgtccctgtctttgaggcactcatagtagatccacaataagatagttctaataatacgtttcaacacctttcaagagctttgaagcaccttgtgtatggctcagaattctagggtcatacttgtgtgttgtttgacctttatgacctttggtgataaagaagttgaatttgaattgaaatgtcagcctctgagttaagacatagtacattttctaatttctgttgtcttttttgagatcttgaaattcaatcctgagacatggcagttttaatcaatggtaaatatctcttaggatgtcattactatcatcaaaattattttgtaattaaataatttccaaaccataatcatggctgtctgaaataagtaatgtgtatgatgttttacattttatcaggttttttttttttttacatattttatcttatttactctttaaaacttcagagtaagtgagctgatattgccccatttcctagaagaaaatactgaggtttatagacatgacttatggaagatcacacagctaatgaatagcagaggaggaactagatcatggtgcttttactgtagttttacttccacaaaatttagcaaaaagaggttgggttccatttgtcacactgggcactttaaagtccaaaaatacaatagagagactctagatttggttatctttctcataagtaagtttttaaatttaaagattcaactaattaatccttccaattctgttgggagaaagtgctgtaataccttcttttttgcatgcccttactgttttagggacttaaaattggggccttatgtagatcattactatagagactacccaacgcttgtcagaactactggacaagtgtgcacaattgatccaggtaagtagtcgtgcttttaaatattttctaaacagtgtagtgatatttccttgtatctttctcaatgaatagcagaggatgtatttcttaccattagcttctaagtcaggggcaatgcctttccaccaggcagattttagttcgtagtgcttgttttctgacacgtagtaagccataatatcttcagtgtatagggaaaattttacccatccctaaggttctgacttgcaaaagtcagagaaagagcttccagtgtcaaggatgctttttttttttgagacggagtcttgctctgtcacccaggctggggtgcagtggcgcgatctcggctcactgcaaactctgcctcctgggttcacgccattctcctgcctcagcctcctgagtagctgggactacaggtgcccgccaccacgcctggctaatttttctgtatttttattagagacgaggtttaatcgtgttacataggatggtcttgatctcctgacctcatgatccacccacctcggcctcccaaagtgctgggattacggcgtgagccactgcgccaggccaccaacttagacttgtagagtacagttagtaccactaaccatatgctacttaaattcaattaaaataaaacatatatttcctcagtgtactagccgcattttgagaactcagtagccacatggggctagtgctaccatattggacagtgcagatacagacacagaacatttccatcactactgtactgtcctagaccctgagctaaaggtactgaaatttggggcccagttgttggaacagagctgaatcctggatgtttcttttgtttttttcacctttagggttagggcaaaatttttggttagattcttcttcttctttttttttttttttttttttttttgagacagggtctcactctgtcacccagacgggagtgcagtggtacgatcttggctcactgcatcctctgccttccaggctcaagcgattctcctgcctcagcctcccaagtgcctgggattgcctggggttataggtgtgtgccaccacgcctggctaatttttgtatttttagtagtgatggggtttcaccatgttggccaggctggccttgaactcctgacctcaagtgatccacctgactcagcctcccaaggggctgggattacaggtgttagccaccacatccagcctttggttagattctttatatgccttgggaacaagaatttgctaaatttccatccagggtgggataaaatagaagtcatttaaattctacatttaataacatagttccttatgtgctgtggcagaaaacatgaagcattttggagaatatggaaaaacgttattccttttttttttttttttttttttttgagacagagtctcgctctgtctcttaggcatgatctgggctcactgcaacctccacctcccgggttcaagtgattcttctgcctcagtctcccaagtaggtgggactacgggtgcgcaccaccaggcccagctaatttttttcgtatttttagtagagacggggtttcaccatattggccaggctgttctttaactcctgacctcgtgatccacctgcttgggcctcccaaagtactggggttacaggcgtgagccactgcacccagctggaaaaatattattctagttgtttcaaaatgacaagtaactgttgatcatcttccgtttaaaataaaataatgttgtcttaatgtattttcgtgtctttttgaatatttatctaattttaaaggtcaaacaggatttatgcatcatccatcattttttacgtctgagccaccaagtatttatcagtgggtgagttcttgtctgaagggcgaaggaatgccgccttatccttacctccctggaatctgtgaaagaagcagacttgtagtcttggtatgtatgtggagtgttactacctatctcctttttcttttaaaatttagttttaaaaagtacacctaatattaagtttttctttctgtgtatagttctgtgaatttcagtacatgtatagattcatgtaattactacaatgaggatatagaacatttacatcaccctcaaaaatttctctcatgattttgagactcatccaagttgtttcctgtatcgacagttcattgcattctatggctaattagtagtttattgcatgaatgtgccatagttggtttttcattcaagataattgggttgatttcagttgttagcaattgtaaatatagatgctgtcagcattcatgcttagcgttttatgtgaacataagttttgctttctctaggacaggtacctaggagtaggattgatgggtcatacagttaagtttatattttgtttttaaagaaactgtcatctgttttccagagtggctcttccattttacatttttaccagcaatatttaagagatcatttacctgcattcttgttggtatttggtattgtcactcttttttatttttgtctttctgagagatgtgtagttatacctcattgtggttttaatttgcattttcctaatggctaatgatgttttcagcgttctaggtatgaggttttgtcagatatgtggtttgcagatattttcttgtggtttctaccttgtcttgtctcgtcattctctaaatacatcaaagaacaaaagtgtttaattttgatgaagctagtttatctgtatttttctttaatggatattgctttcagtgtcatgtctaataattctttgtttaacttcaggttttgaagattttctcctgggtttctttgcatgttttacatttagatctctaatccattttgttaatcttttataacatgtcaggttttaagtcaaggtttttattatttcatttggatatccagttctttcagcactgttttttgaaaagactatccttcctctattgcatttgcacttttgtcaaaagttaatttggccacattcttgtgtgtctgtttctggactttctattctgtttcattgatctttgtggctgtctacgctgtcattactgtagctttatagtaagtctttaaaattgattagcgttactcctcccttcattactcttcttgccttttcatattgattttatttttatttttatttttgagacagagtctcactctgttgcctaggctagagtgcagtggagtgatctcagctcactgcaacctccaccttctgggttcaggcgattctcctgcctcagcctcccaaatagctgggattacaggatcccaccaccacgcccggctaattttttgtatttttagtagagacgggatttcaccatattggccaggctggtcttgaactttcaacctcaagtgatccgcctggctcagcctcccaaagtgctgggattaccggtgtgagccaccgcgcccgtcccctactgattttataatccgcttgtctatagctacaaagaaaaatcttgctgaaatttttttcaaagaaacacttctttatttatttttattattttttatttacctctagctgcaaatctcatgatttatttatttttagaaattagtttgttattactggttaatacatgtccaagatcaaaccttcatatagaaccatagggctgtaacggtgaatgaggtaagtttcttggcatacctgttcctcagtccccccatcctggagcagcctgctcataggccccttgtgggccttttcaggtggggtcttcccaggcttgcaggagaaccatatgcttttgtcccttctctcaaatgttggcagactgcaaatgtcttttcctcctgcccttctttttctttactttacgttttgctccgcttcatggtgagaagtgcttcagagtccccccatggctccaaaacagacatacagaatgaagattctgtttaaaaaacacagatttttttaatgatagcaaaatatatataacataatatttgtcattgaaattgttattattattatttcttgagatggagtcactctgttgcccaggctggagtgcagtggcacgatctcggctcactgcaacctccgccacctaggttcaagcgattctcctgcctcagcctcccgagtagctgggattacaggcatgagtcaccaagtctggctaatttttgtatttttagtagagatggggttcaccatgttggccaggctggtcttgaactcctgacatcaagtgatctgcccaccttggcctcccaaagtgcaggggttacaggcgtgagccactgcgcccggcctgaagttatttttgagtgtacaatccagtggcattgaatacgttcacattgttatgttgccatcaccactgtccgtacccaagacttcttcatcatccccaacataaactctgtacctattagagtgactccccattccccttccttccaggccctggtaattccgttctctttcttatgaatttgtctcttgtaagtacctcatattatgggaatcaagcaatatttatctctgtgtctggcttatttcacttagcataatgtttccaatgttcacccatattgtagcatgtatcaaaattacattgttttaaaggcagtattctatatagtattccattgtatggatataccacaatttatcatttcacctgatgatggacatttgggttgtttccaccttttgactgtggaatagtgctgctgtgaaccatgggtatgcaaatatctgttcaagtctctgctttcagttctttttaatatatacctggtggtggaattgttgggtcatatggtaggtaattcgatgtttaactttttgagaaactgctaaactcattttcatagtggctataccattttacatccttatcagcaatgcaagaggaagggttccaatttctccacagtcttgccaacacatattattattttctatttgtttttttaaaaattatagccatcctagtatttatgaagtgatatctcattgttttgatttgcctccttaatgattagtgatattgagcatattttcatgtgtttattggccatttacgtatcttctttgaagaaatatctatgcagatcttttgtgtatttgaaaattggatttttatttttgagtttaggcatttttatgctctagatattaatgtgtcagatacatgatttgcaaatattttctcccattctataggtttttctgtgaatgtcttttcagtaaaactggcatgagtgctcagtttacctctctggcctttcatcttagttttatcctcttggtattcctttataacttgtcagctcagagatctatttataaaaatatgaatttatttttatttataaaaatattctgaaaaatatcaacagaagcccttattgataggtttttggtttcgtcattataagttttattggactttttttattttttattttttttatttgagacaaggtcttactctgtcacccaggctggtgtgcagtggtgcaatcatggctcactgcagcctcaacctcccggggctcaagcagtccttccacctcagcctcctgagtagctgggaccacaggtgcacaccatcacacccggctaatttttgtatttttagtagagatggggttttgccatgttgcccaggttggtcttgaactcctgaccgcaagtgataaattttttttatgtgatgttagctaatgagacatttgtagtaaccttctagcttatggtggctctttttctattgactcacttgtatatgcggagatggcattgtctgtgtaccatttgttgaaatgagggaaaggaaggaagtgagataacatttattgggagcctgttgtcttcaaggaacttcatgtatgttttctcatttaatacagagatcttatgtacttttgtgtttgtgttatatgttgaatattttaactcttttgagagactttttccttggtcttatctttttcttttcctcctcaaagcaaataccactacagctctgtactactagatacttcttagatagtgagagagcactattcgatacctgttggaatgactgaaaataacttttggtgaggatatggagcaaccgaaactctcatacattactggtgggactgcaaaagtggcacagcactttggaaaactgtttggcagtttcttgtgaagttaaacatacacttatataagacaaattccaactgcttggtatttacttaagagaaatgaaaacatatgcctacataaagacccgcatgtatgtgaatgtctttggggccaggcgcggtggcataatctcagcactttgggagaccgaggagggcggatcacgaggtcaggagatcgagaccaacctggccaacatggtgaaaccctgtctctactaaaaatacaaaaattagctgggcgtggtggcgcatgcctgtaatcccagccactctggaggctgaggtgggagaatcgcttgaacccaggaggtggaggttgcagtgagccaagattgtgccactgcactccagcctggcgacatagcgagactccgtctcaaaaaaaataaacaaataaaaaataaagcagctttggtcatagtgaccacaaactggaaccaaatgttcatcagtttttgagtaggtaaacaaagtttggtatgtctgtataatggaatactactcagcatgaaaaggaagaaactagtgatccttggagagacgtgaatgaatctcaaagacgtatgctaagttaaagaagtagcacgaaaaagactacatatcatatgattcattcacatgatattgtaggatagacaaaactgtagagcaagaaaacagatgaattgtttccagtgctgggtgtaggaggaaaggattgactacaaaaggaacgagggaactttttggtatgatgaaagtatactatatgtgagtgtggtagtggttatgtgatataacatttgtcgaaactcacagagctgtacacctaaaatggacgaattattctatgttataattattttctagttacacttcaattatgtagctaggtgtggtggctcatacctataatcccagcagtttgggaggctgaggcagaaggattgctcgaggtcatgagtttgagcccagcctgggcaacacagcgagactctgtctttacaaaaaataaaaataatataaaagaattagctgggcatggtggtgtgtgcttgtagtcctagctactctggagactgaagcaggaagattgcttgagccaaggagtttgaggctgcagtgagctgtgattgtgtcactgcactccatcctgggtgacaaagtgagatgctgtctctggaaagagaaaaataatgttaattttcttcttttgcagagtattgcactgtacatacttggtgatgagagctcggtttctgatgaatcctcacagtatttaaccagaataactgtaggtaagttggtgcaatgttgcctctggaaacaaatttttgtagatgtcagtatcagaattgaaaaaagaattgaatttttcttgtttgctttggcggccatgtcttacctttttagtactgttctggtctgttgcggtctgttgtccacaactaattttcaggtatcaggattacttaaaatctaataaatcttgtattttcagtgcgggtaaaaaggactattttagcctgaaggaaattattgtaccattgactcttgaacaacatgagtttgagttgtgtgggtccacttacaatgaaattcttttcagccaaatgcagatagaaaatgcagtattctctgatgtgaaatccatatgcaggttctgcagggccaattgcaggacttgagcatgcagggatttgggtacacatcgggtgtcctaaccaatcccctgagtattctgagggccttgactgtacttttcagcctgccacagtattgcttattttattatttttttagatgttgtttgctaatggattcttattttcaaatgtcttctacatgttacatgttttctttaccaggatgactatcaaaattaagtttcattttgttgccttttagccccccagaagttgcaagcagaacaagtggaaaacaggtgacttttatttagactgtgcttttatgtcagacacttaaaacaatattatttactgttctgcttaattactttatgttttattctcttataggtttagtttcaggcattctacgtctgtttctagtctagctgaaagattggttggctggatgactaatgtaggtgagagcttctttgttacctgctaactaggccgtgcttcctccagactagctagaagtggaaggcatgaggagagaggggctctggctttgtgaaaaggcctcacaagattgagattatggttcatcaagccatattcttttttctcgacaatctcacaactttcatataataatatgtgggataccagctttttatcttggtgcataaggaatctttatttgccattacattggaacatttgaggctatggctatgtaagctggtctctgagaatggagaactctaatcaccctacatatacacctgaaatcattgtgatactcagatatcagaaatgggtggttttggcaaagtctaaaagcaataatataaacatttcagggtatacttttgaaggataaatgcacttttgaagggatttcaggcaccaagatgaacattgaactgggaagaggaagaggaaggaaaagcgttctatattccctattccccaaacctatgctcctaggttttaaattaagtaaaataccaaagaaattttttttcacaaagaactgaaaaacaaaattaaaaattactgccacgaagacatgattttaaaaatgaggatattatatgggatgtatgttaaaaagtaaagttttaatgaatattaaaagatgtttttgaagtcttatctaaagtatgttctaaatgaagtttctgacaggtttttttttttttttttttgcattttaccttaaaaatgacaataactgttgcgtagtatacatacaggatacctatgctgaaaaatattggattagttctatccatttgtatattgcataatatttaataagtgttattctcatataaggaaacattttttgcctcaatagttaatcgactttttatattataaataatgcatagtattataaaatttagaaaatcatgataagaaaaacatgatttaattaacctgaggataaaaaaatttaaatatgaaatatggtatacttacaaaataatatgtcaaacgtatatgtttagtttagagaatggtactaaagtgagtattgatgtactggtcacccacccctagaaatagaacattacccgcatagtagaaggcccttacatatctgttcttggatggtcccctcctgtcacacaccccaatgttatagtgaaccactgccctacctacatttgtgttaccttactcttgtttttctttatagttttacatctttataaattgctaggttttatgtagttttgaaaatatatagatgtaaatatatgttcctttttcttcactcaactttgttttttaaagattcatccatgtcgactcacgtagcagtagcagtgggtcattcattttctctgatatagagattactttgtttgaacatatcacaatttaattacccattctgttaatgatagacaatcggacttacccctttctccatctctttttttttttccatagcaaaccagtattgctaatgaatatttttatacctgtgtcttggtgtacctgggtgtaagtttctatatggctgttgatggatcaaatgggtggactgacctatacataccaactgttttccaaagtggttgtaccagtttacactaccattggctatggataagaattattgttgctcgggccgggcacggtggctcatgcctgtaatcccagcactttgggaggccaaggcgggtggatcacgaggtcaggagatcaagaccatcctggctaacacggtgaaaccctgtctctactaaaaaaaaactacaaaaaaaattagccgggcatggtggtgggcgcctgtagtcccagctactcgggaagctgaggcaggagaatggcgtgaacccgggaggaggagcttgcagtgagccgagattacaccactgcagtccatcctgggtgacagagcaagactccatttcaaaaaaaaaaaaaaaagaataaaaagaattattatcgctctacatagttgccaacacttggtattgattggctttgacatttacatttctcagtggctttaatttgcattttcctgatcactaattaggtagagcatcttttcatatgcatattgcccatttatgtttccccttctaggaaatgtctttttgtcttttatatttttctattagattgtctttttttcttcaggtttttacaagttctttcaaagagacttcctatactagtccctgatgttaagacattagtctggtagtaagaggaataaaatgaatttatttgtcaggatagatattgttgccaacttcagctaggataattgggacagtggcaagtctaaattaaaatgtttctctcttcctttaaccattaggattcactttaagagatttggaaactcttccctttggaattgctcttcccatcagagatgcaatttatcactgtcgtgagcagcctgcctcagactggccagaagctgtctgtctcttgattggacgtcaggatctttccaagcaggcctgcgaaggaaacttacccaaagggaagtctgtgagtatcaacatagaaagttcagagttccaattttagccttaaataaaatcataaagtagaaatgttcttcattttcctttaaggctttttctaagtatatatattagcttgtcttttatattatatgccagacggggtttgtaattgtatgcgtcttattaattgttaagttgagcataggagcaggagattttgtgaatgttctgtcttgtgcctggatctttctttgccttgaatcaggacaagtcctgagtgtagtcatggaaactaccatggctatttccctacttgtaccatattagtaattaaccacttcgtaattattacataggaaaagggagagcacatatatcctgaatttggatgagtaattatatataaatattttctactgcatatttttcgatgtgttgaattttttgaatttaaccttttaaataggtgtaaacatatttatttaatcacataaaactgcagccccagggaaaaaatgtgtttttttagtagagttgtttaaaaagatgtcttaagctatccctcccgaaatactgtctttcatcaatcatcaagtctgtttttttttttaaatgagttctaggaatcctgcaagtagaaagtaaaattatttcattactctccaattatctttttatatcatcctctcttaaaacttgaaaatgaaacttttaaaacttattctagaattctaggtaactttaaaaaatgaacagtagaatctcatcaaggaggattcaggaataataattccactcctggtgactcttttatgttcatgtccctgagaagacagtgggaatttggtcttacctcttagtagcttttgaatcaatacataataatcagtgcattgtaactatgagtcaccttaggtcttattactacttcttcagagcctatatcaaaacttattcctaacctcagagttgcctaatgtgtacccatgccggagtcagtttccatgggcatctgatctccagcacggtcatcccagcacgtctctcctttaatctgcgcctcaatcacagctcttcgttgaattagtatttacatcctgttttaaacagaaaacaaatctttttgcttataaaatgattttcctgtgagagagagcagttcagcaccattagcattaaaatattaatctgtatttgaatgtcattttaagtaattatgtctaaatacagtttgttcagttgaggctacattttataactaatcccatctaaatttattttgtcactgtttgagactatgttttatagctaactcacccattagaatatagtttttttttttaaattagatattttataggagctaaaaatgaatttttaggaactaaaagtgattatttggtcgtatctacttttttttcaggctgaccttgttggtttcacattaaatgttgcaaaactttaacatttcaacttggagttattcttttgttaaaagagtataatactgtttttgagagaatatgatatgattccacgcaattcacatctgtgttgcagttagatttaattatttggactgggaagccccatattaaagcacatgctgggcttagaacatgatgacaatcaaggaatttaccctcttacttgttttgctgtagttcagtacttttccttctaagaaatttttattggaaacacattttttaaaaatagtgaaaactggctgggtgtggtggcacatgcctgtaatctcagcactttggggtggccaaggcggaggactgcttgagcccaggagtttgagaccagcctaggcaacatagtgagacctcatctctacttaaacaattttttaaaaaatttagccaggtgtggtggtatgtgcctgtagtcctagctatttgggaggctgaggtgggtggatctccttgaggtcaggagttcaagaccagcctggtcaacagggcaagactctgtctctacaaaaaataaaaaaaattatctgggtgggcggtgcacatatgtagtcccagctactcgggaggctaaggttgaaagcctgcttgagcccaagaggtggaggttgcagggagccaggatcacaccactgcactccagcctgagtgacagagtaagaccctgtctcaaaaaaaaaacaaaaaaaaacttactaatggaatccaaccatgatcctgtctatttaaagtagtaaagtaaaaggtatttcattgtgtgacttcccccaacccttggggtatatcctttcaggcttttttccttctccttctattaatgaacagacaatatttaaattagcattattagcagtgactagtattcatattctacttgcaataatttttttttaagaaatgatcaggatgtagttagatttttttttatagtttattcagaatatttctctgttcgtatccagccccttgactgttgccctaaatttaaactctccccgtcatttccaaatatttccaagtaggcaatgtagtacttttgtttgtttgtttgtttggtttgtttggttgtttgagacagaatctcactctgtcacccaggctggagtacagtggcacgatttcggctcactgcaacctctgcctcccgcattcaagtgattctccagcctcagcctccccagtagctgggactacaggtgtgcaccactgcgtctggctaggtaatttttgtatttttagtagagaccgggtttcaccatgttggccaggctggtctggaacccctggcctcgggtgatccacccacctcggcctcccaaagtgctgggattacagagtgtgagccaccacacccagccagcaatatagtactttttagaaagatttgtagattagagtcccagtatacattgcggccccaacccaggcctgctttggaaaacatattttctctgtgctagtatagtcatgacacatcagcctatatatcctcatgttcagcaaatgcacgttaactgcttttgaaattattattataataaatctgttactcaggtgctctcatcagatgttccttcaggtacagaaactgaggagaaagatgatggcatgaatgacatgaatcacgaggtcatgtcattaatatggagtgaagatttaagggtgcaggatgtgcgaaggcttcttcagagtgcgcatcctgtccgtgtcaacgtagtgcagtacccagagctcagtgaccacgagttcatcgaggaaaaggaaaacaggtgaaagaaaacacgtgtactatctcttgtcacgtttcattgttacatttgtgtcttgtttatatttgtttttccttcaagtttttagcatttaaaaccctaaagagatttaaaagatactttcaagtgaaaatatgccctgtgttttaagttttcatccaacttcaacaaaccacgtgtgttagcaaaatgtctttggcttttgaggacgtaattgttgtatttcataccgtcctcctcttgaaatacatataacagtttactctttagaaaaggtgaatgtaaaactattttgcctgatagttaccttaagaatttacaaacaaagaaaacactggacttgtttttctgtgtcttgatcaggaatagattttgaggttagtggggtttttagtgtagtttaaacttatatcagtattttttttttggatatgatagataatactccaaataaaaatagataagcctttcttctgccactcccctgcacaggatacatcccctgatacattgtaagactcacatgcctgtgacattccagagctattctcttgggacacttctattttaaaattctctcctgttcttttatctgcttgtctctatcatctatcattcatctgtcactgttttctagttctctttactttttttatggtactgttttgaggggaaccgtcacccacacttagccacaggctgctgaagatctgaattagttgtgatttccctattaactgtttcctctccacaagtacccagttattagtcacctgtgaataaaaagatggagtgacagaagttgagtttagagcataggatttatgagcatggcctctagagccaggcatggccatgctgtgctgggtgactggttaaattactttacctcttgttgcctcagttgcttcatctgtaaaaataggcatacttcatgggatggtgctgtgtatcaagtgaattatttttacatagcacttagaatactgctcaatacatagtaaagctcagtgcagtcagccattattagtagtagagttcattgattctaagatgcaagttttttcactttttaatatctctgaaatcagatgtgtatttcagtgaacaggtgtcatagtttaactggcagtgctttctctttcttagtttctcatgaaataatgatacatcttatgagtggcatcttatattcaggggatataatattgttctcattataattttgttacttgtgcaaagttgaagtgaattatgtgtaagatttcctctaaaaaaattctatgggttgcaacagactcttggctttgaattttcctgatcccaaattaatgtggcggtcatgttcccagagaatctttaagacagcaaaatttttctctccagttagctagaaaagcagttatgtgtgtccagttaaggagggagtatgcttatgaatagctttgtctgcagagaaaatgttcgtcagttgtcagcctctgaagggatatttctgtgtcttcagatataacttgtataagcgtttcttagttataaatgccttacttccaaaatttctgttagttttttttaagtggatatatggaatgttaagctattttaacagaggaacaagttgaagagtggtatattaatttcacagtagagccgacagaaaccattttaaccttgaacatacctgatacataatggtattagtcctataaacctagccatcatgtaagtgaaaccaatctgtatttcccttggagacaccatgaaatccattcacctctaacatagggaccttgtttcttttcttgtgtacaggccacagaaatggtacttctgaggctgtattggcaaaagggatgggaggaggatcccacatgtactgaggacagctagactgaaattaacacagtgataaaaaccccaaaagtactgtattttcctttgagaaggttagcatccatcggagtggaattttaaatttcttttgtttttttgaatgcctagagagagtcggcttggtttataggccaggtggttttcattcaatgtaaatatgaaacaaaacagaggaaatatgtctctccctaagagtgtaataggaacaagaatattaaaatgaaaataatcatgtttgggtagttcactcacatctgtgtatgaatttactttgagacaacttcatcttacacagtacaccttcttttgaaatacttacagatgatatttcaattgcgctttgctttaaacattttcacatgttggtttttactttaattacagattactccaattgtgtcagcaaactatggctcttcctgtaggacgaggaatgtttacctttttttcgtaccatcctgttccaacagagccattgcctattcctaaattgaatctgactggtatgttaaattctgggctcaatgagaaaggaaagtgattaagtacatgcattaagtgtagttctttaaattagttaaaacaaaagaaatgctccctctatccccagtgattttaaattttcctaatagctgctatagtggttatcaaagctcaaataccatgtcaaactaaaccttgagagaagcagaatatagttcgttactcatttttgctttttaatgaggtgatttcaagatatacaaagtcacttggagaagttcagaaagatataattgataatgatgagactattgaattttaaataatcttgagtataatatgtaaaaatatttagttttaaaatgtcttatgtcatagtttaaacagatgatcattgtataaatcaagaaatgtcctaagcaaaaagagaaaaaatggtcacttgcagtactcccactcttctgcatcactccttttaacattttaatatatatgtttactaagtttatttccacatatttataattttatatttgtttaattatcagaaaatttaaatctattttagatattttttaaaatttacagtgaacatccttttatatctagcaaataaatgtatgtgtttataattatgtgtatgtattgtatacacgtgtttttaatcgatacattcatttttatttgcttcagagtatttcattcagtggatataccatagtttatagaagcagcctggtattgttggaaattacagttttttggtattataaacattgttggggcgtattcgtcctatgtatttaggctaaatgcttagaagtagaactcttaggacagcaagatgaatggttttaaggaacatgtcaaattgcctttctggttggtgcaagtttttatttctgctatgtataactgtagttatagtcttgattacaatgagttttttagtgtatgtccgcctaatgctgatttgaatgtgttctaaaggtgacaattacatagttgaaattatcattgaaactctattatagtatatatggttttgtgaaacctatacaaaatgtatgtgtaatgtatgttgtagtagtgtatagtatatgtagtagtatataatgtataatttaatatatgataaatagtacataatatatgcaaacataattgtacagtattttaaattgcatactttaaaaaatccagagttccactcagatttgtgaacagcttgtgctttgagcagcatgcaggaaatgagattgactaagtgaagaacacattcccatctccatatcatgcttattctgagccctaatctcactgagggacatagtgagcagagttgcttttaatatttaaattgtctcagaggtaaagcacctatggcaaaattttaacaattattgattcttgatggaaggcatggtatatagatgttcattttagtagtctttccaactgtttatatgaaagatttcatataatgagtgcgggttaaaaaggaaatctaatgcaaaattggcaaatgttaaaatgtattcaatctgggtgatttagcactcaagcgatacttgggtgggtttaaaaaatatatacatgcatctttttttctgaatacatttaattgaatttgcatgatttaaaatgtgtttatgacattaatccaacattttattcttttagtcattctggtaggccaaaaagaaaggttatcctcttaatttaggaaagaatattttcttaaatagttgcttaacccacactgatgtggcctgttgtacttttgtatgttgttattctcattgaagaaaatttaccttaccctttgcattttattttctctcgtgtataaatattatgtcttttgcatatgatgaatgaaagtttcagaaagttcactcagttttttcatattgatatgtctgccttttttgagaaagtgcaagtgtaacttatgaacttattactcattgtggtgctaacactagcagttgagttagcttttaggtacaaaaagcatatagtaaagacaaataagtcttactttgtgctttgtgtgtgtatgtgtacatgctacaaataagacactctgcatctacttaaaatttattttacataacatcttagaactctttaaaaatggtacttttaaagctgcagtgaaatggataactttatgcagtaattaaaatatttatgttaattattttatctgtgacttaagacagtattcaaaatatatttaaaaagattcagtgtttgctgtgtataatgtagatcaaaaagaaaagaatcaagaaaaaattcgtagggaacatatagcattgtgaacatataatttacattgttcttaaatggaccataaaagtaaatctagtgaatgcccttttgaagttcactgggtgactcaagtctataaaaggatgctttttacaaaactatctctaagcattttaaacaatagcatataattagatatctatatctgtatgtatatagagagagagaaaaaaaagagagaagggggcatatataggtaagagctgtagcagatttattaaggttcttgtgtctttttttttttttttttttttgagatgcagtctctgtctgctgcccaggtgggagtgcagtggcatgatcttggctcactgcaacctctgcctcccaggttcaaatgattctcatgcctcagcctcccaagtagctgggataggcacgcaccaccaggcctggcttttgtcttttcttaagatgtcatttttccttaatgtccaggggaaaatataggatagaacatttgaaattaacatcaatgtcatcagatgttgggatttataacttgtatagtttaacagtgatgttagtcttcattttggtttctaagctctctactgtttgaaagaaagatttcaaagcagtgattatcccagtcatctctgtataatgttaaattggtatcagttatctcattatatagcctcatacattttagcaaaaaggacaatgaactgtttagacagtgatggtttttccagttccattaagtttgactcacatgtacaaaagttttaagtggtcatagagacctaacattccaggcattatggggttaatggttttgaatgtagaaaatgtaagtaatcttagtctcaaagatctaaatttaacaatcttggttttgtgaatttttattctctcagtgttcttcgtttggctggatagggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttagccaatgagtatgctggctttctcgtggctctgggtttgaatgggtaccttaccaagctggcgactttcaatatccatgactacttgaccaaggtgagacctgtgctcccagtgcctggctttgtgccttgcctggctattgtagtagctcctaattgctctatttgctcttctttcttcattcttgtacttctaagtccatttgtctcatagtacgtggaataatctttctaaagcataaatcagagtatgtcacttctctggtcaaagccatttaattaatgatctcccattgcttttttttttttgagtaaggcagggtagaatttaatgagtgacaggaaagctctcaacagcgagaggggacccgaaggtgggttgccagccacgaggctgagtctagaggtttttatgggcttgaaatgggggaagtgcatgctgattggtctgtgggtatgcttgaaaaagcaccatttagaaataggcacgatagtgtagaggaccaactggggaagggcaggtatatgtaaagtaggtgaaggataaggaccaatcaggagagagcatgccaaacaggaatgagagctctctagtccatggatttatccagaacttgtagcttggttttcaggctttcgactgtccttggcttgaaggttgagtttcatctgagaatttacctgcctcctaccgccatcaatccccgctctgaagaggtatatctaactgctgttcggataggggtgatgactgttctgcttcatgctgacagagggtgttgttttgggaaacagcagtcaggtctctcttagaggcctatctaagtgtcccctggtaaaagagagccatcaaccgaggttccatttgcatgaccacttggagtttgatggcctctaggcgagaaaaaacaaattttacaaggaggttaagtacacatggaccaaatatgagtattacaatgagaacacaaagaggaactaaaagggggaaaatccatgcccatatattagggacacctagaaaggacaggaagaaaacctctgaaaatggactgttctattccaggattttgcaaaatagggttgtcatgggcatgtccccctagattattagatatgttataattaggcattgcaatgcttttaattagatttctgatccataggctgcagaatccagtaatgcctgataatccctttagttagctgagggtcttggggagaaggaaggagaaaatggatccaattctctcctcgcccagtgtcctggtcccttctgacaagaccaggcataggtacttcactgaagtctgacggagttgagccttggactttgaaactttatgtcctctgtcagttagaaaattaagaagagccttattgcttttctgagaaatttcctcagttggggcacagagtagagtgtaatctacatattaagactaacttgagtttgaaagaactcagagagatctttttgagattgcctgcccaaacaggtgggggctgtcttggaatccctgtggtaacaccatccaggttagctgggtagtctggttggagggatccctgaatgcaaacaagttttgggagttggggtataatggtatgcagaaaaaaagcatcttttaattccaagaatgcaaaccatttagttccttcaggtatctaagttaacaaagtatagggattgggaaccactgggtaaattggttaattacaccagttactcattaaggaggtggagatcctggaccagtctccattccctgttgggtttctttctgtacttccaatattaggatattacaaggactgtcgcagggtttaacaaggccctgcatccttaggttattaatgatggcttctagttgtttcctagcttctggttttaggggatattgtctttaattagggaaggagatgagatccctgagatggatttggactggtgagactgttgtagctcagccagtattttcctgaattgcccaaacatctggattaatatcagtctccaccagagggaggcaaagagtctgtcctggagccataaggatggtggttcccatgtgagctaaaatatccctacctcagaggagtcgggctttcaggtatgattaaaaaggcataggtaaacgaaaggtctccctaggtacagctaagggattgagaaaaatatcgagtcagaggctttcctgagacgcccctcacagttgtgctaagggaggaggggaggcccagaatggagaggagaacaggaatggctgctctggtgttgagtaggaagtctgtcctctgagtcctttgacctccagactcacccgggactcctggatggtaatgcagcctgggctgtcagagctggggaggagagccctgggacccatcagtcctgctggaccatttgagaagccggctctgaaccttgggacgtatgtttctggaggcagtttgtcttccagtagtctcccttacagattggacagggccgtgggggctgcttctgatttcgggggcagactctcttttagtgctcccacactgataacagtcggtcatagaatgagaagctccctgggatcgagaggtttatatgcctgtatggcagctattagtgcctctgcctttttctcgttccttttctccctttttcttgggcttcctcatggtcccgattataaaagaccaaggtggtgactttcaggattttctttagagtactgtctggtgcaatagctaactttttgcagcattcttccaatatttggggctgcttgggttataaacttgtctttcaaaattaactatccttttatagagtcaggagagagatgtgtgtttaattaaagcctctctcagttttttccaggaaaacagaagggttctcttcagacccttggtttatggttgataacttaatgtaattgagagatttgcctctagttttcagatcttccactgtgcatccctaaaaatgttttctcggccactttcctagagcagtgtctgagtcccattgaggattattggtggatgctgcctgcttggctgtcagaaagggctccctaatttcttcccccttttggtaggtgccataataagataaacatttcatctccaaatgtctcagtgacctgtaaagccgcctgcttctctgaagctctaagagtctagttgagaagtaacatgatacccttccatgaaagctcagacatttgattaaggttctgaaaggcttcaatatacctatccaggtcgacacaattgtcctagatttctttttatctgcctcaaatcttgtaaagaaaaggggacttgtactttgataggaccatattcactatgcatttcctgtaaaggaagaagtgatgctggagcgcatccaggtcgaactcttctaacaggatgaggttcaaaagggggcctggataagggggacgagatgatccaagaggagctgggacctgggctggtgcaggggcctctgtctcctcttctaaggaggcagactgttttttcccttctgtctggattaagtctggctggatatcactgctataagtgcaaggtctattatacattgctgacagagcttgcggttattctgcagggcaaaaaaggcctatacatatggaattttggaccattttccttctctgtggttgaagagatctagctataggatagtattatagttgttattttccccagctgactaggtctccccatcttccaacttctagctgggccaagccttgctactgataaataccaggtattttttcttcagagtctgaggatcaaaggagtcccaatgtctcgcacttgagaggagtgcaggctacccatttagaaagagagaggggagaaaaaggcatccttagtctttccctctgctgtgctagagtccaaggcgtctctcaggcttgccttggtcgtggatgtgcgcgcagccaccattcatgaccagggggggatcaagccagcaggagtagttgcgttcacttgcactcagccttgaccctccttgtcaactgcctttgatttctctgaattctatatgagctcaagactaagatgaatccgggggggtccctgcatattatttgtctataattctcatctggctggcagtttatttagcttcatcaagcataacccagcatcctgccctgaaaagaagcaatttctcaaagagacacataactaagtaacatttctcagaagagcagtaggaaaaacatgataggaaagattggaagtctttgtccgacacctgaacaggctgttggggactgggggccggtgtagggtccttcggatgtacccttggccagatacctttagttgccccaggaccttattctgatcccacacgatggctgaacttctgtgaagggaaactggtttagaacaaggccaaaattcccaacaccagagggcaaagggggatcgaccattgctcttaatatacattctaggagctggtgtgatcctgttcacttctccagccctaggtggtaccactgttcttcgttttttttttttttttttttttttttttgatgtggagtctcaccctgtcacctaggctggagtgcagtggtgtgatctcgtctcactgcaacctctacctcccaggttcaagcaattctcctgcctcagccttctgagtagctgggattacaggtgcacactaccacacctgcgtaatttttgtatttttgatggaaacagggtttcaccatgttggccaggctggtcttgaactcctgatctcaggtgatctgcccgcttcagcctcccaaagtgctgggattataggcgtgagcctctgcacccagccccactcttcttgctcccccacactctaaccatacagattggctattttagctctctggcaaactaaactctttcacttcacagcgttattttttttttaaggaatctttatttatataaatatataaaattcacataccatacaattcactgtttaaagtgtgtggtacagtggtttttagtacattcacagagttgtgcatccatcaccactgttaattttagaacatcttttcaccccataaaggaaccttgtacccactagtggtgactccccattcctctacctcacccccccaccttcacttcacttcctgccaaccactaatctactttccgtgtctatgggtttgccttttctggacctttcatatgaacggagtcatacaaaatatggtattttaggatgggcttctttcacttagcctgataattttagggttcatccatgttgtaccatctatcagcaatacattcctttttattgttgaataaatgttttattttatgaatgtacattttattcataagttgatgaacatttgggttatttgtactttttagctattacgaataatactgctatgaacatttgtatacatgtttttgtgcggatgtatgttttcattactcaagagtaatgaagtaatggtaagtagtggtacatacttaggagtggaattgctgggttatatggtaactctgttaaactttttgaggaactgtaaactgttttccataatgactgcaccattatacaaccccatcagcaatacatgagagttccaatctctccatatttttgccaacacttgttatattgtgttgagtccagcctcattcttttgaatgtgtccttccacttgtcccagcactgttttttgaagactgccctttacctgttgaattgtcttggcacccttgtggtcagttgatgttaatgtgagggttcatttctgaatcgcctcagagccatttatttacatgctgttttatcacctgaaacagtcttcctcaccttctaaacttgagtgtcctctttcctgccactgttcctggctaatttgttttcatccttcaggtcctaatataaatttctttgtataatctttagagatttcatccctaataatcctctagtccctcccaatctaaattaagctattttaaaatactctttcataatactttgtactttcttattgtactactttttaataatatatttgtttatgttttttaatttaacactttttttcctattaagtcattaggtccatgagagcaaggaccatgtttgtttagtttactgctgtattctcagtgcctctcaccttgcctgtcaacataaaagtacttcttgaaagtggcaggcagtattttattttaaactatgtatttgttttgtttctatcttagggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttggctgagataggtatgggattaatagtgctgaatcttcataggcatgtactctccactccacattaacccaattaaatagtaaaattataaaaattaaggaaagacaatggtagcttttgtgagcaaagaatgatctagtactaattaaaaaaaacaacaaaactctaagtaatgttatccaaggctaatgtaactgcaggttattaacctccatgtttatttgctagctcattactgaattccagtggtcacatttaatgaggtacctgtggttttaatcagctatgagtatgctgtttatccggctttaccagcagtgtctagcagtggcctgcacttaaaactcagagtagattgttttggtccctgagagacactaaactaaacacatcacagtgtttactgtgttggataacagcacttccaatagaagtcaagtaatggactcctgctttcctcctttacatgctggtgggtatgttggtgatgaacctggaaatggtaaggtccacacactcactttagtgaacattgtctctgttttttattgggtccaaactttttggaaatcttaatgtgttgtcatctttttctgccaaatggaaatgctattggcattattaatatgctcaacaatttagttacatacttatatgtcctattcaagatcttttctatatggatttgtgaatatattgttaaagatgtattattctttagtatcattgtatcagatagctattgccacagtgatgctacatacatacaggcatagcattggcccaggcagctctgctttaggctgtagatgtgtagccggctgttctgctgccgttctgcctcacctgcctcattctgggacccaggctggagggtgtgtttctctcgtggtgttgatagaaacctaggagagaaccagtgaagattgggacccataatttagtctactataatgataaatgaaattattcccaaagttgaaatgttttggctatcacaatacatggtagcataagtcagagatctgaaaaacgcttattctgaaaatattcaacactggttgttaaagcatgttcatctgcaaagtagtctacccttctttggctatatcatgatgatgtctaatggtgtcattgcacagtctcacagctgcggcatacctctttcacactgtatatagaagatttcatctttaattcatatgtatatgcctttttatataattactgtcagaatgtacattaaaaaaattttttttttttgagagagtcttgctctgctgcccagcctggagtacagtggtgcaatcttggctcattgcaagctccgcctcccgggttcacgtcattctcctgcctcagccttccgagtagctgggactacaggcgcccgccactacgcctggctaattattgtgtatttttagtagagacagggtttcatggtgttagccaggatagtctggatctcctgaccttgtgatctgcctgtctcagcctcccaaagtgctgggattgcaggcatgaaccactgtgccccgcctaaaaattgtttttatagatcattgttataaatgggttttaaaacaaattttgtgtaatattcattgagtcgatggtctgtaaaatgcctttttttaacttttagaactttttagattgtttctaataatcctttgttgttatatataaacattacactgattacctttgtgtgatttttttctttaatttttattatttatttatttatttagagacagagtctcgctctgtcacccaggctggagtggagtggggcgatctcggttcactgcagcctctgcctcccaggttcaagcaattctcctgcctcagcctaccaagtagctgggattacgggtgtctgtcagcatgcctggctaatttttgtagttttagtagagatgggatttctccatgtcggacaggctggtctcgaactcgttgacctcaagtgatcctcctgccttggcctcccaaagtgctgggattacaggcaagggccagcacgtccagccttttttctttttttttaaattgcatttttttcctatagggataaaatttcaggaatgtgaacattttttcagagggaagggttttaatacatagtacattttatcgttttcaacaaggtagtgttagagttatagggtgcttttaaaagtatgaattttgtatccagtcagacttctaggatcagtacacagaaattctaccatagtagggctcattattatatacactcgaaataaatgtctaaacataatatttaacagcttaacaacataagtaagtgacctccttattcattatcatcattcgaacatgtttcaccacatgtgatgtgtggatttgaaagtaatgaaaacaaaatgtaagatatttcgttgttgttgttgctgagatggtgtctcactctgtcacccaggctggagtgcagcgacctgattttggctcactgcaacctctgcctcccaggttcaagcgattttcctgcctcagcctccccagtagctgatattacaggcacctggcaccctggctagtttttgtatttttagtagagacagggtttcaccatgttggccatctggtctccaactcctgacgtcaagtgatccacctgcctcggcctcccaaaatgctgggattacaggcatgagccagcacacccggcccagatgttttaacaaaaaaataaaactttttttttgaatactctttcctttttccctttaaaatttttttctactacttggtaatttttttggtaagactcaaagtttcacagtatttgaatatcattgcttataaagacttaaattggcaatttaaaaagaactattttgggccctttttttttggtaggtaaacctacagttgtggacaccatttattatagtgtcataactttctgaatggagttatattccattcgtatgtccagtgcaacttgctagaaagttaactctaagatttttatgagatgagattttgagaagctagtttgaactgtgttgcttttgtttttacaggacggcctcctggtcctgaaatggaatactgcactgacagagagtcatactccttagctgctggcttggccctgggcatggtctgcttgggggtaagcatagcctatgccttcccatgcttcagttaggacatctacatgttgagacaaataacgttgacacctaaacctgaatattgtcccttactatgacttaatctgctgcccagctctattgtctttttggatatttttcaaagtaccagatttgcaaattgagagaaactgtggtcaagagtgggactttaagatttcttttcctccagcttgcagtgttcatgaacaaactgaagggaataaagttttttttttttaaagcgttcaagacatagaatgaataagtgacagcccactatgactgaaaacagagaatagtgaaaacgtatatgatcgggagccttaagagtctatagtagctgcttgaaacaaaccctaacccccttttgccatagtgatgttcactgtgtatcccagaatgttgtcccagtagcatcttccttgtgacaaaatgcagtatcagattgacccatctttaactccatccaagagatgtgtacagaattaccagaaatgtttcattaaatgattgtttcacttgaaatgtggttccccttgaaaaaccaccaatacattcttatggtcaaactaaatgatataaagaaagttataaggccgaggtgatcggatcacctgagattgggggttcaagaccaacctgaccaacatggagaaaccccatctctactaaaaatacaaaattagccaggtgtggtggcgcatgcctgtaatcccagctactcgggaggctgaggcaggacaatcgcttgaacccaggaggcggaggttgtggtgaatcgagatcacaccattgcactccagcctgggcaacaagagtgagactccatcttaaaaaaaaaaaaagttatagtggaaggaatttttttcatgtgtgttctgaaaatccaccttgtggttgaccatctgttagggccttgaattcacattggcacgtgagctaaagaggctggtggtataatggaaaataatcagctgggtgtggtggctcatgcctgtaatcccagcactttgggaggctgagatgggcggatcacgaggtcaggagatccagaccatcctggctaacacggtgaaaccccgtctctactaaaaatacaaaaaaattagctgggcatggtggtgggtgcttgtagtcccagctactcaggatgctgaggcaggagaatggtgtgaacccaggaggcggagcttgcagagagtcgagatcgtgccactgcactccagcctgggcaagaaggcgagactccgtctcaaaaaaaaaaaaaaaaaaagaaaagaatcacacagggaattgcaacttgaattctggtcctaactagtgagtcaagtcatttaactacattattgtgtattgcttaatcagcttcatggattgttgagccagatggccgtgttttatatatagccctgcaacttaactataatagctgtataaccttgggcttaatccctctgtgccacactttccttatttataaaatagggttttaatagtagctatttgatatggctgttcattcatgttaaacacacagaatagtgcctgacacagagcatgcatttaataaattactattattatcatagttattgttggaaaagttcttaagtacaataatgacagtattcaggtatttacagttccagtttcaattatataactaatatttttctttattgttaaatgtcactaactctaaagctcttatgtattttaagacagtacttaaagttgaacattcatgtattaaaacttttatgagaattattaatatttattaactcatgattaatgtttgctttaaattggaaataaaaaaaacaaaacccaaaataacctgctttgaagttagttcatttttatatttgttatgggtatgtgttgtggatcttccttcataaaatttcttttcactcgtctgttattgtcttttccagcatggcagcaatttgataggtatgtctgatctcaatgtgcctgagcagctctatcagtacatggttggaggacgtaggcgctttcaaacaggaatgcatagggagaaacataaatcaccaagttatcaaatcaaagtaagtacacagcaaagtaatagatcaaaagtctggaagctgggaagttaattggaaaatactagtgttcatactgacattggtaaatgtgttaattttaagcatagttattattcagaggaattttataataatttagaactcttttacatgcataaactcttctttcaataggaaggagataccataaatgtggatgtgacttgtccaggtgctactctagctttggctatgatctacttaaaaaccaataacaggtatttctacccactcacccttcctcccgcggtgatagtgtgatatcctccctgaccttggttgtaaaattcagttatctcatgtgtttctttcccctgtgctggattaagctgattttttgttctttcaagtactgtaagtttttgaaagaaaacttgcagtatttgaagttataaagattttacctggaaataatgtatttggctattttaatggtatttgacaatatagttttcaatttctgttcatttctgttttgtagttgatgtcagtaacacccaaacaatgcccatgtttgttttcattaatttagcatattgctgtgaggactggttaagccagaaatacttatcatttagtgtgatcttggttaccatgtaaaacaatggtttttgcctacttcaggagcttttgtaattaccaaaccgtctaccttcctaacttgctatattaatgctgacgcttgaaagtaagatctttggcatttatgcttacactttgcatgaggaataagttgagtacaagacgttatgtcatgtcttaagtctattaattaaaaacaaattctaagattcaaggagttttcagtgttccacatttctccctttagaaaaagtaaatgtgtgcagaattaacaaagtgtttaaaaatagatatttattactttactatttggatgaatgtgtagggcagtgcttccttggcactggggatatttcattgagcaaaactaaaaatatcttccctcatggagtttatgttatagtaagacatacatgtacatctataataactattacattagaaggtgtgaagtattgtgaaaaatatgtagagctgtagtggagcgggaagaaatgttttgaaatagagcttgagattcttgattgtcttgccctctacttgaacagtgtgccttactgttttcctccaccaccagatctattgcagattggctccgagcccctgacaccatgtatttgttggactttgtgaagccagaatttctcttgcttagggtatgctttgtcttcatttgtgttaacatgagaagtctatttgtggttcttaaacttagcttgtaagccgggcacagtggctcacgcctgtaatcccagcacttcagaaggttgaggcaggaggattgcttgagtccaggagtttgagaccagcctgggcaacacaggctgttctccatgactgaatgaatggcaaacataaatgtctttacaagagagccttttatttttaatttgtcatgcatatctaattggcagtgttcatttgaaatttcacaaataggactttgggaatcccaagaaaggtaaccacgttgatatttaatacttggagtgacatttcactgtctcacattattattcaaaacttcctaaaaagcaacaagtgattaggacttttttactgctttgttttacatttttggattactatcagggatgtgataatactgttaaggttgaatctaaagaaagtaacaattcacttaattgtctaaaattttccctctaattcttttttttctgatgtttaaacgtagcatatagaagcttttaaattatgtgtagatagagctatgattctttcctttgtgatttttttcttttccagagtacattttaaaaagtacccgcacaagccctctaaactttggtgatattcaactcaattttagtttttctttgttaaaatttaaatctttattttaatgagtagtttaatgagtaagacggttcccaacttaggttttttaacttaaccatagtgtgaaagcggtactcattcagaagaaactacttccaattttaattttaatttttttcttgtactcctggcagtatgatgctctcatggtgttgggtaatggcagcaagctgcagctcccagtcagccatgcagtcatgagggtaaatgacccatactctacagtttactatgctgacagagaatttcactcaattataggctaatttgagtgttcggagcatgtttaaggtaggctaggccaagctgtgttgtttggcaggcaaggtgtattaaatgtattttctttttctttttttttttttatgagatggagtctcactctgttgcccaggctggagtgcagtgacaccatcttggctcactgcaacctttgcctcctgggttcaagctattcttgttcctcagcctcctgagtagctaggactacaggcgtgtgtcaccatgcctggctaatttttgtatttttagtagagatggggtttcaccatgttggccaggctggtctcaaactcctggccttcagtgatctgcccgccttggtctcccaaagtgctgggattatagacatgagccactgagcctggcctaagtgtattttcagcttaaggtattttcaacttacaataggtttatcagtacataaccttactgcatttgcatatacttatttttcaaaattctcaacagttgggaactgattcttaaattgttctgtttattattatcattgttataaaatgtatgaactttacttgctctaattaattttatctctgttgcatttttaagacacttgctcgatgcctgattttgtgggatgatattttaccaaattccaagtgggttgacagcaatgttcctcaagtaagtacatataataaatattatatctttagtagcataaaattatgatttcttatgggatttttcaaaattctgtaaaatattttttcttatgaaggcaatattgatcattaggatacctcttaaagacctaagaacttccattttaagattctgtgctgcacagaccaccgccttctcttttagcctcaggtccctagaaattgtagtttttaaaaattaaatatgaatatcggtgttgcgtgggagttaaaaaatgaaaggaaaaaactaaatatgtttgccagaatactctaaaaaagtgttgatatttttgtcataattaagtgcacatttctaagatgctattttacttcgtgacaattttagatctcctaataactcttttaattactttatatcatatttattcgataagccaagtatactagttaaaaatgaacagatttttttggtaaaaactgaaaaccgaatattgtaactagccactgcccttagacaactgtccatgtctagtggtctcagtttctttatgtagattgtttctttcagtattttcagaggaaaaatctcaaagattgaaagaagttaatatgaacacccacatcaccaatagactctataataatattttactgtataaacatgtttcatcacttatctatccacttatctattcctctatctaatccaacattttttgatgaatttcaatgttagttccaaacagtaatacactccatcccaaaattgtaccatatatattaactggaattggtatttacattttttccttttaagataaaatttatatatcgtgaaatgcacaaatgttaagtatcctattggataagatttgactaacacatagacctgtggaaaccagcctctatcccttgtgccccttccctctttgtgcattcacctgtacccccaggtaaccaatatgtattttgtttatctcccaaaatatgttaatttccagatgtagaactttatattaatgaagccacatatggcatatacccttttgtataagacttctttcagcgttttcaagatattgagtatattaatagttcatcctttttattattaggtggtacagattgagtatttcttatctgaaatgcttgggaccagaagcgtttttggattttggaatactcgaaattatacttactggttgagcatccctcatctgaaactctgacatctgaaatacttcaatgagcatttcctttgggcatcatgttaatgttcaaaaaggtttggattttgagcattttggattttggattttcggattagggatcctcaacttgtgtattccatttgcaatcctattaggtggggctggaattactgaggcatagggtagatggtatatttagttttattagaaatgataaatcttttcccaaagcggctgtaccatttgacacattgaccaacagtgtttgagagtgttggctgttgcccatctaaccgataattaatggtgttagttttttaagttttagtgctgctgatgaatacgtaatgatatctgactgttgtttaaatttgcatttctctgctgactgttaatgttgagaactttttcattggtttattggtcctccgtctatctttttttgtgaagtgtctgtgcatgtcttttgcttattttttaaaaaaatttgtatttttattactgcgttgctggagtttttttaatgcattctagaaacccgttctttgtcagatttctttttttttttttttgagatggagtcttgctctgtcgcccaggctggagtgcagtggtgtgatctcggctcactgcaagctccgcctcccaggttcacgccattctcctgcctcagcctcccgagtagctgggactacaggcacccgccaccatgccctgctaattttttgtatttttagtagagacggggtttcactgtgttagccaagatggtctcgatttcctgacctcgtgatctgcccgcctcggcctcccgaagtgctgggattacaggcgtgagccaccacgcctggcctgtcagatttcttttgcaaatatccctcccaatctgtggcttgcatattcattttcttagtaataattttaatgagcagaagatattagaatgttaaataatgtctgatttgtcagttttttcttatggttattctctattcctatgaaaaaaaccatttgtctaaccccatcatgaagataatcttttctgcttttctctaaaagcttccaaagttttagttttgtgtatacttacataattcatttcaaagtaattttgtatatgatatgaggtacatgttgaggttgtctaccagggaagctcatcagagactcagcacccaagtttttaattgggagctgacatgtaggtaaggtactctctgccttgtatgtacccaagttccagattctcaggagaatgtgtgttagcctaaaccacgctgtttgtagttcaagcacggtaaacacagatatatacattttgttttaaagcaaccggttaatttacttggaatcagattgtcattctttcttggttgctagctctaatcttggtgcacgtctttatcctgtgggctgttggagtctgccctgtgcacacatggttcatggatcaggcagacatttgcacagaatttatatacagagcttggggccctgtctctgtggctctctcctttgtcatattctgtcctcacctcccaatgggtgtggtattttcctgtatcctggttgttaaggccaagaaggttatgagcttttaattgtagcttttgccatctttcttggcgcagatagacctgctttcagagcagaaaccgcagaaaggaaaatgtatctagtggtgttcctctcttccatggatcgactctcccctctagaatctgcttgcgtttgtcctcactccagtgtcttgaggtcaggagttggtgaattaagcccacctgatttttagaaagaaaattttattggaatatggccatgcccatttgtttacttattgtctgtagctgttttttgttacaaatgcatagatcagtagttgctggtatttactatttgacccttttagaaatagtttaccgacccctgccatagatagtttggattttatattttgtctagggtttacacttggtgtatgagttgatctgataggaatttattcatctattatttgaggaagtagaactcctaggtttgtttttatttgtttagttcttccagttttgttaatcactgatatgaaagaggtgaggaagaattgttttaaatgactcgctcatttgttaccataattttaactctagcatattcagatgtcagagattttagtttttttgaaagtgctctttgaaatgtatattgtaggatgaaatactttttctttcactccttcattcagcacatactcatgaatcctctgtaaatgcaaggcacgtgctaaactctgtaatacattaaagatacatcagacatatagagtgttctcaaaaaactttagtttattaaatgcactaagttcagcttactgagattaaacatgtgtacaagtaactgtaattccaaagtggaaagtataaattcatgtcagagagtggtcttttttgcggcctggtgtggtgactcgtgcctgtaatcccagcactttgggaagccaaggtgggcacatcactcgaggtcagagttcgagaccagcctggccagtgtggtgaaaccctgtctctacaaaaaacaaacgaacaaacaaaaaaacacaaaaaacagtggtcgttttttgtttttatgaaaatatggtttttggacttttagtatagaataacatctctctcttttttacttcagactttataatgttatatttggtctttattacatcagggatactgcaaataggagagataacaatttcacagttctcctgattgatatttcctatcagcttccacttttctctgggttctcatctggagctacattgattctggagcagggttccttgtagtgagcaacctagcgttaaaaggaggatttttttttttaaaggtcactttgtaaactgcttgtctgtttgaacttagggcatatgtaaaataacaactagcatcttcatagtactttttctttcataaaaagctttacatacagggtgcggttactcacgcctataatcctagcgctttgggaggccaaggagggtggattgcttaagcccaggagttcaacaccagcctgggcatcatagtgagatcccatctctacagaaaaatacaaaaattagccaagcatggtggtgtgcacctgtagtcctagccacttgggaagctgagatgggaggattgcttgagtccgggaggtagggctgcaatgagccgtgatcgcaccactgcactccaacctgggtgacagagggagaccctgtctcaaggcaaaaaaaaagaagaaagatattttaagtctttgatttggtgatattcagtacataagaagactgtattataagtgccttctaatatttatttattttattttattttatttttgagactgagacagggttttgccctgttgcccaggctggagtgcagtggtgcgatcttggctcactgcaacctccacttagcaggctcaagtgattctcgtgcctcagcctcctgagtagctgggattacaggcccagctaattttttgtttttcagtagatacgggtttcaccatgttggccaggctggtctcgaactccaggcttcaagtgatccgcctgccttggcctcccaaagtgctgggattacaggcgtgtaagccactgtgttcggccaatatttattgttttattgaagaaaacatcctgaaatgttaagaaatcttctaagaaatcttctcagaagattaaaagaataaatcttaaatacattcatatgtttagcaaacattagctttatcttttttggcttttttcttttaggagaaaaggatcaaatgtcttcttggttgttacagctagatattctgtgtatgtttttcggtaaattgttcattacctatactaaaaggaaaaggatgtcttttctaaacaatagttgtaacatagctgataaacatattgacagtttagcttatcttagcctagtgaataacctcacctgtggtaggtatgttggattaatgctggaaacatcccgtaaagaagaagtctgattagagttgtctcctatttctcttttcccacttcttcccctcacccctgccccaattctaaagccatcatctttgtatttcagttgactggtatgcaatattatgaccctgttactgatttagaatatacttacgtcttcctgtttatatttgttcagccctatttaattattattattattattttttttttttgagatggagtctcactctatcacccaggctggagtgcagtggcgtgatcttggctcactgcatcctgcacctcccagattcaagtgattctactgcctcagcctcctaagtagctgggattacaggcgtgcgccaccacgcccagctaatttttgtacttttaatagagatggggtttcaccatgttggtcaggctggtctcgaactcctgacctcgtgatccacctgccttggccttccaaagtgctgggattacagtcgtgagccaccatgcctgcccttaattattattcttacttagcccatcttagatttgaaatttgattacattcaatgagattaaaatataggcttttgagtgaaacggtttggtaaagcttactttgtataaatatagccatgataagcagtatgttattcttcagattattaaatatttgtaatgagaacattgatatctaagtattcttgctttctatattgacagattataagagaaaatagtatctctctcagtgaaatcgaattgccgtgctcagaggatttgaatttggaaactttgtcgtaagtgatgtataatgcaaattagctatcctagcgtctatcagataattaaattgaaatataccatgtgggagtaatattgtccttgatttaagtaattatgaatcccacatgtttctaaccattatttatcagatgttcatgacgttggttaaagctctctgaagtacagagctcttgccctcaaaaagcaatattggagatttaacttgtatgtatttgttttttatcctttccattaaagaaattggcaacaattttaaaaattgtttttgctgcatatgaaactgtaggcaaggggcaaacttcatgagtaaggtgacccgatgcttctgctgaaaaaaaaaatacatagaaatctgctgactgagggcacttcatcattcccagaaagatataaactagcttagagaactggaatatttattgttacttatttcaagttaattttaaagtaaaataatgattattaaatttcttgtcacctgttttcagccaagcacatgtctacataattgcaggagcctgtttgtctctgggtttttgatttgctggctcagaaaacttaccagcatttaactgtttggtaagaagtattttagtttactgtgttctttttttttgtttgttttaacaaagctttaagatgcttcttataacttggaattttttcttttgtttttctagcataaatttgccaaagattttatgacttatttgtctgcacctaatgcttctgttgtaagtctttttatcattctccttgggaataaaattaaacttgaaaaaaatttactgatgatccagttacttatgtgttatcagatatctctgctgtttttttaaatgtagaatgagagatctgaagaaccattagctcatctttttatttttgttttgcgatattaacttaggtgagaatatgattaccctggaaggatgcacaggtatctagttcttgtgacaagagaataaaaaaggccataatattcacgggttgtcatacctcatgtaattctgtctcagtattaaatattgggaatttcctttttaaaaaatattagtacttagtaaggattcagttgcttttgaggcattgcttctctgatgacaagactgagagattttatttcctggtaaaagctacatggatttatgcaacactatttataatatggaaaagttagaaacatcaaaaaagtctaaaagtagttaattaaatttgattatggtttatttatatattcttacacagtggagctaccaaaatcacgttatacaagaattttttgtggctgggtgcagtggctcatgcctataatcctagcaactttgggagaccgaagcaggaggatcatttgagcccaggaggttgagatcagcctgggcaacatagggagaccccatctctacaaaaaataaaaaattagccaggtgtggtgacacacacatgtagtcccagcaacttgggaggctgaggtgggtggatcctttgaccccaggaggttgaggctgttgcatcactgcacttcagcctgggtgacagagtgagagaccctgtctccaaaaacaacaacaacaacaaaaaagaaacaacttttttttgtgagtgaagcttgcttgtaataggtcatttaaaaggttaaaaatattgtgtagagtaacatctccatttcatttggaaaaaatatgtgtaggtaaaggaaaaattcagagaaaaagccaaaacgttaacaccagttatctttgggtgtgacattccaagtgattgttatgtcttgatattcaatatttgaaattatttctgttgaacttatatttcataatcagggaaaatatttgtatttacagatttttttttttctctgagacagcgtctcgctctgtctcccaggctggagtgcagtggcgcgatctcggctcactgcgagctccgcaccccgggttcacgccattctcctgcctcagcctcccgagcagctgggaccacaggcgcccgccaccacgcccggctaactttttgtgttttttagtagagacggggtttcaccatgttagccgggatggtctcgatctcctgacctcgtgatccgcccgccttggcctcccaaagtgctgggattacaggcgtgagccacagtgcccagcccagatttttttttaagttacaaacttttgtagtcttctaatgatggctaagctagttctgataataaagaaatgtaacacaacagttatagtgatgtcatctcttcacctgacagacaggtcctcataacctagaaacttgtctgagcgtggtgctgctgtctctccccatggtcatggctggctcaggaaacctaaaggttttgcagctttgtcgcttcttacacatgaaaacgggtggtgaaatgaactatggttttcacttagcccaccacatggcccttggacttctatttttgggaggaggaaggtaagtgaatatgtatttttccaatgaaaagatctcattggtgagatctataagggtgacttacgttgatcttgaagataacatgaaaaatttaaattctgactagctcttagcttaactagcagcattattcgacttgatgggcttctttgtagtttaaccgtcaacttatggtctactcagtagaattaccatcctctctgacacactgagcatcactgtatttctcagaatagtctgtgctctgttcttcagtgcattactgcttgtgcccacctggttaaaaattttaccattctactaagctactttctcagaaaggtcacaaacaaaatcgtttaccagatcctgtgacattttcttagttttcagctttcttgatctttttccaacatgtgccattcctgactacatcctttataagactgccctggctttagatgaaccaaaaaccatgtacagaaaagtgtataaatcataggtgcacaggtcaaagagctatctaccacagaaaaatctctttgttatcatgtagatcaagattctgtatagcactttcaactcacagcacccgtctctgcttctgccatgcacccctctcaatcactattatcttcctttccccaaagatagccctatctagtcttctaacaccttacgttgattttgcctgtttttgacatttaaattgaattatacacgatgtatccttttgcactttacttttgctcaacattatgtttgtaagattcatgttgtatgtagcaatggattattcaagtttcagtgttgtattacactttcattgtatgactgtaccacattttattgatctcccccattgatggatatgcttcttgcttctagtttggggctgttatgaacagtgctgttagggaaagttgtacatgtcttcgattttgttgtatatagaactgtgtggaattgggtcataggttgtacgtgtgtattcactttcagtgaataataccatcagtgctgcagtgcacttgtaccattttacatactcatgggcaggatgtgaagttccagttgttccatatccttgtcaacccttgttattggtatagtctttttagtagtctttttagttttagccaactagtaggtatataacaggatctcattgtggctttaatttctgtatttctgaataatgttcttgagtaccattttacacttttaatagccaactgcaaaacctcttttgtgatgtccaaatctcttgctacccagtttttgtatttatctatgttaaaatttttatttgtggtaaaatacacataacgtaaaacttatcaatttttaggtatgcaattaagtagtgttaattatattcacactgccgtgcaaccaatctccagaaatttttcatcttgcaaaactgacattctatagccattgaacaactccctgtttgcccctcccaccagcctctggcagccgccattctactttctgttttgatgaggttgactgctccacattggtttagctttgtattgatttctgtggattctttaaactatgtcctaagcccttggtcagctttgtttgttgcagctatctttgccaccctagggcttgtttgccttttcactctctctcagtggtgtcttttgatgacacaattattaatgttcttcttttatagtttttacttctttgtgttgtttatgaaatattttcttacccagagaaaaggagatattctcctatcttatcttctagaagtttttagcttttccattcacatttgaatctaaaatctacctggcacggatttttctccatgtttttttcccgctgctattgaaaagtttctccttctccactactctgcagtaccacatctattatataagttaagtgcctatacacctgtgtttatttctgggctattaggttttgctggtctgtttttctgtacttgcaccaatactccattgtcttatgagtcttggtatccagttgagtaaatccttcaaactcggttttcttcttcaaaagtgtgtttttctcttggctccttgcattttcatataaatattggaatctgttccatactaaataatctgataaaatattgatcagaattgccttgattgtatgtgtctgtgttaaggagattagaatctgttacagtattgtcttccattctgtgaatatggtatacccctgtatatatttagctgtagtgtgtgtgaccttgatcaatggctacagtgtctgtgtaggctaattttcccctcttctttaaggctgagcttaccattggaactcaccttttcagaagtacaaaaagtaaagttgatcagaaaggtgtgtatttcctctcaacatgttttgtggaattgtctttctttaattgtttagaattaataatggtcaaagaaatattactatgaaaattcttatttattttattctatgatttttgaaaattttttcctttcaaaatgagcctctccgtgtctcttaatcccatctttcattgttccaaactgtatgactctcctcgctcttctttcatatcgaattgatttttctaccattctgctactgcttttctagtgatttttggtttttaaatggtcatgtatactctgtaacaacatttaaacttagcatagctacaccattatgtttctacccaaaatttctaacattagtatcttaatatttatctttgaattttggtttatcaaaagggtacaaagaaaatggcttattccatgcacatgccaaaatagatgtatctctttgcttaaattttgaaatctcttctttctaatccattaaatatataagcatatataatgaattataagtccttatttaatactccaattattttaaaagacagggaaagagatttgggtatatgtgtgtgcatgtttgtgtgtaagaaaagtatttatactcaatagttttagaagtggttttatgtgatgtcctacaccatctttatttcaaaatattttttagaaaaactctgggactttagattaatttgcctgtttgctatactaaatttgagcaacaataaagtaatttaaggaaaattttaatagaccctttaccaagagaatatttttaaagtctatgaaactttatcttaaaagtgtatcatattggtgaggaaagaatttatatttagaggaatagttgtttatacagtcattgtaactttttttttttttgagaaggagtctcgctctttcgcccaggctggagtgcagtggtgggatctcggctcactgcaagctccgcctcccgggttcacgccattctcctgcctcagccttccaagtagctgggactataggcgcccgccacggcgcccagctaattttttgtatttttagtagagatggggtttcaccgtgttagccaggatggtctcgatctcctgacctcgtgatccgcccgcctcggcctcccaaagtgctgggattacaggcgtgagccaccgcgcatggcctcgttgtaactttttaatgataacttttgccttttcatttagtcagtcattctaaaggaatcatcatgcttcacagaaacagaaaaaaactgtttaaataccaattacaacattctgtatttttaaaactcagatttataattgtatatttatatacataggcatatacataggcatatacattaataaaattggataagaaggtggcatacttggtacatgactcttcaatatttataatttctaggactgcattcatggtcttcactactctgctattttatgttaaaaccttgcttcaagggttgaaatttaacatttatgggatattactttggctttaaatagtgatgatcttgaaatggcccaaggactaaatgaaaagtggaatgttcacaccactgacactcttgtattatgagggcatcttatcagtatgccttactattataccccagtttcctgattctcaagaatgccttgaaagtatgtgcaatataatcaataacatctgtccccaccgaacttactttgcagttactctttgagcacatcaaattcttccattgccgctcttctctgtgccctttatccgcacttcccagctcacagcactgacaaccggtgagtctagtgattctgtcttcaatgtgatacttattaagttctctaaggggatcatttggttgtattttggtttcatggaattatttccaaattagcattgttttgttcttcaacttagttatattcctggctaaatcttttaagaaaattatctcacaaagtattagaccagaggataactttggacacctgatgactgaccagtcttccaccattctcagatctatagaactgctctaaacccaaaaggagatcaagtaaagttgtctttagggaaaaaatcatcaggtaaaggatagttgccaagggaagttcaggatactttttttgtgctctaattatttaattccaagagaaaagtttgtctgatttagtggcaatgtctgtatgagtttctttttttcctttcacatagatgccgagaaattgtgtataaatgacatagacgggacaagaaaagcaaaatacagcaaaaaaccagagacaatttagaagtggcagtgagcggtagaacttcaaaccatgtagaagcagttaaaagctctgtgttttagggtacgaggaaccaccaacacttaagtttccctagatatagtttgagacatagcagatctcttgcatatgggggcagagaagaaaatagcccctataagacacctgagccctgtgctcaactgaaggcatcccatgttgtctccccagagacaggtcaagagccctttattgtttatgggagaagggtcaggagcacttatcacagtaacctaagccatcattttaaactacactacaatgtataaccaacgacagaagaaagatagctgttttacaaaagtagcctaatctgaagaccacactctgatggtaggtgcagcacaagaatattgttaagttaatacacttctgacatgtggcctcatgcctgtcatttaggaaagattttttgagttgttaaagccaattattggctagggtacagtggagagccacactcacatactgctggtcatagctatttggcttagctattgtaaacgaagccattttccattggtgacaagaatctttttttttttttttcgagatagagtctcgctctgtcgcccaggctgaagtgcagtggcgtgatctcgggtcactgcaagctccgcctcccgggttcatgccattctcctgcctcagcctcccatgtagctgggactacaggcacctgccaccacgcccagctaactttttgtatattttagtagagacggggtttctccgtattagccaggatggtctccatctcctgaccttgtgatccgcctgcctcagcctcccaaagtgctgggattacaggcgtgagccactgcgcctggccggtgacaagaatctttatgtaatttgttagtgtcattttttctgatctttattgattttatttttaatagatttatagaaataaatgtatttgagtaagaagagggaagttactgtctataaagctttttaaaattgaagtctcattttatccttctttttttttttttgagacagagtctcactctgttgcccaggctggagtgtagtggtgcgatctcagctcactgcaagctccgcctcccaggttcacgccattctcctgtctcagcctcctgagtagctgggactacaggcgccagccactgcgcctggctaatttttttgtatttttagtagagacggggtttcaccgtgttagccaggatggtctcgatctcctgacctcgtgatccacccatcttggcctcccaaagtgctgggattacaggcgtgagccactgcgcctgggcgatttttttttgttttttcttctgagatggagtcttcctctgttgcccaggctgcagtgcagtggtgtgatctcagctcactgcaacctccatctcctgggttcaagtgattctcctccctcagcctcccgagtagctgggattccaggcatgtgccaccaggcctggctaacttttgtctttttagtagagatggggtttcatcatgttggccaggctcatctcgaactcctgacctcaggtgatccacctgccttggcctcccaaagtgctgggattacaggtgtgagccactgtgcccagcctatttttcttttatgagatcttaaaatatgaaaacttttttgtttttacattctaaaatagaaatcttaaagtttaaaaaactgtttgagaaccccaaagaaaaatattgccatacccacatagatgtttgatgtactgtgtttcaaggacgtgtgtatatgtatgtgcaagtatgtatgtgtagaagaactttgctgtctgagaagaattgacatcctgtcttcccccttcttccctatcaatccttaaggaaaaagaaaaaaaaatctgagaagataaaaacagatgcctatgttgagtagaaagggatttttgagagtgattgattttataagtggtcagtttgatagtaaatattttcatattatgatactttttacctccctgtaaaacctcttcactgtgaagactaaagtaaagaattattgggtcaaaggtcagttatataaaatttttaaaagataatttctccattactttttaatagaatcttatctgcctttaagatttctgttcatttgaagatattacttgagcttctgtcctgtcttagcttataggcaacagcagattgcagagctcatattgtcacagttgtttgttacccactctctgtcttttttgtgaacaggtatcatctccaggctctccggcacctctatgtgctggccgcggagcccaggcttctagtgcctgtggatgtggacacaaacacgccctgctatgccctcttagaagttacctacaaggtatctctccctatcatttacttgtaattttattaccactcatccgtctttgcaggtcataatatttcaaatgtgttgtccagtaaaaggtgataagtaatgaattgaactttcataaaaatggaagcttccaaagttattgtatatcctgccaggccattcatgctcatttatatgatctgggtatcactttttagggatcatcagctactcttttgtccttagagcttataatttgaaaatgtccctgttaactttatgtgactgacagtagtgttttgtataactgattgagttagacccattcttagatttgttagctgaaacttgaaaacccaaaattgtgtatttgatgacagctttcatttagatgcatagattacaagttttatatcctcctttcattcagcaaattattaagtaccttctgtgactcaaaaccgtgctaggctctggggtacaaaatgagatgacattgtcattttccttaaggaacttctatcccctggggagccaggcatggatacaatgggaatagagggtgataattggagatgtctgtggaatgcaggggaagcagagaagcaccctcgcttagctgttagttatggggttgaggctgtcaacagtggacagtgtttggactaggcctggcccactgagtggagctccttcccagcggagaaggcaatgtgcagaaacccagcagcattggagcacggcctttggtgctgctggcctgtgaggagcaaggcttgaagtgatgggaaggacacataccctgtgaggaatttagacatcagtcctttaagatttgagtaccagagaggattttatgccatttaaaggtctctgtatgaactgcggggatagggggaggtatagcgtggagatgtttcttctttgttgtttccactgactacctagtgaattgtggctggacttttacatttgtaaagggcactcagtggtatgaacaaaccaaagaagaattgatggctcctacccttcttccagaactccatcttttaaagcaggtaagctgggtgtgttcgggagttgggtccaaggggtcaattcaacagaatggcatagcgttaaagatagctaaataaaagcctctgctttcttcatgtattgtagcagataagaaagctgcagcaggaggaaaagtcagaaagaatagagcaagtcttttcttagagatctttattgatagcttaggtggcctcagaacatgatttacattcattttttgtctggaaatggagcttgttaccttccagatgcctctttctggctgttattgtttcctctgagaaacataggtttcagtttgtcagatgagcatatttttcagctttgggttgactatgtttacgtttatcttgacagattaaagtaaaaggcccaagatactgggaactgctcatagatttaagcaaaggaacacaacacttgaagtaagtacattaaatttctcaaatttaccttttaggaagtgaatagaagtatataagaaggtataaattatagattattatctggaatgtgactcatcaccctttaatctcattcaagactatatgtagggtatgtcttctgtaaaacagtctgtatctttgaaacaagacttgtgttagaaaatgaaagttttaatttcaaactccaaccctaaatatttatttattgagaaacttgcactgacttccttgtgacagtaatggacttatctcttggtatattaacataagatttagtttaagaaagtgtattagtccattttcacactgctataaagaactacctgagactgggtaatttctaaagaaaagggatttaattgactcacagttctgcctggctggggaggcctcaggaaacttacagtcatggcagaaggcaaaggggaagcaaggcatgtcttgtatggcagcaagagagagagagagaggtgcaacacttttaaaccatcagatctcatgagaactcactcactatcatgagaacagcatgagggaaatctgcccccatgatccaatcacccccaaccaggtccctctcctgacatgtggggattacagtttgacatgagatttgggtggggacacagagcctaaccatgtcagaaagtaaagctgatttgtacacgcacaaaagaactttattaatcagtgtttatcagaccacatcttttgttgcatctctttaccattcttttgctagaaagttctcctaaatttaagattattgtagataatatatactactcagccagtttattttgggtggaaataatcacgtgcagttattttagagtgttgatacatttatacctaaagtagcatgtcagttaagcctttaaatttcaaggaagtttaacaagcatgtaaaagtttttatagtttggtcccaatgtgaatttttccagactgtatattagctgttttctgtattgttctgtccttagatttgcagcattattttcttcttgctgcaaaccaattaatagatatttagtacctcatgtaccctaggcatagagctaggggatatagggaatacaaagaaatgttagacaaaatgttatcttcgaagctcataattgagccaatagtcaaagtgcctcctcatttaacaagttccatgaatctagacaccaaagaaaaacagaactttattctaggctttctcatagggactgatttaatcttagacacagtaaataatcatttaccttagtggaaaatggtaaaagcttcatctcctgtgaacatggtattgggaaaacactgtttccagccaagaactgccagtaataccttatattaaattcattctttttctttcaggtccatcctttccaaggatggggttttatatgttaaactccgggcgggtcagctctcctacaaagaagatccaatgggatggcaaagtttgttggctcagactgttgctaacaggaactctgaagcccgggctttcaaggtagtattattgattggtaaaaacggaaagaaataattctaaattgctggcttcctcgcccattgctataaacttcaaaggtggatctgcttcctttttcattgttgcagattgtaaagactgactgtggctctgtttgctttttatgtgataaaataaataataaaatataatgaatataaaatactgtatataataagtaatatatatataataaagtaaaatactgtaagttaatgtttacatttagcagcaaggacagtcacaccatatcttgacactgtaacaaatagtgattttattattgatcttcaaatcggtgaagatttacttaatttcatagcaaaaatagaaaacgagttttgcaagctagcaattattaactccatttaaaaaccaccatttgtttccttaatctcggtgaggataaactgatgacagattcagacttcttttattagtttgctttattatttgcacagtacttgactgccagtgcagtagtgtttgaaataaggaaatagttacgataaatgagggtaggaagcaatctcattcccttggcggggtcagcacatattttgctctatattcttgactcagataagtttccaacacaagaaatttgtcccataatcaggcattaagacttctgaatttaacttcagtttcctgtaattccatgagcaactgtgtccctgctggtgatacaaagtagagtagtctaaagtagttaggaccctaaggaataattagacggcaaaagtggggcaggcagactggatgagtggcagccagaggactgagttagcatcctttgttcttccaagtacggagacagcagtttattttaattcaactcatatttcattttagtcagttacttatgaccgagcctttataatggttcccaggattgaaatgtataaatagttcccagggttgacattggtgaattttgtttggcagtattcagtaagttgtttatgaaatacttttgaaagatttttggacacagtttaacttaaatttgtagtattgcttcttctaaaaattagagcatattccaaagactctaacccaatttgtgaagaaaatagataagtttagacttgagtttgaacgaagaaagtatataaaaattaaaagctatttctatttcctgcctactggagttcagaaataaaatataaacctcagtggaaaatagtaataccttcatatttcattttcaatcttgaaccttgagtgatactgtttttttcccaagtttaaaaagttgtggtaaaatgcacacaatttattgtcttaaccattgcaagttacagctcagtaatactaagtgcattcacattgttgcgcaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacccctcattctacttcccctagtccctggcaaccaccgttctattttatgtctctgtgattttgattatactaagtacctcatttatgtggtttcatacactgtttatctttttgtggctggcttgagtgatattcttttttccttaccttttcagtaacaattctagtttctggtaggctttttaattagtcagtgaaggagggaaaagccttttttggatgagttgtgtaaacaggaagacctgtttgttattggccttttgataaattagcagctcatgttaacttgtgcaaaagcttcttgtaacttcttagcagaacaggttgatgaggcaagtttgcatcatctgggattttttgggaatgttgggtgacaaaggggaggtagagttgttagaactgtgtgtattacagtttaagcgtaaggaaaataatcttttgttgtcttatactgttgtggttgtttgtttttttagccagaaacaatctcagcattcacttctgatccagcacttctgtcatttgctgaatatttctgcaagccaactgtgaacatgggtcaggtatatattctatggtttgccgagccccaggactagaatttgttattatttctatgcatgggtcacccaaaacatctctactatctatatctatctttgagattgatgacatgcgtcagtcacattggatgacttttgcttggcacgtatagatttgcatagcctaaaactattaaattcagcaactttctaccttgatagaagaaacaacttaaaatttataagacatcagttttgacagatgatagtttctgtcatctacaagaatgatacccatccatattctgctttatgttttcagtgtttaccacctttctcttatttttatgtaatttcattaactgtttcctctgtatattataacccttctttttattgttcatacacctgttaccttcaagattccaagggtgctgagcagatttttctttatttttttgttttttgctttttgagacagggtcggttttttctgttgcccaggctggagtgcagtgacgtgatcatggctcactgcatccttgacctcccggagtgaagccatccttccacctcagcctcctgagtagctgggactacaggcatgtagccaccatgcctggctacttttttaaaaaaattttttgtagagatggagtctcactatattgcccaggctggtcttgaacttctgggctcaaatgatcctcccaccttggactcccaaagtgctgggattataggcatgagccactgtgcctggcccagatctttgacttaatccaccatagagacaaggaaagattggatgcatatatggccttcagaaaatttctcaacctctccaaaatgtagtttcctcatttctaaaagtgattataatagaacctaccttacagtattgttttgaggattaagtgaaataaccttcccctctcttttttattgaatctttactatacatgggacactctgctaatacttaaatgtcatttaattatgaccctgagaataggtattttatcattctgggcttacagatgaggaaactgccactgagagatgtcacatgcccaagatctcacagctagtaagagctgggctgtgcactccaggtcacgggtctctaataaagcccatgcccacccttaaccccagctggacttgactctgccacctcccctaaacttgttctggtcagtgttttttttcttgcagctttgttactcggtttcctttctggatcctactcttcccagcccaacccaaggcatagctctgtgatgtcctatctactcattttgtcctagtttggtccattcctctcttctgtagcacttactatccttaactgtctcttgggacttaatttttttttttttattaatgtttaatgttacatgtgctgtggcttttttaaaagattgtagtgttacttttatgtcattcattataaaacttaagaatgggccatagtagtgctatacaatttgtttttgaattgattttggaatatactttgtgctacaaaacttctgattttctgcagaaacaggaaattctggatctcttttcttcagtactctatgaatgtgttacccaggagacctcagagatgttgcctgcatacatagcaatggatcaggtatggatccaaaaacctataccaattctggtgaaatttgtcctgtagttcaagtaactcactgaatagtgtggtaaggttcctagtgtccttccttttagtttcccatttgcttttggaaatttaagaaaggaaaccatataaaatttgaaagctctcaaaaatccaaaaagcttgggctttatgttgacaggagtgccccttggggggctgtcttcctttaagggttcccattcctcccttttgtctcccctgactaggagaggaggggagcactcccttcctctctcccatcttatttttgcctccctcctggcaatgcctctttgtagaagtctgcatgtgagccgttagtgaacagaaccctagcgatggcagtactgtgaaattagacctatgtgatgaagcttgcaagaggttacagagtccatatgcagttatctaggcattggagttcatttttaaatttctcttgttattgctattttaaaagagcctaaaggggtaatgcagaaaataatgcttaataatgttcttaaaggatcagaccaatttattcactttaggcaaattagtaatacatacaccttttcagtattatcatatctttcagacccagatttggagctaagccaagccagtagttttctaacctggcagaaatttgccttggtatcttaaaaatacagatcctttaattccatgtctcatctattgaatcagaatttctggggtgagatccagaatctagttttaaacagctctttaagtgaatatagtaagttcacagctgagcatctgagactcagtgtctaagagaaataacctttaatgataaaaataatttgctaaaaagctgaatggaaaaatatatttagccagaggataattcccccaaaccagaaaacacacagtgttaagtaacatcattaaaaaccaagttccaatataactaagtaggcccagaatgccattattgtctggaatccacccttttttggttggaaagtatggatatatggtatccacgctggcactgcttctcacagtgcctctttgtatagcagccaaataacaagttgtgttatttgctggatgagaatgttgctggctgagaatgtgtctttttactctctgaaccctcacacctttacagtcatgggtggcaggtctttatgcatgaatatcttctctggttgcagctgtagtgacttgcagatggatctcaagggcagtattattagtagtgttcttcttgccctctaccccctgggatctctgccatgtcattgtacccagcttgagtttcccagaggtgactggctatgaccttttgggtcttggttattcggagctgttgagccaagaatgagctcattcacctttgttacttttccctgcaagctcctcatgtagggccatattgaaggaggtgagccattcacctgtacccagtgacggcgcctctgtgggcagactgcatcaaaacacagaatggaccaccccccgaccctttataattcggagccacatttaaaaaatactcagtctacaactctgatgaagagacagagcactctttgattaaatagattgttgtcctctttcctcttcaaggctataagaagacttgggagaagagaaatgtctgagacttctgaactttggcagataaagttggtgttagagtttttcagctcccgaagccatcaggagcggctgcagaaccaccctaagcgggggctctttatgaactcggaattcctccctgttgtgaagtgcaccattgataataccctggaccagtggctacaaggtaatagtagcattgtagcatagcgctcttgtgcttttgagatacattcggttcaggcttttctgttgtaactttgttttttcattggtaagcaagataaatctgagtataagcaagaatggctatagatttaacgtttccagctagatgaattagactttgattatctactttagcttctttagtaaaatacatctgacccaggcagataatatttatagcattttaaataccacttggtgctcaggaccttgttctctcttccctagcatcagatcacatttcctttccagtgcctctgtctcctgtttcctaggggtgtggcctgttgccttcctgaggccagcagccatcctgtttttgtactggcaccacatgtacatgtagaagttgacgtgtgcttgctgagtgagcttgttgtaccaactcagttttgaaaacctgggaccgcacagctatgtgatgtcacagtggtggctttctatcagcaggatttgtgattgcaaggaaattgtagttactcgttaacagtgtagaagtgattctgacttacatgaggcaagcgatggggcctttagatttatggaaatgtgtctgtgtgttaaatacacctgaaactgattttcaggagtagactccttgatcttttcattctttttagttcattcaaatgctcccagtaaatatctgacagttgcttgctttgggttaatactaaccttagtaatagtagtagaaacaattcttgctttgattagtgaaaactattagtaatcaatagaccctaagcgtttgaatataattcagtttaaaactatccacctgtaacactaggaaataaatttctgaaaaaaattaaattgtaaaccaagttgtgagggatatacttggaaagcctgattgcagactctccatgtttatatttaaaagctgcattgtatttgtcatttcctgttcagattcaaagatcatataacttcataattttttggatagtcatttttatcctcatttttggggaaaaacatgttatttcaaaggttttcgtgtttcgtttttattcaatttaacatttgatcacctatggcagacctttgctattgataataaatacttccttaaatctttgcagattccctgatttgcacatttcatataatgtatggaactttggcagtgattagaacattctctaaaacagggccctgattgccttgttgctctttagcgcatttggtggtttccagcattgctgtcagcctccattgaatttgacttgccacacagatttatcaaaaatgtgtttattttttagtgaaaaactagaatttttttttaaaacaaaacctcttaaatatatagtctcctctcttacaagcactagcagttggcattggggtagagaacaataaattaactgaaaattggaaattgcattcatatttgtgtgtaaaaatcacagatgcatatgtggactttcaggatcactcactaacaactcattagatctgagataacccattgaatcactacactaatctgaaaatgcagccaatttatattatataaatgtcggttttgttttttctttttttgagacagagtctcgctctgtcaccagggtggagtgcagtggcgcgatctcagctcactgcaacctccacctcctgggttcaagcaagtgtcctgcctcagcctcctgagtagctgggattacaggtgcatgccaccacacccagctaatttttgtacttttagttgagacggggtttcaccatgttgttcagtctggtctcgaactcctgacctcatgatctacgtgccttggcctcccaaagtgctgggattacaggcgtgagccatggcgcctggcctatataaatgttttgtacagtatttatctcctcaaattataattttgggcaaagaaagcgggtttcaagtttaagaactttaaaaagttttattaactttttcatattttgttatggaaatttaaagaatatacaaagtaagtagactagtgtaataaaccacaacaccaattttaatagttgccagcattctcctatttttgcgtcatttgtaccttcacccattgccacactcaattttccaaattgtgccattttactttcccaccagcagtggattgcaatgcaatttttggcattgtcctttttttttttttttttttttaagacttgtcaagtgcagtaggaaagcaaagtaaacccaaagcaagcaaataaaagcagaaaccaatgaaaccaaaaacagataagcaatagagaaaatcagtgaaacaaaatgctggtagacatgagaaagtcattgaagagaggctgaaccaccatgctctccttcatgatgagctgttcaaagaagaatctcatctgttctcccttaacctttctccctctgctgcctcccccaaacctaaatgtttccacctcccagtagactgacatcctcacaactgtgttcagtggagtctacagttttcatctcactccatctctacaatggtgaggcttttagctacattttccttcttgaaatgagcctcccttgactttgtcatagcacactttcccaatttttaaaaaaaatcctctttaaaaattctcagtatttgtcaccatttcactgtcactcctttgttgacccttttggaagtcatccttgctcctttccctccttcccttctctgcgatagctgacccattgctgatgcctttcagtcctcatcatagatatttcttgaatttgtccacattttactatttctacctagaacagaatgatgattttgtgcctggaccactgttatagcctcctaaatagcctccttgctttttctcatctccattccaaccatctcaatttaactgacagaacagtcttttaaagaataaactgatgtaacactcctgcttaaagcttttcaatggctcctgattcagctgtgaaagaaatccctactgtgtggcaccaggacctgtgtgacctgcaaggcgcctgttttcctcaacaaagcctcttttataccacttgctccccacaccaccctggccccttccacttgctcaaaaacactgagctccttttcactgtggggccattgaatatgctgttttccctccctagaaccttttcctctcattcttcacctgcccaactcatatttatccatgcagcctcagttttaatggcatttcctcccaggccttccaagaccactctccctcaggcagctttcctgacatctttagcctgcccgctcatgctctctaccttttttctgtatcaaaatgcctttgtttgcaagtaacagaaggcctgacttaacctgcctttaaacagtaaggacacaagtatgcctatgttattagaggtctgcaggtaaggcacgtaaagggtcatctttttccagtgtcttcaactccatttctctgaggttccatcagctacattctgtgccatgactttatcctcagtgcatttttcagatggtaatcaaatggctgtaacatgttcacctctagctcagcatgatactcagaggaagaatagagttgcttctaggagttttgtgatgagaatgagggaatttctttccctggagcctccagcaagcttgtcattaagtacctcctcaggtttctggctcgagttgcatctcatgcacacctctcaatctatccctgtggcagagaatgtctcttattgaaaaaatggcctgggtttgcctgtctctgaactaacactgcatcaggagaatgggattgccttgatcacccaagatcagtgattctcaaagtgtggtttatggagcagcatgacctgggcacttgttagaaatggagtttttctggccccaccccagacctactgaataagaatctctgtgctctgtgcatggagtggggcccactcatctgtggtttaacaagccttccaggtgattctggcacatgttaaagtttgaggacccctggccaagactagtaaggatctagttctggagctgaagtcagtcccatcaaatataatatatggtggagggtagggtgcgacaaggggtatttcggggagacaaccacagtgaccactgcacctttatagcactcatcacaatttgtaattatgcatttgtttgtgtcattatttgtgtaatatctgtctcccccaacaacactctaaactctacaatgacagggactcagtctagcttgtcagagtagcctcaataccggctatagaacctgctttatatatgctgagcgttcaataagttcttgatgaaaaagtaatagaagatatttcttgtgcctctcagttctgtcatcagttggttccgttccatttgtttctctcacagtcgggggtgatatgtgtgtgcacgcctacctcagcgggcagcccttggaggaatcacagctgagcatgctggcctgcttcctcgtctaccactctgtgccagctccacagcacctgccacctataggactagaaggtaattgcatatctaagtcttatcttcagtacctctgttacctacccctttacgttctagtttctcagtagttactgcccctagtttgactttcctcttcattaatgttgcagtgtcattgttagggactgttttggagcaaaaaagaaaaaattatcaactttatatatgaataactttcatttttattcagaaaaggatggattcttcttcacagagccccaaacactgatctatactaataaactaaatattccatattattctttactaattgatttttttattaaagctatttttctttattttctaggttttcagttgggttttttagaatcacatataatcttaatttctaatattacaaagctttacaactaataaatacctaattttgtgtttgaatttttttataatagttttaaaaattaatagtattatcacctgattgtatttttcagaatacagaaacagataaaaaaaatttatccattaagctgaatactaagatatgatgaattctaagcacccaatttttctgagattctcaaaaaaaatattttctgataagggcaaagattgttccatttaatcatttaaacttgaagtttaattacattactagttttttgctgttttgcaagcctctgataaaagtttactatctagagacttctggttatggccatgatggaattgcttgtattggactcacttgccctcaaaaacaaatataaaagctaaaaaaaaaaaaaataagaaaagggaagtacaacagggagagctttatattcaccctagcttctcccccaaaggcatttgccagttcatagtacaagaagtagagtgccagcaaaaagcagcaatgctgcagggctgaggagccagaggttgggtttgtgattgcccaagagcctagaacttgaggaacacagtctcaggcaggagagaacgatagaaatcataactcagactctggatatacctttcccttgagttacttaatgatattttagccttcatatacatgggataagacttcaagagatctagcagaagccacaaggccaaaaatgtaagcaaaaatgtcagcagcagcataggactgaggagacaaagggtggaattcaacgcttgttaaagtgaagtggctctgatcagcatcccagctcctcaggtgaattaatacatggccaagccctaagcctgctctagcctaattttagatctggtctgcttcagtttcactccaagcagacttgacctacaattagcctagagcagaactaaggtgatctgtgtgctttctccccacctgacagaagaaaatgtaaccttcataggagaaagaaaacatacccagagcccccacaatttttagtctacaggattcagtgttgaatcaaaaattatgaaacataataataataaaaaaacagataatagaaacagacttatgtgtgattcagatattggagttatcatactggaacttaaaataactatgtctaatgtttccaggaaaatagaaggaatgatagggaatttcaccagaaacctggggtcaataaaaaagagttaaatggaaattctagaactgaaaaatatagtaactgaaatgaagatctcagtattggattatttgaagtgaactggaagacacttatctgctggaagacaagtagaaagtaaacaaactgaagcacagagggaagaatggttaggaaatacagagaagagtacaagagacatgtggaaaccgtgaaaaaaaaaataaacatgcatggggttggaataagagaataagaggagagaaaaaatgagttagaagcaatatttgaagagacagaagctaagaattttgaaaaatggtgttaaatattaacccacagtgaaccctaagcaggataaatacaaagaaaaccatacctagtcacattaatagtcaaactactaaaaggaaaaggaagacattttaaaagtatagacttcttttcaggccaggctggacaaacagggttgttcaatggtcaactgtattagaaccagtaaaataccacttagatagtatttgaaggtagacaggcacttttgcacattatatttaaagaatttatatatatatatatatatatatatataaaattaaacaatattagtagtttcacatgtagttataggtcactttctgaagtctagaatgggtaaattctatcaaatcatatacaggtttgagtatccttaatctgaaatctgaagtgtttgaaatcgaaaacgttttgagcaccaacatgatgctcagaggaaatgttcattacagcattttggatttgggatttttggattaagaatgctcagccgaggctgggcgcagtggctcatgcctgtaatcccagcactttgggaggccgaggccggcggatcacgaggtcaggagatcgagaccatcctggctaacacgttgaaaccccatctctactaaaaatacaaaaaaaattagctgggcgtggtggtgggcacctgtagtcccagctactcggggggctgaggcaggagaatgggtgaacccaggaggtggagtttgcagtgagccgagagagcgccactgcactccagccccggtggcaaagtgagacttcgtctccaaaaaaaaaaagaattctcagccagtaggtgtaatgcagatattccaaaatctaaaaaaatccagaatccaaaacacctctctcttcggaagcattttggaaaagggatactcaatttacattacagtgtattaaggaatttcataattttaaatattgtctttgcatagtcattttcaaagggaaaaatgcctgttttaaacatgattgtgtttctgaagcttccttgaaaggagaggtatggctgaatttatttagagatgtgaccttcccaccccatttccattttagggagcacaagctttgctgaactgctcttcaaatttaagcagctaaaaatgccagtgcgagctttgctgagattggctcctttgcttcttggaaatccacagccaatggtgatgtgaccgtgtctggcggtgaacctaccctgaaacgtgacttctgcacaaaaaacgtgaccaaacatcaaagctaaagcaatgtttataaagttttatggtataactagggggaaatgagctgcacaaacctcaatgtattttaaatctgttgctgtcatcattaacggtatatgacatataaaagcaagttaaaatttacttttgtaaataaagtttttggtttgtttccaaaactcttgatgattgctttagttttggacttagagaatagagcaggggttgctggagtgaatattgatttttaaagtctttgaactgtggtggtataggtgaagtgactaagcccaaaaatgccaagttttaaaagaagctatgtcataaagttttactttctgtggcaaaagagcgctttagcatttcctcagatgtcacagttgtcctgtctaaaataagtttgtacttctggtgacaatgccagacactcttatgatgtgatcaccttaaacaggagaaggagatttttgccctcagttgctcaacatgaagtactgtggactgaattgtgtcctcccagaattatatattgaggccctaatccctgtgtgactgtattaggcaatagggcatataggagattactaaggttaagtgaggtcatcataagggtggggccttaattcagtagaattggtggcctcctaagcagaggaagagagatttttctttctctctctgccatgtgaagacagtgaggagtcggccgtctgcaagccaagaagagcccttatcaggaacagacttggctagcaccttgatcgtggacctccagcctccaaaattgcgagaaaatacatttccgtcgttgaaaccacccagtctgtggtattttgttatggcagcccaggcagactaatacgtgaagcctgctctaaatagataaaataagaaattactacagagggctctttagaaattgtatttaaaaacaagacaatccatatttacctaagatttacagaacgtatgtctgtaaaaggagggatttctggactagatgatggtgaaaaatgttcatataaaggcacctccagcttcgagttgccaacacaggaggaagaatgctccctgctgttcagatgctgatatgtgtcctgtgcttcctggatggccagtgggatcataagctggtagaagcaagatcttcatccactgacttcatatttcttccacatcctgaactgtggtgtttgactttaaaaataaattaaagcaaatagaaatgtttccattgagattttggcaaaaacccacatgacatttgcgtctgcagagtagacttggaaggcatgcacctggaggccaagtggtattctctggactctctgtccttgcatttgcgtggctgccccgaggactcccttcttcctggatgtgaagcagaggcacggtggggctgactgagaggctgaaatgtgcttctcttcacagttacatagttttcttctaattaaaaataaattttaagtggtagattatgaaaattccatttgaatcaagattttaaaaattcaatatcaaaccagttgttactgtcttcactctccgttgtttacgattgtgtgcttttccctgaataaagaatgactggagagacattagttgtttgcacacatattaactcatacctaagggagaacagcttttagaacattgtcgatgaaagcaaatatcagctttaaaagagagaggacagaaagactgcagatggtctggaagcagcatttttaggccatctgattagctagcagggagcaaaggggaggctgggaagtcagcccttgagtaggcctgctggatcatcaaataaatcaattgcagctatttttggggcctcaaaaaatcctgagggtatggctctcaccatccagaacctgcagcctccttagagccatggctcaaagggaagtgctgcagaaaaacatttggctgttaagtgttttggcccaaaaatagcacacatcatttcctgttaaagcctgttggcccgaagtagtcacactgctctacctcatgtgcccaggactgggaggagaggcagacgctggtgaggatcttatgccagttacatcatggttcctaacttactaattccctgtgcccatcttttctacttagatagatagaaataggtatcatcgcttccatagacataattaaagaaaccatacaatttacacatacactcagagtggtggttctttccccagtagacgctgacatctgcgttcctcccttgcaggtcttctgaaggacctagcaggagactcaggttgaaaccctacagaacctcgccgtgtgccgccgagtcttccttgaataaggccattttctcaccctttgtctagtaactagctgactccacagctcatggtaaggggcatgtctcagctcagggggtctcctgacatcccagaggaagcaataaggtgggggtctttcatctctcagcctgatgatctgtgcacacccacttggtgggaggccagggtgcctgtgggcagatgggtcagagtgtgggccaggatttggagtagaagccagagcatgtgaaaatccaaaccaggaagacttcgttgcctcccgcatgcggggttgaaggcctctcttctgtggtctcccatcctcatgctgatcaaattgggggggaatgtctcactgtgtgaggatcaccccaattaagctgtgggggaggacacagaatctgatcccctctgtatccttagcgcatgctacctccagccaccaggggaaagaagcagaggtgaggtgggagaggtggccactctggacggtgtaactgggctggctgcctctcagcgcccacgagcaccccacagatatccacgctagtgtacaaaggttcccaagtggtggccttttcctgcttccaagggctgcccgggttcccccctctctgaaatagattggttgcttctcattacatcacaagctgcagaaaaaaaatttaaataaaaagcctctacagctgtgtccttaactcttacctgtggataaggatggacttgcctgcccaacatcctctatcttatgtctttgggtgaaagggaagctggaatgggcagtaggggctgcttggggcagtcaggaccttcaggcttcaggcaaggagacccactgatcagacacctgcatcaaatattggtgctgacagatcccttagatggcaccggtcctgcccctcctacagtgagatccctgtggctcagggagggaggttgactgccccaaagcacccatcacaaccctaatgaagctgactttcaaccacacttcctatactccaccctgaaccgggtccagtactgcctgcattcccagtccagcagactcttaggagaaagcagtgattaaatgtaagttaaaaggacttggcaccaggaagagtttatgaacacatttgagaagcagacatactaactcttctttacacctttggaaaagcaaaggctttgtgtaattggaatttgattaactgaattaatctatgtgttgctttcttggtcacattataacaaccaccttaatctacatttttttctcatagctaaaaagatttattcctatttcatatggtacattattatatgaaatcttaaaataagttattgattgattgaagcagagtctccctctgttgcccaggctggcatcagtgacatgaccatagctcactccagctcactgcaggctcaactttctgggttcaagcgatcctcctgcctcagcctcctgagtaaatgggactacaggtgcataccaccacacccagctaaatttttaaaatttttgtagagatgaagtattgctatggtgccgtctggtctcagactcctggcctcaggtgattctcctgccttggcctcccaaagtgctaggattacaggtatgagccactgcacccagcctaaaataaaatttttatactaaattcaataaaatatataaataactggaaagtcttaattctcagtgcttgccttgtctctgtagttaagggacctgtcacactcaggcactcttccttgtgatgctgtaggccatgtgctttaagaactcaggcacactagctcattaggggagcttaacataaggatggaggttggaagctagttggtgccactcgtgtttctttcatttgtcttacgttcgtttttgtgcatatcaagaatattttagaccaggcgtggtggctcacgcctgtaatcccagcactttggaaggccaaggtgggcggatcacctgaggtcaggagtttgggaccagcctggccaacatggcaaaaccccgtctctactaaaatatatatatatatatatatatatatatatatatatatataaattagccaggtgtggtggcacatgcctgtaatcccagctactcgggaggctaaggcaggagaatcacttgaaccagggaggcagagattgcagtgagccgagatcatgccattgcacttcagcctgggtgacagaggaagactccatctcaaaaaataagaatattgtaagtgctgcttactgtaccaattcagaaattagggcagtttcatcagctggaaatgtggataaatgtatgcaactctaaagttgaaggaagatgcgttagcaaatccatcatggttagcatccctagctgccatctgcctgccccgttggatctagagaagatgaggtcaaacctttctcactccatgttctatgcaaatttctgcaaatccacagagcagggtgtaggtgctgtctccaatgtcacttccctccaaactccctgctctgttgcactaattcatttgtggttcatctcactgtgccccatgcgtgggctgaatgtcagtcagcttggcatcttcactgcctccttttgtctctccttagcttccagctgttttccctatgtagtgtcagatgagagtcttccagtgggagatgcccatgcagggcctggaggatagaggaggaggtgaagcctttactctcctgcactggctacagcagacacagggcagatggcatactcctgactgcaggaagctaataccagctgtggcaggtgtcaccactcctgagtttctggaagtttacaggagcttctctgtcctctgcttccttcattttcctgtttggatctctgagcaaaatccatgaccccttgagggatgcaatgctcagatgtaaagtcgtccccatcctcgagtcccaccaaaaccacccactgccactcagggactaggctttgcttctagaatttctagccctctggttacctcctctgagctcccagtgctgttcacttttccattctcaaatcctcagttgttctctaaaatgccagaatttctttgcaatttcctaacccctgaacaaactcacctgggtggcaccaatctcaaagctgcagcagtgggtctcactatgctttcagtacaaccttacataagttcagagaaagcctggactgaggaaatgaaaacctgccctgctgctcatcaggctggtgattctttatccaatccactggtggtgagcccgtgggttgattccatgtctctgctattgtgaatagtgctgggatgaacacgtgagtgcacgtgtctttttgatagaacaatttattttctgttagatagatatactcagtaatgggattgctgggtcacatggcagttctcttttacgttctctgagaaatctccacactgctttccacagtggctgaactaattgacactctcaccagcagtgtgtaagtgatcccttttctctgcagccttcccagcatgtgtcattgttttacttttttaaaaaacaatagccattctaactggggtgagatggtctttcattgtggttttggtttgtatttctctgatgattagtgattagtgatattgagaatattttcgtgtttgttgactgcttgtatgtcttcttttagaagtgtctgtgcgtgtcctttgcccactttttaatggagttgttttttgcttgttgatttaagttcactgcttctttgttgtgggagggggaaggcggggatgggcgggagctacaagaaaagaggcatcccctcagacactgggttaaagaaggaagaggctctattcagctgggagcattggcagacttgcgtctcaagaaccgagctctctgaagaaagagttcctggcccttttaagggcttacaactctaaggggtccacgtgaaagggtcatgatagattaagatctatagatagcacatgtggttagagtgcggggttaatctttttcagcttttacttcctccttctcttcagagacaggagacagtaagagaaatggcctctctcctcattcccccctttgagaacctcactcactagtgggagttctcactttcatcttcactatccaggtcttcctgagagacagctgaggtcttttgatgaactaaggtggtaacggagcctcttagtgactggagaaatatgggtaatgtacaggggagtaacatgcaggttcctaatactattattattcctattataagagttttaaatcctcctagagctggaaaccattttccaaacaggaatccaggatcaagcctatgccaaacctgcacgggcacatgtgccagctttgtcatgtctctaactatcctcatgcttcggctatgcatggaccagtcagcttctgagtgtgactggagcagggcttgtcgtcttcttcagagtcactatgcaggtgttgtccgggcttggtctcgcctcccaagtctcagttggccgggagcgtccgcagacttgtgtctcaagaactgagctctcatcttttccttgaatgacctgagagactttgttaacatttgtggccttctgagctcccttctttaacccttccagaagggcttccctgtatgggtttagcctttgcataccctgtctttcatttgggtcccagtgggggtctgttcctggtaattggatcctcacatacttttgggggttttggtaatcagctggaacatgttcttccacccacttagttgctgcttggagcactctcctttcatctgtgttaaagaggtacatgagcaactggtggcaatcagctcaggtggggttgtgggtctggataatagtttggagcaaaccaattatagcttgaggcttttcagtataggatggggtattgtttttcagtataggatggggtattgtttttccaattgaggagatcgacagaggtgaagggtttgtacacaaaggcatgcctttccactatatgcccatcctcatctacccagtatactgttgctttctcatgggcatttgtatcccagttctaggcctcaaatgggctgccaagggaggggtttctcctgaggtctcacatcctgtcttttctaccctgggtggcctaggggtatgtaggccttgggaagctcaggcgcagtggcctcaggagtgggaggccttcattcttggtgaaacggggggccactggtgccatttcttgccatgaatcttctgatgttgggtcggacaggacttcaggagctgactcccctcagcgggtggagcaggattcttctttggctgtctgtccctttgctactagtactgctgctgcctgtcctcttaacgactgtggggggtctaaaaccagctgtaaccaagtgtctatgtacggaaactggtctgggtgtcctggcttaccagttaccttgtgccatacctttgaaacaaggggccagtctaggcttccttctgatggccaacctacttctaatgctggccagtctatctcacacaaagttctaagttttcctggtgtcatagtaactccatagtccccattaaatcctttcttgaaatttttcaacatagttcctagtggagtgggcttactttgcgttccacccatcttcctcctgagacaaaacaacactcacaccacaagaaggaaagtctgaaggggtcactcactcatcttgcctgtctcaaactcaagcactcattcactttcactttcctttttgcaaacaagttaagccaaatcaaaatcaatattgagatcaaagtgccaattgcaatcaagtcaagtcaaatcaaaatcaatactgagatcaaagtgctgataagggcacattgtgggtgatcaggcgacacttccactcaaatggagcgggcaaattcccaggactggtcctactgtattccagatgtccagactccaagtgccggttccttcccggtgttcagctgctgcattgatcctccatggggccctgccgtgcactgctgtgatgaggcattccaccagggcaaatgcctacccggcagtgctctcaggatctgcattgctcaagctggctggagtcccccacagggatgctccgcagggcaggccaaagctgcctaaggggctccctcaactgtccattaatcacctcacttctgggtcagggaaccaagaaatgtagcaggacaagccgcagacaaaacccctcagacaccgggttaaagaaggaagaggctttattcagccgggagcattggccgacttgtgtctcaagaactgagctctcatcttttccttgaatgacctcaaagactttgttaacatttgtggccgtctgagctcccttctttaaccaggtgtctgaggggttttgtctgcagctcgtcctgctacagtgacacttagcctcagtctcatttccagtagggtcaaactgatgacctgacatacttattttctgtgctctcagctgtgtctaaatatccctgtgaaccactataaattcatgggcaatcaagcgtggcccaaaaatatgaccagagtggcgcaaacctgcctacaatagcccttgaagctgattgaggcagtgcctagatgccctgcaagaaggctggtgacacctacccctgtctgaggcatcttcctcatgtctggtagatgctctcttcctgctcctcccccattgtccctggggctcctcaaggctctcgaggcagccactgatggccaggttctctgtgggagttggctctcctgtcagccctccttccttctctcttttgcccacattccctcctctcctgtcttcccccaaaattcaaaaactgtttttattcctgctgcatccccaatcattcatctggagactcacaggtggtcccttccccatcccctgagactccttgggagaagatagttcaggatccgagacttggtctagtacaggaatgagtgatagccaccctgagtgagtgccttcatggctctctggagttccaggcccttgaagcggagcttacacttacccagagtgcagcccatgacagtgtgaaagagcactggctgtagccaagcgttagggaccaaatgcttccaagattccagagcgttggtctagattcactgatgtcatcacatcattccacgaggaatggctctttggtttataaaaggcactcaaggaaaaggccatgagcctcacagggaagggggttagtgtcccagcccgaatgctggagtcacctgctcttaccccaacatgaccttcacgtggggcctcatcttgtgttcaatcaaatccattaatgatttcaaatgaaaatgttacattcacatagcagaaaattgagaatatgcaaaattaaaagttgattaacctctcatctatactacaaagttacaaatattgtttatttttattgccttatttgtgtttagtatcatattaaaatttaaaaatgtaagctttaatattttgagataatcatagattcacatgtgattgtaagaagtaacacagaggggctctagatacccctcatcaaaatttctccagtggtaacaacttgcataactatagttcaatatcacaataggaaattgagtttggtacaatccattgacattgttcagatttcatcagtcttatatacacttgctagtgtgtgtgcattttgttctatgcaattttatctcatgtatacacttgtgtgaccaccaccaagttacagaacagttgtattataagaatacttcctattactttttttagaacttcatcttccctaatccctggcaaccactaatctttacaaccttataattttgttatttgaacaatattgaccaggcatggtggctcacgcctctaatccgggcactttgggaggtcaaggtgggcggatcacttgagctcaggggtttgaaaccagcctgggcaacatgttgaaaccccatctctacagaaaatacaaaaattagccaggcgtggtggtgtgcacctgtagtccgagctacttgtagagccgagttgggagaatcacttgagcccaggaggtcaagcctgcaatgatctgtgtttgtactattactggtggtgaatccacgtgggtctgcagcaacctcagttcttgcctcctcagaagaaagaattcgactgaagagcataaggcagaagaagagactggggcaaattttagagcaggagtaaaagtttattaaaaagctttagagaaggaacaaaaggaaggaaagaacacttggaagaggcccaagtgggcgacttgaaggacaaaagtgcagggtttgttggggtttggtatgcaggcatacttctggggttttgtgttccttctcccctgattctttctttggggtgggctgtctgcatgcacagtggcctgctagcgcttgtgagaggagcatgtgcagtgtgctgactggagttgtatgcatgctcacctgaggcattcttcccttaccagctgaatgcccctaggaggtcatacaccagttaaactctgccatcttgcctcttagtctgcatgtgtgagcctacttgttcaactcctgagattttactgggaagctactgatcaccaggttcaggtgttttctatttatcaggaaactgcctttctctggcactggctgtaaccaattattattttagagagacagttaacaactgcttgaccatcacctggtggttgcctaacattcctggtttggggttgtgaggggctctctcctgccctgctcagacctgaccagctacctactataacagcaccactgcactccaccctgggtgacaaagcaatcctgtctcaaaacaaaaagaaaacaaaaatgaaaagcccccagtattacctaaatggaaccagccagtatataatctgggattggtgtttttcacttagcgtaattcctgatatccagccaagttgttgcatgaatcaatagttaattcatttttattgcctagtggtgctcccagtcatatgataagggcacattgactttgtaagaagctgccatactttgttctagagtggtcctgccattgtacatgcctgccagcagtgtctgagtgatccattttctccgcattgacagtgtttggtgttatcattattttctagtttaaccatataagactgtggttttaactgaagtatcttttcaataacatcacacagttggcaaataatgtttatcctttgcccatgtcttctcattattgagccataatttttaaagatattttattgggtaaacatatttacataacagtaaatgccttaattgtctttgtatattctaaatataatttctttatcatttatatggcttgcaaatattttctcccattctgtattttttttttttttttgagacggagtctcgctctgtcacccaggctggagtgcagtggtgagatctcggctcgctgtaacctctgcctccggtattcaagcaattctcctgcctcagcctcctgagtagctgggactacaggtgcatgccaccacacttggctaatttttgtattttcagtagagatggggtttcaccatgttggtcaggctggtctcaagttcctgatctcaagtgatctgcctgccttggtctcccagagtgctggtattacaggcgtgagccaccacgcctagccctgtctcttccttccttccttccttccttccttccttccttcctttcttcctttctctttctttctctttctttccttctttctccttccttcctttccttttctttctttcttcttcattctttctttctttctttctttctttctttctttctttctttctttctttctttctgtctctttctttctttgtctgtcttcttttctttctttccatctctctctccttccttccttcctttcctttcttccctccccttccctcccttcccctcctccctcccctcccctcccctctctcctcacttcccctcccctcttctcttctcttcttttttctttctctcactacattgcccaggctggagtgcaggaacctagattcaaagatacaattttagcactctgtaaccttgaactcctggcctcaagtgatcctcccacctcagcctcctgagtagctaggactataggcccatgccacaatgcccagctcaaggagtgatactttgtcttgtgcatcctctgtcttgcctttccacttagctatggcctggctagagttcttaatgagagaagtctgctataatcctttctcccaaagagcctcctttatacactacatggtcactttcttccatatacgagagaagagtaagcttgctctctcacatcatcattaccaaatctcagctgggcaattaaaggaaatacttggatatttacttatccaaatacttggacaatttccaaagtagaattatcacagttttggctttgagaaagaacttggtattattgcaggtattttgggaacacttatataatattttctattatacttcttgagaggggttggttatttagtgacatgaattaaggcattataatattaaagaatggggcatcaatttcattggtaagtttcctcttcagcagaaaagagataagaatgttcatttatgcataaaagaacttgtcaaatgctttttttttcccatcagttaatatgatcatgtaatttttcctccttagtctgttgatatggtgaattacactgattgcttttcaaattttgagtcagccttatatccctggaataacttagtcatggttaagaaaaaatatatattgctgaattttatttgttgacattttgttaaagatttttatatatatcttcatgacaaatattggtctgtaatttttaaaataccgtttttatctggttttggtatgaggttaatattagtttcataaaataaattaggaagtattccctgactttttttttgtaagagattttgtaaacttggtgtttaaacttttaaaaacatttgttagaattctcgagggaagttatctgaatctagagatttcttttatgtcagttttacaattacaaattcaatttcttaaattatctatttcatcttgagtgagttgtggcagtttgtaagtttcaaagaagtagttcatatatctaagttgacaaatttgtttgtagagttgtttatagtattcccttattatcatttaatgttttaaatatctatatcccctctttcattcatgatattgataatttgtctttgttttctttgttagatttgctagaggtttattttattaatcttttaaaataatcaactcgttgtttcattgattctctactgtgtttctggtttcaattatattagtttctgctctttactatttccttccttctttctgttttggttttcttatatttatttattttagagacaaggtttgctctgtcatccaggctggagtgcatgattatagctccctgtaaccttgaactactggactgaagcaatcctcccacctcatcctcctgagtagctaggactacaggtgcatgctgccacacctggctaatgttctttattttttgtagagatggagtcttgctatgttgcccagtctgatcccaaactcctggactcaagcagttgtcccagttctgcctcccaaatcactgggattctaggtgtgaggcaccttgcccggcctgttttggttttattttgatctttttctaatttttaaaggtggaaacttagattattgatttgagacttttcttttcttatgtaagtatttaatgctgtgaattttcctcttagcactgctttgggtacatttcacaaattttatgtgatagtttcattttcattcagttctatgtattttaaaaattttctgagaaattgagaactttctttttgacccatggattacttataattgtgttgtatagttttaaagtgtttgaagatttttcatatgtctttctgttattgatttctagtttgattccattatggtatgaaaatatactctgtatgatttcaattttaattttgttgagatttgttttatggccctggatatggtctatcttgataaatgttttgtgaacatttgaaaagataatgtgtgctgtctgatgtcactggggcaatgttctacaaatctcaattatattcttttcattgacactgtttttgtgttcttctaaatccttgctgattttctgcctagttgttcttttttattatcactttttatttctttatttggtggttttgcctagttgttctatcagttgttgagagagagtgttgaaattttcaactataatgtgatttctctctttctccttttggttctatcagtttttgctttacatattttgcagctctgttatttgatgcatgtacatttaagattgctatgtcttcctggtagattgactcttatcattatgtaatatccctttatgtctctgataatctttttgctctgaagtctgctttatctgatattaatagcaactcctgctttgttttgactgatggttacatggtaacatggtatatatttttctcatccgtgtatgttgaacttacttatattcttatatttgaagttaatttcatatggatagcatatagttgggtcatgatttttaatccactctgccagtttctgttttttaataggtctatttagacaatttacatttaatataagtatgagatattaaggctaagtctgccattttatctatctgtgcttatttgtgtgtttatctcttttttttctctgttttatcttccttgctttcctgtggattgcttgaaaatattttataattccattttgacttatagtgttttttaagtgtatttccttgtatcaattttttagtggttgctctaggtgctacatcctgtacatgtaactcaggaaagtctatttgagttgatgttttatcagttcgaataaagtgtagaaacttcatctccctttagataactttaccctatcacattgataatataattatcttaaatagtttctttctatatctcgagaagtatattagacaatgttataatttttgcatcaaccatcatagtttagaaaacttgagaagctaagtgtagcatatatttacccttattttttctctttttgtcctttcttactttctgctattagaagattctttctatcatcatttcctatccatctcaagaaatttccttagttattcttttagggtaggtctgttggcaataaatcctgtttgttttcctttatttgacaatatgttgattttccctgcattcctaaaggatatttgtgctagatatagaattaggggttgacaggtcttttctttcattacttgaaaaaaatctgtcacctctagtctctgttgtttctgatgagaaacacattgtcatttgaattgttttcctcttataggtaaaatgtcatttcaatgttttcaagatttcttcctttagtttcagaattgtgattataatgtgtcttagcacagattcttttgagtttgggatttggaatttgctcagctactcgaatctgtagctttttgtcaaatttgtcatttttcaaccattgtttctttgaatactttttaagccccatactctttctcctctttttcttggtttttgatcatgcaaatgctagaccttataaaaatagtcccatggatccctgaagctctttccccctgccttagtatatattctttttctggctcagattgggtaccttctatttttctatattcaagtccattgattcttttctctatcctcttgtttctgttcttcagccatattgctaaaatatttattttgtttattgtatttttttcaattctaaaatttctatgtggttcttttcaatatcttttttgctgagacgtttttattctttcatttgtttcaagcattttcataattgctcactgaagcttttctattttagcgagtgttctttgacattgtgttggcagaggggaaaagggcattgccttcttagtgccagatgggagtggaagtccaggttacccatttggcaccattgacacctatgctgggaaggggttccttgttactgctaggtagaggtcagagtctaagatttccatgtagctttcaccaacactactgagggggaagggcatgcttcattaatgccaggcatgaatgaaattcctggatctcatctggttttgtccaacaccattctggctggcgtgggatgggtagggtgctttgttgtagccaggagaggatgcaagtctagattctccactcagcctttgctaacaagtgtggggctggagtcacatttttttcatggtgtttggctgggggtgcttatgttgtagacagaagttttctgccttgttaggctgacttttttctggtcctttggctggggaagcttttcttggggccttttttttttttggctgtgcctgttggtatttctaggttgctgcttctctggcacccagtttgagacataagaagccaaaaagaggccaggcacaatggctcacacctgtaatcccagcactttgggaggccaaggtgggctgatcacttgaggtcaggagttcaagaccagcctggccaacatggtgaaaccccatctctactatagatacaaacattagccaggcatggtggcaggcacctgtaatctcagctatttgggaggctgaggcagaagaattgcttgaattcaggaggtggagattggagtgagctgagatcacaccactgctgtgctccagcctggatgacggagtgagtgagactctgtctaaaaaaaagaagccaatcagagaacttataaccatgtcattcatttcttatgtcctgggatccttattcagtttgtcttctttccatatttcaaagtctttcatgcttcatatataatgtccagtgtttttgcagcacttagaaggaggaatagagagaaatttatctactccatcttgtccataaccagaggttcaagagagtaattttattttgccattaaattttgagtgtctagaggccattactgttagcaaactttcttcaacagagggagtgtttaccctgaaagctgcatttatataaaaaataaggtaccaaaaaattaggaagaaaaatgcaacctgagagtatgtgataacttcatgtacacttcttttctcttttatttgttcactattatacctaaaagttatgagaatagagaataacattaataacgttctgacaatccttggaattctaagagaatataagacatccctctcttattttaagaaagcatggaatactgatcagcaaaaaaagaaacgacttgggtggatatcaagggaattattctgagtaaaaaaatctttgagggttatatgctgcatgattccatttatatagcattattgaagtgacaaatttatggaggtcgagaacagatttgtagctgccagtttagggaagagggtagggagagggatggctgtggctatgaaagaaatagcatgaggattccttgtactgtgttatctgtggtggtggtggtcatacaaatctacacataataaaactgcatagacacacacacatactggagtgcatgtaaaagtggtgaaatatcaatagacgaaaggattgtatcaatggcaattttgtggttgaggccagacactacccagagacttcagtgaccctcccctgctggtgatattgtactatatagtcctgcaagttttcaccattggggaaactgggtgaagggtgtatgggagtctctctagtgtttcttataactgtatgtgtcagtctacaatgaattcaaaagaaaaaagttttaaaaagcaaagcaaagcattttgctattttgtactttcttcctctgcagactgccctactcacttccctggtgcaaagaggaaatggacagtctaatgtggcttctgcttaatagtctcttgtgtgcatagagaacctgttttttcccaattgtgtaagagttggttgttcttttctccatgaactattgtttgggctttgagtgagtgaggggagatttggtcctattctggagttacaagagggagaatctgacttatgtaggcaccattggtttccactgctgtccttaatgcccttctgaataagccaggtgattttctctgcacagtcctgaggctacatccactgagactggctctgtacaaagatgctaaacgccagacactccccagatacctctgtgccccctcccctattgatggagagcagaagagatatgagtctttcacggaggctgacatcacatgcagactttggcctcaagtctttgtcacttgccaaggacagaagaaataccgtgaactagaaagcttttgtgagtataaggaggagaaaaaaattagccagagttgcaagatgctttatgttgtttcaagtttgttctcatctctaaaggtaaactataggacccacctgctggggcaggtagatgagataatcctgcattagtgaactgtagcatctgactttcatagagaatggttttcttagtagaaattggggcgcaaaaaaatgaatgcagttatgggaactttgcgatgagatgcaaaatatctgggtagaaagcagataaattaccctcatgtatgtattttagtataaagtggacatgattactaggtaaaatgcacagaatttctcagttttcattgatggtatgaaatgtctcacactcaaatgtcagtaagggccagaagaaaatgtaaatataaggagttagtggataaacaataatagaaagtatggggcattgtcaataaactggagatcttggattcaatatgaatgttttcaaattcaaatttttaaacattgtgatggctggataatcacatctgaccacagatggtcagcagctgcttcaatataagttgtgcttggcttttctacatcatgaacccggaaattaagcttttctgtatataacaaaagcacaaatatcaatggcgtaaacaagattaggtcacctgcttctcgttaggatgtagaaagacatgaaaactttcctcctgtggtgatgacaagaatgaaccacataagaatcgtacgttcatggggctttcaaagattggaagatgtaaggaagctctgatgaactgaattgtagagggcgcgccctctagatgagccgagaccctggagctctctggggcaagtgcctgaatgagttcaggtgggaaaagtagcagctgcctacaggcaggaggctttgcagggttaagaaggagcatcctgcgtcaggggcaacatgtggctctggaggagttccaaatgcaaatatccatctctcagcccaacaactctcttccttacctggaattttgctgggaaagtggcattggagaaggggttggtagcagggagaatacagacagccttacacatctctgtgaggcttgggttctggagccctgcagaaggtgaacctaaaggtgaatccaaactgtctgaaacagtagccactccccagcttccaaacatgaagaaaaggtaagaatcctttaattatagcaatgcaagaggctggggttgggctaccagagtttcttacattagatgtaaagtggtatgatatgaattcaagatagagattgccagactggataaaaaagcaagaccaaaccatacagtatttacaaagatacactttaaatatgacacagatacattgaaagtaaatggatggaaaaggaaaaacatggtaatgtccagactcaatgtgagagggaactcacacagaggtgtggctgattttggcattgggaggtgtgactcattggcattgggaggcatgggccattggcactgggaggtatggtccattggtactggaaggcatggcccattaggactgggagttattgaacattgggactgggaggtacggctcaatggcactgggaagcatggaccattggtgggaaccatggctcactgcactgggagatgtggaccattggctgggaggtgcagctcattgccctgggaggtgtggaccattgcacgaggaagcatggaccattgcactgggaggtgcagctcattgccctgggaggtgtggaccactgcactgggaggtgtggccactgcactgggaggtgtggactattgccctgggaggtgcggaccatagcactgggaggtgcaggttattgccctgggaggcatggatccttgaactgggatgcgtggaccattgcagtgggaggtgtgggctactgggggccatgtggcatttgagttatggcagaatgggtctgggaaagagaattctgggctaagagagtcttccgttctttcttgtttcctcctctggaaatggctacctcttcttcctcaaaggaagctgaggaatgtctgcagcaggcaggctgtgtggggacttctagaccacaaaggcctgtctctgtgacagcttaggcctggtggggtgttcatggctgtgaacaccccggagagaacatggctgtggtctttaccagccctccattcctcttcccctcatagatctgtgagagaaaaggaaaatggatgtgttccttcgttttaggtagaagggctttgaggactggagaacgcctagggagaaaggggtgatcaaaatataccgttgttccaggatgtaattataaaaaactgggctccaaatatgaattcaggaatacttggtccccgtgccaatgcagccaagcccctgcacggtgtgggagcaactcctggggttggtgggaggcctggctgatgcatgatgggtctgaaaaccgctcaggctttgccaggtatgtgtcaggcactgatggcggcgatcggaccggcctaggttggcttagcgcgccctctagtgggagaaggtctaaagagcaaaatgtgagcatccttgccacagggcagaaatgatgctgaacgtgcacgccacatcaaaggacatacgtgcttaagggacttgtgcttaacaattactgtgattagtccgttctcacgctgctctaaggacacacccgagactgggtaatttataaaggtgttttaatagactcacaattccacatggctggggagccctcacaatcatggctgaaggcgaagaagcaaaggcacgtcttatatggtgtgtgcaggggaactgccctttataaaaccatccgatctcgtgagacttattcactatcacgagaacagcacgggaaaaacccacccccatggttcaattacctcccactgggtccctcccatgacatgtggggattgtgagagcaacaattcaagatgagatttgggtggagatagagcaaaaccatatcagtcaccatcttaaattgttaatacattggaatttgtttatgtctgttgtaaaaaaggccagtcgcttagctatttcatggcggttttgaggaattaccaccataacttatgggagagtgttttggtaaatggttacataagtatgaggaattttaattttttcattagaaataatgtgtggaatttataggacaatttattaagaagcttaaatgtatgtatggtcgttgattaatctaggtccatttctctcctagagagctgtcaatagagattgagtgtgtggtaaggcttcctcctcggtgggccttttagtgataggatggtcaagtgaggaagggctgtgctcctgcggctcctaattctgaattacatttattgggccatgcagtctggtttagtgcctgagtttatgtatgggaaatgaattccatttctacatgctgggtccttatcagagcagaaaaaagaacccacgctatgcagatacataaatgtcacccacatgaacaaggcactgtcttcagtatggcatgaagggggcagtgatgaatgggcagctggagaggggagcgtgttcagatgagacaggctggtgcagacatctggggtcaaccacagcagacactaaaatgcagtggggccgtggtgagggggatggaggggatgtgggaggtgagtgggagctgagggaagaggagtggctcagaatgcagtggggggtctgcgagaggaccagagagggaggaagcctctccttgggaagagttgggggcaggtcaggagaggttccaggtagagtcagaggtggctgggctggggtggtgaaagccacccttatcctccctgtgactcttagggtcattgcactgcttttctgcttccagatgagatggagtagcagggacggcgtttatcctttcacctgacataattaacacaggacaaaatagatgaggaaaaaaacaacaaagcgaaactgttgccatcagacagcgcagagctgtggtccctgagagggagagacagacaagaggagtgctaggatttccccagagggtgtggcctggacactttccaagctgtggcccatggatgtggctgctgtcgtggtggggtccctccggggaaatcactttgtcagtgaacagcaacatccttttctgatttttctagtaccacgcattgttttctcccattgtccaacaaaggaggcaagaatgcagtgtgccgcattcctcctgcagcagcgctccggtggcgtaccttaacctcgcttttgttttttcatgtgttggctgagtcagtgagtgtgctgtggtggacctctgccatttgtagctcctcaaatcttcagcaccctcttcacagtttgatagttccccacagtgtacctcctgccttctaatgagtctccaaatattccatttcacagccatccttgtttttgaggtgcaaacatatgatttaggtccagggatcataggcacccactcaaggctttgatcccaaacagttcccatggctggggcagagtgcggtggaggggcaggggcaggggctgacagctgtggcagaggcttcctgattcagctgcctccagatggggccagagcggctgcccctcactgcattagatctatggtatggcactgggggtctctttcttcagcattcgatttggtatgttatcttttttttttctttgatcagcttttcattatctctattcacaagtcgttataatattgctatttatcagtttaatgtaacacatatgataaaaacagatgataaaaagtatcatattaacaatgagaacattattggctgggtgcagtggttcacgcctgtaatcccagcactttgggaggccgaggagggcggatcacctgaggtcaggagtttgagaccagcctgaccaacatggagaaaccctgtctctactaaaaatacaaaattagccaggtgtggtggcacatgcctgtaattccagctgctagggagggtgaaacaggagaatcgcttgaacctgggaggcggaggttgcggtgagctgagatcgcgccattgcactccagcctgggcaataagagtgaaactccgtctcaaaaaaaaaaaaaaaaaaaaagagaacattattttacacaacccatttactgaatatgcagcctcttgcaacaataacatagtggacccaactctaccctctgaatggaccacttttatgattctcctaaaaagttttgagttggatatagtttcttgttgcttctctctgtgatccgagacttaagaatgagtctctggaaacgcagcaattggaaccagacctccccaggatcaaagaggacaggagtgggagaaaggacgcaggacacgactcccaccgtctccagcgctgcgccgtatgcttgacctcagagcatgcaggcactcaatgtcaagtgtgcagccacgtctatatcctgcatctcaagtgctcacaactgtgacaattagcagatatgggagagaggaggcatatcatggaggaatgagtcagtcccaaaaattacatgaacatttctgaaatttcaataccaagggttaacttctaaagtactagtgtataaacagaagccatatagctagccatgaactgaaatgcatgtaccatacagtgaaggagctcctgtgcatacaaaaccacccacgtctcatttatctctaattttaaaataactcattcccttgctggatatgcaagtgagtggtggagaaagaggtctatctgcaaggctggcgggggttaaggatttcattgcttccaaaagacgtgagcaagagaactttattactcactgaaggggattcttccttctcagccaagatggtcccatttaaatcacttttgaatttcctttcaagcttcaattgtgcaaattctagttgtggttgaggatcgtccccaacagctttttgagttattccttggactcttcctttttctactatgttttcatgaataattctagaatccatatttatatccagcccaaggcttctttcctatagaggtgtcgttgagttgtgagcttcaaagatctgatcatactgtttaaaagcaataggcttgggagtccagatgtcagcttctcagatccattttcacagtctgatggtgtctgctagcaattatcagtgcctgacccagaagcggtctattgcacctcagcttggaggaaaaagtgaaggcacatgcagtctgggaaaaaaagagaaaggaaggaaaaggcaggcaggcaggcaggcaggcaggaaggaaggagagaaaaagaaaggtggtaggtttctatgtactgacttggatttgtgtactgtgttccccaggcaattctaatccggactgcattcccctcaatgtctctaaagctgtcacatttgtaaatgcttactgcagaattttcttttttttcttttctttctttttttttttttttttctgagacggagtctcactctgttgcccaggctggaatgcagtggtgtaatctcagctcactgcaacctccgcccgtgggttcaagtgattcttctgtctcagcctcccgagtagctgggattacaggtacctgccactgcacctggctaatttttgtatttttttaatagagacggggtttcaccatcttggccaggctggtcttgaactcatgacctcgtgatccacctgcctctgcctcctgaagtgttgggattataggcatgagccaccgcgcccggcctgaggaattttcttaaatgaatttttaagttgtttcatatcaaaaaggtcagcatcttcacctggtcctttactcatctgaaaagcatcccaaactttcttgtgctgatgaaattgagtataaactgtgtctcaaagggctgcgtcatagggatttgcatgcttctcacacagcagaaccaagtgctgaatgagagagtcctttctctgccggaaatttaaagtctgcagttgattttcagacaaaaaatcccaggctttaggattgttgtcatttccgtcatggggatcctctttctctcttttctttctttctttctttctttctttctttctttctttctttctttctttctttctttctttctttctttcctttctttctctctctctctcttttctttctctttctctctttatttctctctttctttcctttctctttctttctttctttctctctttcttttctttctctctttctctctttatttctctctctctctttctctctgtctctctctctttctgcctttcttgcctttcttgcctgcctgcctgcctgccagcttgcctgcttgcttgcttgcttgcttgcttgcttgcttgctttctttctttctttctttctttctttctttctttctttctttcttttcttttcttttcttttcttttcttttctttcgacagggtcttgttctgtcactcagcctggagtgcagtggtgtgtgatctcagctcactgcaacctcgaccttccgggctctatcgatcctctcacctcagcctcctgagtagttgggtctacagcatgtgccaccacgcctggctaattttattttttgtagagatggggtctcactatgttgcccagtctggccttgaactcctgggctcaaatgatcttcctgccttggcctcccaaagtgctgggattacaggagtgagccatcacacccagccatgaggatgtttgagatgatcctcttaataaactcaacaacagtctcatccatctctctgtcatggcccacgtcttcagctacctctctcctcctgcatgctatctttgtcctataataaatcgttcactcctgaaacctggtagaggggattctgttgtctataacccccaccagtgcatttctatctaacggttaggaaaacctccttggctgggcacagtagctctcacctataatctcagcactttggaaggccgaggcaggcagatcacctgaggccgggagttcgagacgagtctggccaacatggtgaaaccttgtctctactaaaaatacaaaaaaatttagttggctgtggtggtgtgtgtctgtagtcccagctacttgggaggctgaggcaggagaattgcttgaacctgggaggtggaggttgcagtgagccgagatcacaccattgcactccagcctgggtgacagagtgagactctgtctcaaaaaaaaaaaagaaaagaaaagaaaggaaagctcccaactaaacactcaatggcctgctcataacaggagacacaggggaggtagtccagggtgggcgagtcagccgttcagcagcatcgtgaagaagccagttccttccaccttctactcattgttgtgcggcttcttcccctttgcgatctggtgctgcattccatctctagtcttcgggcatcactacttttccctgtggtgctcaacaggccatacagggcagctctgatgttggccaagtggaactgatgtggtcaggagacacaaatccattgagaggaggcagcttctccttggaagcagaatctccctttttatatccatgagaaacagccaggagagcaggaagccaagggctttctccttttctgttgcatgccagcgccctctttggctatgagcagcaggtctctctcccttcaccactgcatttggatgagactcagaggctgcttttgctgtcatctgtttggcttacttggtaagtttctgtgatttgaggcttgtcaccacttgtagagtttttgcttgatcgtgtgttgtttgtccagctttggttaaggccgcttaaaaccctgacctttggagactttgtgtgcaggattcctatttcatcattgtcgtgttttgtcgcaaagtcaggtttgcatcttggagagctttctggtcccccttcctgagttttgtgcccagttttgtggatgagtccatcataaatcttgtggatgaaatcttccaggtgcttctggacttttctgttcttttgcttcgcctgtgtagtgagagggagaagtccaacattaaatgagccctatttttacccaacgtctctttctccctgaccactctgtgtaaaatgcaatcataactcctccttcctgaccagcacttctagtcctctttatcctattttttctttctccatagcgcttatcaccctttcctatgccatctctgcctccagatctggaatataaagtcctcagtaggaaatacctttatctcttttgttcaatgaggtattctaattgctcagaatggtacctgacacatattaggtgcccaataaatagtttgtgaataaatgagtgaataaatactcaggatttttaacaaaagccaccaaagaaaacatgcttaatttattcaggaggtggaaatcttgggtgggatgaattccttatgagacctgcgagaagcgcaggtgatagtttgtgtgtgtgttcgttgtgcatttttattgatataaaacagaagcactggaaagtgtgggaagtgcgcatgtcatgaggatgcaggcccttggctggcttgtttatttcaggggtggttaggcattgtcgccctgggtggaggggtcagcgacgagccctctgaggccatcctgtgacatcccctgggcacctcctagtgtttgtcattcccgacgccccagggccagtgtccttggccttggagatctcaggctctgctggtttccccacctccctggctgtccctttttagtcctttcccacctcctgaccagacactgaacatccttggggctggtctccttcatttcttgctatattctttttttttaaagacggaatctcgctctgtcacccaggctggagtgcagtggcatgatatcggctcactgcaacctccgcctcctgggttcaagtaagtctcctggctcagcctcccaagtaactgggactacaggcatgagccaccatgcccggcaaatttttgtattttttagtagagacagggtttcgccatattggccagggtggtctcgaactcctgatctcaagtgatcctcctggctcagcctcccaaagtgttgggattatagacgtgagccaccgcgcccggccactatattctctttctattcaatttcattcttccctgtgcctctgcttaccatggggcacccacttgcagaggatgcctgattccatgccctggctccctccttggtggcctcatgcatctcaaactcaatatacccaatgctgtgctcagaccttccagctcaaatgcgctctgtctcagacatgctgcaaccatcctcctgggagttgacacctccccaccgtatcccctcacatccagtccctcagcatgttcccttgatcctaacttctaaagtgtccttgaacctactcacttctacctcccatgtgcccaccagacccagccccaaccacttttcgctggggtaacctcagtagaatttacactggtctcccttcattctctcacgcacacgacaaaccattctgtaccctgaagctggtatggtttttgaaaagctcaaatttgattgtgtctttaatgagttcccattgctctgaggtcagtgtggcatctttcatggggaaggtcatggccagcccccttccccttctcttcctatgttccagccaccatgacctgctgtccagtggtcatgagctgagtccctcatacccaaggcttttccagatgctttttctctgctggaacactgttcttgccttgcgttgctagcaaagatccccatgttcattaagcgcctcttaaatgtgacctctccagggaagcctcctccactcccattgcccattgccctggctcagtcagaccactctgtgtcttccttgttggtgctctctcctcttgtcattaaatcgctccatgtttaatgtctgtatcctccacttgactgtatgctctacaagggcagggtctaggctggcttggatgttatgctgctgaatctacagggcgaagcataggaggtgctcaataaactgaatagattttgaatagatgttcactgagggtaatactgaggagtggggttgttctcaatccttactgtagactccaaatgccagtactgttgggcgttgcttcctctgaaacactccttgaagctctgagtctcctttggatggttttacccaactccactcgtgcctccatcccttgctgcctctccagacatttgccttccttgtcattttcaggccgtcagctacagtgactgggaatgtgtgccacttggctctcacactcgcctctcactgtcgtttttctctcacgggagtttatcatctattcttctcatttccttgcctttctctctgcagcaccgataaatcatcagtttcacctgaacttcagaaagaagccattccttaattttggcagaagcacgatggagtagaaagtgaccaagtagactgacttctgatcatgtctctattgtgacatgccttcatgagctcccattgttcttggggttaaggcctttaatatatgttacaaggttggaatcactctggggaaatggccgaaactccctgagctttgtttcctcaagaggaatgtgaggtggattggattaaattccacctacaaccatttccatctcttacatttccagaatttgtcccagaatcatagaagcaaaccttgttcagagaggccatatccagctttgcaaaataaaaaaaaaagtcactgtgctggtgagatgggcctcaatcctggtcacatttctctcttctctccagatatctatgcttcctccctctcctgcctccccagaatataaacagctccctgagggttgaggatgttccttcgtcccactcccaacctgtcacccccaacttccagatttctttaaaagtcaaagagaaaggaaattttcaggaaggagatcatgtctaagagctttttattagtctcatcttccaatttcctgtagactcaagcttctttctttctgtcgtgcggggtttaatatccagtggctgtttgacaacagcaccaggaaatggaatttccatcctgattctgcctggaaccttgggcaaagtgcccaaaccttctgcctcactctcctcctgggagtaacagtccccaccctacagccttctggggcaagcaacagagacctaatatgaaaatggaaccagagagttctgatggatgtaaagtcctcaataaatgcatgcaggtattatttgttaatttttgccataggcaggctgcagcccccaggcaaactctgagtagaaggagcctataaaaacaagcctcctgcttctctctctctctctcatttttttttttttaattttttttttagacggagtcttcctctgtcgcccaggctggagtgcagtggtgcgatctcggctcactgcaaactccgcctcccgggttcatgccattctcctgcctcagtctcctgagtagctgggactacaggcgcccgccaccatgcccgactaattttttgtatttttagtagagacggggtttcatcgtgttagccaggatggtctcgatctcctaacctcgtgatccgctctcctcagcctcccaaagtgctgggattacaggcatgagccaccacgcccagccgcctcctgcttctctcttgaagcctgggttctgctctggtgtctccccagctcattgccggttgacggcacattgggctccctgtcagtcaggttggccacgtgaggaggagtcaatgaggcactgcttcctgccaagctgaggctgcccttcttataataaggaggtgagcctgtctcagggaaggttcttttcctaaatttcaggtgggattctaaacaggacaccactgatttttttaaaaatgaacctatcaagacatgcattttcatgggtgtaatcctgtttgaagtggtcacatttggggtttttatgtacttgctcctattactggtgaaacttctgtgaatgggcttcagatcatgaacagcctcagtggtggcagagtctcatgatttcaagttaccttatagttgagaaatagccccgcagggtaggtgatggcgtactccccacttgccattctatctggaacccggaaggtggtcaatccatattcactgaaatgaaccaagaaatgagactgtggctataaggttgaggatgttcatttgcttgtgaagcttctaaacaagatcttccaaacagttaagagaacacttggatatctttatgatggtgtgtttgctttgaaaaataaacatgaaagagaaccattatgttatagctccgctttctagtgagtaccccgtcaaggcatcatatccctctgtgtagcaatggaaaggcatttaacccaatgattgaacctctctgtgcctcagtttcctcatctctaaaataataatagaacctagctcatataactgttaagggggatcaaaggaggtaaaatgttgtgacaaaagttgcataacacagtggagtgtatttcattcattcccaagtctgaacttatgtgtagaataatgccacaatctatggccctgtgtcctgaaatgcccttcctccaggcccttttggagcaagagctccaaggggctgttccctcagataataacctaggtgattggaaaccttgactagggagcacagacctggaggtcggttccagtgtgggacagttggtcatatttcccactcaccctctgccatgcaaagtgggtgaggcagtggctctggccagttcattggcaggtggcaaaaccttgtctagtctttggcattgggcatgtgataccatcgatggccagtaggtggcacaagttgtccatcactgccgccagctttgctccattgggtgctttctcagaaggggaagatctatttctaatccagtcctggctttatggcaatgcttaatcacatggaagggaacatgcaataactactggtatttctgtaaacatgcatgctaagaatcagctgccatttggaaatgaggatggagggaacactcagtgagaggtctcctgaggacaatctaaaaaaggaaaaccttgagggttttaaaattttagagccagttaacctttgtgactcatggagagaaacgtttagaacccagaaggacaatgagaatacatcctgtggattgtaacctggtccaaggtccaccttgccctctccaccttccttcagctgtgaagtttaggaaggagagacaagatccccttgcatggagtcagcttacccacttcatgacccccagcagggccgggctgcaccttctgggctgtttgcttaattttttattcttttgtcctggcaagttgcctgcttcttgggtttgtcgtttccctggaggaaagtttatttgaatctcattctacccttaataaaattggcaccagataaatacgaagcggatgaagagacacattgcagcaaaacaaaaagtggaacgtggtcaacaacagggcgatgaggactttaatacatgtgtacactttctaaataaaaaattttcattgtagtaaaatacacataacataaaatttaccatcttagccatttctaagtgtacagttcggtagtgtcaagtacgttcacactgttgggcagctaatctccaggactcttcatcttgtaaaacagaaactctctacccattacacaacagctccctgttcttctctcccccaacccctaacagccaccattctacttcctgtctctatgaacttgattactctagtgtcaaagaaaagaatcaaactctgtaagatatttgaagagatttattctgagccaaatatgagtgactgtggcccccgacacagccctcaggaggtcctgagaacatgtgcccaaggtggtcggggcgcagcttggttttatacattttagagaggcatgagacatcaatcaaatacatttaagaaatacagtggtttggttcagaaaggtgggacaactcaaaactgggtcggggggacttccagcttataggtaggttaaaaaatattctggtttacaattggctgagtttatctaaagacccgggaccaacggaaagaaatgtctgggttaagataaaggattatggagacccaagtttttattttgcagagaaagccttcaagtggtaggcttcagagggaacaggttttaaaatgtttcttatcagacttaaagtctgtgttgatgtcagtgctggagaggtatcatgaggcatgtctgacccctgctttccatcatggcctgaaacagtctctcaggttaaattttaaaagagccctggctgagaaggaagccctttcagatggttgcaggggcatggggggatgcttagaattttatttttggtttactctaggtacctcatataagtggaatcacactattttgtcttttagtgactgggatatttcagcataatgtccacaaagttcatccatgttgtagcatgtgtcagaatttccttcctgtttaagctgaataatattctattgcatgcgtgatggttaattttatgtgtcaacttgactaggttaaggggtgtccagatagctggtacaacattatctttgggtttgtccttgaggacgtttccagaagagatgagcatttgaattagtaggctgagtaaagaaggtccgccttcgccagtgggtgggcatcaacccatctgttgagggcccaagtagaataaaaaaggcagaggagggccgggcttggtggctcatgcctgtaatcccagcactttgggaggccaaggcaggcggatcacgaggtcaggagatcgagaccatcctggctaacacggtgaaaccctgtctctactaaaaatacaaaaaaaattatctgggcgtggtggcgggcgcctgtagtcccagctacttgagaggctgaggcaggagaatgacgtgaacccaggaggtggagcttgcagtgagctgagatcgcgtcactgtactccagcctgggcgacagagtaagactccgtctaaaaaaaaaaacgcagaggaggagcaaattctctctttctcttcttagctggagcatccatcttctcctgccctggggaattggagctcctggttctcgagctttctgacttggggactcatcacccttagccccgcaggttcccaggccttcagctgaacgttggtcactccaatggctcccctggttcccaggccttcagattcagcctgaacgacaccatggctttcctagttttccagcttgcagatggcatagggtgggcctctttggcccccttaattggatgagccaatgcctgtaataaatctcctcttatgtatctgtatatattctactggttttgtttttctggagaaccccgactaatagagtatgtacataccacattttgtttatccacccgttcaccaacagacactcaggctgctgccttctggccattgtgcataacactgccatgaacatggtgtaaaatgcctcttcaagaccctgcttccaactcctttgggtatatgcccagaagttgaattgcttgttcatgcagaatttatttttaattttttttgtgtggaacagccatactattttccatggtggttgcatcattttacatgtccatcaacagtgcacaagggttcccatttgtccacatccttgccaacatttgttattttctgtttttcttttttcttgatggtagccatcctaatgagtgtgagatggtgtgtggacacttcaagtttgctctttctagggctttttctggagtgggcaaggctccctgatcccttcctctgaaagtggtgttactgtaaaggtggcattttcctgctggtcatggtggcacgcgcctggaatcccagctactcgtgagactgaggtggaaggattgcttgagctgaggagtttgaggctgcagtgcactatgattgctcctggaaatagtcactgcactggagcctgggtgacatagtgagaccttgtctcaaaaccaaccaaccaaccaaccaacccacccagacatttccccttctgccctcccctcagagctctgcctagagagcctgctgagtgtgggtacttctgggttggtgtctccaccctaggaacccacttgagagtgactttatttggaacaatcttcagtcacaggaatcttctgggaagtcaccagaccattgctttgaagagtacacagcctcagaccctctggggacaggagcaaggcaggctgatttattaaccacgctgcgtcacccttttgccctagaggttagatggtcccaggagcccccctcgccaagacactcctcagagtgggggtaggagggtgggaagttctagatcctcagtctggccttcaaatattccattacattgccggggacatggcgcacccacatttatccaaaggacaggggtctccagaaatgtctgcccgcaatatcctttggttacctccaaaacattctcttgaagttgtttaactgccatacattgttgtgggccggccttttattcccagattcacttatttaaaaaaaaaaaaaaactctcgagcatctctgaagagagaggttatatggcagatgcaagtcagcagaaggcagagagctgagaatggtggggagagagacacagggctcacggtgtgacaagcttcttggtgagtggtcaagtgcgtaatggccaggtaggcggctggtgggatgtgctcaggcagaccagcgtctgagtcccaggctggtcactaatttgctctgcgtccttgggcaagctccttcctttctctgtgcctcagcttcctcatatactaaatgagggtagtgagagctagctcagagctgttgggaggtttaaatgagtggatgatgtaaatacaagtgtcaggaatagtgtaggtgctctttagtgttcacccactgctgtggtttgagtgtgtccaaagttcgtgtgttggaaacctaattcacaacaccaacagtgtttggatgggggaccttcaggaggtgattaggtcatgagggctctgccatcatcaatggattaatagtgttaccttaggagtgggttaatcattgagggagtggtttcttgattaatggataagttcagtcccctttctctattgctccctcctgctcttttgtccttctaccttcccccatgggatgacacagcaagaaagtccttgccagatgcagtctccttgaccttggacttcccagccttcagagctgtaagaaataattttttttgttttctttttaaaataaaccacctgtatgtggtattctgttacaggctaagatactttctttctccactagccacttgctcagtacaagttgagagaagagtgttgtgaagcccaagtttaggcagagaggagcaggttagggcaagtgagcaggcagggtttgtctctcacccacctgcatttagccaacagctaccagtggcagccactgggctggtggacatgttccctgccacggagagaggggagtggtccagctgcaaggctctagttctgggatctagtcttggtgacggaggatcctggaaccatctaacctctggggcaagagggtgacgccatgtggttaataaatcagcctgccttgctcctgtccccagagggtctgaggctgtctactcttcaaagcaatggtctggtgacatcccagaagattcctgtgactgaatattattccaaataaagtcactccctggcaaagggataagtccctacccaggagctgcccaaatttttttttgaaacggagtctcactctgtcacccaggctgcagtgcagtggtgcgatcttggctcactgcaacctctgcttcccaggttcaagtgattctcctgcttcagcctcccaagtagctgggactataggtgcccgccaccacacccagctaatttttgtatttttagtagagatggggtttccccatgttggccaggctggtctggaactcctgacctcaggtgatgtgcccacctcggcctcccaaagtcctgggattacaggcgtgagccactgtgcccgacctcctgcccagatttctattttattcttgcactcagctaacagcctggctgcccagaggcaggtacaacttattcaagagcaggagaattccaattttattatttaaaaaatcacataattaactgagtattacaagctttgagatgtttgttggttaataaagatgaatgggctatttgaggtaatggcttttaattaaatggaagctaataactttggtaagtttgtccgagtagtaatcttggctaacagtttgaagtttcgtacaataatcttggctaacaatttgtagcttgccttgcactgatttcatagcattcattgtttacaacacgcagaacacccactttacagatgggaaaacggaggctgaggctaagggcacaggaaggctgtggggggattgcagtccacagcagccccgggggtctcaagggcatattccttttaatcatggcttcccacacaacatgcatccctaattctgttcacctgacccctgactaaagctcagctttagggcaggagatttaaaatacaaactcattatatctgcaggtgtgggctgcagggagggcttggagatgtagaatcctcctttgctgccatgtagagagaggaaagactgcatgcaggcccagctctgctactcacggcctatacaaccctgcacactttatcccagagcttaaatcttttcccttcttgcagctcttcttctgttaagggacctagagcaggacataatcatctgttcttcttatggaggggctaaggaacaagaaaaatggtaaggagcaaaaaatggggccaggtcatttgacaaggaaccctgggaaatgcaaaagttgtatattctttgctgagttggagcattagtgacctttctctcttttcttgtgaatttacaggagttgcaaaggcccagcacctccctgtggcttttaaaaccaggtatgtgggcaatgctcagcagagactgaggaccatggccggggtgccctgcagccctttcatgccgggcagctgcagcctttaatttgggggctattgtggtattgttggtattattcagggtttgggcttcaagagaacctgtgatgatttctttgttatttcacagaaattggtctgaacggttggcatgtaatgcggtggcactggttctcctgtgtttgcccaaaaccttgccaggagaaccaggcagtggacgggtgtgtggtcagtgtggtgacctgcaaacaccactgtccacacctcatgctcttgctcaagaattttcccaggctccgtgcatgtgtaaatttgcaaaaataacaaagccaaccttcattgtttgttctctaaataagaagaagcttcgtggtttgtgttcgagtgaaacagcaagggagaattttgatcctgtggaatctggccagaccttacagggttgaggggtctctgcactcacatttgccgtgttcctgtccctctgcctctcacctttgaatgcctccctggggcagatgctcccggctcctactcctcggatcctttgtgtaatttctcacaaatttctagagctcacatggaccttcctttcatagtccaggaacacacagggttgatcctcgaggcctgtgcctctctccgggcacccgtaacaccctgctccatgtttgcttcaccttggagtaatcaccttgcactcaccccattgtctttgggggcttatgttttgtgggtgatagagtgcatcatctatgaggtaaaatcttttatgtgtgtttgcttattccgggatgcactggtggccaggctgtgctcattctggctcactgagggtgtgttatcatcctgccatggaccaccctcttctagaaggaacagaacatcagggtctccctcccagccccctgttccaggtaaccacagcgtactgcaggaacaaaggtgtagactgaaagtaagttaaaggacagggctgaggcctatagactgatttttcggagtaaggaggtgggcccttttgaaaatattgagatataatttatataagataaaatttacggctgggctaggtggctcacacctgtatttctagcactttgggaggtcgaggtgggtggatcacctgaggtcgggagtttgagaccagccccacacaaaaccctgtctctattaaaaatacaaaaattagccgggcgtggtggcacgtgcctgtaatcccagctacttgggaggctgaggcaggagaattgcttgaagccgggaggcagaggttgcagtgagccgagatagcgccattgcactccagcctgggtgacaagtgcgagcgaaactgcgtctccaaaaaaaaaaaaaaaaaaaaaaaaaagataaaatttacctattttaagtgcacacaatgaattttggtaactgtatgcatttgtataaccacccgacaatgagatacagaacacttcatcacccccaatagttccctcaagcctctttgcagtttctcccctccctttggcctcagcaaccagtctgtgagtctagttttgcctttctagtctttcatgttaatggaatcaagaagtgtgtactcttttatgtctggcttcttgcattcagcatattttggagccttgtccgtgtcactgtgtgatttctctttattactgagtagtaatgcattgtacagaggtagcacaatttggtttttcatttaccagttggtgaatattcgagttgtttccagttttgggcaattaggaataaagttgctataaacattaatgtacaggactttgtggggagttctattttcatttctctttggttcatattcaggagtgggtttgctaggtcacaggatagacatatgttaaaactttgtaagatactgcaaaactgttttccaaggtggctataccatttgtattcaaaatcaacacttttagcctagagcatataactggccttcctgaaatccatggatatctatctgtgcaatggttttagagacattttattgcctcccacatgtaattaagttacttggcttttaggcaaaagatgataccatgtctatggatgagatgactctagttttgaactctgggttttgcagaagagtttgcattatcctcctcctgaggaaagcagatacatccgccacgatgcatgtgagtcaggtcttctgcgtgtcctctgaatcaggttcgcatgtgtgcctctaatggcagtttcgagttcatcctgtgttgagataatgcctgaaggcgagaggaaaaaatatctgtggttgtcaaatcgggtggaaagtgattaatcatggagacatttacggcatgctgaactgtttcgtttcctgacctttgtcccacgtgcgttaggggcaggcggggtcaagtttaaatccaagatgacaagtgtctgaggctaaggaaggtttctgctgaatacttggcttagagtcaatggctccatgtttcacacctggtgaaaaccgactcgcaattgaaagaaacagcatgggagtgtcaaacacttgctgacttggccttgggctagagcttcttgcgagggttttagaactgacacaccctttggatgtgctgggggcatctggtttttggtgcctgagtcacaaatcctggaatacatttgcccacagtgtttccataccattggaagtgcattatggctgcttctcttagagtcctttaacctcttcctcaagagccagctttgtcaacttgatgtatctcatggcaggcatggactcatgcctgtgtgtcccattgtatccccagatcatgggatttgtgggattcagccagtgtcatttactaatcactaggtccagggccaagtttaggtgaggttcactccatctaagctgtgttttgggggagggagggtctctattttttcatttagagaagtgactagacactagaaaatgtcacagagtaaacgtatggactacagcttgttttctgaaaaggtttagggatcccgtgttagtattgaaagaccctttgaggcctcatcccctccacccagtgggcacacaggcctctgaccttcagcgccaagtctcccttgaggtcagcttctcttcatctttcacttcttttctcttcctttcacccctgctggttgcagcgacaaggtccctgccaactgcggtgtgcacactggcgggccttcacctcccttaaaatccagctctcgaaatgtctgcaagggagcagcctgcaatattacctaatttgtctttaatctggtattcctagaataatccagagaatagagtggcctactgtacacactggattactcaataaagaacatgatgggaaacggcagtatttttctgttttaaaataagtaggtttggagggagctgggaaactgcgggctttagttacaaaatgactataattgtgggagacgtattttctttgaatgttgaaacacattggacaggatatacaatttagaaataatttacagttagagaaaggccctttcatctgagagggggcacatcttctgattggaaaggatggtcccaggggatgagggatcgggccccaggtgagcttcatctttttctcttccaacttcagtgtggccaaacagagcggaaagtcatcacgtagaaggacaaagtctgtgtttttttgtttttgtttttgttttctctcatgagagaagcaggcaagtgctgcctgagaaggtgaaggctcacctgtggcaggcttgcttcaagctggctgcagactgaaggccacccagaggctttggtcaccaagggtggcatgatgggtggccttctccttgctcatgcagctctcaccagcaaatttctactgaatgcccactctgtgcagggtactgtgccaagcacgagggatgccaggacccggaagaaagaactctgttagagaaccacagctgatagctgccagtcagcagtaaaggttcaaagcttggcctggccaaggagctatcacggagggctctgtggaccagggtcttgtagtgggagtgtgtcagcagagtggaggggttggaggagtgagcccaggtatgcaggggtatggatgggccgagagccttgggcctggcctggctgaaggctgtcctgttgaggcactggcaagtgggcttgggaggcagacggatgaccagacacggccccacagagatcagcccaaagcgcttggacccagggcatctgggatggttcttgaggtgagcgcatgaagccttgttttagacacatacactagaggactccagcctccctgcaagccctcctcctctctctctcctcactgttgaggcgagtgctgtgtctgccttagattccttctgcaggcttctgtctgcctgccagcagatgcctctatgtctgtcagccctcagaatgtcaggcacatgcactacccactgtgtgtgtggggtgtgtgtgtgtgtgaacatgtcagatacccacacaggctctccactgttcagtgtgtctccagtctgggacctgggggtggaaatagtcaccgtctacatccatcttcttctgcttctctcttaggcatttccaattcaacatacaccagcctgaactctttatccacatccctttccagcatgctcttcctccagcccctactgaccccatcacaggaaaaagccattctgttcttccagttactcagggcgacagcctcggagtcatcatcgatgtctttttcctctcacacctgacacctgacctgtggccatcctgttgactctccccttgaaatacatccagaatccagccccttgtccccactccagcactcacagtcacattgcacctggtctggaccccagcaagtgctgccctgtgggactccctgcttctccccttgctccacactgtctattctctgtagcctttaagaacaactcaggtcatttcactgtcctgctcaaaaccatcaaatcgtttcccgtttccttcagaatgacattcacagtcctttccgtcacagctctgcgtggcctgtggtgcctctgtatcctcatctctgacttagtttactccaccccattctcctccttcaccagactcccaggcactccttcacgagcagcatgcacctgccccagagccttggcaccagctgctttccctacccagaacactctccttcccacatcttcacagccagctgtttcattccctccaagtcccttatcagagaggctttttcagtcactttgagtaaaacagaaacctaccttttcatcattcttgaccccttaactaaacttgcttgagtttttgttgttgttgtttgctcgttttttacttattaccacttgacatcacttttgtgggaatccccttgcttttatggaaatatgtaagagtaaagaacttcatcttattttccgattatccccaggtcctagaacagtgctggcatttggaagctgttcagtatttgctgaataaatgaaatgaattatgctgtgattcactgtgtgtttggaggtgtttggagggactggcatgggaggattggattctacggtggtaatagtgacatggcatgatgaaggcatggagtagaggggcggccacagaaatgcaaaggaaggatgactgagggagaggcctctagctcggttgttgcaggacagggatgcttgactggcagtgccttggatgactcgttataagagctgtactccagactcaggatatgctttaaccataggttttcagatttctcctggggtccagtcaactcccatgccagtcccttgttccatgatcccaggccctgctccaattccttaactcttattctgtaaccgtaacccaaatggctaagcctgaggttgcaggctgacctttagagaaaaagttgaactttctctttaaagctaagtgggaaaaaaacaatgacggataaaatgtaaagatgtacaaaggtaccagtttgtacctgggtgtttgaatttctttacattttgctgtcagttgtacatggccatttgaaatgagtaatttaatattctgctgatttttaaatacatagatcattttcatggcactacatagtaaatctgtgctttgcttgtctgctatctgtgtgtttaggttcacaccagttctggtcgtgaagctatagctcaggcattatcatggacttcctagaagctgccttgccagcaaggagcctaagaggtgttcagaaaaattatccaaaacttggaaataaggaaagaggatgactctatgtcctttaaagtccagatcagagcattgtctattagatccactcaaggattatttaaatctcaaggagaatgtaactttgcttcacatactgtttactagtaactggctgcctgtcaacttgtgggagataagctggatacaattttgtccagtacagatgcaaatgattcccttcccttcccttcccttcccttcccttcccttcccttcccttcccttcccttcccttcccttcccttcccttccctcccctcccctcccctcccctccccttcccctccctccctccctcattctctctttcttttcttttctctctttctttctttctttcttctttctttctttccttccttccttccttccttccttctttctttctttctttctttctttctttctttctttctttcttctttctttctttccttcctttctttctttctttctttctttctttctttctttctttctttctttctttctttcttctttccttccttccttccttccttccttctttctttctttctttctttctttctttctttctttctttctttctttctgtctttctttctgtctgtctgtctctctgtctctctctctctctctctcattctgtctctgtctcattctgtctctgtctctctctctctctcattctgtcacccaggctagagtgcagtggcatgatctcagctcattgcaacctctgccttccgggttcaagtgattctcctgcctcagcctcccaagtagctgggaccactggtgtgcaccaccacgcctggctaatttttgtatttttagtagaggtggggttctgttatgttgcccaggttggtcttgaattcctgagttcaagcaatccacccactttggcctcccaaagtgctgggattatagacatgagccaccgcatccagccagctcttttatgtttaaatcggccaagcgtgatcgatttccttcaggttcaaaagattacccaaacattacagttgtattgtgccatagaacattaaccagttttgtatgtaacttagcaaacttttttcagcattctttctgacatacgatacatctgtgttcctcaaatgctttgagaatcagcttttccatcctatgggttccctcagtaatgagttaaagaattgtgcttgctacctgtatgagggtatgagagccaagttcctaatattttgaaaatgatgttttgatggaggagataaaaagtctcctgtgttagctatataaacccaaacctacaaaatgatgtcaagtaccatagaatgtatacaaaagacataacctactcctcccaccaatttctattttattagcatgcatttctcaggaaagactgttcaaaaggtaaggagagaataccattctaccattctgccaattcaagttagaccagctatttctctttgcttattcacttcctgttttctcttaataaatttatttaaagacaatttattagagaaaaagttgtcttacaaatgcgaattgtaagttgtcttactgatgtgatccagcaatccgtcctggccggcaccctgccaggtctgtaattaagactgggggtttgctctgcaaggacacattctccacctttgtctggggggctctgtactcagtcttgcggtttgtctgtggagctgaggtgctggttgggaatcaggagacgtcagttccggtctcagcaaagctgctgcgaggtgcggggcagaggcctggtttacctggtataccacatgcccttgacttccctgtggtaggtgcccctgattccgctccagctcttgctttgcatgtaatttacactgaggttgcaaacaactgcttattcctgtgggacttagttttttccttagggccaatctgaaaaacttacctccttagttacatcctacggatttgcagacaaataggggaaagaaatggaagaaataagggaaaatgttatccaaagttggaaataatagaagattactctatgtgctttcgatgtcatactagaagaagccgctttaagtagcaccattattctgaatggagaaatctgtggttgctttagtcatggagactacatcacaactagggttttccttttatttttgagatgtgtgtgatgggggaggataggggtacagcattctagaaatggcctcattttgcatttccttaggtccaaagttaaaataactttctgttctaagaagctttaaaagtggttcatggaccaggcacggtggctcacgcctgtaatcccagcactttgggaggctgaggtgggcgtatcacctgaggtccagagattgagaccatcctggccaacatggtgaaaccccatctctactaaaaatacaaaaaaatttgctgggcatggtggcgtgtgcctgtagtccctgctacttgggaggctgaggcaggagaattgtttcaacccaggaggcagaggttgtagtgagccaagatcctgccacttcactccagcctggtgacagaactagactcagtctcaaaataaagtggttcatttctttctaaaatcattaattgaacattaaaaaacattggtaagaaaaattgaaccaagaaggttttgggttatactgtaggtcagtgagctttaagtttctgtgtctctgaagctacatggctggacgatagctgaagtcagtgccccgagtgaagcctgaagaggagctgatggatttttctggtggggaaggcctgtgactgcactcagagagagctgggccaggcggggtgaggcacggtcactctgagttcacagacccactctgatccttgaatgggtctgtcctgaaataatggggaatcctggaacatgctgctttgtgtagacgcctttctcctttgcaacttttaaaggtatttgtcccctgggtttcatttgaaatgcttttttcttcttcttcttttttttttttgccagatgctttcactaggagcagtatccagaaagctatgtttctaacctaccttgttgtttgcctcttgggcaaatgggtttgtttaccttattgactcagttcagtggaaaatattaccctgattgggatggagatggggctgctgttctgaaataactacgcaagtttacctgttcaggtgggacacagcttcttgtgttagtcacggatgaattttgaaaatttatacatagtgcaataaatgctggtttctttccccttcctcactccttcctggggcctatatgtgtgtatctctaacacacatacacacacacgcaggcacacacacactcatacacatgcacactcacacacaagaggatacgttgcatatacagctcaatgctacaaagaagcccttttaccagaagagcacacgggaactccgctgaagtttgacagggtgattgtcttgtggctactctaccctgaggccagagcacagtgagggcctccctcctgcccccagccacaccaaagagggggcaggggttcacagggagcaaaagaggagctttttgccatcaccatgagacggtgaccacaggggcctggctcgaaggtgagggtggggctggtgactggtgcctgtggattccagagtggttggcctacacagcctactgagaggtagagcacggtcctttgcgtccctgtggactccgagtgcctgccatggtttggaaggtccactgaaggctgagtgctcagcggcgttgccagccagctggatgcatgtaaacagcattgtgaatggagaacattctttcaccttattcttgcacattcttctcccctacttagcttcttatccttcctatctactcatctagctagcaatccctaaaattaaatcatttataaatgagtccgatgagggtctttttttgaaaactggatttagtgaataaggcagacccctgtttttggatagggctttgcctcttgttattaaggaggaataacttgttcccaacttggttggtgaccccagctgaggaggaacaagtggcagatgagtcccagggaagacccctagggggaatggctggaggtagctgtatcagggatgaaaagggtgggggtggtgatgaggggaacgcagcccttcatgcaaagaagtgggtgtttgaaatcagtgggtgactatttttttggcaatgtgggctccttaggtcatacacagtggccttagaaagccagccctgcctctcttccctcaactgatggtggatttgtgtaatgagatcaccgtcttcttgaaaaacacttccagggtagctcattacaaagcctcgcacagtgttcggagcagggcgagctgcaaggccccgggctttccattctgaaagagctgtgggtgtcggggtggctgccagctgtgagagctccgtgggtggggactctgtccctcaaagccacgcactcaggcttgcccattctagtgtctctgtgggagacaatcaatgtaatttactctattaatggaatgaaggattacaataataaaatctttttcaaggaatgcaaaaaagcatttatcaaaattcaatatccattcatggtaaaaactctcagcaaactaggaacagtaggaaacttccttaaaataataaaggcatttacaaaattcctgcaggttgcatcatgcttaatggtgaaagcctgaactatctcctaaacccatttactcctcctcagggaagacttccctgaccccatgtttaagtcaaacactcattatacattcccttaggaccagcctctcatccaaagaagtgatcataaatgcaatttaaaatgtatttgtggttgggcgcggtggctcatgcctgtaacccagcactttgggaggccgaggcaggtggatttcttgaggtcaggagttcaagaccagcctggacaacatggtgaaaccccatctctactaaaaatacaaaaatcagttgggtatagtggtgcgtgcctgtaatctcagctacctgggaggccaaggtggaaggatcacttgagtctgggaggtggaggctgcagttagccaagatcgtcccactgcactccagcctgggtgacagagtgagacttcgtctaaaaaaaaaaattatttctgccactatttgcttaatgtttgttttctggtgtaggcattcagctctgtgaataaaagcattctgctgatttctgctgccctgtatccagacggaaggaatgggtgagtgaatgacaggcacctgttctgtttacagtcagtaaagtaaacacaacactacacgtatgaactccaccggaaagatgaacacttatggtatatttggtgccactgtcccagggagagtagaagtacagggttttgttcttctgacttgagaaatttttgtgctagaagggccactgagggtcatccaggcctatcactgcccaccccaaatttataggtgaggtcactagggcctgagatctgaagcatgcatgacatcccgaatgaactacaaatcctaggtcagagttaacagtagtggtaactgcacaggatgagttggtgcagggtgacaagctcatgcgtggtagctattttgaatcaataccccgtaactaacctctgctgtttgaaacacctggcagagtgctgcaactcacccttgggcaaagccccactctctgaggctgtggtggggttcagggaatactaccccaaaatatggcagattggcattggagaaaacggcagaagcaggaaggcctctctcaccttctccttgcccttcttttcctgaagcaggccatgaaaccaagctgactttctcctggagcaaggcataaggtccttgtgtgagaggtgcccactctttacctggaggggaggaacatctttatctctgaagacacagggacgcagaagaaaagctgaacaaacaggccttgctgagttcccccttgtatataactaattagatcatactccctttgtccaatcacacttctccactactgtcgacttctccatcaaacttacaataaaaacacacaggtgtccctattccctatttctttatctttttctttctttctttctttctttttttttttttaagatggagtcttgttctgtcacccaggctggagtgcaatggcgtgatcttggctcgctgcaacctctgccttctgggctccagcaattctcccaccatagcctcccgagtagctgggattacaggtgcccgccatcatacccggctaatttttaaatttttgtagagacggtgtttcaccatgttggccaggctggtctcaaattcctgacctcacgtgatccacctgcctcagtctcctaaagtgctgggattgcatgcatgagccactgtgcccagcctctttggatcttttttcctgaggtgtcttatgttacataaaatttaaattaaataagtttgatgtttctcttgttaatctgtattttgccataggtgcctcagctatgaccctcgtaatgggtgaggaaaaaacacattttcttccctgcagctgcttggccacctgccttttgcttggattggcagaaatctggcttaatctggcttctccagtcctccatcacctggccaggaggtagcccttggtctaaccccttctcatgtttggaagcagactttccctttctttctaaggactggtaggcagctcctcatggatggagtgataactccagaatgtcttcgtgtgatggctgttggagtgggaagtgggctgggaggctgtgctggcatagactttgtgtaggattgagaagacaataactgccagtgtgaagatcaggcgggagttgggaagacagctgagagtggccaaggggaagccagagcctcttcaagtcatctctagatgggtgtgaaagggagagaagaggccaagaaaccatgagattaaaaggtggaggtgggggcatagagatcccagctgctctaggggaccctcccaggcaagtgctgtgtgtgtatgctcctccactgttccttctgcaatgcattccatctggctgctagatacggtaaagggaatgaaaggtgggaaaggcaaagggtgcatttaatccactcttcagctgtgaattctctagaggagagctagtccttgtgtttgttgatgcagctgcctctctcctgagacctgtaaaatgacttttttttttaaaggtaaaatcatgactcttacacaaatgtaaaatgaacacatgtcaaagattttatttagttcattaattaatgagggaaccagtaagatgctacaaccagcccaaaggagaattaaaaatgccacgcatagctaggacaataggaatgctgacatagaatttacaaatagatgcaaaattgatgatagccactggacagtctgtccacatgtccatggacaaggatagttggcattccatgggtcttttacaacttgcaaaccgaggaaagtttaggtcctcctttttccttgctgacctttcatgggtcagccctcatctggacatcaacactcctgagacatgtggtcactgcaataattgactgaaatcagtaaagacacaatttctccctctgctgctccgtgttcctgtctagagagttgttttcctctccaagtaaaagttgttaaagagcttaaagacaatgaagggcagagagagccaggatgtgaagacttttctgctgtactgtctttcacagatccatgttgcagctgggagcacggggaaacctggacacgcacttcaccaaaatgagacaactgtggcaggagacaggctaaggcgagtggggacaaatcaatgtgctggatgccctggtgtacctgtgacgaagaagcaggagctgggaagagagaggaaaaggaaatagacaagtgaataaataaataagagttcagaaaccccgtctccaccaaaaatacaagaaattaggtgggcatggtgctggcgcctgtagtcccagctattcgggaggctgaggcaggagaatgacgtgaacccaggaggtggagcttgcagtgagccgagattgtgccactgcactccagcctgggtgacagagcaagactccatctcaaaaaaaagagttcaaaggaagtgtagaagagttgagagaagaactctatttgcacattcactcttcagttcatttcctcattcattttctgaacagtgaatctggctctgtgctggatcctggagcataaagactaaattagctgcacaaagaccctgatcactaacatcctagtgggaaagacacactgtgtattaagctgagtaatcaccaccttcccaccatgtctgtatcctgatccctggaacatgtgaatattatcgtatatggcaaaatggactttgtagatgtgattaagttcaggatcttgagttggagagattactctgcattggcctaatgtaatcacaggggttttcataaggaggaggcaggtgatcagcataggagaaggcaatgtgattatggaagtaaatgtgggagtgatgcagctacaaactgaggaaagctggcagctctggaaactggaagaggcaagggacagattctctgctggagccttccaaaggagccaaccctctgacaccttgctttcagccttgaaagacacattttggacttctgaccaccaggactgtaagagaatagatttgtgttgtttgaagccactgagtttgtggtaattgctataggagtcataggaaactaacatatatgctgaacaattgcatggtcgcatgattgcaatgtagagtgttttgaggaaggaaattaaggcagctggggagctgatgacaggtgtcctggaggaggaggtttcctgtggagagctgagggctttgaaggaggccacccatggtggtggattggggacgtggcagtttcaaagcatacaccatgtgaaggaaggaccctgcagaagtcccaaatcaatgttttcttgcttatccctggtggatgatggaggctggtggcaggggcattaatgtgtggccatggtggtctgtgtgatacggtgaaaatgcaaaggagatgaactcccaagacttttgggagacatttataggaagatgggtgctaaataaatccaaggcagtcttttcagacagagggcttgataccactaattaggcagcttggatgagtggcaccatggaactggctggtggttttcttgtgaaaatagacacaaactcccttctctccatgttcttagaagatgtgaatttagaggtctccacattgcctgacaaagtctgttttaactgggtaaaataaaaaaaaaattaccattgtattgctcctgaaccttgcttaaaattccctttaaagatctacaaagggttttgctcatttgtacaatcttaaaggtcacaaaattagaagcttagcagccacatgccaactgcacacagcatttgaaatctttgacacagaccgttccagaagtcacaactggcaaagctgcacttcttgtgacactcagtagcctgcacacccatctcctggcttgtaagcatatgcctttttgtccagccagctgaggtacttggttcctgattgttttcttgtttgttttttaatgctcagatattctcatgtggtgaatatttgtgagccaaattacttggcaggagcgtttgatgccatggccaaatggggagcccagagtcagcatctttttaaagctaactcttacttgccagctcctctttctgcccacatactcgccccgtaccaggcccagtggctgttgcacagacaaacaccaagcagtcctgcaaaccccatttgcttccttctgggcttgatgctgcctgggagtgggcttctccctgggtggtatgtaggagttttccttacattttcatttcttatcagcttaccatttgcaactgatgcaggacaggcaagaccccaaactggggcttagcccaggaggattcttggctttgcccaggagagaattcaagcacaagtggtggtgttagacagcaacttttattgaggcagcagcagctgtactgctccctgtggagcagggctaccccacaggcagtgtgcccagagtagcagctcagggacagttcagcagtcatatttgtacccacttttaattacatgcaagttaaaaggcagttgatgcaggcatttctaggaaaaaggtggtaacttccgggtcattgggttactgccatagaaaggggtggtaactctcaggtgttgccacggcgatggtaaactgacatggcacactggtgggcatgtcttatggaaagctacttctgccctggccctgtttcagctagctctcaatttggtccagtgtctgagcccagcctctggagttgagtcccgccccctacctcactatcttggttctatttggagatgccctgaaaggctgtgtccagtcccacagtgagtgaggaatctatgctgaggttcctttggaggtgaattttgaatgacgtataacccagtacagaggaaaagtccagaactgagggatgcaggctaatattaaagactcatagttttgggggctgtctgtccaaaggctcatgcatgggcagaaagagttcacctgacctgtgctgtgggaagtttgctgtaaacattctgataaacatttaactttagtccctttcagtaccagtgccatgccctgcagtgttcactaagcgcccacaggcatctgctctctgtgacctgctcatatgacgagctaaagtcgagcatgcttcattcacagccaggcctcctccttctttgttggcctgagtgtgttgctgaccattcatgggtcagccccgacctggacatcaacactcctgagaaatgtggcaactgcaataattgactgaaatcagtctctccctgtttgctggtccatgttcttgtctagagagttgttttcttctccaagaataagaaggtggaatcgatttttccaccttttgttcccctcaccccagtgatgatgaggcaccaggagggaattttctgactttctgcaggcatttatgttctgcttcacatcatcatatttattcctttaatgtaggagaaccttaaatgaagcttgttggaaataggccatcctccataacctgggtttgttggagcccatgtatagaaatgatttcttggcaactctagttctcttgagcatgtgtgctatggttaaagaggcagaagggcacaagaattttagcaccctgaggactgaaaaccttccatagaaccagcatacatattgttttataaataaggagtattcttggggtatagttgtttgcaaagaaagggagctccttaagatttatgacccagctcacaataaccagatgacctgaatcaagggtgtatgtcaggaacaggatcctggaggggtcaatgacagtgtccatctgtggcctcaaagagcccgttcccaactctcctgccttttgacagaaggtctgtctggttatggctttaggaagatagatgacttctgtatagtcacaggaagagtctgcgtgcctggagctgtgggctggaaaggaggtgagagatgctggcctctccaaggcctcgtccacgtgccccatctccagacaggagcagccagggctccgttaggctgcaaacaatggaaaacctgaatagcagaggcttaaaaaacatgtggtttgcttgtctcacctgaaagaagtctgaaattgggaagtccagggctgggtcagaggttcagagatgctggggttgaggcctagatggctttttggccttttccccaggaaaaaacagaatcaatcagaaggtggctgatgtaggtcaggtgggctggggctggaggggatggtaggctgtgagtctggcgctccctcttgctggtgtggggatgggtaccaggagggcttctctcctccaccttgctctgttgctctgttgctctgttgcccaggcacccattgccaagaagccagactggaattcccaatgggatggggcagtcccaaggcacatggaatctttggtgggacttatacaccctgtactcctgtgagctcctcagtcactctggtcaaaaactctaatattgttccttttaacacagtcatcacccaaaaccctgttaaacacccaaatgcacctggggcaacccttgaccttatggagcccactttctttgcaaacaacacagatgttgagatgaagcaggaaggagtggttacataggaggatccagaatccccaaccccagggagttcgatatgggaaaaatgcctctgagtagggcggagggatgctcagagggctgcagggtcctgggaagtggctgtgtctcaaagtgtgctccatattcatacccgtctttccccactgcttttatttgcttcgcttttgaatctgtgattcaccttctttggtctcacctcttcctcgggccctttggttaagggcaggctgattactgcatatggctgtgccccagccctctgctttacccagcgattaaggagaagcccacaccaattcaacaaggcttgcattttaggagcagacaaaaatcttagacccagaagccaggtgtgcagaaaatgcatgttggcttccctttagcgttatctaatttcccaggctcaattctgtctgggtaaaggaacattattcttggttagctgaagtcccctgcttttcctgcagatgtgtctgatgctgggggctggcattgctccccttgggggctgggagatgctctcctttctggtctttggttgtcagagcctgctgttcactgctgttgtctcttgttctgactccaccccagctctgcttcaatcctactctctccaggccacagccacccactgggacctcccatgaagctcttgggagctctcacccatcctggagggagcccatgtaaatttgggcctggcttgttgattctgaatcaccaaataggcatttgcgcagcctgcctctccaagggaacttcagggttttgctgccactctggactttgtctgaggctatctttctgcacaaactgcacaaagtggggatgaagcccacttcatgggcacaggcccttcccaggacactgcagcctctccatacccctcccccctactcaggaggcctctgtgctgctgaggccaaagatttgctttgaaaggccaaatattcttcctgagccctggtcttaacccggggctgaagctttgctctcaaaggtaaaggtgaagacctccattttcctctgctctctgcaaattgcctttggctgaagcagggaacaggaaatgaatgaccaagttatgtggcctgggagagggagaagagcccagtcaacagctcaagaaatcccgccatgtctacttaaggggaagaagagagaaaggaggataaagagagattttttttccttttaatataatgcacattaaattttaggttgtttttttttttttctacatttaggtcccttatgtggcagaaaattccaaaatatattagtaaaaatgaacccaccttacatactcttggggtttcgttgaaatgttgagaagttaagaaactttgttagattattttacttaatttttaaaaaatagcctatcaaggagttttcaaaactttttaggtgtataaacaccctatttcggaaaccaccgtattttacactttcacttcccacctacaccagctcagtgacaagaaagtgtctgaaacaaggtgcaaaatcaaggttctcagaaacacgcttgggacgtcttgttccgcagcttggctgctctttccgcccggagtgtccttagcctgtgcccctttcgaactccggcactttgtctgcggagtagctccagcgcagtctcccagcgttacctggcagcctcctccttcctggagcaggagaagcggctctgtctcctgtgttccatcatcgattatggctgctctcacactgggttaggaaggtttggtcacctgagtgcctccctcctctgtgctgttggactctatggtttacatactcctagatgctattttttacatactcctaagttttcaacctgagaaatctgaaaccatcccctaaccttacctggttacctgttgaaaaatgtgttatcccagaggtagattctttgggtcctaggcatctggacttgcaagagtctcatgtcagtttcatgtgcttacaaaggtgataacagagagggacatagctgtgagtttttcccaacggccagtgagtgcttcgttccctgtatcatgttttatttatttatctatccccagggctagtgcagtttggacatagggtgctatgggttgaattacatacttgtcaaatccatatgttgaaatcttaacccctagtacctcagaatgtgacattatttggagagagggtatttatagaggtaattaggggaaaaggaggtctttagggtgggtcctaattcaatatgaccgatgtccttatatagagggaaaatctggacacagagctgtatacatccagggagaacgtcatctggagatgaaagcagagatcagagtgatgcagctccaagacatggaatgctgaagatggtgagcaacccaccagaagccaggagagaggtataaaaggtttctccctcacagcccttagaagccaccaaccctgctgatgccttgatctctgatcctcaaggatgtggagtagctgtgtgagaggctgtctgagggctcttcaaaaagttcataggaaatgcatattatgaaaaaactatgctggatttcaaattttttgcaccaaaattgatttgtactacctttttataacatgttcatgcacaatctagtttgaggcactaagaaggataatacatcagtttgaaaagagcctctatcagagcaatgtgaatttctgctaaaattgaagtaagaacaaacatcaaatttatagtgaagcttgaggggaagtatagtgaactcattgatgctttgtgaaaagcttatggagacaatacccccttcccccaaatcagcagtttacaaatagataacttcttttaagaagggagaagttgaggctgggcacagtggctaatgcctgtaatcccaacactttgggagcctggggcaggtgaatcacttgaggtcgggaattcaagaccagcctggttaacatgtgaaaccccatctctactaaaaatacaaaaaaaaaaaaaaaatagccaggtgtggtgacaggcacctgtaatcccagctactcgggaggctgaggcaggagaatcacttgaacccaggaggcagaggttgcagtgagccgagatcatgccactgcactgcagcctgggtgacagagcaagactctgtctcaaaaaaaaaaaaaaaaagggagaagttgatgttgaagatgaagcctgtggtggcagaccattcatgtcaatttgcaaggaaaaaattaaccatgccctaattgaaaagacctgatgattaacagacatttcagttggttcagtttatgcaattctgactgaaaaattaaagttaagttttccactcaatgggtgtcaaaaccattgcacccagatcagctgcagacaagaacagatctttcaatgaaaattaaacaagtaggatgaagatcctgaaggatttcttcaaataattgtaataggagacgaaacatagctttaccagtacaatcctgaagacaaagcacaatcaaagcaatggataccaagaggtggacattttccagtcaaagcagaagcagaccagtcaggagcacaggtcacagcaagagttttttgggatactccaggcattttgctgttgactgtctgtagagccaaagaatgataacatctgtttattatgagagtgttttgagaaagttagccaaagctttagcagaaaaatgccactgaagaattcagcagagagtccttctccaccctgacaatgcttctgctcattcctctcattaagtaagggcaattttgtgaatttcaatagaaaatcattgggtatccaacttgcagttctgattttgcttcttctgacttctttttgtttcctaattaaaacaaaataattaaaaggcatccattttcttcagttaataatgtaaaaagactgtattgatatggttaaattctcaggaccctcaatattttaagaatggactaaatgggtggtatcatcacttacaaaattgttttgaacttgatggagcttatattgagtaatacagtttataaagttgatatttttcatttttatcttttgattccattttccatgaacttcctaaagtcctcttgtatttctaggagggtcttggattaaaaaaaacaggaggaaggaacaagtgagaaattactctcatagtttatggcgtgtcttaacatcaagttacttttaagtcttttattcttttaggaagatattttctctttcagggaaaattaagaaacatcagggcctgagttatgttggaaaatctctcccctactctgactgtctggctttattctgagctcccaagctataacagtggcacttgggtgggatgagagtggggtggggctcacatctacatggctgaagaccaaggcagaatctcacacccaagtcttgattctttgtgctgcttagctgttgttcacaccacttttcctgcttgtgtccagatctgaatgaaactgatggctgttggagaggcctttgtcatctgactctatctgttcctctgtcaagtaataccatcaatgatgctattcatagaaacatttcatgtttgagaggtgttaggagttgaattgtcttctagaagctgttgaattcctaaccctttatatctgtgaatgtgactttatttggatataggtagggtctttgcagatgatcaaattaagatgaggtcagtagggtgggccttaatccgtattactactggtcattctaaaaagggaaaatgccgatacagacagatgcattcaggagaattctgtgtgaaaatgaaggtggagatcagtgtgatgcatctccacaccaaggaacactaaaggtcaccagcaaaccaccagaagtgagatgcgaggcattgaataggttttcctcgcagcttcggaaggaaccaaccctgttggcactttgttcctggacttccagcctgcaggtggttgtgtaagcatttctgtggtcgaagccacctggtttgcagtactttgttagggcagccctagcagactaacacaagaggtcattgaaagtgtcatatccagaacagtgtgccttttgggggaggaaagtccagttggccctttcacatacacgaacatctcacatttaaagacacaattccaggctgtctgtggacactcataggtgcccgtgaaagccgcctcagccataaacttcttggagtcacattgtgaagtatttatttttaattacagattttctttgatgatcctcttctcttctctttttgtttccttggcttgtcactcattcgttgtggtaaatagactgcctgctgtttacgatgagaagtagcctgtgctttggtctggtctcctgacgcccggttgccagcagtccttgctgtctctgggttggaagccgtgatgcctgctcatgggctcgctgtctcctcaggcatgaaagtggaggcatccttctggctctattttcaacttaccttggtgaggccacaagaccctattgacacatgaaggggaagcacagagggaaagggggttttacttttcctcttcaacagggctagccctcggggactgagcagagagagttgtgaatgctgggttttgaaactggccccaaacgattgtctcctggaatcagagaaggaacaaccgactgcacctaaaagaaacagagtgtttaccagtcttgctggatggctttaaaaacgcaaatacatacgcattctcattagcccatagcactcagccatcttcacccccattagagaaagccagtctgctgcctgcccccctcaagtcactgctgaactcatagcatgtgtcgggcttctggaacctcacagatgtattgccgcagacaccctttagatgagaggtgtaggttaggggcacaggcaagggagcggtcactcctagacctgaagcatctcttccatagacgtcacagtatatatcttcccagccagctcctccccagcccttcagggaaggtgaacacaattccacactagagtggcttttaaagaaaaataacatgtatgaactcttcccagaattctatgaaatgaatgagtttgcattactttttctagcttatgacctgagtcttttattttttcagatacatttagttgtgtctttcaaaatctatttttgcagaacctaccctttgttagcattgggctggaaccccggaaggataattatgtgtgggacttggtagctgcccttaggtgtacaatcccataaaggagagatgccatatgcagaatgatgaaatgcagcatgaggctaagtgtccagcatgggttatggagggtagatgagagagaggttggtgcccagaagacagccgtcctgcctcgggcctatatgtctgcagaggcccacaggagtggggcagtcctgttcagggagggctgaggggttctccgaatcttatcaggtaggacagggagactttagaaaggattgggcattcagtttgtgggtgtgttataagcaaagtctggagcagctgtgagttggatttcactgggtttcatggagcagatgtctcttgctggggaatgatgggatgtaagactagagacagacacagtcagaggcgatgtctgccttgaggcagacaaacagatttcaacttggtcttctgggcctaggcagtgagaagcctggaaggtgtctgagcttggagatgacctcatagagccaactttttggaagattggttgggtggcagagtacactgtatgaaggcacaggagagagaaaggacaaatgcacaaaggaaggatccagaattccagggcaggctggacatgtgggcctgaaggaaggggaggggtgaagggagacctgaccatggcttctgcctgcttgaccaagcttggcatgtacattagaatatacagagtttgaggcctgaggacccttgttctttttcaataagtaatggtattttaaaaaccatctctgggttttatcatgagcagaggcgaattccatgcacagtgaggactgttttatttatttatacttgttgaatagtaaacagcattgaagaatgtttttaaagaaacccaaacttccttttccatttctcagtattaactttctttttagcaactagggacacaattgaatgctattgtcttaaacctgcctgacagagcagaggtacacgctggggggcgtgggaacctctatttggcaaagggaacttctcctgttattcccatatggaaagagacataaatttggggagagcttgctccttccctacatttctgtgatccatggttaacagtctcctcaagtgaatttcaaattctctttccaataagctgcaaaagtacttaaatcatttatttgttctgctcctgaaatgagagttactcactaaagtcccaaagtgtcccgaaccatgaggtgtccacagtgaaatgacatgtttaaaagttgccataaatgctggtaactggacatgataataaatctgagtcatttcacatggccagttgggtcggtaataacaagacatgcacttaaaatatatatctttttgcctttcgggctataaagattaataaattgtgtaaatttccaagataaagtgtgagacattctgaattttatgtgaatgacttgcatggtgacagtaaccatgttctggcccttggaacaggaggtaatttactgttgatggtttcttggcataatatatatacgtatttggggggtaataatttaaaatcatccagcacatggtctctgataaggtgcataactcaggtactcagagttgttttataggaaaagagatacaggcacaccgtgcgactgcaatcccggcacgttctccttcctcaggaatgacaagggatggaaacctggctccccacggggaataataaagcatgcctgtgaaaaatgaatcctggacctgagctcagggccagagtgctccaaaatttggggctttcccaggacttagtccagatttgcttctgtccaggccagtgaccgcttgaagctgtagagggcaggggagggagggtccccttcctgaaagggaagtgctgtgagacgtggctgtcactgataccagtggggacctctctgcccccagcctctaatcatgcttgaaggtttactctctgagcatggcttgagaagacaagggaaagcaatggagattggccatcacagccaaattctgcctgatatggaggcctgagtccttttgtgcaggtggtgactcactgccctgttgaatgggaggaaggaacagtgatcagacccaaacactctggttttcttcccacctgtttctcagaagtaataagtgcagggctcatgctctgcctgtgtgtgtgtgtgtgtgtgtgtgtgtgtgtctctgtgtgtcctgtgtgtgtgtctctgtgtgtgtgtgtgcctgtgcgtgtatgtctctttgtgtgtctatgtgtgtgcgtgtgtgcctctgtgtgtctctgtgtgtgtctctctgtgtctctttctctgtgtgtgttgtctctgtgtgcacgtgcatacatgtatgtccctctgtgtgcctatgtgtgtgcatgtgtgcctctgtgtgtttctgtatgtgtgtgttgcagaggagctgctaatgtgttctcatgctggttgtactgccccgccttggaacaactttatccttgggtgcaggggctgggtgagcctggaagctgccagatgcagcacatgatggaggagaagggcctggaaacttttgcagttgtcactcaacaaacactcatgcagctcctcctgtgtgccaggccaggtgccaggagctggagggaatacagagagtgagcctgccgctttgggatctcatctcctggaggaggaataagttatctacttaggtattcaattttaactggtatttaattacagccatacaagtggttccattattagtcaagctgaactaagttttgctgcaataacaaattttcccagaatctcagtagcttaacggagcaaaggttggttgcttgtgaatgctgtctgtcctacaaggtggtgctctgctctgtacagtcactcaggattcaaggctgacaggctaccttcttctttaggctgtgcattctggaacatggggtttctttagcctctgtagtggggaagagagacaagagactcactcacaagcttctctatcatactaccttatgatggaggtggtgttattagcctttttacatctgaggaaactgaggcacagaggagttaagtaacatgtccaaagtttcacagcaagtgagtagcagaaccaggattgtgagctccagccatctggctccagaatccctgttcttgtcatgctctgccatctaattaaacagtttcttgggaagggaatgaagagatgtcagacaggccaggagctcaggggactagaaaaagaatttatcagaagaaggaaagtatgtcggggaatgacagggaaggataaatgagcaaggctagaatcccagaaaaatagagagacttcatcttggctggcagaatagcttttgcaaattcgggattagaagcctggtttcatgagtttgggacgaaagctacagaaaatgcagacacagggtggatcttacggattgtgaagtcagggaggtctgaaatgaaatagaaatggcccaaggaaacctttcatattcctttttgtttccacatacatctggccacaaaagctctttggtggtttatcccatctcactgcttccttagggctctttcaaactccttgcatctatgtaagcatggataaggagcacagcagacatgggacacacctgtgttgctttctgggcatgctgtaggatgccactttttggctgtgcacctggagcaagaggcagcagggcagcagcacccagccccctgcagttgaagctaaagactgcagctgcagcgcaggaattccccagtaggacaggaaagcaaacacaggcaagataaggtcagagacagccaactgtttacagcgtccaagctcttcctgggtttggtccaccctattaaaagataataacctcttaaaacatttcaaaggatgtgttggcagtgtttaagaggaaacataattgtcaccacagcctgggtagtgtgcaattgagtaggagaccatcttcaggataggatgggtgatgggcaagattgtgctgggagaggagttcgtttgaactgcagactccagaagctacagtggctgcccaacccatgaaaacacccacagatgctgtaactgctgggtatctgtcatctttggaataaaccactcatgctggggtctcactttctaagccattaccagctgcaagggttggctttgtgaaggcaaagggaagtttactttataacgatgtaggctatgtggagatatagaattataggagcacaaagtgcattactgactcactgttctgctgcccatagagcagctcatcctgctttgtgaggcattgctgtgagttgccttcaggcaacttgggaggaagagctgcctgaaaccctttcttgaatcttctttaaggttgctgatcaggacccatctaccatgggaggactgtggggattcctccatgacctcagtgctgagctgatctggctcattaagagatggttcttacgaccgggttcggtggctcacgcctgtaatcccagcactttgggaggctgaggtgggcagatcacctaaggctgggagtttgagaccagcctgaccaacatggagaaaccctgtctctaccaaaaaaatacaaaattagctgggcgtggtggcacatgcctgtaatcccagctactcgggaggctgaggcaggagaatcacttgaacctgggaagtggaggctgtggtgagccgagattgcgccattgcactccagcctgggcaacaagagcgaaactccatctcaaaaaaaaaaaaaaaaagaaaaaaaaaaaaagaaaaaaaaaagaaagaaagatgcttcttacaaagaactctttctttgcatctcatggataatctgaattgtacatctcactgaactaccttctttgccatggctgctggggtgcccagagcaagtgaccatggcatgcatgctgtcacctaagtggctttctcttatttttcttttccttctctgttatttattctgttgtattgtttatattttgataaactcacttaaattcattttgggacaagatgggatctaaaccaagaagtagataaatatgtgtgctttagagggtagttattgcagagtctatcctgggaagagtggctcctttgttcaggatgcctttctgggtatgaggggtgggttcaattccttccatccctttctagaagtatgtagtctttgatggattcattgagtcactgatttgttctgtggacacttattatgtgccaggccctgtgctaggcctgaggaaagtgacgatgacctcagagttatgttccagtggtgggagataggcaaagactatgtaagtgggcagagacactaattacatgtaagaaccactgccttgaagggagaatgaggatgagggtgtgtcttaggtgggctgccatagcaaaataccatctactgggaggctaaaacaacagacactgatttcacatgctcttggtggctggaggtcagagatcaaggtgtcagcaagttttattctgaagcctcttcttttagcttgtaggcagccacatctcactgtatgctcacatgacctcttctcagtgtttgagcagatagagagagagagagtgctttgatatctcttcttacaaggatgttaatcttattggaccccatccttatgacctcatttgaccttaattatctccacgaaggcttcatctccaaatcacatcacactgaggcttggggcttcaacatatgcattttggggtgggcacagacattcagtcatgacagagagggagaagatctacttcctatggggtgacgcaggaagcccactctgcagagggcaacatgcatgctggaatggaaaggataagaatgaggtggctgtgggagaggagggtggggaggcatgtgagggcgcgaggtggagagaacagccagggcagaggccctgaggctccctgagcagctggtgtggtcgcagcttactcaggagtggagagtagcacaggggaggatgtgagatgagtggggcacgagtgtgcagagccttgtaaaccagctatggtgagggttttgggtttcctactacatccagtgcaacgttactgaaagattgtaagcagagggatgtcatgatctggcttaggcttaaggagctgtgtggacagtgggctggagggattgggaatggaggcaggagactgcttgtcagttttggtaagaggctgggaccatggtgatggccacgttctagaagagagagtggaatctgttgatggaggaaatgtgagagacagggagagggagcacttaagggcaactcctaggctctaggcagaacatttaggtgcatggcgatgctgtttactgagctgaggggatgcggaagggagcagaggcaacgtgtatgtaatgggtaattgcatgtgtcaatttgactgggctaagggatgcccagatagctggtaaacattgctttggggtgtgtctgtgaaggcatttccagaagagactagcatgtgaatcagtagactgagtaaagaagattaccctcaccagtgtgggtgggcattatccaactgagggcctgaatagaacaaaacggcagagacagggcaaattcactctccctgcttgattgcacatcttctcctgccctcggacattggtgctcctggttctctggcctttgggctcagacaaggtgatatggtttggctgtgtccccacccaaatctcatcttgaattatggctcccaagatccccatgtgtcatgggagggacacagtggcaggtaattaaatcatgggggctggttttcccatgctgttctagtgatagtgagtaagtcccacgagatttgatagttttataaaaggcagttccgctgcacatgctctcttgcccgccactgtgtaagacatgcctttcctcctcctttgccttcctccatgactgtgaggcctcctcagccatgtggagctgtgagtccattaaacctctttttctttataagttacccagtctcaggtatttcttcatagcagtatgaaaatggactaacacaacagggcttatacatcacctcccctttagacttgaactgagttacatcagttcactgtctgcaagctggaggttttcctgggcctccagcttgcagacagaagattatggaacttctcagcctgggtaattgggtgaatgaagtcccataataaatctcttatatttctctacatgtcctgttgtttctgtttctctggagaaccctgactaatgtagtatgtaaggcacccagtcataagggcaggctatccttccattaatgacctcattccgggtgtatctgtagcctagaccactcttctaggaaaatcctattcccttcttgtctcttccatgtggaaatctcacagacattgcaacccaacccatccaaatcagatgggaaccaggggtttaatgttaacaggtgatatctgctgctgccggtctgccattgtcctaaagcattttatacacattttcttatcttagaaagtccctgtaagataggtgtgctaacaagaatcattttgcagctgaagaaatggaggtgctactggctcaaggaacctggattcatttagagagtgtgcccaggatgagacgtgtggagagcctggcctgaaccaacactaacagtctcctggacaggaggtgagtaaggaagaagcggcagggaaggagggacaccgggtgaaaggaggtgggtgtaggaggaaggagatcacaactgtgttgaaagtcctagcagcctgagaaagacgggggaagaaggccctgcaatgaaccctgtgaccttgggaaggacaagtcctcttgcccctggggcccactgtctgagtccctaggaagtatatatacaaagggtttcggaatgcagagtttgcagatgtgggctgcagctgcaccctgtgtgtgactggatggaattcacagctagaagtggttttgtccctggctgctgaatgtatcagctgttggtgccgctttagttttattgagtgggaaggatgtagaccctgagtctggagaatgggactgggctggccatggagcctggagaagagaatgagaccatgcaaaacctttattccttgttcttggtttcttgttaaacaggcccagtgccaccagattaaggaggtgagggggcggttgtaagaaagtaagagatcagtctgaagattataaatatgggccagtgcaacaaagggaaattcttgtgtcaatatttttctgagccagcacttgggagatcctgatttccttaacaaaatgataacaaacattttttcatgttaataatgtaagatgaacatttccttcatgtttaagccactgaatgtgcagtgaacaaaagacatttacatacaggcatatttgaggatatggaaggttcaattccacaccactgcaataaagcaaatatcaccatagagcaatttatacaatttctttggttttccagtgcatgtaaaagttatgtacattatactgtagtctattaagtgtgcaataaccactccttatctgtctaagaaacatacataccttaattaaaagataccttattgctaaaagatgctaaaggtcatctgagcctttagtgagtaataatctttttgcttgaaggagagtcctgcctccgtgttaatggctgctgactgaccacggtggcggttactgaagcttggggtggctgtggcaatttcttaaaatgagacaacaatgaagtttgacacatcagttgacttttactgtcaggaaagatttatttgtagcatgcaatgctgtttgggatagcattttacctacagtagaacttctctcaaaaaaatggaatcaagcctctcaaaccctgctgctgctttatcaactaaatttatggaatattctaaatccttttttgtcatttcaacgatgttcacagcatcttcaccaggaggaaattccatcttaagaaaccactttctttgctcactcataagaggctactcctcgtctgttcaagttttaatatgagattgcagcaattcagtcacatcttcaggctccacttctcattctagttctcttgctatttccaacacatctgcagttactacctccaccaaagtcacaaaccccgcaaagccacctatgaaggttggaatcgatttcttccaatcttatgttaatgttgatactttgacctcctcccatgaatcaatgtttttaatgacatatagcatggtgaatcctttccagaaggttttcaattgactttgcccacatccattagaggaatcactatttttggcgctataaccttacaaaatgtattttttaaataataaaactgggaagtcaaaattatgccttgattcatgggctgcagaatggatgttttattagcaggcataaaaacaacattcatctccttgtacatctccctcagagctgatgggtgaccaggcatattatcagtgatgagtgctattttgaaaggaatcttttcttctgagcaacaggtctcaacagtgggcttaaaatattccacaaaccatgctgtaaatagatgctatcatccaggctttgttattccatttttagaacacagccagagtatgtaactcatttatttatttatttaatttatttattttattatactttaagttttagggtacatgtgcacaatgtgcaggttagttacatatgtatacatgtgccatgttggtgtgctgcacccattaactgatcatttaacattaggtatatctcctaatgctatccctcccccctccccccaccccacaacaggccccggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcatccttttttatggctgcatagtattccatggtgtatatgtgccacattttcttaatcccgtctattattgttggacatttgggttggttccaagtctttgctattgtgaacagtgccacaataaacatacgtgtgcatgtatctttatagcagcatgatttataatcctttgggtatatacccagtaatgggatggctgggtcaaatggtatttctagttctagttccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcgtgtgtcttttggctgcataaatgtcttcttttgagaagtgtctgttcatatccttcgcccactttttgatggggttgtttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtcctttcccatgcctatgccctgaatggtattgcctaggttttcttctagggtttttatggtttcaggtctaacatttaagtctttaatccatcttgaattgatttttgtataaggtgtaaggaagggatccagtttcagctttctacatatggctagccagttttcccagcaccatttattaaatagggaatcgtttccccatttcttgttttgtcaggtttgtcaaagatcagatggttgtagatatgcagcattatttctgagggctctgttctgttccattggtctatatctctgttttggtaccagtaccatgctgttttggttactgtagccttgtagtataatgtgaagtcaggtagcgtgatgcctccggctttgttcttttggcttaggattgacttggcaatgtgggctcttttttggttccatatgaactttaaagtagttttttccaattctgtgaagaaagtcattggcagcttgatggggatggcattgaatctataaattaccttgggcagtatggccattttcatgatattgattcttcctacccatgagcatggagtgttcttccatttgtttgtatcctcttttatttcactgagcagtggtttgtagttctccttgaagaggtccttcatatcccttgtaagttggattcctaggtattttattctctttgaagcaattgtgaatgggagttcactcatgatttggctctctgtttgtataagaatgcttgtgatttttgcacattgattttgtatcctgagactttgctgaagttgcctatcagcttaaggagattttgggctgagacgatggggttttctagatatacaatcatgtcatctgcacacagggacaatttgacttccacttttcctaattgaataccctttatttccttgtcctgcctgatttccctggccagaacttccaacactatgttgaataggagtggtgagagagggcatccctgtcttgtgccagttttcaaaggaaatgcttccagtttttgcccattcagtacgatattggctgtgggtttgccatagatagctgttattattttgagatacgtcccatcaatacctaatttactgagagtttttagcatgaagggttgttgaattttgtcaaaggccttttctgcatctattgagataatcatgtggtttttgtcgttggttctgtttatatgctggattacatttattgatttgtgtatgttgaaccagccttgcatcccagggatgaagcccacttgatcatggtggataagctttttgatgtgccgctggatttagtttgtcagtattttattgaggaattttgcatcgatgttcatcagggatattggtctaaaattctctttttgttgtgtctctgccaggctttggtatgctggcctcatagaatgagttagggaggattccctctttttctgttgattggaatagtttcagaaggaatggtaccagctcctccttgtacctctggtagaattcggctgtgaatccatctggtcctggactttttttggttggtaagctattattgcctcaatttcagagcctgttattggtctattcagagattcaacttcttcctggtttagtcttgggagggtgtatgtgttgaggaatttatccatttcttccagattttctagtttatttgcatagaggtgtacagtgcaatcaaactagacctcaggattaagaaactcactcaaaaccgctcaactacacggaaacggaacaacctgctcctgaatgactactgggtacataacgaaatgaaggcagaagaaataaagatgttctttgaaaccaatgagaccaaagacacaacataccagaatctctgggacacattcaaagcagtgtgtagagggaaatttatagcactaaatgcccacaagagaaagcaggaaagatctaaaattgacaccctaacttcacaattaaaagaactagagaagcaagagcaaacacattcaaaagctagcagaaagcaagaaataactaagatcagagcagaactgaagtaaatagagacacaaaaatcccttcaaaaaatcaatgaatccaggagctggttttttgaaaagatcaacaaaattgatagactgctagcaaggctaataaagaagaacagagagaagaatcaaatagacacaataaaaaatgataaaggggatatcaccaccgatcccacagaaatacaaactaccatcagagaatacaataaacagagtatgtaattcttaaaagccctaggagttttggaatgagcgttggcttcaatttaaagtcaccaggtgcattcgccctaataaaagagtcagcttgtcctttggaaacaggcattgacttctcctctccagctatgaaagtcctagatggcatcttcttccaatagaaggctgttttgcttgcattgaaaatctgttgtttagtgtggtcaccttcatcaatgatcttagcaagatcttctggataacttgctgcagcttctatgtcatcacttgctgcttcaccttttttttaattttttttttgacgtttcactcttgttgcctaggctggagtgcaatgctgtgatctcagctcactgcaacctctgcctcccaggttcaagcaattctcctgtctcagccttctaagtagctgggatcataggcgtccaccactacttctggctaatttttggtattttcagtagagacggggtttcaccatgcctggtggccaggctggtttcaaactcctgacctcaggtgatctgcccgcctcggcctcccaaagcgctggaattacaggcatgagccaccacaccaggcccaccttgcatttttatgtgatggggacagctttttttccataagcctcatgaaccatcctctgctagcttcaaccttttcttctgcagcttcttcacctctttcagccttcattgtattgaagagagttagtgtcttgctctggattaggatttggcttaaggcagcatggctggtttgatcttctatccagaccacttacgctttctccatatcagcgataagcctatttcactttcctgttcatgtgttcactggaggagcacttttaactactttcaagaacttttcctttgcattcacaagttggctgtttggtgcaataggcctagctttcagcctgtcttggcttttgacatgccttctactaagcttgatcattttcagcttttgatttaaagtgacagatgtgtgactcctttcacttgaacacttagaggccattgtagggttattatggacctaattttaatattgttgtgtctcaaagaacagtgaggcttgagaagagggagagagatgggagaacagctggtcagtggagcagtcagaacatacgaaacctttatcaattaaatttgccatcttatatgggcatggtaccccaaacagttataatagtaacatcaaagatcaccgatcatatgtcatatgtcaccatacagacataacgatgaaaaagttgaaaatattgtgagaattaccaaaatttaacagagacaggaagcgagcacatgctcttgatacaattgcttgacacagggttatcacaaactttcaatttgtaaaaaatgcaatgtctgggaagtgcgataaaatgaggtatgcctttactgactttaattttagtaaatgacttcataaggaaaaggaaaaaatgtcattgtgagggcactgtgtttgttatagactagctaggtcatcaactgggtggttttgatactagcagagtcctccatgtgctaggacactgtttgaaattcttgttatagctttaaaagtcatggttttatcaactaactccctattagttactgtaattgaatttttatgttagcttccactagtagcaagtttttgagtcaagatggcccttgggttttattgccaaccctgacagcagaatcctagacagggtcgctttgctcttaaagcctctgatgtccagttgcaaagtgagtataattgcttctctctcagatctgtgttgaggagctcaagaaataacgaatgtggaagcactcagatcaattactttttttgtttgtttctaccttatctagtttcctaggtcaaaagtttgcttggctaatggaagaaaggagtcccaacctttccaagtgggacagattccctagctgtgctctgtatattgaatctgcttcttatcatttggctgtggtctgtgtgagtgctgaaaaggaggagataatttcacgcactagggaaatggaaaagactcctgcttggcaggcaccagggtggcaagagaatccaggatgtggccacgcacagcttaaagactacatttcccagctgcctttgcaggtgaatgccatcagtgagacctaattgagagtatagtctggggagtctgggaatgttgcctaagaaaggctgatttagttggtggtgcaactccctttttacctcccctctttctctctttctggaatgtggatatgatggcagaaccacagatgatcttgaatgaggaggtcacttgctgaggatggtgcaacagaaagatggaaggagctcaatccctgatgagcttgtggacctactgtatcagtcctggattactcactttctgtcttttatggagagaataaaccatcctctttttaagttgctcttccccctttgtttgtgatccctcttaccatagaccaaacttaattcctaatgaatagatctgccaaattgtttatatcagagatgacaacaggaacacatctgtttacattttcctttctcctgaagccccacctagtcccagagggtggtgtgtttcttcactgctattttgggcagaagctacccggctgtggtggttaaagtcagcactgctgttagcccttgtggggcctttgtgcaaattgaaaaaaggcattcatatcctaagacaccttcctgttctttgccagaaaaatgtctcaatgcaaattgacaatgtgtggacaggaatggaacatgcccttgagaagcagcccctgcacaggatgccactgctcagctttgggtcaatgtccaggccagtatctgacctcgaacttctctctaggtcttccacctttacttagcacaggcctcagaacagtccagccaggggtctaggagagaaagtggctgagactgtgtgagatggggatggggcagaggacggatagggtagagggtggattacagtgagtttctggctattgactgctttcacatgagcagctcatttctgtgccaaccatttgactagtaagttggcagaagccctgcctgttggtcacattctggcccatgctacaaggccacctggcaggctcaggctgcagcacggcaggctgtgtgcacacggctatctcccctagtctgtccccagagctgtctgtgcagtcctgagctcccatgtaagccaatgctacttttgtgtgaagaaggtggacgaaatcatcagcaactcttgcttatatagaatgtgacccaagcaatggaaagagaaaatccaggtcttggttttgtactggcttgcgagaagtccttcttttcctctctagcaatttccctacatccatccctgcctacccacattggattaaagggaagagagaaaaatgccctaagccccagagagaaaggtggcagaaccatgatattgctgctcttgactttgtaagatggccaacatcagcccagagaaatctgatctgaaatagaatgagctcacctgacttcgaaatttaccacatttgtcatgaggcagtcacttaacctaaaaagtaaacaggctcttactctgtcatagtttacatttgtgtgtgtgtgtccttttctgttttctttctttctttctctttctttctttcttttctttctttcttctttctttctttttagtagctttaacttgttctgcaaacaaagaatatgacagaacaatgtacgttcctttgaaatggcaccattaatcttgatagcaagtttctaattatgaaggatagagagctttggctgcttcatggaactgtgtcctggtgacttttttcagtccctttttcttgctttccctgtctccggtagcttccttgagagctgtggtttctcagtgttagatattcaaaagcacagcagcctacaggccatggctaaatcttctttacaaccagatgcatatgagatcttagcaggaagtaagaaaagtaaacgcattattaataaacacacttaaatgcatacaataaaatgaatgctgtttccttcaaagtaaccctcctttgcagatatagtctaaccaagcctctattgccctgcccagcatggatctgaaactctcctccgtaaattctctagaactctaggaccgccccttctaaatgcccaaaagaatcccaactgactgagggcaaagatgcaccttatttctggctccctttcgcttcaccacttgacttcaaatgacttcaggctgattccagaaagctaatacaccctcaaaggacaatgcaccttcatttagctcactcaggagagaggccacagtcttgaggggaggcactctccaaggcacagctcaaaaattgtttcaagcaatggaatcttcacgtgaatgggcacatggcctcccacagcaaggatgctcgttaatggggaagaatcactgaaaatccgaattcagatgtgtttcagaaagcagcttcaaagtgtgtgactgatcttcctagtcctgggaagagcagaattggcccttagaaccgttaagagtcagattgtgaaacagagagttcttgttccccatatgtttcactctaaatggaacatgaatcagagctgggagaggagcttccaacttctgtcaataataaaagccttcttatgagtcaagtgctttgtaaatactttgattggtagaggaaaaaggaattgcatattgaaagaactgtatttccattaaaatgcatgtgtgtaaagtaaagaagggcaggaaacattgagcccaagactttctgagtttgagtgaaccaacctgctggagtggtttctggccatcactttgtgctgccatgtctcagcctgtgctaagtccagaggatctggggttccgatatttgcaagaaaaagcaaggacaacaggtttgaagtcaagcaatgggagggtctcccagagacctggagcagggaggatgagtgccttagctgcttctgtctatccatcttccatctgtctggcaatcaggatattttctggggcccattcaatgcttctctgttggctgggggctcccatcagctgccaggggttccacctgttttcagtggtccatgtgcagtactcagagaaatgcctcctgagggaatgagtccagcgggtgagcgccttttaagaaatgcggtggctcacacctgtaatccagcactttgggaggccaaggcaggcagatcaccagaggtcaggagtttcaaaccagcctggtcaacatggtgaaaccccatctctactaaaaatacaaaaaatagctgggtgtggtggtgggcacctgtaatcccagctaatcaggaggctgaggtaggagaatcgcttgaacctgggaggcggaggctgcagtgacccaagattgtgccactgcacttcagcctgggcgacagagcgagactccatttcaaaaaacaaggagtatgaaaatgctttccagctctttgcagtagggcctgtctcatggggtgcagcctggaacttgcgcaggcccctacacagaaggacctgtgcttggcccaatgctctgctcctgctgtcttgtcatacttaatactttttttagcaagaggccctgaatgccatttgcattaggcaaattctatagctgatcctgatgaggctcttctgtatggggacctgcacaactgcaggactgcaccctatgacgcaggccctattgcaaatggctggaaagcgtttttgtatttcttaaagggtgttcactccctggattcagtcgcccccaaaataacgtcttgggtgtcttatttaggtggcacctgcttggtctgaaagagctcatgtgacttcaggaaatactgaatttgttctgagaaagcctcttgccctaaaaaaaagtgtatggggggagtgctcctagtctgtcatagttaaagttcaaaggttatttacagtgtgttgcatccactgtggtgactcctggcagatcctgaacttaagcagacgtgtgttacagatcttaatgagtgtgttgatgccgatgggagttgccctggatcacaccaagtgggtgatgggtgggtgagaggagagacattctttttgttaacccctcatttccacggtcagtctcagatggtcattacaaacctcttctaaatctggacctcaacaagcccccctcacaccagggacaaagtaagggtcatgcgatggcctctgagctgaccttcgagttcagagtggccgtgtgctggtgctgtgatcattaaactgactgctttgcaaggtcagcactcaaggctatagatttatatctctcttttattctaaaactagactatgccacaaccaggtgactgtggtgcctcactcaggtggtctgtcttctgcagttgaaggcaggtctttttcctccatccattcagattgaatccagggggtcctccctggaagacctgtgttccacagaagactcccctggagcttctcctctctgcacctcagctttcttgtgggtgcagcaggccacccaggcccagtccctgctcacgacaatgacttcagctttccagggtctttctcatgcattcccaaccattagactccccagtcctctctctattttttccccttatttagtaaatatttattgaagatccattacttgcacaaaagacagcaggccgcagggaaaggggtttatagtgggagatacgatgaaaagatgattaagattgcaagttctcaaaagtttagatgttgaagtattattttccaaagtgagttacacagggtattaatgggtaccgctcaaagaaagggttctagagtgaatatgaaacattggcttaaacaaagttaaacattttaaattactgcacagcttctcaaaagttttaatatgctaatgtgtcatctaacttcccaaaaggagaaacataatatattggacttcttaaaagtatttatgacattttttcttgcattgaactagtcccagatagaagacttagccttaaagggcaaaataaaaagatgagttctttttctttttaactgacaaataaaaattgtatacatttatggcttataatatgatgttttgcaatatgtatactttgtaggatggctaaactgagctactaacatgtgcatcacctcctatttttttgtgtggtgagaacacttaaaatctactctcagtgattctcaaaatacaatacattattaactatagtcagcatgttgtacaatagatctcttgaatttattcctcctgtctaactgaacttctgtatcctttcaccaatatctccccaaccttccccatacccctgactccagcgcctgctatcaccactctacgttctacttctgagtttgactttttataatagattccacatatgaatgagatcatgcagtatttgtcttccgtgcctggctcatttcacttagcataatgtcttcaaatgtcctcagggtctgcccctctttctgcctctgtgggggctccaagtgggaattcgtggttactgtaattggcagggggcggagatttggagctggaacctctagagtctgagctctaccatggaaaggccgtataatgctcagcaagtcatttaactctttggtgtctctgttttctcattgataaatgcaaagataatagtgcaccttcactgagcttcactgggttagccaggtaaaaagccttatggggcaatgcctggctctggcaggcttgaatgctggccgctggctctggttctcccatgtggaaacaaagcctacgtctcacacccagcagcaggagcagcggggtctcggcccagccagtgtgtcctgagtggcacagggtcagacataaccaggtccatgaacatttgtgtctttgtataaggtcagacttttattgatgcaatttcaatcataaaagccactagctgcatggagttcccaaggaggtgattttctttagtgctacctgtttacttggtagttaaagcctcaggcgcactttacaaatcagtcagtattgcaaacaagacatagtagtacacttaatcaatatacaattgctatagattaaaccttctacatcagtaaacattcataaagtaatatttaacattaagagaaagggggataggataaacgggttaatgaaccagtccaagagggtaacatgaacaaggagaatgtcctggtctgatctggatggacatcaacattttgtaagaaagagactatcgtggcagatgctgggtgctggtcatgagtaacagcaggatggggtctatgaagacggccatctggagctggtgaattcttcctctttttatagcccccgagtcctctggtgaggactgataaagtgaaccttatctgattgggtatagtcactgttgattagacaaacatctggctcctgttggcatgatgtcttttaaaaatgtaagatggagtctttttctaagatggagtcacttaggtcaaaggtcctgtgtccacaggggctgcccacatttcaccacaagttgccatgagactgcccaggaggacccgaatgcctggagtgctccagccatgctcatgccacggcttttgtccctctgcctgtctttggacacctctggtgtggagttggagatgaggaggagaggcttgcattcctatcagcagtgtggaatgagcagaggtgcgggtagactgaagctctgtgtttaacctctgtttacagaatatggacgctgagagagagtctggggtacttaaggaaaggcttgattggattgcagaaaacagtttctgaaacagactatttctgaagactcaaattttaattcttttgaatttatacagcaactcatctcacaaataattattaaatgataataacaataataatgatactcttcctcctcctattatcaccaaatagcatttactgggtgttggcaaaatgctgggcattggtcaggaatgctggacttgtatttccacttgacccttcaaaaatccttgtgatcaataaattactatgttatataattaaaatattaaaattattggaaattttatttaataatagcaataatatattagtgtaaatacttttctgaataatgaaatatacaataatatattatgcacaaacacaaatgtgttaagtaaacacatcagagcttgttgccagccatgatataatgtgtattatcatatgctataccgacatccccatttgacattggaggatatgagctctgggttgctaagtgacatttcccaggttacagctctctggaggaggcagctggactccaggaccccgtgtttcctgagacctccatagcctgcctcccgctttgctgtgctgcttctatgagaagataaagtaatttaatagcagctgtcgatatgcagggccacctctcaagtgcttgaaaatagttctcttaagcgggaaatactttttttttttcccaaaataatttattatgtttcaaaagtatttcctctaattgcagggaatccaaatcaagcgcttgcatttcttataaacaaacacctctgtatactttcccctgaccatggctgacttcaaaaccaggccggcctgcaccagagcctcagagccagagaccgccccaggcagaaccacagactatgcagggcacctctgttcacctctgcacccatctccctgaagtgccgggcttggcttcccggcaacatccttcatttcaacagctaaatacgcggtcaacaatgggttggtgaaaatgggggcgcccaggagccattccatgccttcagatggggtccgggctcactgtgcaatgcatcatttcacacaggttaaaaggaaaagcagttgccagtgcctgttgttcatttaaggagattaaaatgatagaaaaagaggattttgcatttagacagtgagcagtggaatttaaaaagcagtgccagaaatcatttagtatgtgttacattctattcttttttttttttttccagacagagtctcactctgtcatccaggctggagtgcagtggcatcatcttggctcactgcaacctctgcctccctcaagttcaagtgattctcctgcctaagcctcccgagtagctgggattacaggcacccgtcaccaagcccagctaatttttgtatttttactagagacgaggtttcgccgtttggccaggctggtcttgaactcctgacctcaggtgatccgcctgcctcggcctcccaaagtgctgggattataggcgtgagccactgtgcctggccttagtatgtgttacattaaaaaaatcactccataaagatgtacaattattatgtattaataaaaaatgaaaataaaaagaccgtgtaaactgccacgtattcccactggagagctggtgagtctctccgtggatcgtaccattaccacaagagtcctctggcccacgcacaccctgctctgcccatcagcagtgctccccctcctctccgccattggcttctcatatcctcctgggctgatgtgcccatgctgtgtactcaacactgcctctggctggtgcaagcctggaagggaggtagacggtatggatggctaagcaggcgagctgggctggctgtggcctcggctgtctatcacgctgctacccagcctcggattcaggtcgaacttgcctgcactttctgaacacctagaaagatgcagcccgggcccagacagttcacttctcactcagcaaatgggaaaaaaaaatggagaaggcgctgcgtcctttgaggctcctgccctccagccaccttatctactgtgtctctctgggctcaaatggcgctttcctccagggctctcttggcgtctcatccctctacctccacagggtgtggtaccttcctttgttcctgtggttcccactgcacagctggatctctgttctcactgcctgaaattaacattcctgttcccgtttctcttgccttcctgacttccaggaggtggtggcagttactcagctctgcttccacaccctcgccatgtcttcctcaatagactcaaccctttgtcctgctagttgctagtactcaggtcacaggcagtggaactcgtcttcggcatttagtaagagatggcctttctgactttgtgccccagccacggtgcagtcttctggatctttcccagcagcgtcgacaccgtgagtgctgcctgtgcacgcattcgttgcattcttgctccagatggcagtctgaccagcacgactcaactcccctcccctcctgtccctttctagtaaaattgcctgtatgttaccccaacctctgctgactcacaggtgactgctgtcctgatttttaaccccgcagaataattttgtctgtttttgagattcacataaatggaattgtatagtacacactatttggtgcctagtggcttgaatttagtacagtgttttagaaacacatccctgctgttttgtctgtcagtagtttatttgtttgctgggtgatgttccattgtataattatcctataatttctttattcattctcctgttgttgtgcccttgtttatttccagtttttggctactgtgggagacagcatgtgtagcagtggcgctagctaggcttggacattagtctctctccagaacttgggacaggccattaaggacaggactggtgaatgtgacccagagcttgctgaccctcagctgcctgggacagcagtggcagtctgaccctgggggagtcagaggagggccacgtggtgaccgttacaccccaggagatacggactcaatgagcaaacccctgtggacaggggtcaaggaatctccctcctaaggaaatacagggttttgtgattttctttggttcaatgtcaagagaatcaagttgtgggaaatgctggaaccctcctcaactcagtgcactgagtccctgaatgctcactaaaggagacaggaaaggtggagtgcaggcctgcacagcagctactgggctctggatcagggagggcatcgtacaatatccaaggagagagcaacggaaggaaacaccagttaattcatttaaatctcacaataacatgtcatctctatttcatagatttgaaagctgaggttcagatatgttaaataatttgtccaggggtagcagctagtgtcagagccgcttcttaataactggccacagaactagataattctccaaagataaaatgcaaactaagtgactagtagaaaacattgattatatattagttttatgccaaatgctattcttgccagggtattacagttaaaaagacagacagaaattcttgccttgatggtgccccaggatgagatgaatgatgaacaaagtgaacacatagagtattctagaaggtggtctatggagaaaaataaaacagagaagaaacaggggttgtggtttcaggggtatttgcaagagtaaatatcttgaccaggaaaagcctatgagaaagtggcatttgaggacagacttgaaagagatgagagcatgaccctggggtgggattgagcattaaaggtgaggaaatggccgtgcaaaggccctgtgacagcagtgtgccaaggctgagaaaatgcagagagggcagggtgacttaagtgactgagtgagggggagtcataggagctggcgtcagaggggggtttctggggatgagctcaggtggacctcacaggccatggtgaggaatgactctttgctgagtaaggtgggaaaccatggagggtttggaacaggggagtcacatgccctgagttgcgtttaacaggatcgctctggctgcccagttgacaacagataattgtgggacagaaacatgaagacccttaggacattattgcaataattcaagcaataattcagatggtgactttgaccagagtggctgttccacacgtggtgaaaagtggtcacaataaggttcaattgggaaagtgggacccaaagatttgctcacggataggatgagggatgtgaaagaattgattctgactccaaggatggtgacattgctattcaccgaggtggggcaggtgacaggaaagcagctttgcagggaagaacaggaactcatttttggatacttcacactgggaaatgccaaggaaagctgttagacagctggatatctgcatgtggagttgagggaggggtccagctcggaaatataagcatgggcgtcatcagcgtacagactgtatttcaaacatgagagtggatggggttatctagggagtgcctctgacattctgaggttgggctagacccaggggaggagacagtagaggggcatccagtgaggggagaggaaagcaggaaagcagcggtggactggagggggtgtctggctgtgtcacagcagctcttaggtcaggtgatctgggggcttggcaatttggagctcatttgagggagattttgcagcaaaagcctgagtgggttgggttcaagagaattggggactgtggacacagacaactgcaaagggttgggtggagaggatgtaggccaaaagaggctctgtccagcctgaccaacatggagaaaccccatctctactaaaaatacaaaattagccgggagtggatgtgcatgcatgtaatcccagctactcaggtggctgaggcaggagaatcttttgaacccgggggtgcggaggttgcagtgagccgagattgtgccattgcactccagcctgggcaacaagaacgaaactccgtctcaaaaaaaaaaaaaaaaaaaaagggaaagaaaagaggcttcttctaactctttttcatggcagatttcaaacatatacaaacacaggatgaaagaacaaaatgcttgtgtctccaccacccacttcaacaatgatcttgaccaatcctgctccatctataccattccttcccttgcaaaccccaaacatgtatattaaattaattgatattgccccacctgcaaaccccaaacatgtatattaaattaattgatattgctccacagctcactgaggccccacagctcactgagaccctgtaaaagttttttgtttttttttttttttgagttcttctcccctctatgcttcatttgggataggtgccatggggctgccttctagtttgctgatcttttcttctccagcatctaatgtaccattcatcttatccagtgaactttccatttctgatattttacttttcatttctagaatttcatttgtttggtttttgtatcttccatttctttgcttgtcatgtttatgccttcctttttggtggctcacgcctgtaatcccagcactttgggaggccgaagcgggtgaatcatctgtggtcaggagttcgagaccagcctggccaacatggtgaaaccccttttctaccaaaaatacaaaaaattagctgggcgtggtagtgcatgcctgtaatcccagctacttgggaggctgaggcaggagaatgacttgaacctggtaggcagaggttgcagtgagctgagatcgtaccattgcactctggcttggacaacaagagcaaagctccacctcaaaaaagaaaaaaaaaaaggaaaaagaaaatatttgtaagattaaaaataactgttttaagattcttatcagatagtttcatcatcattgtaatttctattgactatcttttttaaaaatccagtttatgggttatggttttcttgcttctttgtatgcctggcagttttttattagatgctctatatagcgcacttttcattgttgagggctagattttgttgcatttccataaagagtgttggattttcttttggaacacacttaagttgcttgggatcaggttgaccacttcaaagcttacttttatgttttatggcaggcccagagcagcatttagtttgggactaatttagccctactgcagcaatgtccacaactagggcatggcatggatggagtggcccatgcagagtagggaggggcaaggcacgttcaagagctgagaggccattataggaaagatcatcttgtgactattaaagtggccaaggtactaaatctgtttgtccttccttccttccttccttccttcgtccttccttctttccttccctccctccttccctccttcctttcttccctccttccctccttcctccctcccttccttccctccctccctccttccctccttccttcattccttccctcccttcctttctttcctccctccttccctccctccattcttccctccttccctccctccctccctctctccttccctccctccctcccttccttccttccttccctccttcctatctccttccctccctccttctttccttccttcctttctgaaagttgggaaaataaagaactaaattccgtgcatgatcctagattggatcctgaattgggggtgaggtcctataaaagatattattagaacaatttgatgaaatttaaatttgtacagtatattaaataataatacataaataataaatttcctgaattgggccaggtgtggtcgctcatgcctgtaatctcagcactttgggaagctgaggcaagtggatcacttgaggccaggagtttgagaccaggctggccaacatggtgaaccccatctctactaaaaatacaacaattagccaggcatggtggcgggtgcctgtaatcccagctatttgggaggctgaggcactaagaattgcttgaacccaggagacagaggttgcagtgagcagagatcatgccactgcactccagcctgaatgacagagtgagactctgtctcaaaaataaaaaaaaaaaccataaaaatgaataaattttccaaatttgatcagtgtattgtgattatataagcgaattccttgttcttaggaagtacatatgctgaagtattgagatgcaaagggtcaatttactctcaaatggttcaacgacataaagagagaaaaaagaaaaaagagaaagagcacaaatgtgataaaatgtgaacaaagaatgaatcattgttgtactataattcccgggatcccaggaatatgtactcactaggacagtcatttgtcacgttgcttaggaagcaggtttggagtcttgtgtggggaattcgtcgacaccaccagtcccgagtttatgtgcagtggaaaatggagcagtgtggtcagcagtaggagagccagcttccaccctccacctgctgttccacgtggtgggtctgcacagcctggcttgtgagcaaatccatttttccttctctttgggaccaacatgggcttagagatgacatagccttgggcatccaataaattcaaatttgagaatctcaatgattcaaaattgctgctgtcaattaatacatgatgaattcatgttgttttgaaaaaagaatgattgaggtgaccaacagaagacttcaatgtttgtccccaagtaggtaggccaccccagatttccaaccctgggtgcattgcattggcaatctaaatcccaaggactgtgaactctgtggtcattctgcagtttcctctgagagtattcatgggttggggaatctcctgctgaaaaggatattgggtaaaattgctttatgtgagcactagtaaacatttagcatatattaccaagaaaagcaacactgtaagcccaggaagcttagagcttctcaaacagaaggggatgatggagaaaaaaggtgaaaagtctggcaggcaggatgaaggtcaatcaaaaaagggcagctggccacagggaaatatcatttcacccctactagcgtgactgaaaaaaatgtatgttggtgaggatatagagacattgctgatgtcattttaaaatggcatagctactttggaaaacagtctagcaattccttgaaaagttaaatgtagagtttccatatgacccagcaattccactcctaggtatatactcaagtgaaataaaaacacatgcccccgcaaaaacaaaacttgtacacgaatgttcattgcagcatttttcatgatagcccaaagtggaaacaacccaagtgtctacaaactgatgaacgaataaataaaatgcggcatattcataccaagaactatcctttggcaagacaaagaaatgaaatactgataaatgggacaattggggtaagctttgaaaatgtgctgagtgaaaaaaagccagacacaaaaggccacatattgtatgactctgtttatctgaaacatccagaacaggcaaatctgtagagacagaaagtagattagttgtggcagggctagaaggagagggatttagggagtgatgacttatgggtgtggtgttttctttttggggtggtgaaaatgttctgaaattagatagtagtgatggttgtacaactctgtgaatatactgaaactaactgaattgtacgttctagaaggatgaattttatggcatatgcatggcacctaaaaaaaccaaaagagggcagctgtgtatcctgggtttttccttgcttcttgtatgtgtgtttctgcagtccggttgagcagctatgcctcaaccctcgggtctatcctggtcttgaatgttcctgactgttgtcttcagtcttggaaccacacagcaccacagcacagcctgcaagccttcctgggaagatttacacctctaggctgagtctctgctactgcactttctcctccctctcaaatgaaaccgcagtgcctctctgtgtgaccttctcagtcatgcaatgacttctctttcatttcctataagcctctgagctctgccttctccttgccaattccccttagctccatcttcctttggccgtccgccgttgtgtaaatctgtagggaaatgtcattcaaagacaaaacccactgcttattcttctttcttaattgctccttgggaaatgtttgcttctgtgttcttggtgaaggaaagcttaattttgtctgcttttatatcactagtcttttcagattacacattcccaatcaatcacctcttgaatcaagtaattagttttattgtatcagtctatccttcagaatttcattatgcaaatataaacatgcataaatacattcatgtttccccgccttttacacaaaaggaggcacactgttttgtgccttgctttcgtttcacttactatgtctgagaacttttcacatcattatatggagagcttcccctttctttatcagctgtgtgagagtccagtgtcaagatggactgtgtttggtttcatcagtctctgtggaaggatcctggctgacctgtgtcttttgcttttacaaaccttgctggatgatctcacaatcaccttgttgcatgcacacgtaggcagagctgtagaatagactcccagtggggcagttgctgggcaaagggtaaatctctttataattttggcacatattgccagagtgccttctacagggttctatcaactgctgggcactcctgtcagcagtaagagtggctgcttctcccagcctttccagtaaaatatgttaccaacatttgaagccaggtgcagttgctcatgcctgtaatcccagcaactttgttactaacatttgggatttccgcaatggtgtgtgctaataaatgtttaacaaccacttctccaaacaaaacgaaacaaaacaaaacccaaaaccaaaaaaacaagaagccctaattgtagtatctgctgatttccatagcataaatacttctacccaggccaattgcaagctatcaacatgatgtccctgaacacggagttgggaagagatgggccgtagcacccactgtatagtatttctaccacacagatgcaagagatgcaagtagcatggataattgtgaaatgtggtaaaataataaggaatttaagagtttttatttcctttgtatttgtatgatttatttagttataaatttatataattaaatcttagcaacaatctgcatttaacaacctactcataaaaccagctcctaaaaatctggtaattattcatggtcaactgtcaagagtcagctccagcacactactgcaatgctgccaatttgaaaggtagcgaatgccatcccaatgtagttgtcatttttattgttattgttttacttgtttaaggacgatttgcatttccttttctgtgaaatatgtttctgtccttcgcacatttatctactgagttttattctcttgttgatttctaggagatccttatacatgaagctccttctgcatatcttttgtctgtgttataaactgcagtgttttttcccggtttgttatttatcttttgtgcttgcccatggcatttttctttttttctttttctttttttgccatgaagttgttgttgttattgtttcaaaatatagttgaattatttttttcattttttctggtttttttttttttttttttgacacggagtctcattctgtcacccagactggagtgcagtggcatgctatctcggcttaccacaacctccacctcccaggttcaagcgattctcctgcctcagcctcccgagtagctgggattacaggtgtgtgccaccatgcccagcttattttttttttgttttgtatttttagtagagatgggggtttcaccatgttggccaggctggtctcgaactcctgacctcaagtgattttcctgccttgacctcccaaagtgctgggattacaggtgtgagccactgtgcccagcccattttttcttttatggcgtccaaatgttgaataactaggaacaacaggattaaatacattttttttctaatcacaatcaagtttcacatacttaagcaagtttcttatactctaagcagtctgtacaattcctgtatctccttggagttcattatattcaattttgtctttttcttttgagtcagattattatttaaaaaccctctctacttaatggtatcacaaatatgcataatatgttagagacaggcctggcacacttcagctaaaaagaagtatgcatagaggttataaaatatttatcaagataccatcactagttcagtggtggctaaccccaccacttttctgtgactagtattatttcctactggggagtttcttcacttgtgtttgacttcccatgtgggcattgtcttagtaattttgtgttgctgtaacagaatagcacagactaggtaatttataatgaatagatatttgtttgacttatggttctggaggctgggaagtccaatattgaggtactgcatcagataagggaagctctcatatggcaagaaagtttacaggggagagaaagagagggctgaccttgcttttataacaaatccactctcaaggtaaagaatccactccctcaacaatgacattaatccattcccgatggcagagccctcatgaaataataattgcttaaagatcctatttctcaacacagttgcactgggaaacaagttcccaatgcatgaactttggggaacacattcaaagcatagtaggcatgtactggcttagtcctgcattgctctctccatcagacttcaaggcccaaagctctaagaatgatgctggagtgtggtttgtgttcaagaaatattagttgagacaccacattcaaaggtatgaacccctcagatagactttcatctgcatctccaccatccctgacaatgcccattaacatttagtcagcagccacacatttccagcattacttgagaagctgtgcatgtggtctatgtggtgtagcctcagaatacggtcatgcagaaagttctaactcagtgtatctaaaagccacttgaccacttagagtgagcttttatttctagcatctcatttttggttctgactttagaaatgtgaaaaccagatctcaggtatgatatgtaatttacccaaagttacctcattgctactttggcttttagtagtgcgtctggcacatagtaagtcctcaataaaatgaagagcatttgagatgacatgattttcccatttcccagtccagggctcatgtcactgtcctattacaggtatgacccaagatggtggtggctggatagtttccttccaaggtactctttaaggggtagacatgaaaggcagtgatcactcatgccaacaccctatgcttgtaacctgatctccccctggctggtaggccttattctgtcaagatttacccttagaaaagcatatgataagtataacaactacaaaatattgagggcatattatataccagttaatgtgctatgtgtccaatcctcatccaaccctgtctggtgttaatattattactgtcattttataggggtgcagagaggttataggactagtccaagaccagacagaggcaacagtagagccaggtggaaattcaggtctgtcatggtcacaatgctctttgtccgtggggcatggagttgcccaatatattattgttttacagtctttagacacagtgtcttcgcttgacaggaggcacgttcctttatgttgtaggaaatgcactgaacctgaataactctacaggagagctctcatccccccttccaggtcgtccctgctctcagcctgcacctcccattttttgatcaagacagccttgaagttctttatgtctgtggaaggaaggagacggagcttgtttttcacttttgctgccatgattaattatttttaggaaagcattgtgtcttttgagagaggattgtaagtgctgggagaataaatggatcttagagtgagccttgtgtgctccagacttccccagcttgataaacagcttcctgaccagtggctgccagtccctggtctcactggacggacattggctgggggccaatgtctgagttgaatggcgaggactggacagtgcttcttcccagccagtgtggcaatgagcccactcttaagaaggcgccttggcttgggaaaacacattgcacattagatgttggtatccgcggcagggacctgaggctggagtcactgccaggcaccttctgggaggcctggctttccagcaaggcctgcttcacattctcaggagaaccagacccagcataggaaatgccctattgcccaagaggaaaccccatgtcgaggaactgatataattaggatactgataaaaattagaatgagaaggggagggcctaaatgaagggtcatggggtgtactttttaaaaaaaacaaacaaacaaacaaaaaaaacaaaccttcctgcccttctctgcatatgaatatactacatgcttatccaagaaaactttgaaaagtaaataaaaatttcttccaataatttcacccagaaatttaacttctactatttttaaaggagtgtcttttgtatgccaaacttctcctatttttaaataatatatcatgaaaatcattttattttgtaaattggacctcaggtgtatgaaactgggttaattgtgacctatgattcatagtgcatgtattagtccattttcatgctgctgataaagtcatacctgagactgggaagaaaaagaggtttaattggacttacagttccacatggctgggaaggcctcagaatcatggggggaggcaaaaggcacttcttacatggtggcagcaaaagaaaatgaggaaaaagcaaaagtggaagcccctgataaacccatcagatctcatgagacttattaactatcacgagaatagcatgggaaagaccggctcccatgattcaaatacctccctgctaggtccctccctcagcatgtgggaattctagaagatacaattcaagttgagatttgggtggggacacagccaaactgtatcattctgcccctggcccctcccaaatctcatgtcctcacatttcaaaatgaatcatgccttcccaacagctccccaaagtcttaactcatttcagcattaacccaaaggccacagatcaaagtctcatctgagacaaggcaagtcccttctgcctataagcctgtaaaatcaaaagcaagctagttacttcctagatacaatgggggtacaggtatctatgaaatgggagaaattggccaaaacaaaggggttacagggcccatgcaagcctgaaatccagttgggcagtcaaattctaaagctccaaaatgatcttctttgactccaggtctcacatccaggttatgctgatgcaagaggtgggttcccatggttttgggcagctccgccctgtgattttgcaaggtacagcctccctccaggctactttcacaggcttccattgagtatctgcagcttttccaggtgcatggtgccagctgtcagtggatctaccattctggggtctggaggacggtgaccctcttctcagagctccactaggcagtgctccagtaaagactctgtgtgggggatccagtcccacatttcccttctgcactgccctagcagaggttctccatgagcgccctgccactgcagcaaacttttgcctgaggatgcaggcatttccatacatcttaaagatctaggtggaggttcccaaacctcaattcttgacttctgtgcacccacaggctaaacaccacatggaaactgccaaggtttgggacttccaccctctgaagtcacagcccgagctgtatcttggcccctttcagccatggctggagtggctaggacacagtgcaccaagtccttaggctgcacacagcacagggaccctgggcccagcccaagaaaccactttttcctcctgggcctccaggcctgtgatggcaagaggggctgccatgaaggtgtctgacatggcctggagacattttccccaaggtcttggggattaacattaggcttcttgccgcttatgcaaatttctgcaggtggcttgaatttctccccagaaaatggatttttcttttctattgcacagtcaggctgcaaattttccaaacttttatgctgtgcttcgtttataaagctgaatgcctttaacagcaccaaagtcacctgctgaatgctttgctgcttaaaaatttcttctgccagataccctaaatcatctttgtcaggttcaaagttccacaaatctctaaggcggggcaaaatgccaccagtttctttgctaaaacacaacaagaatcacatttactccagttcccaaaaagttcctcatctctacctgagaccacctcagtctggaccttattgtccatatcactatcagcattttgggcaaagccattcaacaagctctaggaagttccaaactttcccacacattcctgtcttcttctgagccctccaaactattccaacctctgcctgttacccagttctaaagttgctcccacattttggggtgccttttcagcaatgccccactctactggtaccaatttactgtattagtccattttcacactgctgataaagacatacctgagactgggaagaaaaaaaggtttaattggacttacaattccacatggcttgggaggcctcagaatcaaggcaaaatgcacttcttacatggcagcggcaagagaaaatgaggaagatacaaaagcagaagctcctgagaaacctgtcagatcttgtgagacttactatcatgagaatagcatgggaaagaccagcccccatgattcaattacctccccctggggtccctcccacaacaagtgggaattctgggagagagaattcaagttgagatttgggtggggacacagccaaaccatatcagtgcactctcttcatttgaccatgcaatgcatgtttttaataataaacatctccatccaatatgaaaactcatactgtaactgtgatttataaaacctttggcccaatctttttcctacaactacacttctctttatctaccttttatttttactttttgcttacttgagcacatgctatacatgcccctttttatgcctctcaggaggtttacagtggtggaatttcatcactcagatagctttccactccacgccctttggatcccaaaatggactgcccatttatctctttctgtgtgaaggaagtcagggttaggagagtcatctgtatatgcctcctcgtttatctctgattctttagcaaaaccaccctgaaacccaggcagatgtcaagtcagcttgtccttgagggtctctgctaaaggagaggccccagtggccactgcagcctccataaatcgctgtggtcaagcatgcatcttgccatcagaccaaccaccacctgatatgtgaaattcacatttgttaattatttgctagaaatctaagaagctgttatttattgtcatgtagttgaaagcctctttccgcctcctccagaattcacttttctttctatctttcctctgatcattgtttttatcctttgactgttcttttgtagttcttttctttattcctgaatttatttaagttgcagatgaggattttggctatgtccacaccccagacttcaccaggaaggtaacttagggttccccaaaatccaaccaaactgttctcaaatgcaggaggagaactctccccttcccctctacccctgccccctcatttcttctcttacaggctttcctagctcttttccaccccatgccccttctgtctctccttccatcctggggtttgtggtagaggattacccagttgcggacgagtcacatgccttatccagtgaaaatattattgtcttatggatgccaagaacaactcctgaatgtacaaactatttttaatgctcatttgagattgatagatatcaggcaaataataaaagtttcacaagattgctacaaataaataattttgaaaacaaaaccaaccaaagcaaaaaacaaacaaacaaaaacaaccttttctgttgtgattagcatttttgctaaactcaccttgggcttttgactttccagacactctcattgcaggtgtttggagctcagttctgttcctccaggcttgtgcgctctccttgaccccaccttttgtgcgtgtgctgtccttgtctgaaaccagcctggagctccctatacagatgtgtcaaggtcaggccaggtcaaggctgagcacagagaaaggagctgctgtaggaggcccacaaggaattttgttggatctgtgagatcagtgtatgctccagcccctctgacatatccagaggagacagccttgagtttgggcccagtactgccacttattagctgtgtaaacttgaaaaagtcaattaattttgcataagtctagtgcaataagtaagagtcttcaagtcatcaccctgttgtgatggattacatgagatcaagcatgtaatgtgtcaccatgataactggcaaaaataagtgcttagtaaatgctgaccattcttcttcttaacaacatcatcatcatcatcatcatcatcatcatcatcaacaacaacaacactaggtgcaagcgccagccccggccaaggccaataggccctgtgtaggttgcgggctacctactcagtctggatgctggtttcctgttctcctgctcctgtctttgctcttgacctgttttcttcttgcctctgcaatggactctgctgctggttgtgccatctcctcaaggttggacccttggaagctgacgtatagctggtaccttccagctacctcttcaacacccctgcatagcttgaactcaggtgacctgctctgctccaggctccgagtcccccaggtgcattttcctgtccttgttcccaccatgggctcagacagtgagtgccttgaaggcaggaatagggggtcctcaacccattccctggcccctgacaagcagctggctgcaggatgtcctccactacttgttagtcaaatgcatgaaacattggatgaaggcaagaaggtgagatagccaggtgtggtggctcactcgtgtaatctcaacactttgtgaggctgaggcaggtggattgcttgagcccaggagtttgagaccagcctcggcaatgtggcaaaaccctgtctctacaaaaaaaatttaaaaattagccaggcatagtggtgtatgcctatagtcccagctacttgggaggctgaggttgggggattgcttgagcctgggaagcagaggttacggtgagctgagatctcaccactgctcttcagcctgggcgacaaaaaagagaatgtctcaataaataaataaataaataaataaattagttaattaattaataaaggagagataggaaccttctcctttgttgaatccaagtttagtaggatgttcctttcttttctctctctttctttttctctctttctctctctctctttctttcctttctttctttctttctccttccttccttccttccttccttccttccttccttccttccttccttttttctttctttcttgacaagatctcaccctatcatccaggctggagtacagtggtacaatcatagctcactgcagccttcagctcttgagcttaaactatcctcccacctcagctttccaagtacctgggactctaggagcaagtcaccatgcctggtggatgttcttttctattgaaagtctagagtaattcatggccaatacttaattttagcagctttgttccttttgaatgagccctcaagccaaaaacatatccatcttttaacagtttcatttatttcctttgaaatcacttcaactggattcaatgcaatgcatttgaacagatgtttacacagtgtgttgggcattgttatgggcacatgactgagaagagaatggtcaagtttcctgccctggacagaactaaaattttaccaggaagagagatgctgagcacctaactaataaatacacagggtaatttcatttttataagagtttccaaagcaattaccatcaccaccaaagaatcagggtagattactgggtctcgacaagtgtgtgtgtgtgtgcgcacacgtgcgtgcgcatgcatgtgtgtgtcttggggaagagataaggcctgaataaggagggacagctgtcctgtggagatctggagaagattattgtagtagaggaatggcaagttcaaaggcctggaagtggtagcagagtcattgtgtttcaggggcagaaaggaggccagcgtgcctgggtgccaagggaaggaggtgagggtgaggaggcggacaggcatctcaagtgcatggagagccacctcttcttgggtccccagtccagggcactttctttggacccaggatgtaggtactgacagctgccatgaatctcggagttgtcagcattcacagcaaagggcatttccaggctaaaatctaagtaaacaagctccagaacaaagaagacaccatgttcaaagtgtgtgaaaatggataacaaataggaaacatttaaaaacaagcactttgtggaaaaccatgtttccttgatgtgctttctgtcatggtatctgaaacactgcaaaaggacattgaagatctgggagggagagttgacaatcttcccaaataagatacagttatcttatttcaaataaaaaggaagcaaaattggcacaagtttgggtcaaatttctcctgtgccaagtctagaatcagcaggtagtgctgaaatcactgtcccacatcccagacatagtgagcattcttttaaggctccaggctcaagtgtgtgcaaacagagggaaattacacttgaaaaaaaagatcaaggaccgtgaattagatacaaccttggacaacaaaagcagcaaccatgaaaggttgtatgtacttaagaagtcaaacacttctgggaaagctgtggggaagagagttggtatatgggaaaaaagtggtaaactcaaaacgccttttgtatggagaaaggcattggccagctttaaaggcactgcagcatcagttgagcaagtgcttttaataaattactctcttttgtagctctgtactttttctgatatggataagctatctagcatccaaagcaaactcatcttaaaccaagaattcaaacaaatgataataaagatggtagaatgcctattccactccatttgaaagagatgcacaaaagaaaatggtaggtgttgcttgcaggagtgtgataatagtgttgctcttctaaactggcaactttatgagtagatcatcaaagccaaggtattttactttgtggaataagaaacgatcacaccgaaaataataaaattcagcactgcaggttttctgccctttataaatgtttttcaaagacggaaccgaaagaatagcttgagtgataacaagcttttcagaaggagctctggaaattaatatgggacaggtgatggagcaagactttcagcatgaagaagcccaggaactgggaaaacacaagtctttacttcagaatcaccccatagcctccaagtagtgtgttgcaggttgaatctagctgaaaatggcataaaacagaatattaatagctatatccacatatcactaaactaggtacattcttgatgttcctgaatataaggagattataaattaaaatgattctgaaaaactacagacattgatgcaagtttctagtttcaaccaggataatatcacatctcacctcaaacaaaaggcattttcttcagaaaggaactaaaaaaaaatggcctttattctatacttgcttatggttctggtttaaaaacaaaaacaggttccagaagactacttattcaaagaccctgccccacattcctcttgaggatcccagtgaatgtggcactgataatatgaatggtttaccttccgtgagattgcattgaggggggaaatattcttagaaataaaatttttaaaaagaaaatatgatgtaaattgaccaaggggtttaaaaaatctgtcaatctcatatcctatacctagcaaaaatatccttcagaaatgaatggaaaattaagacattctcagatagaagaaaaataagaaatttgtcaccagcattaaagaatgactaaagggatgtctctaaacagaaagtgaataataacaaagggaggctggaacttcaggaaggaaacaaaacaatgcaatggttaaaaattctcctcaagtgtttaaaaaattgtgttgaagcaaaaaaatataacatcatctggtgagatgttcagtgtctgtagtggaaatatttatttaacatatttgtattttaagggggagggtaaacagacctaaataaaagtcagatttctatacttcacttgaagaggtaaaatgctgatacagttagctatgacatattatgtatatatattgtaatatctagggaaattagtaaaaaactatatgatgaagagatatattaaaaatgtactatagatatgaatatatgtgtgggttagtatacatacatagttttccttactctgtcacctgagagaacaaagaagcaatgacaaccctctagcaattagcacaccggacacacagatcttggtttctaacaccattcaccaataaaacaaatcagggctccttggagaaatggctgattccaggccttgggggaaaaatatatgagatgaacctggagcattttgtagcaccagaatgtaaggaaatgtgtgtgtgtgtgtgtgtgtgtgtgtgtgtgtgtgtgtgaagagacacaggagccaaccaaaagagctctcaatggccaaacttggaataattggagcaagaaaataataaagtagtaatgtattatcacccaaaataaatatccatgagtccatagtgatataagtaaatacttgaataaataaatggggggaaaaaagacaactctctcttatgaagaactggaaatagttaatacagatactacaacctgaaggaggagaagtgtaagttcctggtccttaggtatgggcctacatagtgattttcttccaaagagtgtagaatagatagggggtgggggaaagtagatttacactggagacacctgccaagcactacttcagccaggtgatcatggtcaacacctgctgtgataaatcgtggtgtgagtatgtaccctggatatgatgtgatgaaaatgacacttcactgctttacccattacccttgtcgaatcatgaaaaaagcctcaggtgaatttcaataagggggtatcatagaatacattgaatataggataatacctaaccaggactcttcaaaattgtcaaggtcctaaaaatcaggaaaagtttgagaaactgtcacaaccaagaggagcctgaggagatgtgatgactaaacacagtaagtatcctggatgggaccctggaccataggaagatgttaggtaaaactaaggaaatctaaataagatatagactttggttaataataatgtatcaatattggctcattaattgaaacagtcgtgctaattaatataagatgttaataagatgggacactgagtgaggatgtatatgggaactttctgttctaccatctcattttttttaaacttataaaaaataaagtctattaaaacattatagcactttgggaggctgaggtgggtggatcatctgaggtcaagagtttgagatcagcctagccaacatggcgaaatgctgtctctactaaaaaaacaaaaattagctgggcatggtggcaagtgcctataatcacagctactcgggaggctgaggcaggagaatcacttgaatttggcgggatggaggttgcagtgaggtgagatcatgccacttcactccggcatgggggaaagagcgaaactccgttaaaaaaaaatcatgagtttaaacataaaacataaaaatatataatgtttagaaagaattcacaggagaaaatctttgggacctaaggctagacagaattcttagacatggcaccagcagcactatccataaagagagaagaaaaagtcaatatactatacttcgttgtaattaaaaacttttgtggtgtaaaagactcggtgaagaggatgaaaagacaaactgcagactgggagaaattattttcaaatccatatcttttttttgtttttttgagatggagtcttgctctgttgccaggctggagtgcattggcgcgatctcagctcactgcaacctccagctcccgggttcaagcgattctcctgccttagcctccagagtagctgggactccaggcccagctaatttttgtatttttagtagagacagggttttaccatgttggccaggatggtctcgatctcttgacctcgtgatccacctgcctcggcctcccaaagtactgggattccaggcgtaagccaccgtgcccggcctcaaatccatgtcttacaaagaccttatatctacaatacacaaaaatgtatcaaattcaacagtaaaaagacaagaagaaaaatgaagaatcccatcagaaaatgaggggaaaatatgcccatgaatttcaccaaaaagactatacagatggtaaagaagtgcaggaaaggatgttcgatatcactagcctttagggaaatgcacattaaaaccaccgtgagatattactacacacctatcagagttgctaaaattgaaaacaaattataacacaaaatgctggcaagtatgtggagaaactggatcacacctacattgctgggtagaacaaaaaatattatagtcattcagataacagtttggcagtttctttaaaaactaaatatgaaattgctgtttgacctggaaattgcattcctgtgcatttattgcggagaaatgaaaatgtatgttcacacaaaaacctgtacaagaatgtttatagcagctctattcataatagctaaaaactgaaaagatgcaagatgtcctttagtgggttaaaccatccacatcatggaatactactcagcaataaaaaggaaccaactattgatacacacaaaaccctggttaatcttgagaattacattaagtgaaaaaaagccagtcctcaaaagttacatactatgttactctatttatacaacattttaaaaaggacaaagttacaggaatgaagaacagattagtggttggtgggacagcagtgaagtggggtggttgcaaaagggccacatgagggatgcttgtggggatggaattgtttcatagcttgactttctttttgtttgtttgtttgttttttttagacggacggagtcttgctctgtcacccaggctggagtgcagtagtgcaatctcagctcactgcaacctccacctcccaggttcaagtgattctcctgccttaggcctcccgagtagctgggattacaggtgccactaccacgcctggctaatttgttgtatttttagtagagacggagttttaccatgttggccaggctggtctcaaactcctgacctccgttgatccacctgcctcagcctcccaaagtgcaaggattacaggcctgagccactgcacctggccaatagcttgtctttcaataatagtgttcttgctgtgatatcatactacagttttgtaagatattaccagtaggggaaatttggttaagagcatgtgatgtttctattatttcttacaactgcttatgaatctacagttacctcaaattaagtgtaatttaaaaaatactggaaaacaacaacccccttaccccatgcagatattttcatctattttggttgtatttatttggtattgacttccacaatgtatatagtatgttttgattgctaatctatgatttattaattgaagacgattttagatagatctgtatctttatggtagagtttatttattgtagctgcattttaatttaaaacttaattactgttgctttgtttccttctggtttctgcatgatttccactgcgtctcttgtgttctgtttgtttgttttggagtttctcacattgagagatttttctcattgttgggtaaccatgactctatcttcctgtttaagaattaggggctgggcaccatcgctcaggcctgtaatcccagcactttgggaggctgaggcaggcagatcatctgaggtcaggagtttgcgccagcctggagggttggagaaactggctgttgcattagtccgttctcacactgctataaagaattaactgagactgggtaatttatgcagaaaagaggtttaattgactcagagttctggaggctgtacaggaagcatggctggtaggcctcaggaagcttacactcatggcagaagggcaaagggaaagcaagcacatcttcacgtggtggcaggagacagtgaaagaagaagcactacacacttttaaacaaccagatctcgtgaggactcactcactatcatgagaacagcaagggagaattctgcccccatgatccagtcacctcccaccaggtccctccctcagtgttggggattgcaattcaacatgagatttgggtggggacacacagccaaaccatagcagctgttacctcatgctcctaattttgtggaagatcagataacaacttagtttcagtttggtggaattgtagcatagataactctgttttgatttttagtctggttgttggggcgtagtgagggggcttagtgggggccctgtgtgttttatctggtgaccctccagtttctcagcgccatgcatttgcttgtcctggcctctgcagtcacctttgctggctgtggcattgtgagggtgtgaaggctgcagattcttagagggggcctattccaggctctcctgtgttcatgactgtcacatcccatcttgggcgaggccaggctagagtccacaggctccactcaggctctctttcccagaccccgacacctctgtcagcctcgttgtaggtcctcttttgattgctattgccttggacctggacagtttataaaccaagcttgccaagaggcaagagtgaagaggtctgttaaatagggaaagagcttggagtctcctgggccatgtgctcagtacacaagttcttacaggtgggtagtcctgtttgggatagttcagacacaccagagtagggagtgagggtcccatgctggccacctttcttcttcacctccctcttctcatgcctccctgccaccacccaacattttcagccttgagaaattccaagtaagccccttgctcagggctgggaatccagttggcagttcgggaggcggtggggtcagagttaccgcttctttccgggcctttccagaggttctgctgctcccccaatacgccttccattgtgctccagtgcgtccctccagcacattcccacagttagattcttctggggactgttgtaggcacatccctgaaattcccgagggatctccccctggctagtgtacttccttttctcaaggtatgtgggaacaggagctgtctgccgggattagcagcccacatgatttcccagtctcaggacctgtttcctgttgggagcccctgagctctgagacatgtggttgccaagtgcttgcagcgctgggtgtggtggagccccaggctgactctcctaggtggcagactcttgggggcgagctctccccagggcggggacaggctgggggtggcgggctcttgggggtgggcaggatctccttgggtgaggggtgtctctgggggtttggctctggggaaggggttctgaggagggggcagattctcctggggaggtgggctctgggggtggggagcaggttttcctgggtgggcctctcctgggaccaactctccctggccgcagtctctcttggccacgattctttcctccacagcaacatccatgtgcagaggtgctagagctgccagtactagcttaccagcgctggctacaagatcttcaggaactttttggcctggttgttaaccagagcaactattaaaaattatagaacctcaggtaagcaaattaaatcgcaaacaaaagtaatggatacacaaaacttatactaccttttttatgacattttaccatttcctgtgcccttgaggctctttacgttatggtacctgtgtggtggaaatactgtactgggcgacggggcagctgtgcttctctccccagttcctgcttgtgtgggagtatttcaccatggaaatcagcaaatcatgcttagttatttggacagctggttattaaacatttaccagcacacaccattacctgagttctatcagcttattaaattaaaaaataaatggagccctttaatcacattgttcttattttattttattttttattattttttagaggtaggctcttgctgtgttgccccggctggaatgcagtggtacaatcatagctcaccatagcctggaactactgggctcaagtgatcctcttgtcttagccttctaagtagaaaggaccactggtgcttgcaccatgtctgactaactttttttaaaaaatgcttttttgtagagatgggtccttgctttattgcctaggctggtcttgaactcctggcaagagatgcaagtgacccttgcgtctcagcctcccaaagtgctgggatataagcatgagtcatcgtgcctggcctaatcacattgttcaagcattgtgcaaatcaatggaagcctagctcacaacacttctggtttaaatgcaggcacacttcccctctgcctggccctgactcctgctgccctctcctactcagttctctggcagctcatccccctcacccactctactccattccctgcctgctttccagtctctcgacctggacaggttttctgtccctttccccattgtttctttgaagtatttattatgtaccttcctttatcctctcagctaaagggtttcccttttcttgccaaggtttgtgatccatctctctcttctcattctcctgattctgaatttatcataacatttcctgggcacaatttaaatatgcttatttgaccttcccaggctgtgctaacagcaccaccaccactgctgctgccgaaaagagttagtgatatttatctacacctgtacctgtgccacctgtgtcccatgccagagaccccggagcactccatgggcaggtcccatttaatgctgatacctccatgagaaatgagtgtttggttgaatttaagtactgtaagggaactttttagactgccctaggtggtatgtgaaacctgagggctttgtggttgtgccaaggggcttctgagtagagaagaagaagggataccagagaagatgagactcacccacagcccttctaaccccagacctagcagagcatttcactgtccagaaataggagttgaaactgtggccttcagagcaatgttttaacctggctttagtattcttactagctgagtgaccttgggcactctgtgcctcaatttcctcatctgaaaaatggggataatactattaccttataaggttttttgtgaggtttaaatgagttaatgcacataaagctcttcaaaaagtgttcaactaataaatattagccattgtcattactgaggctatgtgcaaaattgtacttaataaaataatgcttctggtaagaggttgaagaccacatatgtagctctatggcctttattttatagttgagaaaactgaagctcagagctaagaactggacacagccagtgagcagcagagtcaggactaaatccctttctgctctgaatttttcaacaaatggtattaatcctcttctttgacctggaaggggcatgacacctacaacatttgatacccatggcatttgacacccacaccactcaacacccttgtgcctttattttgattaaaggtgtgcctttaaagtgatgagaatagtgtccaaataaatatgacagaacccttctatccattttctctgggaagaaatgaatattaatatctctggtaagatttgaatattaaacaaagagaaagaactagcccctttagtggatatagcatgatctggggaacaaagagacagcccagatgggagcatgttattggagagggataaggagcgtgcaaggtaaggtgtcggtgaacaaaagttctctgtaaaagaattggaagggaagagactttattccactaagcagtttgcaaaatggggagatgtgacctgtggtctaaaatgaaggttccttccagggagcaaaaggaggtttcagttttgacagcaaaagttcctgtccgggttcccactcaagtccatttatgcaaatgaaggattcaaacttgcttagttctaattacttgatgaagctaagttctgattggttggttcaggtgagttctgaaagtcccaaagttgaacagaggtatgggttttctgttgacacagagtacatctgtgatgtctagtcaataaatgaccactaggctcaatgttaaatttaggcccagttagccactagggatccatcttgaaggactggctctttcggtttcatattcattcccatgaccgaggcaggacccatcctgcagcttttgcccagcgggtaggagaccaggcttgggaggccattaagtcaacttcagacactgttttactgcccagggtggaggaagatctctaaactaaatgcctacagcatccacagctgaatctggctggcatgtaaagaaccagcagtaagcgatgtgcctggtgtgctggggtacacgaacggaggcgagccgggccctgtagtgatagtcagtttcactgggactaccctactccagacaggaagtcctcattgctgacagcacttaggagcagtgcctctccaccagaagtgtattctcagcaggggtggatctgagagcagaatacctagtggagaagaggggtttccacttgtggggtagagctctttcaagcacccgggccacattcagagaagttcccctgcactgggctaaatgagtcaggtggcctcacttctctcagacacatctggcaacctgggcagcttttggggtgacactgcaggaccacaggagggactccttctctctggcattctgagaggtgaagggcttcacattccagtgatggaaatcttggcaacactagagaaaggagtgcagctcctacctaaccagtgagagaatattatacatgattttgtataatctgatttgaaacttgaaataatgcaacattttcttagttgaaaaacaacaaaaaatacataatttcaaagctgttcttgggggcgaggtgcggagcgtgaactgtctcccacttcagggggtaagcaggtagacaggaatgtcaccatccattgtctcgtgggtgtgaatcactgcttctagactcctgtgcttttgataattattgcaaagtcatttcaacttttgctgtgttatgatctttaaaacaaatagtgtattctactgcaggataggttaattgtcattaagaggtgattccagtggtattgttaaaaaaagtacacccacaatcagtaaatttagaaagaaagttaggtgagataaaatatcatgaagatttaaaaacaccaggaaataaataccagtctgctaattttatgacaagcatcccaagaaatattggagatgatgctgagaaaataaaaatagcattaaagatcctcaaacagcccctgttcctctgactttgcagcatttggaggggaaagcactcttacattatgagggcctctggagccccacctaaatccttaagtgaaaactcccagggagcatcattttctgacagttgcagctggattagcaccacgtgggccagtagcctcagagaagggagtgtgcaatatcagcttcctccagagagatgccgatgggtccattctgggcccccgtttccatacctgtagcctcttaggggacacagaatgactgggaggtgctgcctattcacctgtggaatgtgggcacttctggggtctgactttctcctatatagctctgtagcttttgaatacctataataattatgtacttgtattaatttttaaaaatctattaaaaagaaaaaaaataaaggaagaggggctgagctctgctgtggaaatcagatctatttagaaagcaagaaggtctgtggacaatccaatacaaggtggcccagcctccataccacctccagctgtccccaggctgctttgcagtaacaacctatgggcaaatggcagcgtgcgcctccgtctttctgccctatatgcctgaagtcacagcggtccttcaggagtgttatgactcattcccatggggaggtgggggcgtgctaggtgtcttagtccattgtgtttgctctcataaaataccatagactggggggctttaacaataggcatttatttcttacagttctggaggctggaagtccaagatcaaggtgcagcagatctggtgtctggtgagggctccctttctggtttgcagatggccgccttctctctgtttccacacatggtggagacagggagagctctgatcccttccttttcttataagggcactaatccatcatgagaaccccacccccatgacctcatttaaacctaatgatctccaaaggtaattacatagggggttagagcttcaacatgcaaatttggcagggacagggggtggggaacatgaacatccagtccattaccatagagatattcaaatgggggtaaatgcttctgtggaaaatccccccgtgggaggctgctctgggctgtgtgtccaccccaacttggtgctcccacgagactgtgggaaagggtggcagtcctctatccccagtatggccttcagcatgtgcagtccctggcctggctacctgcagaagcccacaggaaaggggcagccaggggttgaaggagaaaagaggagagaggggtggggatgagacactccattctgaggagaggtccccaggaagaggctacgcagattctttggaactggaattgcctgagaaggcttaggacagcgctgctcattagaccactgcctgggaaatggccatcagctgagaatgtgggaccttagtgtccctgtgtctgggggagtccaagagagagagatggatactgaagattttgcaaagtggcatggctgggtgagtgggccctccaccaggagacactgactacaggtgcttgctgggcataaccgaaggagggcccggcagaatccagaccctccccattgccgtgagaggctcagggggctagcttatgaggaagagaactaaaaactaggggacacattctgaggatacaaaatgcacaatgagccctcatttagatgaggggtagggtcttaaccaaactccagcattacaccccagcctttccttgtggttctatgttgtcatgcaccatgtgcttagctacagctctcctgggtgctgccttccagagatgggaccacctcagtgacagtgaagagattaagtgtgcaagctggggacagcgggcaagtgattaacatttcctgactctgactcgtcctttggagggtgatgctacatacagcccatcatacgcactatcatggcccaatctctctgaaagtgaaatcacttctccccactgagctgcatctggaattttagcagcttggagcaatgcaaaataatggtgcttaaactcagaccagcctcctcaattttgagctgggcaatccattacacatacattttaggcagaatgggatcctggtaaatttgctgtctgtgtatgtggcccacaaatttccattcattgaacagttgtcatttttaagagctgcagggcaaaaaggttatttgttgactttttgttttttgcaaatgatattaccttgcaaaagagcttaccctgaaactgaaaagaatgattctgtgttaccatatgcttttataggcttagctcttgtctgtgggaagtttgcaagcattccctcctctgctccccattcatttataaagaaacctcccacatggtgctattaaaataaaaacttactcatatgcttagtcaatgccgagcagaatttctttcataggttccgtatgaatgagttctgaagtaacaggtttagaaaatgaaactgctcaaaaagaatatgaaaatgacttgaaaaggtgccagaaaatactttgactgtgtgtgcatgtgtgtgcacgggggtgggggaaatatcagatcatgggaaggttccaagaccttcaggttataatggcatgtgaacaacctcaggagttggtgtgggaataaacgattcaggcttaaaatgagaaactcctgttatggacaccacgggatgttctagtcaacagatctaaacacgtggccccatgactacctgtttatgtgggtgtaatcaatgcccagctctgctattcaccagctgtgtggcctggggcaagttgctccaccaacctgatcctcagttcccttgcctgtaacatgctgataataacagcatttattccataggacataggatccccacaaccccaattccttggagctcaaaaattagatgaatcttgatccttgttcacagtactttccaccacggatccatccatgactttgtcatttatttagttatgtaactagttatttccaatattgtaatgagcacccatgaatctaccaccaaacaaaagctaagtctaggacaataacctacatcttatcagctagtccccagtatcttattaacctcttctccccacttctaaggtctacaccatcatgaatcttgtgttcctgatacccctgcttcccattttatttggttttatgcttccatatgtatttctagaaagtaggtatatttttatcttaattgttttttaactttataaaacttttagggacttacttttttccatttaatgttatattgctaagagtcattcacagtattgtgtgtcattgtaatttctttgttctgactgctgcatagtagtgtatacaaataaaccatagtgtaatcatccatactcccattgaggggtacttgggaaaggagagggtccagacttttgctagttagaacagggctgttatagtcctactggtacatgtcagcctttgtacaagtataagagtttctcttgggtatggaccttcaaggagaatcatgtcagagaacatgtgaaagttcaactttaggagacaatgccaaaacattctctaaagactctgtgctaatctacaatgccacaggcttcatcctctccagcacttaattgtgttaggctttttactttttgctaattgaatgagtataacatgttatttcattgtgattttaattttcactttttttctttaacaaatttttttatttttagtttttgtgggtacataataggtacatatatttatggggtacatgagatgttttgatataggcacacaatgcataataatcacatcatgggaaatggggtatccatcccctcaagcatttatgttttgtgttataaacaatccaattatactcttttaggtatttttaaatgtacagttaaattattttgactatagtcacccttttgtgctatcatatactaggtattcataatttttttcacttttctttttgaatcttttcataagtttattgggcatatatgtttcctcttctgtgaaatgccattggtgctttttttccccattattatactggttatttgtgctttgttaacaaaattgatttgtagcagttctacatatattcttggtactaaacctttgtggttgatattatgaatatcttgtcccagtttttactttgtctttttactttttaaaggtatctcttggtgaacaaatgttctttattttgacatagttaaatttatcattttatagtcaacaatttaagtgcttaagaaaaactttagctgcgtgtattagtccattcttgcattgctataaagaactccctgagaatgggtaatttataaagaaaagaggttaaatgactcacagttctgcaggctgtacaggaaacatggttgggaaggcctcaggaaacacaattatggtggaaggtgaaggggaagcaggaatatctgcatatggccagtaggacagagagagaaggggatggtactacacactttaaatacagaactagggggatggtgccaaaccactagaaaccacctctatgatccaagcacctcccaccaggcctcacctccaacatttggaattacaattcaaaatgagatttgggtggggacacagagccaaaccatatcactactccaaggtataaaatagttacctgtattttactataaattataaagtttcttttttgacatttaattcctgaatctatctagggttatttttcggatatagtttgagagagatattcaagttcattttttcccatatgaataactacttttttccacctccatttgtttatcagcctcctctcctcactgacctcctgtatcctctgtaataaaccaacattctttatttgcatccatctttttctgggatcttattcataccccatggtctgtttttctgtctctgcaccaaaactacagggttttaattgctccagcctcataaaagtccagacatcaataagggaaacccctgatcactaccttttcagaaacatcctatttttggtcttttatgctttcacataagtttagaatcattttttcaggttctatttttaaaaaaattattaggaatttgacaagaattgcactgaatatatagatcaaattacactattaaattatataatccatgaacacaatatctctctccaattacttagccctttttaatatctcttaaagttttacacttttccttctagaggtcttgaaaatgtgtccattgttaggtttattctaggagacttgatattttaatttttttttttttttttgaggaagggtcttattttgtcatccgggctggagtgcagtggtacgatcatagctcaccacagcttcgaactcctaggtccaagtgatcctcctacctcaccctcctgagtagctgggactataggcacatgccactgtgccccactagatacctgatgttttctgatgctgttgtaaagaatattgtcttttagcctgggcacagtggctcatgcctgtaatcccagcaccttgggaggctgaggtgggcggatcacttgagatcaggagttctagaccagcctggccaacatggtgaaaccccgtccctactaaaaaaaaaaaaaaaatacaaaaattagccatgtgtggtggtttacacctgtaatcctagctactcagggggctgaggcacgagaattgcttgaacccggaaggcagaggaggttgcagtgagctgagatagcgccactgcactccagcctgggtgacagagtgagactctatctcagaattaaaaaaaaaaaatattgtcttttaattaaactttctagctgtttgatgtatgtaaattttatatcttcactaaatttaattgttcttaatcatttgtttatggattttgggcattttctatataagcagtcataccttatgtgggtgataatggtttctttccctcataagatgattttaaaagtgaatggggttatataaacaaagcaaacaacacagtggttggcagctagtcagtgctcagtaaatgcttgtgactactgatattatcgtcattactcattaacagaagaattttagaaatttctttaacaaattccttcatgttgaagaaagaaacagaggcccagaacaagtccatgatttgcctgggatgacatgacaactcaatgccaggactgcacctggaaaacctgggtctttgggctacaaagtcaagtgccctttcttttaatccccaacaaatgcaggcttctgtctggcataaacttttgcaattgtagtgtttacatgaatggggctttctggcacatccatgaaaaaaaatctattaaatcagcagcatgaattaagctctttctgtgtgctgggcttcccacattgcacacgcttctagcagaggaagaatttacaccctgcaactcagaggggcagaaaatgataatttatttccttttaaatattctctatatggatctcatcatttcctgttgatggcagaggaaggagggagaaccttaaacttgcccattgaaagcaacttagactcttttggtctaactcactttcttttgggtaaatacacagttaaataaaaattaagatttccttctcaaaggatgtctcttcactctctatgtcccaggttggcagctggaagagggaaacaattatggattctcacagtgtggagtggtgcctctgaactcatcctgcctttgagacatagcaggtgctgattgagctgggcctggcctgatcatgtctttgagcatccaattctggggccactaggtctagctgtctctgctggtgctttgggacctccactgctcagatcttcctggccccaaagatctctaaatctcagctttgtctgtcatctgtctctaggctctgcaaaggtgacctctcagcagtctggctcgcagctacaccctctgggggcacgtagaacactgagacccctttctggccacagtgtagcagaggaagaggcaggctgtggggcacatgtgaggtattctcagatactagctcagccttaacttctctcatcttctcttctctctgcatccctccctccccaacttgcctcttggccagaagagtgtctccttcctgttgggtggggtttccctaacttgatgtcctctgtcttctctttattcaggcttatagcaagctccacagtcacactggcaaggcctagctctttgaagatgaagggaactttcagaatctagaataatgtgtgtcctctttcaacaaaacttgacattggaaacctgtttctccatggcctctaaaaatgtcagttttggcatgcaaatattttctaaatattatcccaattacccatggttatggctgcctttgggattatgatgaagactgtagttgtgtagaacatgtcatgctcctgactcccctctcgggatatggaggccactgtctttgtgagtggatggagctccttcctctgtccatctcttaactaatgaaagccaggtctgtctgttctcagcagtctttctctgcctagccactgtacaggacactgtcactaacacgtcctcaaggaatgacctctgacttctggcctgaagatctctgtggcctctattcaacctttattgagagcttattatggttacagctctgtgctcgtgagaacccagagagagcgagacagaattgtcttcaagctgctcaaagagtaaaatccatgcataaagacctggctgtatcacagctgtgcttatgatattagcaaaatccagtacaactaggaagaacatgtacagagaaggaaggaaaggcaaaactgttgggtctagttttcttggttcctacatgaaagaaggctgggcaatatttaccctcgataaagttcattatgccttgggtatagtaaaaatctgaagttttgcctctgtagaccactattctgccagggctgggtgccagagtgtattttacaatgctgacgcctgtccgagacagtgggttgtggtttctgttccactctccaatgcacttttgggaaggcaggtgactgggatggacctgctctagtcatcaaatgtggcaggcccactttccattgccaacaaaagttaagtaaattaaatagggccccaaaggagctctctaggagttggtgtatcatgaaatgtgaagtgggcttgcccctatgcaagaactaaaagaaacacaatttagttatctttggcttctgaggcatcggcagagttttctgctgccaatatgagatttcagtggagagtagggtttcccaaatcatgttgaaacgtgacattgttttccttaggcccacagggccttggcctgacactgagcatgtattcgtgtgtgcacacacgactgaccactttctgcacgcttcttacacatccgccatgtgtccgcctcagccagtggaagccctgtgccactcttgagatgcaggtggctgtttcttgctgctgtcactgttactgctgctgccgcttgcagcctaattcctcgctggtttcaaaatgtgtctcagagatttccccaaatccatttctccaaattctgagttgttcatccatggataacaacaggatggcatggatgtaggcactggtaaagaagcacagaagcatgtactgagggtgttaattctgaacatggagagactgcatgttctgaaacacatcttagcatttctgtgtccacatatgtgtattgcatttcaagcatttttattattattattattatttttgctgggtcgtgtcaatagaactgacagcatcctgtgaccatatcttcacctttagtgctttctaagtaaaactcagtgtcttaatatagccaaagggaagaaaatcctagtgagagaatgaactttttctgacattcctggttggtgaaatgcaatcctcttttcctggcatttggtgaggataattgaatttatgtctggtaactaaggggatgctcgggagcctcaggaaccatgagcaggaatgaggatggtcagaaagcacattgggttatgtggattcagtgacacaaaccccaagaaacctggtggcttttggcactgcatgtgattagagacaaatgatctattttcatcttctggaaaaatcaataaatacatatataaaagagtgccttcaagtcctttgagctattaagaatagctaacgttttgattgcttattgcatgtctattgctgttctaaaggctacatatgtattcactcatttcttcttataacgtccctgtgtggcccacggtcatgttattttcattcccattttacagataagaaaatggaggtcacgagctggagaactccttgctcaagttgcatagctaataagggacttagctgggattcctggccagcaatgtggctccaggcctggtttctaacttccccttcttggcaaccaccttcacagaggaatgcaagaggtgagtggatttgatgtgatattttatatcatgcctatttctatccactttctctggagtccactaagattaaagaaggagagaaattctctagttctacaggaagtgcgggctgtttccagtgggtccttgaagtcctttgtctgtttccagtttttccttcaggtcttttgagcccagcttccctctggccagctcaggctcagggagacgggcatacaccggtggcctgggtgacagtgtgcagctgatgagccacaggacttgggcaggccatagtgggtcaggagagactggacgcttcgtcttttatgcttctgggatttctgttgtggcttctgttttcaccgcatttcaaatcctttaagttaggtcatatggggaaaatgcttgtgcttctcatttatctccctggaggctagcctggatctctgatgaggaggagcaccaggccactccataaccaccgggctgcaggatctccagggccacccaggaagccaaaatcagaacagagctccttgctgtgggggctttgctcaccctagttctgggagccagccagctctatcttggggatataactttccagggacaagagatgcctgattttgtgcagacacctgtgtcatggagagtatttcttatgttccaagcagagaagttcaaatttaccagtcttcctgtcactccacccccaaaatctggcgaccccactcagctgtttttcagggcccaccctcatggcaccttctggggactccctctttgctactgaggttgagacctagcactaggttttgtgctagaagcgccttgggggcagaaacccccatatgccagctgcccaggtcaggactgcatgttttcctactcaccgccaccttgccttgtatagaagaggtgtggccacgtgcggaatccgcgggcacaggcagcgaggccaatgaatggtatcttgcctgcggtctgctcttgggaagggtcctctagtcccggtgtccagggacccacaggctacgtcacatagtctccatgtcttcttgtgggaaggtaccgtgtgagtctttttaaaaagtaatcttaaaagagaacatctttgactgggcgcagtggctcacgcctgtaataccagcactttgggaggccgaagcaggcagatcacacggtcaagagatcgagaccatcctggccaacacagtgaaaccccgtccctgtcgcttggaatccctggaagaaagcagaaccgagaagagaagcccgggtttaacgctgtggtttcttttttgcaagataaaaccatgtgatttagatatatgcaaacaaatcttgagttaaaggaaactgagtttcaaattagataattgtctctgagaaaggcattcatatatctcatatttcatttctaactttttatcatagaacatcttaaacatacaccaaaatagagaaaattataatgagctcccatctgtcacttgccttcaacaatgatcaacttatggccaattatgtttcagctacaacccaatctcgccccattctaatttttttaaagcatatcctaaacattgtatcattttatctgtaaatattttagtatatatctctaaatatatatgaactcttatttttaatagacataatcgtaatcatcatgattttaggaaatgattttaataaaaatcacacccaattcacgaagttaaaaaaccctcccaatattcacacccttctcattactcttggttttaaatgacttttcctgttgtttgaagcctgcgttgcagtctgactctgatccttccaaaaactgctcctagagaagctagaggtacactctgagattaagctacctcaacttcaagcctctggattctgggaggagttgagtccaccctctgatctagagtttccaggcatggctttgtgaatgcacctaccttcttcccagatttttgcccgtctgaccctcttacatgagaacatccccatacatggctgtggaaaatcctcaagtgcaatgaaggcaagactgaaaacagagccgctgccaaacagagcagcaagttgaagggcaagtgcctgtcaacacaatccccttgaaagactataaagagctgccaaaacatgagatgcatctgacatccagatagtattagctgactgcttcccaaatgggttagctgtctacagaaacgccctaggtagctgatatgaatcgcaaatgtgctgtgacttgattaatttgtaacagtcagaaattaggtagttcagtgctagtcatgctcaagcttagtagtagctggtttagttgttttttgttttttgtttttttctgtgggtaattggatctaggatgatagtgtaccatcccccagcagtcatagaagacatggtaaaaactagctttacacgggtcctggacttgaggtcacgggtgtggaaggtgattcactagggagttggctcttagcttagtgggtcatgtatttctgagaagcttctttcctgaggtttacagtcagtttcagaggtgaatgaactgcttcagatgatcagaaagatacactctgtcattattcccccaagaataatctttgcttctgtagttacattaaagctaaattttgctgccagagtaggagccatccattatattataatcgatgacatgaatgttttgctcaagttcagatgtctaataagagtcattttctttccgagggagtgttatcagtttcatgaatatgcgctctgtatttcattagcattcttctagcaaaacatgattctgagtcatttctgaaatatctgctctcgcctgcaacttgtttctcagtttttacaaaaattgccttttctacttactggcagaaaagtttgataccacacgagcctaaaatgggtatgctgagaaaaaacacagcacacctatggaaccgtgaccacaacagtgcatcggtctctgtcccaccgtctcattcgaggttaatccctctccacagggcggcacctcagcagggaagggcgagtctgaggactgagggtaaacagtcatgacatgggtattcactatcatggctttcttagatttttaagccagaatgaagttcagagagcttgtcagaggatgttgaatgaacagaaaaggaaatttggaacccatatgaaaagagctgctttatgaatcacagagagcttttgagttccagcttacagtaattcaaataccactcacttatattcaactgagagcagctctggcccagccttgtcccctgaccccggggacactttctctaggatgaacaagagaaggtgttctccactgtactagctgccagtgtgtttctttcaaccaaggaagtatccatgtctcttattctatgtcattattgtaagaatggtctaccttgatccttagaagccaaccaggatggagtcccattttgcagagtctgctgtgactgccagccacccctgtaccatggacttccacagcaatgatgctgtgctgcatctccatccaaagggattgcatctgttttaattgcttgactttcaaggacactcagggacaggtactcttccataattctacgtcatcccagtttcacaggggcgtgaattccccatcccctgcaaggtctactgctctccaaagtgtgtgtctttgagatggaggctcttcacagggttcaccacctctgcaagtagggctgtgacaactcagccttgtgcactgccacaaaaggcccttcaagagcttctagaaatttctggctcacagaagccactggaatactgtaaatggagttggttttggtggctctgtcctttgatgggaggctctgtctcctgaggccaagattgaaggcaggatctgaagattgtgcgcctggatcaactctaatcctttccagcccaagagagttgttcttgcttcttcttggactgttgtgagaaacttccacactgactgcttggaagtgtcacatgttggacctcttggtaccagtgtctctgacagactcataccactgggagctcagagcgagtggctgaggccagcagagctgaacacttagtgccctgtccctgcattctgtgggatcaagaatgaactggaagtaggatgccgccctagaggaggcacaggtgctacagaggcagctcagctcaggaagcggacgtgaaccccttcctaccccccattagtgctgtggccatgaggccccctcacctgagggggaacacctctgtcagcctggctatctgccaccaacaaacacttttcctgggaaggggcctggattcctccagttgagcctccttagatgcacaggttgcaccagggtggaggccacagccaaaaccaaacagtgtagcatgaacaggccaggctcccagagtgggaagggaggactggctggaggcagcaggaggctggagccacatttgcctgcaaaaagtcttttcagacgcacatctcaggccagttacgcaactggctcctggatccctctgcccaggcccagtccctcccattgcctctcagtgtaaagcagggaatgctgcaggatggagagtcctaagccttaatcgtggatcttgggattcagagtccagagaggataaagaagcaaattcacagtcaacacttcctttttttggatgtttaccatagtgaagttttgtgcaaagtgctatgcggacatgatctgacacatcatgttcccccaccctcccggcccaggatctgaaggtccagcaggagaggcaagccaatgctaaccaaggctcaatctgatacagggacacagactgctctggacttccgtatatgcctttaaaaatatatatatatctttaggctgggcgtggcggctcacgcctgtaatcccagcactctgggaagccgaggtgggtggatcacttgaagtcaggagttggagaccaacatggtgaaaccgcatttatttattttatatatatataattttattaataaataccctggaaggaccttgttcctttaacgtgctggcacctatagcagggaccaaatttgtacttttacaaactgtctgtactggtctaaggaggagcagaggcgcacatacaatagctgcttatgcagaatcactggaaaacaggtgattcctgaacgttgctagatgaatataactcagaaataacccacagcctagattagtaatctgtgaaagttggagaccaaatgaaatttgtttagcaataaaatgcttttgaagagaatttctctttctttgatgttcttgctcattactgtacactctaatggtgttgggctcagaactattgctcaatagaggtttgataaatgaatgctccagaagacacacagaggctatcagtgtggtcgttgtcaatgagtgtcccagacattaaataagagcctgcaatgcctgagagccatgcgcagagatcatgggactgacacctggggagaggttctgaagggacctaagcacacagacaggagggaggtgtcatcagcagattcatccagccccatgttttgtagatgaatagttccaagacactttttaatagttatccaatcctgtatctcctgagcatgctcagtgccatagagcctcagtttccacatttccaagcagacttttctgttctctcataagcacatttgagaaaggacttgtttccccttgctgtcataaatgcccttgctttcaagttcaagccaaaaagaagcagtgcaattgttcttcaagctgatccggtgcagaggaaccgcaaatgccagctccagctatggtttctaattgaatatgactttctttgtaaatgcctgtccttgcccccagcagcaaactgacaactaggacttgcctttgtgagctgaaatgatgtcgctgataaccaacagcttgtattaatttttcctgataatctcatagtacttttaatgagattggtggcaaacatgccattctggggcaaattaatttgtccttgcaaaacagagtgtcagcgatttttatttcctttgtctgacgtgtaaatgggttgtttccaatggcaattgatacaacctagtattttcggctgcactgaagggagaacaagattttgccaagagcaacaaaatcagcacaaccacaattaaagcagatgatcgacatttggaaaatggtctgctgatgtttcttccttcgttttccatgctgaaataggttgtgatttagacaagggccaaagagatgaacaaggcagccagcggctgctcagcctccatgtagcctggtcatggagaagcaaaatcgacatgaaatgtgaccctctctcttttatgtgctttcacatgctgtggtcaggaaccaagtactgtatttgcattcactgctcaggcactgtgcggtgacctgcttttatgccactttgcattgctgaagtgatgtgggtgaaaactggaatcctagttagaaggaaacatggcatccgactcttccattctctcatttccaatgtattgtgttgcctctctcacccgccaaagaaatgaaatgtgattttctaccagagttggaagagttttggccacaatataagtcattatggcagtttccattttctttgctatacattttgaacaaggaaccacagttcatggaattgcattgaaaattaacagcttttttttttctttttttttttttggccaagctagccagaaaggaacttgcatgagaaattcactaatgctaatgcagtttttcaagtggtaatatttctagaattttaattaggactttttttttgctttgaagggtcccatcacagaagagaaaggaatgctaatatttgtctttgatggccagcagggtcctggaggacattaacgttttgcaagctgaatgaggtcttcccactgacacgagcataaagagcaggtggatttaacagctttcattccattttctatttagtttaatcaagataccagttaagaacaaggggaggctgctcccagagcttctctgtccttttaggggttgaccctactggctcggctggctgtggattagaccacacctgctacaaatcaacaaataatgaacttcggatgctgagaacctgaaacactacataaaagagggcataaacaaactcttctttttcaacatatgatgggcgattgaagcggtcagtggaagatagctgtgcacaagaatgtgggcctcctcccttgagccaaggtctcagttttatgattcctaacttagagttaaaagaagcaagccatacaggtaaatgattatcaggcagagaggcctagaatgcattacagttatgcaaaacctgggtttttcataggtgtttttaatgttggtgtgaacagtggagccaaatagcatcttgtagcccctacgtgggcacgattctttcctgggcgacaccgtctgcatgccccatggtgacattcctgtgcgcttgctacagttggctagtaatcctggctttgaagaaggttttccagtgccaatcaccatgttcaagacaatgtgtgggccagtattctgggtcatgcgtcttccccaggagctttggttaaagtgagtttgaggaaaatatgggtgctctcagatgctcacagaccacgtggatgtgaaatttagacttttatttggatgataataaagacagactttaaatgttttcagagtaactggacagctctatctgtctcaataactgcaggcagttcaaattcagcaggaaactactcaggttcctcctagccctgccccattctttataacatggaaaccctgattccccccgccgaacactttccttcaggtagcaggatttttgcttcaccgtaaacacaccaggatcacggatgatgatagcatttattgcttggaataaaaagtgatttgcggccctgtaaataggacagcaaatagttttgcttttgacctaaggctcccatgtcacttcatgatttcattcatcttcatattcaaaagaaggataaataaactgctttcctgcttagtagcttggtcatctgaaatccagtatctgacatcaattcccagtgggagaaattgtgctttgctgcgtgtgtcttaactcagtctctgatgttctggttctgactcaggatgttggtgacagctgcaccacatatgccacgtctttcatgctagactaagaccagacatcttttctggtgcgcatggagtcacactgtgacctagaagacagtgctttgaaataatgacaaagcacagaggcaaggaatgaagttgacattgcataccaacggcatcatcaaatttgtcctcaaatgtcactgtgtaatgctgagtgatttttggaatctccctagtttcccccaagcaaattacatatcttcataggcacatcgatatcaatgttttgaatgtaatatattttaatgaatatgtaaacatgtacaaataaatataatgaatataacaagtatgactgtcctatatgagacatagatattttcaataaatgtatatttattatgaatatatatttataatataaatatcaatacaatgttgttgaatgggtgaataaatcctttaaagcagcctcaatgttataagtagtcactgtgattcattcatctcatacaagcattctctttctatggatgtaattaatacttatggcaaattgacttttcttgagtctcatgaaatagaaaaattcctttctgacattttgactattctaatatggcacaatattataattttagtgcatgtaatcttttccacccagaaaattggcactttctaaattcctggtttcttatttgaaaacaaaaaagacaaaaattatgacaaatactaccaaattaatatttaaattatatttgaatggcaaattaatacttaaaattacattgctaaaaactaattccagatacggagcaaacttaaatgagaaagataaaacaatttaaattttagaagaaaatataggagggcaacttcatgattttggccaaggcaaagatttcttaattaggatgccaaaagcaccattaaaaaagtgggtaaaataaggcattgaaataatattgggggctgggcacggtggctcatgcctgtaatcccagcactttgagaggccaaggtaggtggatcacctgaagtcaagagttcgaggccagcctggccaacatggagaaaccctgtctctactaaaaatagaaaaatcagtcaggcatggtggtgcatgcctgtaatcccagctactcgggaggctaaggcaggagaatcacttgagtctgggaggcggaggttgcagtgagcagagattgtgccactgcaccccagcctgggacagagggagactctctcgaaataataataataataataatattgggtacagataataatttcctccacatgtgtgaaaaagaaggttatgagaatcagaaagcaggaatttagacaatatgtaggggcagcagatttcccttgttttgtaaaacaggcctcagagaggagtatcaacttgcaaataggtcaaaaaccctttgagggaaggaagtttctgggcagcagaagctttaccaccatccactgtcacatggatagggattgcaacatactggcccttcactaataacatctcgtcccatttggatggcaaccctgtgaagtacatatgatcatgctagggaaactgaggttgagtgaggcctggtgccatgcccgaagttgggctgctgtccagtggtaaggcacgggctagctgtgtcagccctaaagggcaccccactacatatccccaagatacaggccacggggctgcaccctcagccacggcccagcgtccccaaggctcagcatgagtttgcatctgctccttccctaggaagtcatttatttacataaatgactaatgatcctgggcaagggctcctgttgggccacatgttctgctttttaaaattcagagcctaggtcaactgtttgatagaaaaatgaaaacataatgtaaattctaaataaagctgatatgcaaagaaactgccctgttaacttaccttacttgtagatcatattttcggtggaagtctgttcagtttaaagataaacatgacatgattagaggagaaagaggatagcccctccctttaagctccaagataattcaagacatcagttaactattgagcgattagagaaggtgttttgggagctgaccttgacctagtattctcaaatctccttcccctccataaggcctggtatacttcatgttgctggcagtcaacatctgtctggcttatgaagaacgagataatcacactcattttggggcctcaggctatgagcacctgagtgtgttaatatcaattaaaaaccccagtacccatctgttgaggtcaggactattaaaagtcaggcgtggctgggcgcaatggctcatgcctgtaattccagcactttgggaggctgaggccggtggatctcttgagcttaggagttcaagatcagcctgggcaacatgatgaaaccctctctactaaaaatacaaaaaattagccaggtgtagtggtgggcacctgtagtcccagctacccaggaggctgaggtgagagaatcacccgagccccagaggatgaggttgcagtaagccatgatcgtgccactccacttcagccttggtgatgggagtgagaccttgtctcaaaaaaaaaaaaaaaagaaaaagagtcacgagtcaggagtcaggtgtaaatgcctgtatatcagactgtattttagaaatttgcttttaaaagttacccttgtgactgagactcaaaaagaaacttccaggatgaatgttcaagctttttttttacttaataaaaatacagctttaaggctgggcatggtggcccatgcctataatcccagcactttgggaggccaaggtgggaggatcatttgaggtcaggagttcaagaccagcctggcaaacgtagtaaaacctcgtctctactaaaaatacaaaaattagccaggcacagtggcatgtacctgtaaccctagcgactcaggaggctgaggcaggagaatggctgaaacccgggaggtggaggttgcagtgagccaagatcacgctattgcactccagcctgggtgacaaagccagactctatctaaaaaaaaaaaaaacaaaaaaaaacaagtaaaacaaaaaattttgcctgtgatacgataatgagtttcttttaaaacttctgagattagtgtcttagagatttaactgttgtgttttgctgctttcagcttgttctccctttaaaaaggcctgggatcattgctgtctccttttcctttttcatcagctcctgtgacgttttcatctcaacactttgggaggctgagatgggcggatcacttaggccaggagttcgaaatcagccttgccaacatagcaaaaccatatctttactaatattacaaaattagctgggcatggtggtacatgcctgtaatcccagccactcaggaggctgaggcatgaaaatagcttgaaaactggaggcagaggttccagtgagcccagccaagattgtgccactgcactctagcctgggcaacagagcgagactccatctcaaagaaaaaacaacaacaacaacaacaacaacaacaaaatgatcccccaagaatcaataataaccagaataaggagccattatcagatattctttattactcttaattactgttaggcttcaggaagccactagttgggtacagctgcccaggactaaacctgtttcttacaaggtcctacagccacaaaaggtggacaccacaacctccatttataaaacagaaaacttaaggctgttgttttgcaaacacatagattaataacatggttctgtaggtggacctaggagcattaatttttccctctcttccaattataattttcttgtttaacatcctagtaaagtttatgtcttctaaatttcatgtaaagatgatacggtctgtcataagtcttccaacccattctgtcttctgaccccacaaatgaatgcatcgtgccattgggccccttagttcaggtaccaaagatttttactcctcaaaggctagggaaggcctgcccccataaagtcagcaggaagcacttacagaaaagggactctgctcttctgcagtccccttaagattaaggaggagtatcgaatctctgagggagcaatgagataggaggtaggtgggactcaacccaggaccagattgaagactggctgacacaaggaagagacactggaagcacctgtccataacacatgcccaccagtgccatatcagtttaccattgccatggcaacacctgaaagttattgcccattttctagctatttctgaataacccactcctttattagcatgtcattaaaactggggataaatatgagtgcaaaactgcccctacgctactgctcttggcacaatgcctatgtggtagctctgtttcacaagaacagtcacaaagctgtaacactgccacctcagtaaagctgttttcttctaccaccagcttacgctgcattccttcctgagtgaagccaagaacctgccctgcaccacttttgtcaagtcagttgacataaaattactcataatatcctctctttattttttgactcctgtaggctgtgtaatgacttcttcctttccatttatgatattgtgttttgtgtcatttttctttccctcttctttttttttgagacagattcttgttctgtcacccaggctggagtgcagtggtgcaatgttggctcactgcaacctccgactccccagttcatgccattctcctgcctcagcctcccgagtagctgggactccaccacgcccagctaacttttttgtatttttaatggaaatggggtttcaccatgttagccaggatggttttgatctcctgacctcgtggtccgcccgccttggcctcccaaatctttccctcttctttatacacccttcatcaagtagtcacaggtttcaattcagttctttcttggtggtagtatggctcatgaaaaaagctgattcttctgtgtttgaggccattcaccatgtttatatgtaatactgtaaaaagtcctgtgacataagcctctgcttcacaaactgaccgctgtcaaacatcatctccccaccaatagataatttttttgttcctcaccagtataattcacataggagtagaaatctcaagtttaaagtgtggatttgcactttaccacttggtgtattcaagaagatgaataatattaatacatcagtagggccaggcgcagtggctcaatcctacaattccagcactttgggaggccgaggcaggcagatcacctgaggtcaggagtttgagaccagccgggccaacatggcaaaaccccgtctctactaaaaatatgaaaattagctgggtatgttggcacacacctgtaatcccagctacttgggaggctgaggcaggagaattgctttaaattgagagatggaggttgcagtgagccaagattgtgccactgcactccagcctgggtgacagagtgagattctatctccaaaaaaaaaaaaaaaaaaatcagtagctttgaattttaaacatctatttgacaagaaattcacagttctttctctcttaaataacgtaataattctttcagtaatgagcctggtttgatgcctctctccccaacatgataaaagtatcacataaatctatgaaaaattcaatttccctgttcctacaactgtctgggatggaaaacttcttcccttgctctagtcctttcttctacacctagtttcacctaatctgtgactcaaaacaatacttgtcaggaaacattctggaaagagcaaaaggcttctaagaggtgtcagagattcctggaccaacatctgtccatctctagagggggttgtgagtatgaggaagagcagagcttgtaaatcttctccttgctttcactcccactgtatttcctaacaacaacaaccacaaccacataatatcatagaacaagcatctactacttccaaggctttggtctcagtaaatcttctctacctctatcacagcatctagaaggtttgatactcatacaaatagtgctgtagctttcttttcataactggaaaagtgggcaagactcagtgtaatgcaggcattccttaagctacttagcattcagtttttagattatcattgcacacatatacccagcatatgtctaatatacatgtaaaaatccatgaagcaagtgttatattagcttgtgttttctattgtattaaatttttctcttatatcgtcttctcctttttgtcattaaaaatctgttcaagtcagtcaattaattattggatcataagtagataaagtcttttatttcataacacattgactcaatgaatatgtttctttgcaagacacagtcctcatttccaagaaaacaagcctgaaaagattatactggagcaagtctacaagtaatgatggtagtttttccttattgtcagtcctggggcaagaataacataaaagataacaaggtagaataaagattacataagaaagaaggacagcaacaggacatgggaactatttatagggtaacatttaaataatggatgatgagaagtaatgcgttagacagggatggatgggaatgattgaaggtctgagtactttagcacagattaagatcaaatcattaggattttaagagttgtgtacagttactgaagaaaatgccttagaatttaatttgactgtggataaaacattcttggattagatttaagactattttccatggtaagtatatttataatgatgatgactgtagtgctgaacatttaaacaatgaaaacaaaattaattgccacacacataatgtcctgaatactactgtaaatgttttatcttattttctttaaactgtctacagcactgtaaggcaggtaccactattgtcacagttacacagatatggaaaccgagacacagggaagttaagttacttgattaatttcaagcaatcgggaagccatggagcatctatgtcagggctgccaggacatgtgactgtaaacagaagtttttaactcaaagagggtatgtgtctgggttaatggaaagcttcaggaccctcagaaaacattactaataagcaaatgaaaggtgtatctgggccgggcgcggtggctcatgcctgtaatcccagcactttgggaggccgaggtgggtggatcaccaggtcaggagatcgagaccaccctggctaacacggtgaaaccccgtctctactaaaaatacaaaaaattagctgggcgtggtggcaggcgcctgtagtcccaggcactcgggaggctgaggcaggagaatggcgtgaacccgggaggcagagcttgcagtgagtggagatcgcaccactgccctctagcctggaagacagagcgagactccgtctcaaaaaaaaaaaaaaaaaatgtgtatctggaagattaagttctaacagactcttcatttccatagatccaataatgcacttagggagatgactgggcatattgaggacaggaagagagaaatgaaaacacagccttttatattgttcttaacagacttgtgccaaacattatacgggtgtatttaggtgattgaagagaagaaaggcacaggagtgaaattctgtgagcacaagggaggagttctacactcagactgagccaacagacttttctgacctgacaaccaaggcggcgcaggatgctcagtgcagagaggaagaagcaggtggtatctgcagctggaagcccagctcccaccccagctgctttgcatgtccctcccagctgccctaccttccagggcccatatcaatgcctgggtcagagccctggggaggaactgctcagttaggacccagacggaaccatggaagccccagcacagcttctcttcctcctgctactctggctcccaggtgaggggaatatgaggtggttttgcacatcagtgaaaactccatcaggagttttctctgatcagcaagaaatataattaaaattcaaagtagatcaacaattttggctctactcaaagacagctggtttgatctagattacatgagtgcatttctgttttatttccaatctcagataccaccggagaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataacttacctcccacagtgattcaacatgaaacaaaaacctcaacaagaccatcagtgtttactagattttaccagctgcttcctttacagacagctaatgtggccactcagttttagcgtctctgctctatttggacattttgcagttctaaaaaaaaatcattgaataatttggactttgattcttggactctcttcaactgaggcaccagaatcccaggtttccagaaatagtgactcactgtatgaatccttatatagcctcagtggttcttaactttcccagtagaggtagctcagtgcatgctacactgctccatttgaattttgcaacattctaagtagtagaaaattctatttatttatccaaatagttgactcagtaaaagctgttcatgtgaagatactaccatggctgaataaatcccattctttttctttcttcaggctatcaacatttcagtggcaaatggttattatggaaacatttgccatttaaaagtgaactaaattatttcttcaattttctctgtgatgcagtagactgtaaaaagattaaagtttgttaaaataaagtacatattcgataaggaagaaatagattattcctaatgacgtctgcaatgacctagtagaaggagtgatagaagcagttgttttcattatttttgtccaaaacttccttccaaatgggatttcattgatcatattcatttattaccacctataagacatgttgacattatgtaacatctgatgtgaagcgctgaggatacatctgtctgtattattcttgccaaaaattaatggtgtgaattgaatcagtagtaaacatcatatacaaacccaactaggaggacattcttcaacatacctggacagtaaacttcaaatgtttgaaggccatgaaagagaaacaaaagtgaaaaactatcacagatttaaagatattaaggacaggataaccaaataaaatacagaaacctgaattttatcttgtaacataaaaaaagtcatcaacgggaaaaatcagtgaaatccatatggtattttaaatgagttaacaaataacattatatctatgttcatttcatggttgtgatacttatgctgtggttatttatgatgctgacattagagcaagctgaaagaggcacatatgggaatcatttttactatatttttcaaattttaggtctaaaagtatttcacctctctcctgcatcctgggattgcctccaattaactacctgcttacaagacttttctttattttctttttgccttttattctttacatgtaaaagatgagtccatctggagcttattttaaagcacagtatgaggactgacattgacctgtttttttaaatgaaataactagctgtcccaaccctgcttgttggataacactgctctgtttcaggagtacccccactgtcatacacccgtgggtccatacccctgggctctccatctgggcactcccctgcctgtggcacctccttcctgagggccggcctcacccagggcccagctgccctctccatggcctgtgtcttcctttcctgatgcctcagatttcccccattctctggcactctttccatcctcctggcctcactctgcacctcccctgaggtgcaggactgccctgccccagcccccagcttcctcactcccaaagccttgtgccactgaagcacgagctccagagtgcacctggatggcagcttctctcctggccaacaaacgcctggtgctggctgccctcccagcatctcccctcaactcctcagctccaccccagggccttaacacacacatgcatagcacacacacatacaaacatatgcacacacagacatgcacacaaatgtacatacggacttacacagacacatacaaatgtgcacacactcgtgcatacacagatgtgttcatgcaaacacacacgtgcacgctcacaggcacgtacacatgtgtaggttatgctaagaaatccattttgtgtggaagacactcaggctcaaatatgtgtccaaagtcacacagctatggagcggcagaactcaggtctctagtgcacacagccccgacttaccgcagttccacttaacagttttcaactttatagtgatgcaaaagccatccacagtcagcagaaaccctcgtgtgagtcccacacggccagtttttcgctttcagtacagcagtcaatgattacatgaggtatccgacacttgactacaaaacaggcttcgtgttgatgcttctgcccaccgcaggctcagggcagtgttctcagcaggccaaggtgggcccccccacgctgtgctattcggtagtcaggtggactcagtcattttccactcgcagcggccttatcgggccgcagccaggggtaagttgagcagtgtctgtacttttagctccaccctgggtatttttaagtggcagatttacaacaaaaaataaaaataaaaatgaaaaaatacagcgttccaaatagtaggggcataaaaggagagaatgcacgttgcggtcagcccatgcctgggagcataagcacttcagaggcatcaccaggcgtgactggctgttgttcctgctcttcctggcagcagcggcctgggcctgagagggatcgccctggccacagctgtaggcaaggctgctgggagccaggagccgccgcgctccgcggtagcgagtctgcggcgccacctcgtgggtgctgcgtggaactccccgtggtgcgggccgggaaggccgggtccccacaaagccggagcccgagcacagcggtgcgagctcgccccaggacatcccacagcacccggagacgggggctggtcccccaaaaccctcaggggtgagaggaaggaggtccccagcctgctgagagctgtcctctgagcacgcactcgcgcacactcacacgtgcatgtgtgcatcctcaggcaccctgacgcgttcacatgcacgtacacgcgtgtgcacacgcacagtctttcacaagagtatgacgcattcacacaagagtgtgacgcgttcacacgcacgcacactccctctccctcgagcctggaaggtgcactgggctcataggggtggaaacctctaccgcggcagaggcacagcaccagggccaggatgctcgcttttatttcagacgtgaaaaccgaggcccgaaagagacagccagtgtccaaccctgtccaacgtctctgctgattgcgcctcctgtgtgtggccggggccggtgtgagggcagcgggcccaccgcatgcctggcccgccccagggcctcgagccacttcctcaggagctgctggcagctgcagcgacggcgcacccagagcccgagggtcccatggagccaggcttcccagcacacaggcacggtggagcctcggggtgggcatacaccccgcgagctcgcgggggctgggcactgcgggtcctcgggtggggactctggagttcagtcttgaaggacacagtcactgagggtcagggaaccaggagggtagggagggtagggaggggtgcctaggcctagtgggagaagcatgtgaaagttccctaagagggctgggggtgaacaagctctcggcccggcctctccgggtagactgctctggtgccctggagcctcccttctccaaggccccatggacgcccccagaggggtgacgccctcgcccacgctgagctctgagtgctgcacgagaactcccagagccgtgtgcacacgcactccccttgttataaccggcattaagtgcactcacattgtcgcatatcccctaccaccgtccatctccagaacttcttcatcttcccaaaaggaaaccatacccactgaacaccaactccctccttttgttaaccattgctctttctgtatttgaatttgcccattctgggcccctcatgtaagtgaaatcgcaatgtatttgtccttttgtggctggcttattccatctagcacaatgtcctcaaggttcatgcgtgttggcacacctctcagaatttccctcctggctgggtgatattataggctcacgcctattatcctagctgttagggagacagaggtaggaagatagcttgaacccaggagttcgagacctgcctgggcaatatagcgagaccgcattttccacaaaaagaaagaaaaaaaagaatctccttcctggtaaaggttcagtaacagtctactgtatgcataaccacatttcgcttgcccatccactcacccatagaccctcagaatgcttctaccttttgactcttgtgaatcacgctgctttgaacatgggtgtgcaaatatctgtgagagagcctgctctcaaaaaaatccatattcttggcaccatgaagaatcacctctcacagacaccagcgaaaagcaagtctgtctgagagcagagggtgaggaggggaaagccgggctgcggatcacagtgggcggaggaaagcccacccttgtgctcccatgtgtgggaggagagaggagagatgccctctagtgaaggaactcttgtagcagccagctccattcctgcttggcctgtggagggccagctcaggaacccagaccaggaagaagtcaaatgaccgacaagatccatcaggaagcagaagtgtgctgtgtctcatcggcaacaacaaacagagctaggaccagccacccaccccccaacccaggggaaatgcatccaccacacaactaccaccgctgcgctcatgacactctcagagacaggcacgggagctcctggcaaggcacaaccagggcaagtgacagtttgccagtcctgggcaagcagacacttatcctctctccagtccccaatcccaccagcctgcacaagcagagaaacatcctgcataaattaaaagatcatccggatcatcaaaagatctgagcaaacaaaacgactgagacaaaaaacaaacaaaacaaaacaaacaaaaaacagaacaacaacaacagaagaacactcatttttacagagagatttgagcccatcccaacagagtacaatgctctttccaagctcatggatggcgtttgggaaaatttagctgtgctaaaggagcaggaagcctcagcccctttcccaagaattgctgttacacaaatcacattctctcaccagggtgcaacaaaattagaaacatgcaataacaaagaccatgttaaaagtgcattttggggccgggcacggtggctcatgcctgtaatcgcagcactttgagaggctgaagcgggtggatcaccccaggtcaggagatcgagaccagcctgggcaacatgacgaaaccctgtctctactaaaaatacaaaaaattagccaggcatagtggcaagagcctgtaaacccggctactagggaggctgaggcaacaaaatcacctaaacttaggaggcagaggttgcagtgagatgagattgtgctactgcactccagcctgagtgacagagtgaaactctgtctcaaaaaagaagaaaaagtgtgttttggaaacaaagttagttttcacaatgaaaattataaaatgcctggaactcaatagcaatagggtattacatattaaaattatgaaactcaacaaaattgacatttagggagaaatttatatcctcagattaatttgtcagaaacaggataaaaggagaaagctcatgataatttgagtaaaagagaaaataaaaactaaaatgaaaaacttttcagaaacaaactacaataagtgtgtgacctatcaaaatctctggatgtgtccaaagcagttctcaggggaaacgttatagctggaagtgtttgttaatatgcttcaacagaagacatataaaattatataaactaagtaaacatacaagaagcttttttaagggaaacaagaaataaatgtatttaattttaaaacagccataataaaagtagacttgataaataaaacccaaaaccacttctttgaaaagaccgttaaaaaaacctctgagaagtcaagcaaaagagaaagaaaaggcacaaattttaaaatgttagatttagaaaaatggcataataaccaacgtggagaagctgcttcaaatcaaggagacgggaggccagcttcattccatgggaggccagcttcattccagtaggttccgtttcacctggatgaaatggaagattttcttggaatgtataaattggcttagcaggaggcagaaaacctgaacaaacagaacaaacagaaatggtaagcaggtgctcgaggggctccatcagcctccagggatgggctgctgtgttagggagggccagagcacaggggaagtggagtgtaattctttctacaagattagcaagctgaacttgaatctcacacacgcacacacaccacagtgacgtggaaagaatccacaggacacttatgagaggtaaaaatagaaagtttctgcacaaaacaatcgtgtgtgtttaaaagataccatgtggcagaaaatagtgatgtttgtttgccagtgtctaggaagaaaccttgaaggcgcacgccagactggcggctgggttggctagggaggagacgatggggtgggagcagctaaggacgacacacactcttttaactctgttcctgcgttgtcgggacgtttacaaactgaagatatatatttttaattaattatttttttttttaaaattttactttaagttctgggatacatgtgcagaacatgtaggtttattacataggtatacatgtgccatggtggtttgctgcacctatcaatttgtcatctaggttttaagccctgcatgcattaggtatttgtcataatgctctcctttcccttgcccccaacccctggatagaacctggtgtgtgatgttcccctccctgtgtctacgtgttctcattgttcagctcccacttatgagtgagaacatgaggtacaaactgcagatatttatacattactttaaagtaattaagttaaactaaactaaatgtaagccaactacatgtaaataaataaaaccaataattaataacaagataaaaataattaatacttaaataattactaatttatttctcagctaaaaattaaaaatttagaaaatgtggaaatgtgtttcataataggaggatatttaaaatgaaagggcatttctgtagtcaaaggggtaggagactcacccaaacaagacacaacctcaaaaccaaaaggaaaactatcaggtttgattatacgaatactgaaaacctctgaatacatgaaaggcaaattctatatcccatgaaactacccttcagaaatgaagagagaaataaagacattctcagaggaagagaatataggaatttgtcactggtcaatttagaaatgctaaaaagtggctacggaaatatgttctgtcatttccacaatacaaaaaattaaaacaaaaaaatcaaaataaaaaaatggctatagaaagttcttatgcagaagggatgaatatgggactatgggaggagggacaaaggaaagacgagaaatgtggatacatacgcgagacaatccacagttcttaaaatcacatctgacgactgaaacaaaaactataccaccacctaatactcaagccagtgatttatacaagtggaaaaggtaaagagacataaatgcaaggcaggtttccacactttgaagtggtaaatactggtaccagtagactactatattacaatacacatattgtaacatccagagcaaacactttaagactatacaaagagatacacgcaacaacattttacagaaatagatcaagatggagggaaagaaaaaggaaacaaaaaagcaaataataaaaacatcaggcataagcaattatgtaacaataagcaccttaaatgtaaatggtctaaataaaccaaaagacagattgatggagagcctataataaacacatggcccaactaaatactgttcatgagaaacttcaaactcacttaaggacctaagtaggttgaaagtaaaagaatggagaaagatatcctgtgaaatcattaattttttaaggaagcaggagtgactatattaatatttcatgaagtagacttcaagcaaaataatttaccagagctggagagggtcttcgctgaattttaagatctaaaatttcctatgctgccttgacatctttgagcctcacagggccccaaaggcctagccgtgggttttcctgtttctaccagacaccccctaccccgccacccaacaggaaaggctccccacctggctagttcttttatcagccagaacagttgcacctcagcctaagaagtttcgcttcacctgtctgccagcccatgaatttattcaaacaagccaattgcattccccctcgggaaccattggtcatcgtgtgctcttgttactaccaagcccgcctgcttcctcagcccgcagccctcactccactacagagtgcggtgcccatctgaccctgtgtggcatgcagtgtcctcctccgagctgtgggtatatgcgactaaaacactgctgtcaatctcatccatccacgccaggtgtcatgttcggccatctcctacactttagggcagggacccctccttcaccaatggggtgaaaaggaagtgaccataacaactgcttaatgacaaaaggattaacccaccaagaagacatctacttcaacatcctcctcttagcaactgttaaaactaggcagaggccgggcacagtggctcatgcctgtaatcccagaactctgggaggcaaaaacaaaggatagcttgaggccaggagttcgagcctgggcaacatagcaaggcctcatctctccaaaaaattttaaatttagccaggtgtggcggcacacacctatagtaccagctactcaggagattaagccagggggagtacttgaccctaggaagtcaaggctgcagtgagtcatgttcgtgccaccgcactctagtgtaagtgacagagtgaaactaggcagaaaaggagcaaggatttacaaaagatctgaacagtcaaccagcaaaatctgacatccgtataacaccccactccccaacagcaaaacacacacatttttaaagccaatagaaatctaccaagatgaggtacacttggggcaataaaagaactcacagcaaatctcgctgtgtgcccctctgcgccggcgccgtgcccctctctgcgccttcttttctcaccatggggaagcgtttgggggcctcttgagggaccccctagatgcttctactcagagcccccaaagccggggagcctccactcctctgtctgcagcctcccctgtcggttctcgctacccagggttcagtggcctgggggtgacggagggggtcgcctctgccaaggcccctcccggcgcctccctggctcatctagcccaccttcctcccacgctggctcacgcaaagtgctctggtcaccaggagcccttcctgaccagccccagccccttcttggccttcgcccacctggcctcccctggagccctgacctgggtgccgggcctgctgggtccagagcccaccccgccctgaacaaccccgagtctcagccaccctcggttcttaccctttcacagctggggagtggagcctgggcctgcacctctccgcgccagagccggcgccagcgcctctccgcgcctgcgccgccgctgcgcgcctcgccgccgctgtctgcctctccgccgctgtccgtctctccgccgcgccgccgctgtccgcctctccgccgcgccgccgctgtccgcctctccgccgctgtccgtctctccgccgcgccgccgctgtccgcctctccgccgctgtccacctctccgccgctgtccgcctctccgccgcgccgccgctgtccgcctctccgccgctatccgtctctccgccgcgccgccgctgtccgcctctccgccgctgtccgtctctccgccgcgccgccgctgtccgcctctccgccgctgtccgcctctccgccgctgtccgtctctccgccgcgccgccgctgtccgcctctccgccgctatccgcctctccgccgcgccgccgctggccgcctctccgccgccgtccgcctctccgccacgccggcgccagcgctgtgtgcctttgcgagggcggagctgcgttctcctcagcacagacccggagagcattgcgagggcggagctgagttctcctctgcacacacttcggagatacagcgaaggcagagcaatgttctcctcagcagagacccgggcgggcgggccggtggcaccgcgagggcggagctgcgttctgctctgcacagaccttgggggcactgcctcgctttgggacaactcggggccgcatggacggtgaataaaatccttcctgtttgcagccctgtttgtggttggtggcagcgatggacactgcagccagccagagcgtagaaaggcgtcggggtaagtgcgctatccaggctgcactgtgggtggcctgggacgggttgggagccctatctcaggcgtcactgcccgtcttgggtggccggttgggtgtgctatctggggctgtgctgcctgcaccgggcggggggtggggggtggtttgggggccaaaccggggctgcactgcctttggtggggagccggttgggggcactatcccagactgtattgctggcaacagtgaggtgggctaagtgtgctatccggggctgcactgtgcggctgtcgggggggtggcggtttcgggttgagggcgctatggggtgctgtaatgcccatggtgtggggaggcggggcagtttgggtatgttgggtgtgctattgggggggtgacactgctggtggtagggggcagggtgggttgggggccatatcaggggctgcactgatggctttagctaggatttctggtactatgttaaacaacagtggtgacagggggcatccttatcatgttccagatcttagaggaaaagctttccatttttccccattccatatgattctagctgtgggtgtctttcctgtagtttttattatgttgcggtatgtttcttctgtgcccgtttctttgaggatttatagcatgaagggatgttgaatttcatcaaatgctttttcggtttcagttgacgtgatgatactgtttttgtcgtttatttggttgatatgatgtatcacattgtatgttgagtgacccttgggtcccagggatacatcccacttgatcatgatgaattatctttctaatgtattactgaatttgattcactggtattttgttgaggatttttgcatccatattagagatcctggcctgtagtttccttctttgatgcttttgtctgattttggtatcacagtaataatggtctcacagaataagtttggaagtattccctcctgtttttcaaaatagtttgagcaggattcgtactaggtctttaaattgtttggtgtgaagccatcagcagtgaagacatcagttcctgggcttttctttactgggagactttttctgatggcttcaatctcattacttgttaccaatctgttctggtcttggatgttttcattgtttaacctaagtaggttgtatgcatctaggaatttgccaatttctactaggctttccaatttattggcatatagtagccagttatgatcctttgaatttctgaagtattagttgtaatgtctccttttttaatctgttgattttatttatttgaatcttgtctcttttcttagcctggttaaaagtttgtcaattttgtttagctttccagaaaaccaacttttcatttaatcttgtatgttttttatttcaattttgtttgtgctacgatcttatttattttcttattttcggtttagtttgttctttactagttctttaagatgtattatttgaaggttttcttttgtttggatggtaggcacttatagctgtaaatctctgcctttgtactgctttctgcataacaagttttggtatactgtgttttcattaccctttgtttcatgaaatttttgaatttctgtcttagtatcttcattgatccgctagtcatttattcaggagggtagtgtttaacttccatgtgattgtattgtttccaaaattgcttttcttattgatacctagttttattcctttgtagtgaaagaagatggccacggagacagacagcagcgtggtcagagtggtaggagccggccatcagcgagagctgctccatgcctggctgctgggtcctagagcctgtggcccactggcttgcctcactgtggttggtggtggtggtgacagagactgcaggacgaccagatggtaggacaggggctatccagggctgcacctttcgcagtgtggggtgggttgagggcgctatccagggtgtcattgcctgcattaggggtactggttggtagcactgtacagggctgcactgcccacggcagggagggtgggttatgggtgctttctggggctgcaatgcccatggaggaggacaggttagggcactatcggttatacgctactggcggcattgggggacggaggtggggggcgctattgagggcaggactagcagtggagcgggggcgagttcggtgctatcaggggctgcactgctggtgtcggtcaacagagttggcatcccaggaaggagtggttctcctctccctgactccacactccagagggcgacccactcttggtcatactggagtgcagcagggcacgcagcgtttgcgtgggaatcctgagcatggcagagcccccacacccaccgtggttcctggttcctgggcctgtgtactgtgggtctgtgcctcagaggctgccaggcacccctggggacaccacgggggacagggccctgtgcgtggaggcgtccggaacaggaattggcacctgggtgtggagggctggctgggtctgaatttttctgcttctcctgctccccgaggagtgcagccccagtgggcccaatggttcctgtggagtggggagctgggtgctgtggtgtctccagcacccaccccagaccccagttcctgcccagcttgggccaaaaggagaggctggactttggagggtgggtgtgagtgcctttgctgaaactggcccctgccacccagtggccggcatgacaagttgaggctctaacccttccacccctcacgtctttctctaggcttttctggctttgcccgcccagctgctctgtgccaggaagaggaggagacacctagagcctgcgacaccatggctcgcctcgctgcgggtgggcggcagtgacggagactgcagtgcgccagagcggtaggagagcggctgcgctaggagggcaggcggctgcagccagggttgggggtcaggcttagagcgatggacgggctgcagcagtggccagatggtaggagccttgtaaggagggctggtgcattggcaatgggcctggctttgccctgcgcctgccgtggatctggccctgtactgccctgccttgccctgtacctgccctactgttacttggactctcggccctgtcctgctctggtcccatcctgaccctgtcttggccctgtgctaccctgtccctgccctggtcttgccctggcactggctctgccctgaacctgcactggcctgaccttggctctggccgtggctctggccctgcctcttgtcctgaccctggtcgtgtcatggcactggccctgccaatggtcatggtcctgctcctgttctggccctgacctggccttggacatgtcctggccctgctttggcccatccctgccctggccccaccatgggcctgcctgttctgccctctcctggcactgaccttgccctgtcatggcccagtggtgccattgccctgccttaccctgcgctggttgtgacttggccccgcttggtgctggccgctccctggacctgccctggacctgccctgaccctgcccttggcttttgccctgccctcactgtggcctggccctggccctagccctggtcctgccatatccctggccctgcccttatccaggccctgcccctgctgctgccctggccctggcctggaacctggtcctgtcaaggacctgccctgactctgccatggccctggccctgctctgccttgttcctggccctgacccagacccagaccctttcctggctctgcactggactttccctggccctgagctggcaatggtctgcccctggtcttgccatcaccctgccctgctgcgctctggatgtgtcatcaccctgccctggccctactctgcctttgaccctgccctggccttaccttggccctcaccctagtcttcgctagaccctgctctggagctggccctagcacagacctggccctgatcctggccgtggtctttgtcctgccatagccctggccctgaagtggacttggaggtgtcctggccccggcataacatggctctgcattggcctgtccctgccctgccgctaccatctccttgccctgctctgtcctgtcccagtactgtcccggccgtgctatttcccttccctaccctgccttggctgtgccctggctcggttctggccctggccccggccctgccctggacatgctctgacactgcctcagcctcggcactagcctggctctttcttggcatcagctctgctctctctgtggaccggctcttgtcctgtcctgcactggccataccatgccctgccctgccctgccctgactcagtcctggctcagccctggcccaaccttggccttggcattgcccctggtcatgccatatttcttgccctgtccctaccctggccttggccctgacccttaccttgctgtggccctgcccttgccctaacgcagcccctggccctgtcatggccctgccctggacctgtcctggccctggcccttccctgcttgagaacttgccctggttctcccctggccctgaccctgaaatgcctggccctaccctggccttgcactgctctggcccttgccctgactctggtcctgtcactggcctagccccagccctgttgctggtcttaccatggcccagaccctgccttggccctgccctgacactgtcctggaccctggctgtgccaagaacctgcactgtccttgccattgttttgctcctgccccgaacctggtcttccccaggccgtggccgtggccctggccctggccctgcccaggtcttggcactgtcctggccccgccctgccctggccctatgctttcctggccctgccttgccggccctggccctgccttggccctagcctggctttgaccctgccctggccctaccttggccttcaccctagccttacctgggcactgtgttggacctggccatagcacagacctggttgtggccctggtcctgccgtggccctgtctcagaccctagccctgccaggtacctgtcctggcccagctctgggcctggctttgtccctggttcttagatgaacctggtcctgctcctgcccttgctcttgccctggaactggccttggacatgtccatggtcctaaccctggccctgcccaggagctgccactgtcttggctgtgccctggctctggccctgccccggccccaaccatagacctgccctggttggtcgtgaactaccttaaccctgtgctaccctgggcctgctccaccctgccctggccctgccctccctttggccctgccctgaccctgccttggccctcacactggccctagcacagacctggtcctatgtgtggccttggcctggcattgacccctgctcctgaccccggtcctgccatggccctggccctgccaatgaccctggcagccctggccctgtcttggccctggccctgaactggccctgccctgaccctggccctgaagtggatttgcaggtgtcttgtccctgatgtaacctggtcttaccatggccctgtccctcccctggctctgtcctggccttctgctgaccctgacccagaccttggccctgccccagccttgtcctagatctggccatggccctgcgtctgccctggaccagcgctggcactggcatggaccctggccctggcccttcgctacttaaggccatgccctggcccagccctggtcctgaccctgtcctggccctaatttggcgtggctctaccctggcatgctattctggccctagccctgaccctgtccctgtccctgtcctggccccagccccattgctggtcctgccacggcccttgtcctgacattgccctttcctggttctggccctggccctgtcccagccctgctctggccctggtctgaaccctggccctgcaatagacctgccttggtcctgcccagaccctggctctggccctacctctgccctggccatacccttgccctggcctggaccccagtcctggtccttgtcctgccccagccgtggccctggccctgccctgcctgtgccctgttctatcctgggctggccctgccatggcctggtcttgccattgccctgccctagcctgccctgcttgtgccctagacctgccccggcctttgcccctgtcttggttctagccttgactgagccctggaccttccctgatcttgcctcagccctggcactaccctggccttgccttggcatttgccttactctctctatggcctggctctggtcctgccctgctctgctcttgttctgtcctggcacagccctggccctggccctggccctgccgtatcactggctctggtcctgcccttatgcagacctgaccctgccactgccttggctttggcctggaccttggccatacagtgaccctgccatgaccctttcctggccctggcctggaacctggccctgccaaggactcgccctggctctgtcatggccctggccctttcctggatttgggtgtgtcctgtcccttatttgccctggcccttccctggctctgccataccccttctctggggtagggccagggtcaggaccagaccagggcagggtcaggaccagggtagggccatggtaaggcctgaagatgggaagggccagggcagcggctggaccagggaagggtcagggccagggatgtagtaggactaggggcagagccggcactagggctgagccaggacagagcaggagagattacattgggctattacgtaaaatttttattttagatttttaagataactatagtagtagtaatgtctatactatattgtttgtaatagtaataatatttgcagtaatcactaaattttaactaatactatctttgcttccagtagtgttctatgagtataattttatcaatatgttaatatgtgaggcattgattctcacaataattctatgtgctaggtacttaaagcatccccattttccaaatgtaggaaacaggcataaagaagttaaatacttggccagattactcctgtaatcccagcactttgggaggccaaagcaggcagatggcttgagctcaggagtttggaaccagcctgggcaacattgtgaaaccccatctctactaaaaatgcacaaaaagaactaatttaagtttcttgtaggattctggttacaaaacactggtcaaacacacagggcatggatagggcagggccagggacaaggtcaggccaggaaggggccagggccaaggcagggccagagatggacttggaagtgtcctggtctgatttgccctgccccaacgttggcccagccctgctctggcacttcctgtcatgccctgtccctggcctgagcactggccctggccctgtcctgcttctggccctgccccggagttgaccaggcactgccatggcccagtcctgcattgccctgccctcctctgccctggtgctaccatggccctgcttgggccctagctctgcctctactctggacctgccctgactctgctcagccctggatctaccctgactctgccttggtgttgccctcccatctctatggcctggctctggctgtgccttgcatagatcatgctctgccctgcgtgtcccagcctgggcccagcccttgtcctaccatattcctgaccccagccatacccttcttctggccgtgaccctgccgtggccctctcctggcccttccttggtcctgccctgcccttccatgccctggccttgccctcaccctgcattggccctgcactggtcctgccctgccctggcactgccttggccccggccctgccttctccctggtcttgcctttgccctgccctggcctgaccccaggcctaccgagtccatgaaatggccctggacctgccttgccatcgtctgtcctggccctgtattgtccccaccatgctctggtccagcgcttgccctggccctgttgctagtcctgccactgttatggccctgccctgtttttggccatgccctgtgctaccctagccctgccctgccttggccttggccctaccatggccttctcctaccctggcctggccctacactggccttttctaccctggccttgcccttcccctggtcttgccttgccctggccttgccctgccctggccttggctttgccttatcctggtcctggttctgccctgaccctggccttgctctggatcctctctggttctgctttctccctggccctgcccttgctctggccctgtccctggcccagccttgaccctgaccctggccctgacaatccccaggtctgacactggccatgcttggccctggcccctccttttggccctgccctggccctgccttggccctgtgctatcttagtcctgccctggccctgaactcaccctggccctaccctcaccctacactggccccgccctaccctggccttgccctgccctggccctgcctttggcctgctctggctctggttctgccctggccttgcccttgccctggaccctccctggccatgttttttccatggtccttctctggccttgcccttgccctgtcccctttctggtcctgccatatttctggccctgtcctgtccatgtcctggacctgactctggccctggacctccctgtccctgccctgccataccctggcccgttccttgctctacactgaccctgccctgccttggccctgtgctaccctagccttgccctggccttctgctgaccctgatcctgccatggccctggccctgccatgtccctgccctggccctggttctgccctgcttctggccctggccttggtcctctcatgtccctggccgtgaccctgcccctggtttttctctggccatgaccctgcccctgttctgtcctatccctggccctgtcttagttctgtcctagccctggcttttcacagtactttatgcttagtaagggctccatggtgtctgtgagttgaatgttgtgttcatagtatctgccaaaacagaaagaaaaaaaacaaaatattttgataagaagttaaagctttgtatataatatgccttgaattgtaaatgcctgttattagttgtattacatataggtcatggttttgtacacataactccaaaccattgatactgttaaaagaatatatgaatatatgaaagaatgtgtaaatgtaagaatgtatcagtatctaattacctttccaaattaatttttatttttagctctattagatttttctcagtgtaacaaatgtttattcctatgtaattaagggcgtatttcctgtacagaatattcatattacctaattgaaaattatatgatacaaaaatataatactatttttaggccaggcatggtggctcatacctgtaatcccaacattttgagaggccaagtttggagaatcatttgagtccaggagttgaccagcctgggcaacatagtgagaccttgtccttattaaacaaataaataaataggttgggcactgtggctcatatctgtcatcccagcattttgggttgccagtgcaggaggattgcttgagcccaggaatttgagaccagcctgggcagaatagcaagactccatctctacaaataataaaatattaaccaggtgtggtggtgcgcacctggggtcccagctacctgggaggctaatgtgggaggttttctcgaggctgcagtgaactgtgaatgcaccactgcattccagcctaggccacagaacaggaccttgtctatgaataaagaaataagtaaaaatataaataaaaataagtaaaaagaaatattagtaaatataaatataaatacatataaacataaaaatgcatgcatgaaaagaaacaatttttaaatttaacatcactgagggcatcctatccatttcatttcatgattccattatgtcatttcacttagatgaaatgataagatgacttgagatgagatgaaatgatgagatgaaatgacaaaatgatgagatgagatgagatgatgagatgaaatggagagtggaaatgagatgaaatgatgagacgaaatgacaaagctgaaaagaaattgaaaggagatgagatgagatgaaatgagatgaaatgatgagatgatgaaatgatgagatgaaacgagatgaaatgatgagatgaaatgaaatgaaataatgaaatgatatgaaataatgaaattgaaatgagatgagatgagatgaaataatgagataaaatgagatgaaatgagatgaacgatgagatgacatgatgagatgaaatgagatgaaaaatgatgagatgaaaaatgagatgaaatgaaataatgaaatgaaataatgaaatgagatgaaatgaaataatgaaaggaaattatgaaatgtaatgaaattgaaatgaaattgaaatgagatgagttgaaatgatgagatgtaatgatgaaatgaaatcatgagatgagatgaaatgagatgaaataatgagatgaaatgagatgatgagatgagatgaaatcatgagatgaaatgatgaaatgaaatgaaatgatggatgaaatgatgagatgaaatgagatgaaatgtaatgagatgaaatgaaatgacataatgaaatgaaataatgaaatgagatgaaatgaaataatgaaatgatgaaataatgaaatgaaaatgaaatggaaatgatgagatgagaagaaatgatgagatgagatgagataaaatgagatgaaatgatgagatgaaatgaaatgatgagatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgacataaaatgagatgaaatgtaatgatgaaatgagatgaaatgatgagatgagataaaatgatatgaaatgatgagatgaatgatgagatgaaatgatgagatgagatgagatgatgagatgaaatgatgagatgaatgatgagatgaaatgatgagatgagatgagatgatgagatgaaatgatgagatgaactgatgagatgaaatgaaatgaaataatgaaatgaaattgaaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacataatgaaatgaaaaaatgaaataatgaaatgaggtgaaattaaatgagatgatgaaattaaatgatgaaatgaaataatgaaatggaaatgatgagatgagatgaaatgacgagatgaatgatgagatgaaatgagatgaaatgatgagatgcaatgatgagatgaaatgatgaaatgatgagatgagatgtaatgatgagaggaaatgatgagatgtaatgaaatgagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgagatgaaatgagatgaaacgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaatgagatgaaatgaaatgatgaaatgatgaaataatgaaatgaaaatgaaatggaaatgatgagatgagaagaaatgatgagatgagatgagataaaatgagatgaaatgatgagatgaaatgaaatgatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgatgacataaaatgagatgaaatgtaatgatgaaatgagatgaaatgatgagatgagataaaatgatatgaaatgatgagatgaatgatgagatgaaatgatgagatgagatgagatgatgagatgaaatgatgagatgaactgatgagatgaaatgaaataatgaaatgaaattgaaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaaatgaagtgatgagatgaaatgatgaaatgataagatgaaaagagttgatgagatgataagatgaaatgatgagatgaaaagatgtgatgaaatgaaatgatgagatgaaatgagatgaaatgaaattagacgaaatgtaatgagatgaaatgaaatgacataatgatatgaaaaaatgtaataatgaaatgaggtgaaattaaatgagatgatggaattaaatgatgaaatgaaataatgaaatggaaatgatgagatgagatgagatgaaatgacgagatgaatgatgagatgaaatgagatgaaatgatgagacgcaatgatgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaatgagatgaaatgaaatgatgaaatgatgaaataatgaaatgaaaatgaaatggaaatgatgagatgagaagaaatgatgagatgagatgagatgaaatgatgacatgagatgatgacataagatgagatgaaatgtaatgatgatatgagatgaaatgatgagataaaatgctatgaaatgatgagatgaatgatgagatgaaatgatgagatgagatgagatgatgagatgaaatgagatgaatgatgagatgaaatgatgagatgagatgagatgatgagatgaaatgatgagatgaactgatgagatgaaatgaaatgaaataatgaaatgaaattgaaataaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaaatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacgaaatgaaaaaatgaaataatgaaatgaggtgaaattaaatgagttgatgaaattaaatgatgaaatgaaataatgaaatgaaataatgaactggaaatgatgagatgagatgacatgacgagatgcatgatgagatgaaatgagatgaaatgatgagatgcaatgatgagatgaaatgatgaaatgatgagatgagatgagatgtaatgatgagaggaaatgatgagatgtaatgaaatgagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgaaatgagatgaaacgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaataatgacatgagatgaaatgaaatgatgaaatgatgaaataatgaaatgaaaatgaaatggaaatgatgagatgagaagaaatgatgagatgagataaaatgagatgaaatgatgagatgaaatgaaatgatgagatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgatgacataaaatgagatgaaatgtaatgatgaaatgagatgaaatgatgagatgagataaaatgatatgaaatgatgagatgaatgatgagatgaaatgatgagatgagatgagatgagatgatgagatgaaatgatgagatgaactgatgagatgaaatgaaatgaaataatgaaatgaaattgaaataaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacataatgaaatgaaaaaatgaaataatgaggtgaaattaaatgagatgatgaaattaaatgatgaaatgaaataatgaaatggaaatgatgagatgaagtgacgagatgaatgatgagatgaaatgagatgaaatgatgagatgcaatgatgagatgaaatgatgaaatgatgagatgagatgaggtgtaatgatgagaggaaatgatgagatgtaatgaaaggagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgaaatgagatgaaacgagatgaaatgatgaaatgatcagatgagacgagaagaaatgatgagataaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaatatgatgagatgaaatgagatgaattgaaatgaaatgaaataatgaaataatgaaatgagatgaaatgaaatgatgaaatgatattgaaatgaaattgaaagatgagatgaaatgatgagatgaaatggtgaaatgttgaaatgaaatgatgaaatgaatagatgtgacatgaaatgagctgaaatgatgagatcaaatgaaatgaaatgagattaaatgatgagatgaaaaatgatgagatgaaaaatgatgagatgaaatgctgagatgaaatgagatcagatgaactgagatgagatgagatgaaataatgaaattaggtgaaataatgaaatgatatgaaataatgaaattgaaatgagatgagaagaagtgagatgaaatgttgtaatgaaaggaggaaatgatgagatgaggagatgaaatgatgagatgaattgagatgaaatgagatgaaaaatgatatgaaaaatgatatcaaaaatatgagatgaaatgaaatgagattatatgaaatgacaatgaaataaatgaaattagatgaaatgaaatgaaatagtgaaatgaaatgatgaaatgaaataatgaaaatgaaatggaaatgcgatgagatgagatttggtgaaatgatgagatgaaatgatgagatgatatgaaatgatgagatgagatgggatgagatgaaatgagataaaatgatgagatgaaatgatgagatgaaatgatggggtgaagtgatgcactgtcacgtgtgtgtctattctttttcccaagcaacaaaaattataattcattaattttaattttattatttaagaatattcttaagagttgaaggaaaaataatatctgtacattatgggttacaatctaagtataaataatacataaatatattaaaacttacaaagaatatgttttggaatcgaatataccatgcttctgtgatgacagttatttcatgctggttgtcacaattttacatgaaaaactaatgaaaaaatgtttttaactgtttctaaaaataacagtttccaaaacagttttacattcgaaatatgaaaaagttgtctttgtgttccttaatctgatgagattttcacactctgcacatgataattgttagatttttattgtgttgataaattgtatatcaaataaaaaatgttattacctcttaaattaggatttttaggtgatataggcagaaaggacagcaagtttttataactttgtctaaatgaactttctaaatgcctgagtattaaaagatagcatgtctataaatcacaatgtatatattactgtatgacctaggaccaatcaaaaccgttacctctgataacattatattgtgcccagtataaaatagatataataatacctcaaacttaaatccgggcattgtcattgaatatcttaagaatatgcaacaaaggtgcttttaaaaatacaagctagtgattgtaccaaatttgtaaatcacataggatagtgggtcattttaagaatattagttatttcaatctataaacgtggatgtctttccttttttgtgttttctttaatttctttcattaatatttgtcatttttgttgtcgaaatcttttacttccttggttaaatttatttctaagtacatttttgtagctattgtaaaaggaattgctttcttaatttcttgtttcagctagtttactatcaatatatagaaatgctactgatttttgtatgttgatttatatcctgcaactttattaatttcatgtatcaccctaagaagcttttggtagagtcttatttttttccatgtataagatcacattgtctttaaacagggacaatttgactgtctcctttccaattcagatgtcctttatttctttctctcacctaattgtcctggctaagactttcactatgtgaaatatgattggtgagaataggcatccttttcttgttccagtaaaatctttttcttgttcacagtaaaagctttcaccttttccacactcagcatgatcttagttgtagatttgtcctttatgtccttctgttttaaggcatatattttctatactaaattgttgagaggttttttgtcatgtaagaatatttaattttgccaaacgcttttattgtgtttattaatttaatcatatggttttcagtatatatccaaaggaaagaaaatcagtatatcaaagacttacctgcacccccatgtttattacagcactattcacaatagccaagatatggaatcagcaaaagtgtccatcaacagatgaatggataaagaaatgtgatatacatatataatggaatactatttagtcataataaagaacaaaatcctgttatttgtggcaacaagaatgcaagtggagggtattatgttaggtgaaataaacctggcatagaaacataaacaccacataactacgtgttctcacttatgtatggaagctaaaatttttaatctcgtagaagtagatagtagagttttggttaccatatcctggaaagagtaggagaaagaagagtataagaaaaatgtggttaatacatacaaaattacagctggagagaaggaagaagttctagttctctacagcactgttgggtgactgtagttaacgggaatttattgtgtgttttcaaataactaaaataaaagattttaaatattctcactgcaaagaaataatacatgatttaggtaatggatatgataatgactctgacttgatctttacgcattgcataaatatatcaaaatatcactctgtaccccataacatgtacatttattatatgtcaattaaagtaaatttaaaagagaaaaaatgaggtaaaggtaaatatacataatttaattactttttcttctataaaacccgagtcagtaccaagaagagtcaatttattagttttctaaaataaaaaaaatcaaaatcaccaaaaaagagcaatatccaagaaaacattgaaaatgaaacacaacattcagtaagaatagaaaacttgggcaccgtatcaccctgttcctagataccgatttactgatggccatttaaatagaattttattctatctaattcatttatactcccagagttcgaaattacattttacctacaataaatgagataacacttgtaaattatatggtactctgcctaacacacgttaataactcaatacatgttagcaataagcttttaatatagtagtcaaagtattaatttctcacattgcaatttccttcaaagacatgaatacaacctttctaatgactccttgttcatcaagatacctcttcaaattattctatttgtttcattcagtatattatctgtgtataccgatattacactcttttctttttttgagatggaatctcattctgttactgatgctggagtgaggtggcatgatctcggttcactgcaacctccacctcccaggttcaagcgattctcctgtctcagcctcccaagtagctaggactacaggtacataccacgatgcctggctaatttttgtatttttagtacagtcaagagtttcaccttgttgtccaggctggtctcgaactcctgacctcaggtgatccacccaccatggcctcccaaagtgctgggattacaggcataagccaccgcacccagcctgatattgcactcttggattttgaacactgaatatctttttgaaagattacacctctttactttgtgcttcagaaattattttccttcaagtgttctaagagtctaatgaagaatgaagtcatgttttatcacttttgtccttaaagatttcagacatgctgaaactgattgaagtatcatttgctactagatagattaattatctccagttgtaggagtggatacatctttaatggtatattttgggttattgtcttatttttgatgcagtattctataaataatttattaaacctggcatccttgggtgagcacagatttttcaactttggtgttatattgtgtttgcttttaaaaactgcttctgaggccaggtatggtggctcttgcccatacccagcactttgggaggccaagatgggtggattacctcaggtcaggagttcaagaccagcctggtcaacatggcaaaaccatgtctctactaaaaacacaaaattagccaggcatggtggtgcatgcttgtagtcctaaccactcgagaggctgaggcaagagaatcacctgaacctgggaggcaaaagttgctaggttgctgtgagccaaattcgcaccattgccctccagcctgggtgaaaagagcaaaactctgtctcaaaaaaaaaaaaaaacccaccaaaaactgcttttgaatggagttgtacatataatttttatgaaaaaaattaacaagtgcataagttcataatagaaaaaccaataatactccaggcacaagttagtactaaaaaaattatgttgaatattctctaatacaacatgctttttcccttcatgaacaatttgtgttttactgagaagagtcactgtttatggtagacattagactacagatgaatatgtactttaaacactcttagttgctttcttaattttatatctgctgctttatgcttctgtttattttcattctttccaatgtccacattctagtaaatttgaatattttaatccaagtttatatactatttaatattgcttgtatagtttagtatttttaagactcaaaaaggtttacagaaagaagaaaaagatcaacatgttattaatcatttaaagatcattttgaaatctttgacctttatattttaatgaataaaatattagtagttattagtataaaataatttatgtcttttggacttagcatccagtatttcttttttaataaagaaaataattattctcttgcaatgtactatgtttatctgggttttgaaaagtgatgtttcctaatatgagaaagccatttacagttttaaatctacaaaggcaaatggaatggtactaaattatttacataataatgtttagatggtggcccttataacattctttctatacttcctacagagttggggatatgcaatcctagaatatttctgggagctaatcctttagcttgatgaatgaaacaagacttttaaataaaattaaactttcaaattatccaggtaatgggcctgtcttttaattcaatggatatggagcataatgaattaacccctgttcattgggtaataagttctcattcttataatactcaaaatgtcctttaatttttaatttttgatagtcatatcattatccctaggtattttagcttctatcttaaattctaaaataattttgaaataggagaaagtattctttattactatatgtattaaacatcatggttttcaaattgaactgcaaatgtatcttttcattgcttcttgatgacacccttcaccctatccatattgtcactaccaagtggtgattacttttcaggttcacatacttattcttcagaaaaatcttctctgtgccttataaagaatatgattgttggcattcaaaagccagcgaagtatacattattagcctgttgcctaactcatttctttaagaaactacactaattacccacatacttatgtttttatttcctcattatttctggagaaaacaaatactgctaacatgatatttgtaagagagaaaaaagtcttttcttgaaaagtgctgtcattgtagtactaacttatagtatcaacttctttataaactccttagacactttttattctgagagaaataaaaaagctaaaagtcaaatgactttttttactctccttattataagcacccatcttggtaatttagggtctttatagttagggtaagttgtgtcataccgaggttacaaaataaaaagtattttgtctttttgggcctttccttattcagtaatactgtcagtttggctttttttgtaggtcaacttattgaactcagtattctgaaataatatgtttactatcttttgagaagcacttaaaatattagatttattgttactcttctgcctttattgggctggaagaataattgtttcactccacaaaaggcaagttgcggagaaaaacacatagacattcaaccgcaaagcagagaaacttgactattttctgcaattttaaagtgtatattgaataaaaccatctttttattttcttttttgctcactggcaaatattaacaacatcaagtgtattattataatgttatctagttaaaaatctcaaaaagttttcataattaccattttaaagtatataaataggtgacctaatgttaatttttattgtctgagaccatgtctgttatttcactctttaaattcagttagtagtgcagaacctagcacttagtagatactcaaaaattatttgctgaataaaaaaaggttaaacatgtaatatatacaaaatgtactggaaaaaaatgcaccaaacaattttgttataccagtttaatgtaaatattgcctttaaaagataatatagttttcaggtgtctacagtgattttgtaatatttgtgcacatataaaataatatttccaaaaatgtaatccagtggggaaatatactttctaaattctagatttataatttagggtttaaattataaaatcattaaataagacacaagtgaaatgtagtcaaatatccccttggaaaaaaattaagtggcctctaaagtgaggtattcatatatgtaattttacaatcctctagtgatagaattaattaaatacaccaccaaattgattaattcctactgtgttaaaagagaagcactaacaatgccagttaccatgtaacatggatttaagctacaagtcatagaaatgtgatgagaagcctcagcgctgtaaaacagagggtggaggaaagcttttcctctctcaaatgagctttgcgaggtatacttcttgaaggataggaagttgaagtgttcaggacttttatgtctattctactttggcttagtttacatgattcgtagtttattagcctagaaatggccaagaaaacttaaggttcaataattagttataaatatgaaatatccccgatttttaagataaaaacaacttataaatgtatttgtctgtaaaaattgtgtatatttttacagaacatctatttctttttttatttttttatatttatttattatgctttaaattctagggtacacatgcacagtgtgcaggtttgttgcatatgtatccatgtgccatgttggtgtgctgcacccattaactcatcatttatattaggcatatctcctaatgctatccctcccccctccccccaccccacaacaggccctggtgtgtgatgttccccttcctgtgtccaagtgttctcattgttcaattcccacctatgagtgagaacatgtggtgtttggttttttgtccttgcgatagtttgctgagaatgatggtttccagcttcatccatgcccctacaaaggacatgaactcatcattttttatggatgcctagtattccatggtgtatatgtgccacatgttcttcatccagtctatcattgttggacatttgggttggttccaagtctttgctattgtgaatagtgctgcaataaacatacgtgtgcatgtgtctttatagcagcacaatttataatcctttgggtatatactcagtagtgggatggctgggtcaaatggtatctctagttctagatccctgaggaatggccacactgtcttccacaatggttgaactagtttacagtcccaccaacagtgtgaaagtgttcctatttctccacatcctctccagcacctgttgtttcctgactttttaatgatcgccattctaactggtgtgagatggtatctcattgtggttttgatttgcatttctctgatgggtctatttctttaaaacaaagggaggggagtctctcatttgcattagtttttttcatagccttttgaacttcacaatttctatgtttcagaacctatttcttacagtttttctatgctaaactctgtcctagtcagttctagagtgtatgaagaaccaaatgatgtaatagtatgccacctggctgtagtggaacaaatttgactcttaagtatgcaggctctaattttcctgtctggttttggcaagtattccttacataggttttttctttgaaaatctgggattgagaggttgatgaatgaaaattaatcctttcacttttttgtatataggtttgcaataattaggtcagagtggagttttaaggtcacggaggggtctgatgacttacaaataatgggctctgattgggcaactactcatctgagttccttccatttgacctaattaagcttgtgaaatttacactaagccatgagctcatctttaaaaagttttattaaaagattttcagctgttccaaatgggacttattactggaatgtgttttaaaggatcatatcagatgaatgaaaggtatttgatccttcgtttccttaataataaaatgatggtttggaaaaataggctacagtctaaccacagtgctattattaggctttcttgttaaacataggtctaagcctaagtatgtcaatacaacaaatacttactgtttcatttctagtaatgaaaaaaaaaaaaaaaacaagtctttctggcataaggatgattttcatctggttattttgaaacatttttgtaaaataaatttccatctataaagaacatttttatttgtaaggaggggtatgtctctgtgcactggaagagagggaggactaaatcactgggaagtcttatgataaagaagccattggcttaaatcagcgaagcaagccgtcccttggtttaaggtgtttttcctggccatcctgtcttgactagaactttacctacaccttcctttttggtttaggcaaattatagtatctaaaactaaagtctcagctctgtgtctttgacatataaatgttctaccatgtcttctctggaatctgataactatctatctctttaaaatgcaagtctagggagatgactcatcagaaaaagaagaaaaaagaggtatttggaaattgtgcaaattaaagcagcccctgatgtcaaagtctacacattcctgagtgagtcagttctggccagttctagctggatcaagagagctcttctgggcaggcctgaagagcacctgaatggcagccacctgaggagccaggtgcctgaaacttccttcacctgcttgaggagcgccaaagcccaggtgctggctggacaaccacttctggctgcctaagcagatggcagaagaaggaaacaaggtcagaggcagagtattgaaccctgcctcccaggtgggtggaagatgcctgtcgccaaactagggcccagcttgccgggtgagatgggtgaactggtgatcccccgagagagtggacgtcagaactacatgttcctggacttcacctcggccagcgaaggagagagagggttaatgttaactgcacgaggcccactctagccttaaattctgtaattcaaacccttcccttggagacaaaacaaacatgacaaggaattctgaggtcaggggacaagaatcacaaagtgggagattgaggaggcagtgtccttcctgcccttggtctactggctaagaaccttcctcagcctgacctttgcacattgcactttcagctctgtttgcaattttcctcctttagtgctgagggaatcccagtgttccatcctgaaatctataggttcctaatgggtggttaaaaaaaaacctcagcgagagaagcagaaaatgtttcctcttcctgaaaaactgtagaaaggcaggcaccattctgggtgaggacatggtccttgcaaatgtctttgtgttgtttttgtttttgttcttgtttttgagatgaagttttgctcttgttgcccagactggagtgcagtggtgtgatctctgctcattgcaacctccgcctcctgggttcaagcagttctcctacctcagcctcccgagtagctggaattacaggcacctgccaccacacctggctaattttttgtatttttagtagagatggggttttgccgtgttggccatgttggtctcgaactcctgacctcaagtgagccacccgcttctgcctcccaaagtgctgggattacaggagtgagccaccgcgtccagcctgcaaacgtctttaaagacagcgtgtttcagaggctgtgacagtgccctgtgaacatgccaattctcacagtcccgggagctctgaggagcaggcccggctccttgccaggctgatggtactgaaactctgctctccaagacataacctgatggccatgcaagatttcttaatcgactgtggaccgtgagagtctgcatctcattttaattaagatgggaaaagaaagaacaaaagagcaactcccaggttatagagaaagtggattttagtataatattcaagtgtagcattgctaataataacaaacctttcccctcccaaacggtaaacacttgcactgcctattatacaaaaattcaaccaccctctctgttaccccgatatctcctccccagtgaccccccctctcatgcggcctcatgagcctggccagtggtgaatggcactttcatgggcatgagactccacgtgagtgggactcagctgggacccctctccacgtgggagctggggaagccaccctagtagcagctcaaagtgtccgtgatgtccctgctgctgaggtaggggccgcctctgagctggtctcggggtgtgagctgctgctggtagtgggctctgccctgagggcctggtggctggtcagaagggcaggcacacatgggtgactccccaggaactcaggccacctccccaccacagccctgcactgtgtgctccaggcatgtgctgagtgcctggtcaatcaccagtgccctattgatcccagtctccagagagagcatttagtgtcactccacagaggggaaactcggcccagagaagtaaagtgactctccccagtcacagggctggtcagcagtaggatgggaggctagtcccttgctgtctgactccctgagcccacccatatcccaaggcagccaacctctgcccgccctggttcaggccccgactggcccctgtggtgggtgatgtctatcttcctggcctttgtgctcccagccaactgggatggagcctccagctggcatgacaggttgtagctacggacagaagagtggctgtgaggctgccaggaatctcaccagggccccctcccagggcctgtccagagtgaggtctgggtaccccaggcattgccagaccacaggatctgatgttggccaagaggccatggccacaggctttctgaggctggcccccagggagagttcaatcctactatcccaattcctgtcctggccttacctctcagtctcaccgagccacttcatggtcccaaaccaggacccaaagtgctgcttgggctcaaggttgtaattatttgcagccaactggagcagtggacctccttgcttactttgaattcctgggtccagagggaaaaactgggtgatgacagggactggacagggatgccacaggggccctgtgggggtgttagatggggtggtggccagtctttgctcataggggaccccctcctcctctccagtcctgtccccacctgttctcagagctggctcaaacagcagctcctccaggaatgtgtccttggtttcaacctggtactcccacctgcaggtcttcctggagtgtctcctctttctctctgtctccccataaatctaagacgagggggatggatctgcccactgctactcaccgtatgactcttgtgaggttgatcagtctcccctggaaggccaacagctgaagtccatcagaaagggtcctctggcccagagccagcccctgcccacccctgtcttgctgcacccagggtgcaagacccagatcaggtctgggtgacaggaggggtatagaggggctgaggctcaggggccttctagcctaacttgtctggagacagttggggaaactgagaccccaagcagggaggtatggctccgagagattattctcattaatctggaacatttttgcaagctgttaggtataggaagtctgtcacaggtaagagaaatgctttttaagagcatgagagacagcagggttgtgacaatattgaaacaccaccgtgcagattcaccaattgccaccaccgggagccccctgagagtcattgcagatgcacagccctcccctgcaacccctggacctccccgtggtctggcacctaaagggttatgcctcatggcaggaatcaggaccctcagggtgccctgcccactccaaggtctgcctctgctctgattggtcactgacattcagattgtcacccaaatataaggacattagcagaaagactcattcaatacaagtggactcagacatagataggaattgggttgcaagaagccccttttgtttcttttattttattttggaaaaaacttttattgtgaaaattcacatatatatatatatatatatatatgtatatataaactcaatcaatgcaaaaggatagacaatgaacaaatgaattccccttccactccagatccccaactcagatccagacctcctgagcccacttcccccatctcatcacagatccagacctcctgagcccactttccccatctcatcacagacccagacctcctgagcccactttccccatctcatcacagatccagacctcctgagcccactttccccatctcatcacagatccagacctcctgagcccactttccccatctcatcacagatccagacctcccccactttccccatctcatcacagatccagacctcctgagcccacttccccaactcatcaccagtgatttcttgggctctgcattagttttctattgctgctgcaaccaacagctacagactcagtggcttccatttctgtcttatagttctggttgccaaaagtcctaagaggatctcactgggctaaagtcaaggtgctggcggggctatgtcccttctggaggctcaagggatgaatcgggtccctgccttttctagcttctaggggctccagcttctaggtttgtggcctccttcctccatcctcaaagccagcaacagcaggtgaagtcctcgcccatcatgcatcactctcccttcttcctccttcaacttttttttttatatttagggggaacgagtaccggattcttacatagtcaaaaagctccttatagagaagctcggaactttcaatacaactttgccttttctgccattttaattttccatttaatttaaatgtattctctcatttgaccttcatactctgtggagaaatattcctatttcggcttgtattgacaagctgttttcacacagcccccacatcacccaaccaaccagcaagaaacagataaagaaactgaggcccagggaggctaagagtcctgccaggatcattcacctttcaaggtaaggagccagttccagacctgggtttgtgcagctccaagctcccccgtctttctacaatgctagatttagactatagcaatctagcaagtgtggccacacaatgatcaagttggatttagatgatgttccctataaatccattctcctctcccgtgtaagcaaggcaaagtcctccaggccatggggagtccctgaagactcgatgaactgcagtggccacatcaggaggttgcaggttgaccagaactcaccgacacagcaggagagcagcttggaacctgcaacctagccaaaacctagtgccttggattgggggagaaaacaggcagccattcctctctctctgctggctagaggggattctggcttttcctgccagagccacccctttccctcctcctaaagttgatggtggttctttaaggaaagggagaagtgcacggtgtgatagggcaggaagagaagaaaatggaggagaggaggggactttcccataagcaggcagaagaaaaggcagctgtggtgtgtgatggacatggatgcagtggtgtccaatgtggggtcagccctagaggagagacagagagagagacagaaaagtgagagtcctgacccttacgattaacatgggatctgcctgcaaatgctgtttagggccatcgcctcttcctgtactgctatttttgagagtgatgctcctgagccccatgacccagtcaaatttgatgtcccctcgagccagattcagtgctgggagtccagtgtgatctgcctggatcttgctgcattgagaacaggccagtcttgaccccaatacaggggctggatatgaacaggcaacagctgggtttctgagtcagaaagacttggttaattgctaattgcttaggcgagtaatttaattttgttgagtcagattcttcagctacaaaatgcagatgacagtacttattcctccaggttgtggggaaaatggagattctaagcacgatgtccatttcacagaaaggtaccaatttggtggcttattttcctttctaccttcagaagtggctatccctgccacccaaacagacccttgactctcaagtggacggggtcccatttgcacagggggagaccttacagcctacgttgagtctatacttaccacttagtgagcattgtgtccgctcaggggcctctgtgggcatccgtctcctctgcagcatctttcctccccactgctgggtctgcacatgaccccctccttgggttaggcctctgatcagtgatgaccttggtatggtggtgatggtcagtcttggcatcaaatgagccagtttatatcatcagctattcaataaaatactaatctaggtgtcaccgtgaaagtattttgtgacattgttatgtacgtgttgttacaaatgtgcatgatgcatttactacagcatagaattttgcctgggtgccagcctgaagtctgtccgacagatcatagccatgttagtcccacagtcacaggggccaattgattaaattattttatctcccttgaaaactaaaaataaaatcctaagccccccacccgacttaacagaccccctgttggccaacggaacctcaaataaatcttaaaattcagttcttggccatgacaggacaggaggtcagacatacctccctgtacctccctccctcttatggtttagaccccacaactgaacagcattaatgttaaaatagagatcatgagactgacagaacagactctttgtggcaataagacctcaaattataaacaggagctagggccatgccaggcgagcgttaagtcttgtaccctactcttaaagaattaactagattctaactaccacgtgggttttatttttctctagcaaccaagcaagcactggctgtgagagaagcaagattaaaacaattacaactcacccagttcacagacgctgagtaactgatctcctgccccactaaccttaatgacagctttctctggacaagggactgatttcagtaactttctcctgataagagaccatcctccatggactggttctggccagttttggaggctgtgcctgtacagaggctgagtaccttcatgtccctgcttcactttttgatgtgtagggcctaattataatacatttaaatgtcaagtctccaccccagaatgaacatgcatgtttatggaatatgcatgcattaggacctcttttatgagtattctcataaaatgatatagctcctctgatatcctattgagtatgtatatgtagccaattcatttggctcaaattcctgtcctctccttccctccctggaaatgcctgcctctggccttggctgtaggccacacttcccagcctgtcataatggccaccttgcagactgcaaacctatataagaaataaagctctcttttctaaatttataaaattgtgtgatttttcagttgatgctctctttctacacacacacacacacacacacacacacacgcaatttatacagaaggaaatctggagaatatatgtgggaatggatattaagtgtgtggcaccgtggtggaagtaacataaagttggattaggctaaatttattaatgttggcccactaaacagagattctggactcagggttgtaggtcaaagctttagaaagggctccaagggttggtttgatcggttacttggttggttgcttgcttggttggttggtgcttgcttccttgcttggttgtttggttggtttgttgcttgcttgcttgttggttgattggttggctgtttgcttgtttggtgacttggttggttggctgaaacagaatcagagtttacctaaggtacataaagttgagatgccacaacttccttggtttatgtgtacagaaaggtatgcaaaaactcagggagactggatttattatgtcagacctgctcactcacactggagggtctacggaacatactcctcacaacgatcatgagaaagaatattgtgagaggagcccagtatcctggaagagctttgagcttgtgctctcagtaggcaaaatgttacagcaggaactgcagccactggactgggatctttaagtaaaatgaggataattgaatcctggggtggcagggaacatgggctgtccttaatcaccaaagatgaggtgggtgtggtcaccacagtggaaagcagtgtcaaagcagcagtcagaatggtttgactcacagacacccacggcattgtgtagtccatggtatccacagggagagctaatgggctgtaccaaagtcttagttgttctttaaaaaatgaagaattctaggtcaactgaataaaagactaactcaaattaatgaaacacagatctaaaaccctcaatcaattcccagacttgagccagttcacaggcccacaaccccttaagtgaaggggaggctgggtgatcttggggaagtacgctgctacgttgccaaaaatttacattgttaatctttttcccagtcttccccaaagggacttacagccttctgccaggatgactgtgacttaaagaaaagaaaattctcagatatttggggaattactggacactggctctcatttgacactattatcactatgttgcctaggatggattcatgctcctgggttcaagcagtcctcctacctcagcctcccaaagtgctgggattacagacatgagccactgtggccagcagagctttgaaactagaacatggaggtccagtggtaaagatttgacaagtctgggaagagattgggccaaggcaatgttgatgattcttttttttttttttttttttttttttacaacagagtcttgttctgttgtctaggctggagtgcaatggcgcgatctcggctcactgcaacctctgcctccggggtccaagcaattctcctgcctcagcctcctgagtagctgggattacaggtgcccaccaccacaccaggctaattttttatttttttgtgttttttgagacagagtctcactctatatcgcccaggctggagtgcagtggcgcaatctgggctcactgcaaaccccgcctctcaggttcatgccattcttctgcctcagcctcacgagtagctgggactacaggtgcctgccaccgtgcctggctaattttttgtatttttagtagagacggggtttcatttcaccatgttagccaggatggtcttgatctcctgacctcatgatctgcccgcctcggcctcccaaagtgctgggattacagggatgagccaccatgcccagccacaccaagctaatttttgtatttctttttttagttgagacagggtttcaccatgttggccaggctggtccctgaccttgtgatccacccgcctcagcttcccaaagtgctgagatgacaggcatgagccaccgtgcctggccaatgttgatgattctaaacagcagccgttaatgtgaaaaccatccaactggaagccctggccttgcccagaggacacagtctgggtggtgggcagagacttcagctgccttccaaggcaagcagctccttgctgcccgcttgctggggattttacttacagggcagaagctggcaggtgatttgggggcaggaattgcttcctggatggtataggatgaaccacactccccaggaaggcactcatcctggtggcctaacagaagcagccctcaccccaaaaggcaatgctgctccactagttttatggggtgactccttcctgtaggttccttccagctttaccagaaacacagaacatctttcctgacagggcattggttttgtttttgaacagagagatccttcttttaaaaagttagttttttgttttgttttgttttgttttttgtaatggaatcaacctaggtcctaagcctagcaggttgttattattatttttatgattattttttgagatggagtcccactctgtggtccaggctggagggcagtggcacgatctcagctcactgcaatgtctgcctcctgggttcaagagattctcctgcctcaacctacagaggagccaggattacaggcatgcaccaccatgcccggctaatttttgtacttttagtagagatagggttttgccatgttggccaggctgatctcaaactcctgacctcaggtgatccacgcacctcagcctcccaaactgctgagaatacaggtgtgagctgccatacccagccacaggttatttttgctgatcttctccctcctcccaccctcaaagaaaacgcggtacatctacaccatggactactacgcaaccctgaaaaggaacaaaatcacggttggtttttttttttttttttttgcagcaacatggatgtagctggaggccattatcttttttaattatttttattattttttttctattctactttaagttctggggtatatgtgcagaatgtgcaggattgttacatagatatacatgtgccatagcggtttgctgcacccatcaacccatcatctacattagatatttctcataatgctgtccctttcccagtcccccacccctgcagtaggccccagtgtgtgatgttcccctctctgggttgatgtgttctcattgttcacttcccacttatgagtgagaacatgcactgtttggttttctgctcctgtgtcactttgctgaacatgagggtttccagcttcatccatgtccctgcaaaggacatgaactcatctttttcatggctgcatagtattccacagtgtctatgtgctacattttctttatccagtctatcactgatgagcatttgggttggttccacatctttgctattgtgaacagtgtggaggccattatcttaagtaaattaatagaatgctgcgtgttctcacttataagtgggagctaaatgttgtgtatatgtagacacagagaagggaacagatattggggtctagttagggggagagaggaaggtagaaggacaagagttgaaaaaaccaactgtggggtattatgctcactacctgggtgatgggatcactcataccccagacctcagcatcacacatcgtacccatgtaagaaacctgtacatgtacctcctgaatccaaactgctccatcatttgcaccagcaattccaagactgggcatctacccaaaggaaaagaagtcattctaccaaaaagacacatgcatggtaaagttccttttttttgtttgttttttgagatggagtctcgctctatttcccatgctggagtgcagtagcaatctcggctcactgcaacctctgcctccagggttcaagtgattctcctgcctcagcctcttgagcagctgggattacaggcatgcgccaccatgcctggctaatttttgtatttttagtagagacagggtttcaccatattgaccaggctggtctcgaactcctgacctcaggtgatctgcccaccttggccctccagagtgctgggattacagtgcctggccctgtaaggttcatcacagcacgacttacaataggaaagtcatggaatcaacctagttgcccatcagtggggtaccggataaagcaaaagtggttcttctacagcatcgaatactacacagccatgaaaaagaacaaaatcatgtcctttgcggccacatggatgtagctggagggcattatgcttaatgaattaacacaagaacagaaaatcaaataccacatgttcttgtctggataaagcaattgtggcccttctacaccatggaatactgcacagccatgaaaaagaataaaatcatgtttttgcagccacgtggacacagctgaagggaattatgcttagtgaattaacgccaggaaaagaaaatcgaataccacatgttctccactagataaagcaaatgtggtctttctgcatcatggaatactacacagccacgaaaaagaataatgtcatgtcctttgcagccacatggacacagctgaaggacattatgcttagtgaattaatgccaggaacagaaaatgaaatactacatgttctcaactggataaagcaaatgtggcccttctacaccacggaatactacacagtgatgaaaaaaataaaatcatgtctttgcagccacatggatgcagccagagggcattatgcttagtgaatcaatatgaggaacagaaaatcaaataccacatgttctgcactagataaagcaaatgtggtccttctgcatcatggaatactacacagccatgaacaagaataaaatcatgccctttgcagcaacgtggatgaagctgaagggcattatgcttagtgaattaacgccaggaacagaaaataaaacaccacatgtttttgcttataggtgggagctaaacattgcctgcacctggacacaatgaaggggcaccacagaccctcaggactaatagagtaggaagcaggggcgggggtacaagggttgaaaaactaccctgagattctttgaatttcaggcagaaggcagcaactggagagatctttgggtcacggatttttctgttgcattttcttgcttgtttgttttctatctctctctctctcttttttttttttcttttttttgagatggagtctcactctgtgacccaggctggagtgcagtggtgcaatctcggctccctgcaacttctgcctcctggattcaagcaattcttctacctcagcctcccaagtagctgggactacaggcacctgccaccacacctggctaatttttgtatttttagcagagacggggtttcaccatgttggccaggctggtctcgaactcctgacctcaggtgatctgcctgccttggcctcccaaagtgctgggattacaggcatgagccactgcacctggccctcttcttatatatttctagaactcctctcgaatttggggtttgtttttcttaattacaaggaatcaagttgaatcattagtgcatatataaatatacattttattttagtacacattatatacctcaggaatgtacaatgctcagcgcctgggtgacgggattattcataccccaaacctcagcatcgtacaatatccccaggacacaaagctgcccgtggatcccctgaatctataataataataattaataataataataataataaataaaaagtgactttgtcattcgcagggaaatgtgaatgacattcactctgcctctcaggcccttggattcccaaagtttgttttcctcacgcccaggggacactcagaatgtcgtttgcagaacacgggttgtttttcttagaaacgccttgcaaaacaaaataggaagcaaaatctttctcactccttccactccataatagacaaaataaaatgagggggcaggaatccagagactttgaccacagttggcagatttattgtggtacagacatgaaggcaagcagtgttctctctgattctacgaaccgtacagcccgggccagctgccttctgctttctggatggtgcaggcgtgagctccaagcccaaatttcactggagctccaagaatcgagcctggcccaggcactcactgcacgggggccaagcgtgaaaccagtgatcgctccagcaaggtaacaggacagcttggtgatccttcttgccggccacaaaaggttatagccagaattccaccgaatgtggtctttctgtgtctctccccagatagtgaagctgcacaaacctgggggtggggggtggggggtgctgacctcagtggggtgtcctggagaggcaggaaccagagtttacagggtgcagatcctactgaagcaaatggacgtggcatccgtgggcagagctggctgtggctggccttccagcctggatgtctcccccccccccgcctggggtgtcaccaaatgcacccagagaccccttctaaacctggggggatgtgctgacctcagtggggtttcctggagaggcaggaagctgggtttccagggtacatatcctactgaagcaaatggacgtggcatccttgggcagagctggctgtggctggccttccagcctggacgtctcccccactgcctggggtgtcaccaaatgcacccagagacctctcttctgaaagcccattcatgggaagcctccaggtctcctcagcaggcagcatcacgtctgatttcactgcgttatcaggtaatgcaggcctgttctacctgtgtgcgtgagcgcgtgtgtgccgtgtgggagtgtgtgtgttgatgtgggtgtgggtgtgtgcttgtgtggctgtgtgtgtgtgcctgtttatgtgatgatgagtgtgtctgtgagtctgtaagacaacgtgtgtttccatgcgtgtttctgtgtgagcgtgcattcctgtgttttatggaagtgtgtttttgtgatggtgtttttgtgtgcacctgcgtttatcgtatttgtgtgtttgtgaatatgagtgtatgtgtgtgaatctgtatggcaatgtagaaattcttttttttttttttttgagacggagtctcgctctgtcacccatactggagtgcaaaggctcaatctcagctcacagcaacctccacctcccgggttcaaacgattcttctgcctcagcctcctgagtacctgggattacagacacccaccgccacatctggctaatttttcttttttgatatggagtctcgttctgtcacccaggctggagtgcagtggcgtgatcttggctcactgcaacctctgcctcccaggttcaaatgattctcctgcctcagcctcctgagtagctgggattacaggcataagccaccacatctggctaatttttgtatttttgagtagagatggggtttcaccatgttggccaggctggtctggaactcccgacctcaagttatctgcccgcctcggcctcccaaagttctgggagtacaggcgtgagccaccttgcccggccccagtgtgtgaatttttatgtttgtgtgtctacatgattatgtgagtctttttgtgactgtgtttccatgagtgtgtgactgtatttatgtgtttgtgtgtgcttgtgtgattctgagtgtgtctatgagtgtgtatgacatatgtgagtgtctgtgtgggtgagtagccatccacgtgtttatatgagagtgttttcatgattctgtttatgagtgactttgtatgtatacgtgtttgtgtgctttgtgagaatgtcaatgtgcatgtgcacccacgtgtgcaaaaaacccacacatttttgtaattgtgtttgtgtgtgtgtccctgcatttgtgtgagtgtgcatgtcttcgtgtgtccatgtgtttctatgagtgtgttttgtgattctgtctgtctttgtgttgatgtgtgtttgtgtaagtgtgtggttgcatttgtgtcagtgattctggagcaggtgagctgatcacaagtctgagccgagaatccatggagctcatttacaacagaagccgggaccctgtgcaaatccttctgaaatatccccggtttacagagctcctaggggtggggaagaaaaattccctgacttttcggcctcagggaaagagagagacaccccgctggccgtacacctctgctgtttctcagaaaacaggtggggtatcactctttcctaaatgacggtgattttaagaacggttcaccttttgaagagacgtttctgccctggcgatccatacatattgaacccaaatgaatattttttaattaaaaatttttatataaatatacattgtgcatactttatattaatatattgatataaatatattttaatataaacatgatttttatagttcatataaataaagttatatatagtgtatatgtaaaatatacttttatttgtgatacataattttatagattaaattttatatactaagcaaagttacatgtgatatatacatgccatataacatcatttatataatatatctttatgtaaataagtatataataaaattgatcttatatttgttaatacataattatgtatatatactatgtaaaaataaaattatatattgtatgtgcataattatatttctataaatacacgcttatgtgtgtatttatacatgaatgcctgtgtttgtgtgagtacatcagtgagtgtgtgaatgtgtgtgcatgtgtgcctgtgtttgtgtgagtgtaagagtgttgtacatttatacactcacattttgttttctggttaataacaagatctatctttgatttaggatatgaagaattcttataagcaaccccccacacaaaatttgtatttattttaaaatattcttaaaatatgggttcttttatttttgcacaaacagacaagagtgttttttctttccaaaacttttatttcaaattctgaccctgaggagcagaaaaagaagaaaacattgtgtaaccttatatacattagaaacataagtagttactaaatgcaatacagattttgacaacatgcatttaggaaaaatgaggaattcaaactcgtagctgcctcaatattgaactttctaaagtttaattttttttaattaaaaaatattcatttgggttcaatatgtatggatctccagggcagaaatgtctctccaaaaagtgaaccactctgaaaatcaccgtcatttgggaaagggtgatgccccagctgtcttctgaaaaatagcagaggcttccggccagtggggtgtctctctctttccctgaggccgaaatgtcagggaatttttcttccccacccctaggagcccagtaaatgcagaatatttcagaaggatttgcacagggtcccggcttctgctatttatgagctccatggattcttggctcaggcttgtgatcagctcacctgctccagaatcacttcccatcttagcttctgggctaagacacctcaaaaccagcaaaggaaagtcctcactggtcaacgcgtccatcccaactcccccatctccccttagggtgggtttggggttcgggactgctttactgttcctttcaaagcagactgggaggtaagattttattctgcttccagaggttcaggatttctgcagacggtcagcaactctttgcatcctactggtaaaagttttatatactttgtatttatagaaatacgcattgtgtatattttatatgaatagattgatataaattattttagtaacttaaccatatgacttttatatttttatataaataaagttatatgtagtgtatatgtaaaatacttttatttctaatacataattttatagattaaatttaatatattaagcaaaaatatatgtaacatatataacatataacatcatttctataatatataacttaatgtaaataagtatataaaattgatattatatttgttaatacataattatacatatatactgtgtaaaaataaaattacatattgtatatgcataattatatttctataagtacaattatatactatgtataattatgtataaaataattgtataataaaattatataataaattttgaaacgttataaattattatacatagtattttattgtattaaatttagaaatgtgttatatgtaataaaattttattataataaatgtagattatataaaatcttatttataataaattaccttatgtataattataatatgagaaaataattacatatcattgtattataataaatttagagatgttatacattattacatataaaatttcattatattaaatttagaaatatatgtaataaaatggtattatgttaaaatttttatgtaacattttattatacatgtataattttatataatgttttataatatatagaatataagtacacagaatataagtacaaaaatatttatatacagctacacgtaatataaatacatcagtgtaagatgttttgtgtgtgtgagatggagtctcgctctgttgcccaggctggagtgcagcaacacgatctcgtctcactgcaacctctgcctcctgggttcaagcgattctcctgcctcagcctcccgagtagctgggattacaggcatgcaccaccacacccaatcaatttttgtatttttagtagagatggggtttcactgtgttagccaggatggtctcaaactcctgacctcaggtgatccacccgcctcggcctcccaaagtgctgggattacaggcatgagccacagtgtaagatactagctattaaaaaataaatatatatatatactgcaacagctgatttgtctggaagagtttggtcagaagacagtgtattaagaagactgtgagttcccagaggaatataagaatatacatcatgttgatatattatatataacataaatagctaactacatctgtgtatatagtataaacaaaagtacaaaaatatttgtatataactatatgtaatataaatatatcagtgtaagatattagctattaaaatatatatatatatagagagagagagagcaaccggtgatttgtctggaatattctagtcagaagacagtgtattaagaagacagtgagtccccaggagaatacaagaatgtgcatcatgttaatatattatatataacataaatacctaacaacatctgtatatatagtataaacttaaagtacaaaaatattagtatattactatatgtaatataaatatatcagtgtaagatattagctattaaaatatacatatgtgtgtatgtatgtgtatatgtgtatataaatattatatatatatatagtaaccgctgatttgtgtggaagactttggtcagaagacagtgtattaagaagacagtgggtcctcacaggaaaataagaatatacatcatgtttatattatatataacataaacaactaattacatctgtatatacagcataaacataaagtacaaaaatatttgtatataatcgtatgtaatataaatataccagtgtaagatattagctattaaaatatacatgtgtgtatgtatgtgtatatgtgtacatataatatatatacatatataacatatataatatataagatatagcataataatataatatattatatataatatgtaatatgtaacatatattatataattaatatattctatgctatataatatataatatattctatgcaataaaatatatagcatatatatatatatagcaacagctgatttgtctggaagaatttggtcagaagacagtgtattaagaagacagtgagtccccagagaaatataagaatatacatcatgtttatattatatataacataaatagctaactacatctgtatatatagcataaacataaagcacaaaattatttatatataatataaatatatcagtgtaagatattagctattaaaaaatatatatatatagcaaccggtgatttgtctggaagactggtcagaagacagtgtattaggaagacaggcagtctccgcaggaagcatggtgcaggtgggatctggaggtgactctgggctgccagaagacgccccactgctttgcggcagacacaggtggagaggtcctctctgtagcttcagcatggacagtgtgtgtgtcttgctgtgggaacacttctttctgcttccctctccactgtgaccccatcacactcactgacctgccctcctccttcctctcgctctccggggcccctgtggaaagagggtcttccctccgtgcagcaggaacccccaggaccatccccatgctcctgggttctgaacttcagggacatatgatcctacctgaccgggcacaggctctgttcaccctcaggaacccctgtcctcccaggccaccgtggactggagaactggcctcctgaaaatccagagagaacttagcactcacaacttctttctttttttcttttttctttgagactggatcttgctcttttccccaggctggagtgcaatggcatgatctcagctcactgcaacctcctcctcccaggttcaagcagttcatcctgcctctgtctcccgagtatctgggatcacagtcatccacccccgcggccaactaatttctgtatttttagtagagacggggtttcaccatgttggccaggctggtctcgaactcttgacctcaagtgatccacccgcctcggcctcccaaagtactgggatgacatatattagcatgatgtatattcttctattcctccggggactcactgtcttcttgggcagtaaaccactgtgcccggacttctctgtccacatctgcacacatctaaacctctgtagattctgaattgtttttccttttgcacagaatgagaggaactgaagtcgggaggcccagccccaacacggtccctgtggctctgtgctcaggtggtttatggctgagaaggacttggggggttgagggcttcctatcagcccaggagacattacctgggtctgggaagcctgctctgcacttgtgggtctcgaattgtctgttgcatttacctgcctcattattttttcttcctgtctctcttcttacatatttctttcgaatttggagcttgtttttcttaactacaatcaacttgaatcattactgcatatataaatataaattttatattgagtagacattatatactcaatctactacacattccaacacgggccatatctaagacgaatatttatatttaatgtttaaaatatgtttacatttcatatagaaaaatatatttatatttaatatatatgtgtatatttaatacaggaaatatatatttatatttaacatataaaaatatatgtttatatttaatatgggaaatatatgctttgtttaatatacataatacatgttgatatttaatatagaaaaggtatagttatatttactatgcaaaatacatgtttatatttaatatagaaaatatgtttatatttaatgtacaggatacatatttacatttaatatagaaaatacatatttatatttaacatacacagtatttatatttaatgtataaaatatgtttacatttaatgtgctgaatatatgcttatatttaatgtctaaaatgtctatatttaatgtactgtatacattaaatgtaccaaatgtattcttatatttaatgtataaaagaagtttatatttaacatataagatatgtttacatttaatgtataaaatgtttatgtttgatgtataaaagatgtttatatttaacgtatacaatttatatttaatgtaccaaatatattattatatttaatgtccaagccagccaagccagtcagccaagccagctaagccacccacccagccaagccagccaagtgagtcagctagccagccagccaagccagccaaaccagccaagccagtcagccagccaagccagccaagccagccagccagccaagccagccaagccagccaagcaagccagccagccaagccagccagccagcccaggagccccagccagccagccaacccaaacagccaagccagccaagccagccagccagccaagccagccaaggcagccaagccagccaagccagccaggcagccaagcaaaccaagccagccagccagacaaggcagccaagccagcaggccaagcgagccaagccaagccagccaagccagccagttagccagccaagccagccaagccagccagccagccaagccagcccagccagccagccagccagccgagccggccaagccagacagcgagcccagccagcccagccagtcagccagccaaaccagccagccagccaagccagccagccacccagccaagccagccacccagcaaagccagccaagagacccaagccagccagcaaagctggccaaaccagccaagccagtcagccaagccagccaagccggccacccagccaagccagacaagccagccaaccagccagacagcccagccagacagccagcccaggcagccaagagacccaagccagccagcgaagctggccaacccagccaagccagtcagccaagtcagccaagccggccacccagccaagccagccaagccagccaagccagtcagccagccagccagccaagccagccaagccagtcagccagccagccagccaagccagccaagcctcccagccagccaaaccagccaagccacccagccagccaagccagccaagccacctagccagccaggcccgccagccagccagccagcgagccaagccagccaagccagccagcctgccaagccagccggccagccaagctagccaatccactcagccactcaagccagccaagtcacccggccatccaagccagccaagccagtcagccagcccagacagccaagccagccaagccagccaagcccgccaaccagccaagacaggcatgctagccaagccagccaggcagcgaagccagccaagccagccagcaagcaaagccaggcatgtcagccaagccagccaggcagccaagccagcaaagccagccaagccagccagccagccaagccaggcatgccagccaagccatccagccagctaagccagccggctagccaagccagccaagccacccggccagccaagccagccagccaagccagccaagcctgccaagccagccaaccagccaagccagccagctagccaagccacccagtcagccagctagccaaaccagccaagccacccagccagccaagccacccagccagccaagccagccaagccacccggccatccaagccagccaagccagtcagcccagacagccaagccagccaagccagccaagcccgccaaccagccaagacaggcatgctagccaagccagccaggcagcgaagccagccaagccagccagcaaggaaagccaggcatgtcagccaagccagccaggcagccaagccagccaagccagccaagccagccagccagccaagccaggcatgccagccaagccatccagccagctaagccagccggctagccaagccagccaagccacccggccagccaagccagccagccaagcctgccaagccagccaaccagccaagccagccagctagccaagccacccagtcagccagctagccaaaccagccaagccacccagccagccaagccacccagccagccaagccagccaagccacccggccatccaagccagccaagccagtcagccagcccagacagccaagccagccaagccagccaagcccgccaaccagccaagacaggcatgctagccaagccagccgggcagccaagccagccaggcagcgaagccagccaagccagccagcaagcaaagccaggcatgccagccaagccagccaaccagccaagccagccagctagccaagccacccagccagccagccagccaaaccagccaagccacccagccagccaagccacccagccagccaagccagccaagccaatcagccagccaggcagccagccacccagccagccaagccagccaagccagccaagccaatcagccagccaggcagccagccacccagccagccaagccagccaagccacctagccagccaggcccgccagccagccagccaggcagccaagccagccaagccagtgaagcccgccagccagccaagacaggcatgccagccaagccagccaggcagccaagccagccaagccagccagccagccaagccaggcatgccagccaagccatccagccagctaagccagccggctagccaagccagccaagccacccggccagccaagccagccagccaagccagccaagccagccaaccagccaagccagccagctagccaagccacccagccagccagccagccaaaccagccaagccacccagccagccaagccacccagccagccaagccagccaagccaatcagccagccaggcagccagccacccaagccagccaagccagccaagccagccaagccacctagccagccaggcccgccagccagccagccaggcccgccagccagccagccaggcagccaagccagccaagccagtcaagcccgccagccagccaagacaggcatgccagccaagccagccaggcagccaagccagccaagccagccagccagccaagccaggcatgccagccaagccatccagctagctaagcccgctggctagccaagccagccaagccacccggccggccaagccagccaagccagccaaccagccaagccagccagctagccaagccacccagccagccagccagccaaaccagccaagccacccagccagccaagccacccagccagccaagccagccaagacagccaggcagccagccacccaagccagccaagccagccaagccggccaaaccagccaaccagccaagccagccagccatccaagccagccaagacagccagccagccaagccagtcaagccagccatacagccaagccagccaagccaggcaagccacccagccagccaagccatctagccatcaagccagtcaggccagccagccagcctgccaagccggccacccaccaagccagccagccatccacgccagccaagccagttagccagccagccaagccacccagccagccaagccagccaagccacacagccagccaagccacccagccagccaagacagccaagccacacagccagccaagccatccagccagccaagacagccaagccagccaagccatccagccagccacgcaagccaagccagccagccagccaagcaatccgtgccagccaagccatccagccagccaagcgaggtgtccggccaagccaccccaccagccaagccagccagccagccagccagccagccaagccacccagccaactaagccagccaaaccacccagccaggcatgccagccaagccacccagccagccaagcctgtcagccagcgaaccagccaagccagccatgccagccagccagccaagccatacaagccagccagccagccatgccaggacgagactccatctcaaaaaaaataaaaaaaaaacagcctggccaacatgatgaaaccccgtctctactaaatgtataaaaaattatctaggcgtggtggcacacgccagtaatcccagctactcgggaggcccaggcaggaggatcgctttaaccagggaggtggaggttgaagcgaaccaagattgcaccacctcattccagcctgggcaacagggtgagactcaatctcagaaaaagaaaaaaaaaaaggccagcctggccaacacggtgaaaccccatctctactaaatatgaaaagaaattagctgggcgtggtggcacatgaatgtaatcccagctactcgggaggcccaggcaggaggatagcttgaaccctgggggtggaggctacagcgagccaagattgcaccactgcactccagcctgggcaacagggcgagactccatctcagaaaaaataaaataaaatagaccagcctggccaacagggtgaaaccccatctctacaaaatatacagaaaaattagctgggggtggtggcacacacctgtaatcccagctactcgggaggcccaggaaggaggatcgcttgaatcagggaggtggaggctgcagcgagccaagattgcaccactgcactccagcctgggcaacagagtgagactccatctgaaaaaacagaagcattccagcctggccaatagagcgagactccatctcaaaaaaaaaaaaaaaaaaaaaaaaaacaccagcctggccaacatggtgaaaccccgtctcttctaaatatacaaaaaaaatagggccaggcgtggtggctcatgcctgtaatcccagcaccttgggaggccgaggtgggtggatcacgaggtcatgagatcgagaccagcctgaccaacatggtgaaaccccgtctctactaaaaatagaaaaattagctggatgtggtggcacatgcctgtaatccctgctactccggaggctgaggcaggagaattgcttgaacctaggaagcggaggttgcagtgagccgagatggcgccactgtactccacggtggtgtcagagtgatactacatctcaaaaaaaaaaaaaatagctgggtttgatggcacacacctgtaataccaggtactcgggaggcccaggcaggatgatcacttgaacccgggagggggtggttgccgtgaaccaagattgtaccactgcactccagcctgggcaacagggcgagactccatctcaggaaaaaaaaaaaaaaaagaccagcctggccaacatggtgaaaccccgtctctactaaatataaaaaaaattacctggatgtggtggcacatgcctgtgatcccagctgctcgggaggcccaggaaggaggatcgcttgaacctgggaggtggaggctgcagcgagccaagattgcaccactgcactccaccctggataacagaattagactctatatgaaaaaaaagaagaactccagccagggcaatagagtgagactccatctcaaaaaaaaaaaaaaaaaaaaaaaaagaccagcctggccaacatggtgaaaccccgtctctactaaatacacaaaaaaattagctgtgcgtggtggcacacgcctgtaatcccagctactcgggaggcctaggcaggaggatcgcttgaacccgggaggtggaggttgcagcgaaccaagattgcaccactgcactccagcctgggcaacagagcgagactccatctcaggaaaaaaaaaaaatatcagcctggctaacatggtgaaaccccgtctctactaaatatacaaaaaaaattagctgggcgtggtggcacacgcctgtaatcccagctacccgggaggcccaggcaagaagatctcttgaacccagaaggtatatgctgcagcgagccaagattgtcccaccgcacttccgcctgggcaacagagcgagactccgtctcagaaaaaaaaaaaaaaaaaaaaaacaagaacaggttggccaacatggtaaaaccatgtctctactaaatatacaaaaaaattagttaggcatggtggcacacgcctgtaatcccagctactcggaaggcccaggcaggaggatcgcttgaacccgggaggtggaggctgcagcaaaccaagattacaccactgcactccagcctgggcaacagggcgagactccatctcagaaaaaaaaaaaaagaccagcctggccaacatggtgacaccccgtctctagtaaatatataaaaaaattagctgggcatggtggcacacggctgtaatcccagctactcgggagccccaggcagtaggatcgcttgaacctgggaggtggaggctgcagcgagccaagatagcaccactgaactccagcctgggcaacagggtgagactccatctcagaaaagagagaaaaaaattaaaaaaagaccagcttggccgacatggtgaaacctcatctctactaaaaatacaaaagtattagctggccgtggtggcacacgcctgtaatcccagctactcgggaggcccaggaaggaggattgcttgaacctgggagtttgaggctgcagcgagccaaaattgcaccactgcactccacccgagtgagactccatctgaaaaaaagaactccagccacggcaatatagcgagactcaacctcaaaaaaaaaaaaaaaaaaaaaaaaaacaccagcctggccaatatggtgaaccccgtgtctactaaatatacaaaaaaattagctgggtgtcacggcacacgcctgtaataccagctacttggtaggcacaggcaggaggatcgcttgaacccgggaggtagaggctgcagtgagccaagattgcaccactgcactccagcctgggcaacagggtgagactccatctcagaaaaaaaaaaaaaacaaaaagagcagcctggccaacatggtgaaaccccgtcaatactaaatatacaaagaaattagctgtgcatggtggcacacgaatgtaatcccacatactcgggatgcccaggaaggaggatcgcttaaacccgggaggtggaggctgcagcgagccaagattgcaccactgcactcgagccagggcaacagggccagactccatctcaaaaaaaaaaaaaaagaccagcctgggcaacatggtgaaaccccatctctactaaatatacaaaaaaattgctgggcgtattgctacacacctgtaatccccgctacttgggaggcccagacaagaggatcacttgatcccgggaggtggaggctgcagcgagccaagattgtaccacagcacttcagcctgggcaacagagcgacactccatctcagaaaaaaaaaaaaaaaaaaaaaagaacaggttggccaacatggtgaaaccccatctctactaaatatacaaaataattagctgggcgtggtgacacacacctgtaatcccaggcaggaggattgcttgaacctgggaggtggaggctgcagccagccaggattgcaccactgcactccaccctgggcaaaatgtgagactccatctgaaaaaaaagaagcattccagcccgggcaatatagcgagactccaactcgaaaaaaaaaaagaccagctggccgacatggtgaaaccccatctctactaaatatacaaaaatattagctgggcgtggtggcacatgcctgtaatcccagctactcgggaggcccaggaaggaggatcgcttgaacccgggaggtagaggctgcagcggagccaagattgcaccactgcgctccatcctgggcaacagagtgagactctatatgaaaaaaaagcactccagcctgggcaatagagcgagactccatctcagaaaaaaaaaaaaaaagaaagaccagccttgccaacatggtgaaaccccgtctctactaaatatacaaaaaaattagctgggcgtcatggcacacgcctgtaatcccagctactcggtaggcccaggctggaggaatgcttgaacccgggaggtggaggttgcagcaaaccaagattgcacctctgaacgcctgcctgagcaacagggtgagattcaatctcagaaaaaaaaaaaaaaaaaaaaaaaagagcagcctggccaacatggtgaaaacccatcaatactaaatatacaaagaaattagctgagcatggtggcacacgaatataatcccagctactcgggaggcccaggtaggaggatcccttgaacccgggaggtggaggctgcagcgagccaagattgcaccactgcactccagcctgggcaacagggcgagactccatctcaaaacaacaacaacaacaacaacaacaacaacaaaaaacagcctgcccaacatggtgaaaccccgtctctactaaatatacaaagaaattagctgggcgtcatggcacacgaatgtaatcccagctactcgggagtcccagacaggaggatcgcttgaacctgggagttggaggctacagcgagccaagattgcaccactgcactctgctctgggtaacagagtaagagtccatctgaaaaaaaagaagcactccagcctgggcaacagagagagactccatctcagaaaaaaaaaaaaaaaaaaaaaaaaaaaaaagaccaggttggccaacatggtgaaatcccgtctctactaaatatacaaaaaaaattagctggacgtggtggcacaggcttctaatcccagctactggggaggcccaggcaggaggatcacttgaacctgggaggtggaggctgcagcgagccaagattgcaccactgcactctggcctgggcaacagagtgagagtccatctgaaaaaaaagaagcactccagtctggtcaacagagcgagactccatctcagaaaaaaaaaaaaaaaaaaaaaagaccaggttggccgacatggtgaaaccccgtctctactaaatacacaaaaaaattagctgggcgtggtggcacatgcctgtaatcccagctactcgagaggcccaggcaggaggatcgcttgaacctgggaggtggaggctgcagcgagccaagactgcaccactgcactccggcctgtgcaacaaagtgagactccatctgaaaaaaaaagaaacactccagcctgggcaatatagcaagactccatctcaaaaaaaaaaaaaaaaaggaaaaaagagcagcctgtccgacatggtgaaaccacgtctctactaaatatgcaaaaaaattagctgggcgtggtggcacacgcctgtaatcccagctactcgggaggcccaggcaggaggatcgcttgaacccgggaggtggaggttgcagcgaaccaagattgcaccactgcactccagcctgggcaagaaagtgagattccatctgaaaaaaaagcactccagcctgggcaatatagcaagactccatctcaaaaaaaaaaaaaaaaaaagaccagcctgtccaacatggtgaaaccccatcagtactaaatatacaaagaaattagctgagcgtggtggcacacgattgtaatcccagctactcgggaggcccaggcaggaggatcgcttgaactcgggaggtagaggctgcagccagccaagattgcaccactgcactgaaccctggacaacagagtgacactccatctgaaaaaaaagaagaactccaaccagggcaatggagcgagactccatctcagaaaaaagaaaaaaaaagagcaccttggccaacatggtgaaaccccgtcagtactaaatacacaaagaaattagctgagcatggtagcacacgaatgtaatcccagctactcgggaggcccaggcaggaggatcgcttgaacccgggaggtggaggttgcagcgaacaaagattgcaccactgcactccagcctgggcaacagagcgagactcccactcagaaaaaaaaacaaaatgaaaaaaaacaccagcctggccaacatggtgaaacaacgtctccactaaatatacaaaaaaaatagatgggcgtggtggcactcatctctaatcccagctactcgggaggccaacgcaggaggatcacttgaacacaggaggtggaggctgcagctagccaagtttgcaccattgcactccagcctggcaaaccaagccagccaagccaaccagccaagccagtcaagcgacccagccagccagccagccagctaagccacccaaccagccagcctgccaagccagccaagccagccagccagccagccggccaggcagccaagccaagccagccaagccagctagccagccaagtcagccaagccagctagccagccaagtcagccagccaaaccagccaagccacccagccagccaagccacccaagacacccagccagccagccagccaagccagccaagccacccagccagccaagccagccaagcaagccagccaagccagccaagccagccaagccaggagccagccaagccagccaagccagccaagcctgccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacacaagccagccaactcagccagctagccaagcaagccaagccagccagccagtcaagccagccaagccagccagccaaccaggccagctaaaccagccagcctgccaagccagccaagccagccagccagccaggccagccagccaaacaaggcaccgcagccagcccagccagccacacaagccagccaagtcagccagccagccaagccagccaagccagcccgccaaggcagccatgccagccagccagccaagccagccaagccagccaagccagccagccacccagccagccaagccaggcagccacccagcaagccaggccagcctgccacccagccagccaagccagacaagccagccaagccagccagccacgcagccagccaggacatccagccacccagccagccaagccatgcaagccaacaagccagcccagacagccaagccagccaagcaagccagcaagccagccagccaagccagccagccaaaccagccaagccacccagccagccaagccacccaagacagccagccagccagccagccaagccagccaactagccaagccagccaagcaagccaccagccaagccagccaagcctgccagccagcagagccagccaaccagccaagccagccagccagccacttaagccatccaagcaacccagccagccaagccagccaagccaccgacccagccaagccagccaagccacccagccagccaagccagccaagccagccaaaccagcctgccagccaagccagccaagccatccagccagccaagccagccggccagccaagctagccaatccactcacccactcaaactagccaagtcacccggccagccaagcctgccaagccagctagccagcccagacagccaagccagccagccagccaagccagccaagccagccagccagccaatctagccaagccagccaagccagccaagccagccagccagccaagccagccaagccagccagccagccaagccagccggccagccaagctagccaatccactaagccactcaaaccagccaagtcacccggccagccaagccagccaagccagccagccagcaaagccagcccagccagccagccagccagccagccgagccgccaagccagacagcgagcccagccagcccagccagtcagccagccaaaccagccagccagccaagccagccagccacccagccaagccagccacccagcaaagccagccaagagacccaagccagccagcaaagctggccaaaccagccaagccagtcagccaagccagccaagctggccacccagccaagccagacaagccagccaaccagccagacagcccagccagacagccagcccaggcagccaagagacccaagccagccagcgaagctggccaacccagccaagccagtcagccaaaccagccaagccggccacccagccaagccagccaagccagcgaaccagccagacagccctgccagacagccagcccaggcagccaaaccagacaagccagccagccaagccagccaagccagccagccagccaagacaggccagccaagcaagccatggaagccagacagccagccagccaagctagccaacccagccagccaagctagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccagggagccaagccagccagcaagcaaagccaggcatgccagccaagccagccaggcagccaagccagccaagccagccagccagccaagccaggcatgccagccaagccatccagccagctaacccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagacaagccagccaaccagccagacagccctagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccaggcagccaagccagccaagccagccagccagccaagccaggcatgccagccaagccatccagccagctaagccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagccccaagccagccagcaaagctggccaaaccagccaagccagtcagccaagccagccaagccggccacccatccaagccagacaagccagcaaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccggccaagccactcagccagccaagatggccaagccacccagccagccaagcctgccaagagacccagcaacccaagccagccaagacacccagccagccaagctagccaagacacccagccagcgaagccagccagccagccagccagccaagccagccaagccacccagccagccaagccaggcaaacaacccagccagccaagccagtcaagccacccagccagccaagccggccaagccacccagccagccaagctggccaagtcactcagccagccaagccagccagccagccaagccggccaagccactcagccagccaagatggccaagccacccagtcaagccaactaagccagccaagccacccagccagccaagctggccaagccactcagccagccaagccagccagccagccaagccggccaagccactcagccagccaagatggccaagccacgcagtcaagccagccaagccagccaggcagccaagccagccaagacctccagccagccaagaaaggcatgccagccaagccagcaaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccacgacacccagccagcgaagccagccagccagccagccagccaagcctgccaagccacccagccagccaagccaggcaaacaacccagccagccaagccagtcaagccacccagccagccaagccagccaagccagccaagccacccagccagccaagctggcaagccactcagccagccaagccagccagccagccaagccggccaagccactcagccagccaagatggccaagccacccagtcaagccagctaagccagccaagccacccagccagccaagccagccaagccactcagccagccaagccagccagccagccaagccggccaagccactcagccaaccaagatggccaagccacgcagtcaagccagccaagccagccaggcagccaagccagccaagacctccagccagccaagaaaggcatgccagccaagccagcaaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccacgacacccagccagcgagaggcagctaggcagctagccaagcctgcccagccagctcgagccagctaagccaggccaagcaagctagccatccaagcttgacaagccagccaagcatgccagccaagccagcgcagctggagccagccaagccagccaagccagccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacacaagccagccaactcagccagctagccaagccagccaagccagccagccagtcaagccagccaagccagccagccaaccaggccagctaaaccagccagccagccaggccagccagccaacccagccaccgcagccagcccagccagccacacaagccagccaagtcagccagccagccaagccagccaagtcagccaagccagccagccagccaagccagccaagccagccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccagccagccaagccggccaagccagccagccagccaagccagccaagccagccagccagccaagccagccaagcaagccagcaagccagccagccaagccagccagccaaaccagccaagccagccagccagccaagcgctttacccgaacgtccgtgaggcagtgagagccaaagcagcctgccagccaagccagccaagccatccagccagccaagccagccagccagccaagctagccaatccactcacccactcaaactagccaagtcacccggccagccaagcctgccaagccagctagccagcccagacagccaagccagccagccagccaagccagccaagccagccagccagccaagccagccggccagccaagctagccaatccactaagccactcaaaccagccaagtcacccggccagccaagccagccaagccagccagccagcaaagccagcccagccagccagccagccagccagccgagccggccaagccagacagcgagcccagccagcccagccagtcagccagccaaaccagccagccagccaagccagccagccacccagccaagccagccacccagcaaagccagccaagagacccaagccagccagcaaagctggccaaacccgccaagccagtcagccaagccagccaagccggccacccagccaagccagccaagccagccaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaacagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagccaacccagccagccaagccagccaagccagccaagccagtcagccagaaaagccagccaagcctgccagccagtcaagccagccaagcctgccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccggccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagcctgccagccaagccggccaagccagccagccagccaagccagccaagccagccagccagccaagccagccaagcaagccagcaagccagccagccaagccagccagccaaaccagccaagccagccagccagccaagccacccaagacacccagccagccagccagccaagccagccaagccacccagccagccaagccagccaagcaagccaggcaagccagccaagccagccagccagccagccacccagccacccagccagccaagccagccagccacccagccggccaggccagcctgccacccagccagccaagccagacaagccagccaagccagccagccagccagccagccagccagccaagccagccaagcctcccagccagccaagccagccaagccacccagccagccaagccagccaagccacctagccagccaggcccaccagccagccagccaggcagccaagccagccaagccagtcaagcccgccagccagccaagacaggcatgccagccaagccagccaggcagccaagccagccaagccagccaggcccgccagccagccaagacaggcatgccagccaagccagccaggcagccaagtcagccaagccaggcagcaagcaaagccaggcatgccagcccagccagccaggcagccaagccagcaaaaccagccagccagccaagccaggcatgccagccaagccatccagccagctaagccagccggctagccaagccagacaagccacccggccatccaagccagccagccaagccggccaagccagccaaccagcaaagccagtcagctagccaagccagccaaccagccagccagctaagctggccagcctgccagccaaccaagccggccagacagccaaggcagccaagccggccaggcagccaagccagccaagccaccgacccagccaagccagccaagccacccaagccacccagccagcccagacagccaagccaggcagccagccaagccagccagccagcaaagccaggcagccagccaagccagtcaagccagacagccagccaagccagccagccagccaagcgagccaagccagccagccagccaggccagccagccacccagccagccaagccagccagccacccaaccagccaggccagcctgccacccagccagccaagccagacaagcctgcgaagccagtcagccacccagccagccaggccagccagccacccagtcagccaagccatccaagccagccggccagcacagacagccaagccagccacccagtcagccaagccatccaagagagccagccagcccagacagccaagccagccagccagccaagccagccaagcaagccagcaagccagccagccaagccagccagccaaaccagccaagccacccagccagccaagccacccaagacacccagccagccagccagccagccaagccagccaagccacccagccagccaagccagccaagcaagccagccaagccagcgcagccaggagccagccaagccagccaagccagccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacccaagccagccaactcagccagccagccaagccagccaagccagtcagccagccaagccagccaagccagccaagccagtcaagccagtcagccagccaagccagccaagccagccagccagcccagacagccaagccagccagccagccaagccagccaagcaagccagcaagccagccagccaagccagccagccaaaccagccaagccacccagccagccaagccacccaagacacccagccagccagccagccaagccagccaagccacccagccagccaagccagccaagccagccaagcctgccaagccaaccatccagccaagcctgcaaagccagcccgccagcaaagccagccaagtcagcctgccaagccagccaagacagccagcaagccaagccagccaagccagccagccaagccagctagccaagccagccaaggcagccaagccagtcagccagccaagctagccaagccaggcagccatccaagccagccagccatccaagccaatgaagccagccagccagccaagccacccaagccagccaagccagccagccaagccagctagccaagccagccaaggcagccaagccagtcagccagccaagctagccaagccaggcagccatccaagccagccagccatccaagccaatgaagccagccagccagccaagccacccaagccagccaagccagccaactcagccagccagccaagccagccaagccagccagccagtcaagccagccaagccagccagctaaccaagccagctaaaccagccaagcctgccaagccagccaagccagccaagccagccagccagccagccatcccagccagcccagccagccaagccagccagccacccagccggccaggccagcctgccacccagccagccaagccagacaagccagccaagccagccagccagccaagccagccaagcctcccagccagccaagccagccaagccacccagccagccaagccagccaagccacctagccagccaggcccaccagccagccagccaggcagccaagccagccaagccagtcaagcccgccagccagccaagacaggcatgccagccaagccagccaggcagccaagccagccaagccagccaggcccgccagccagccaagccaggcatgccagccaagccagccaggcagccaagccagcaaaaccagccagccagccaagccaggcatgccagccaagccatccagccagctaagccagccggctagccaagccagacaagccacccggccatccaagccagccagccaagccagccaagccagccaaccagcaaagccagtcagctagccaagccagccaaccagccagccagctaagctggccagcctgccagccaaccaagccggccagacagccaaggcagccaagccggccaggcagccaagccagccaagccaccgacccagccaagccagccaagccacccagccagcccagacagccaagccaggcagccagccaagccagccagccagcaaagccaggcagccagccaagccagtcaagccagacagccagccaagccagccagccagccaagcgagccaagccagccagccagccaggccagccagccacccagccagccacccagccagccagcccagccagccaagccagccagccagcccagccagccccgccagccagccaacccagccaccgcagccagcccagccagccacacaagccagccaagtcagccagccagccaagtcagccaagccagcccaccaaggcagccatgccagccagccagccaagccagccaagccagtcagccagccaagccagccaagccagccagccagccaagccagccaagccagccaagtcaactgagccagccaagccagtcagccaagccaggcaagccagcaaagtcagccagccagccaagccagccaagccagcccagccagcccagccagctaagccagcccagccagccagccaagccatccaagccagccagccagccagccagcccagccagccaagccagcccagccagccaaccaagccagccagccagccatgccagccaagccagccagccatccaagccaaccaagccagccagccaagccagccaagccagccaagccagccaagccacccaggcagccaagccagccaagccagccaagccagccaggcagccaagccagccaagccagccaagccagccagccaagccagccagccagccaagagagccaagccagccatccagccaggccatccagccacccagccagccaagccagcctgccacccaaccagccaggccatccagccacccagccagccaagccagcctgccacccaaccagccaggccagcctgccacccagccagccaagccagacaagcctgcgaagccagtcagccacccagccagccaggccagccagccacccagtcagccaagccatccaagccagccggccagcacagacagccaagccagccacccagtcagccaagccatccaagagagccagccagcccagacagccaagccagccagccagccaagccagccaagcaagccagcaagccagccagccaagccagccagccaaaccagccaagccacccagccagccaagccacccaagacacccagccagccagccagccaagccagccaagccacccagccagccaagccagccaagcaagccagccaagccagccaagccaggagccagcccagccagccaagccagccagccacccagccacccaagacagctaaaccagccagcctgccaagccagccaagccagccagccagccaggccagccaagccagccaagccattcaagccagccagccagcccagccagccaagccagccagccagcccagccagcccagccagccagccaacccagccaccgcagccagcccagccagccacacaagccagccaagtcagccagccagccaagccagccaagccagcccgccaaggcagccatgccagccagccagccaaaccagccaagccacccagccagccaagccacccaagacagacagccagccagccaagccagccaactagccaagccagccaagcaagccaccagccaagccagccaagcctgccagccagcagagccagccaaccagccaagccagccagccagccaaaccagccaagccagccagccagccacttaagccatccaagcaacccagccagccaagccagccaagccaccgacccagccaagtcagccaagccacccagccagccaagccagccaagccagccaaaccagcctgccagccaagccagccaagccatccagccagccaagccagccagccagccaagctagccaatccactcacccactcaaactagccaagtcacccggccagccaagcctgccaagccagctagccagcccagacagccaagccagccagccagccaagccaaccaagccagccagccagccaagccagccggccagccaagctagccaattcactaagccactcaaaccagccaagtcacccggccagccaagccagccaagccagccagccagcaaagccagcccagccagccagccagccagccagccgagccggccaagccagacagcgagcccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagccaagccagccaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaccagacaagccagccagccaagtcagccaagccagccagccagacaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccagccaagcctgccaagccacccagccagccaagccaggcaaacaacccagccagccaagccagtcaagccacccagccagccaagccagccaagccacccagccagccagccggccaagccactcagccagccaagccagccagccaggccagccgggcaagccattcagccaggcaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccagccagccaagccagccaagccagccagccagccaagccaggcatgccagccaagccatccagccagctaagccagccggctagccaagccagacaagccacccggccagccaagccagccagccaaggcagccaagccagccaaccagtcaagccagtcagctagccaagccagccaaccagccagccagtcaagccggccagcctgccagccaaccaagctggacagacagccaaggcagccaagccggccaggcagccaagccagccaagccactgacccagccaagccacccagccagccaagacagccaagccagccaaaccagcctgccagccaagccagccaagccatccagcctgccaagccagctggccagccaagctagccaatccactcacccactcaagccagtcaagtcacctggccagccaagccagccaagccagccagccagcccagagagccaagccagccagcccagacagccaagccagccagccagccaagcctgccaagccacccagccagccaagccaggcaaacaacccagccagccaagccagtcaagccaaccagccagccaagccagccaagccacccagccagccaagctggccaagccactcagccagccaagccagccagccagccaagccggccaagccactcagccagccaagatggccaagccacccagtcaagccagctaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccaggcatgccagccaagccatccagccagctaagtcagccggctagcccagccagccaagccacccatccagccaagccagccagtcaagccagccaagccagccaaccagtcaagccagtcagctagccaagccagccaagccacccggccagccaagccagccagccaacccagcccagccagccaaccagccaagacattcagctagccaagccagccaaccagccagccagtcaagccggccagcctgccagccaaccaagccggacagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccactcacccactcaagccagccaagtcacccggccagccaagccagccagctcagacagccaagccagccagccaagccagccaagccagccagccagccaagccggccaagccactcagccagccaagatggccaagccacgcagtcaagccagccaagccagccaggcagccaagccagccaagacctccagccagccaagaaaggcatgccagccaagccagctaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagcaagcaaagacacccagccagccaggttagcaaagacacccagcagggagccagccagcaagccagcgagccaagctgggcaaggccaccaagcgagcccggcagctcagtcagtcacagaggccagcagaccgtggtcaagccacccagccagctaagcagatctacgcacaagctctccaagccactcagccagctaagctagccagcagtcaagccggccaagccactcagccagccacggcgccaagccacgcagtcaagccagccaagctagccaggcagccaaggcagccaagccagccaagacctccagccagccaagaaaggcatgccagccaagccagccagggagccaagccagccagcaagcaaagccaggcatgccagccaagccagccagggagccaagccagccagcaagcaaagccaggcatgccagccaagccagccaggcagccaagccagccaagccagccagccagccaagccaggcatgccagccaagccatccagccagctaagccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagacaagccagccaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccacccagccagccaagccaggcaaacaacccagccagccaagccagccaagccacccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccaggcagccaagccagccaagccagccagccagccaagccaggcatgccagccaagccatccagccagctaagccaaccagcaagcaaagccaggcatgccagccaagccagccagccagccaagccagccaagccagccaaccagtcaagccagtcagctagccaagccagccaagccacccggccagccaagccagccagccaacccagccaagccagccaaccagccaagacattcagctagccaagccagccaaccagccagccagtcaagccggccagcctgccagccaaccaagccagccagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccactcacccactcaagccagccaagtcacccggccagccaagccagccaagccagccagccagcccagacagccaagccagccagcccagacagccaagccagccagccagccaagccagccaagccacccagccagccaagccagccagccaaaccagccaagccacccagccagccaagccacccaagacagccagccagccagccaagccagccaactagccaagccagccaagcaagccaccagccaagccagccaagcatgccaaccagcagagccagccaaccagccaagccagccagccagccaagccagccaagccagccagccagccactcaagccatccaagcaacccagccagccaagccagccaagccacccagccagccaagccagccaagccagccaaaccagcctgccagccaagccagccaagccatccagccagccaagccggccggccagccaagctagccaatccactcacccactcaagccagccaagtcacccggccagccaagccagccaagccagccagccagcccagacagccaagccagccagcctagacagccaagccagccagccagcaaagccagccaagccagccagccagccaagccagccaagccacccagccagccaagccagccagccaaaccagccaagccacccagccagccaagccacccaagacagccagccagtcagacaagccagccaactagccaagccagccaagcaagccaccagccaagccagccaagcatgccaaccagcagagccagccaaccagccaagccagccagccagccaagccagccaagccagccagccagccactcaagccatccaagcaacccagccagccaagccagccaagccacccagccagccaagccagccaagccagccaaaccagcctgccagccaagccagccaagccatccagccagccaagccagccggccagccaagctagccaatccactcacccactcaaactagccaagtcacccggccagccaagccagccaagccagctagccagcccagacagccaagccagccaggcagccaagccagccaagccagccagccagccaagctagccaagccagccaagacagccaagccagccagccagccaaaccagccagccagccaagccagccagccacccagccaagccagccacccagcaaagccagccaagagacacaagccagccagcaaagctggccaaaccagccaagccagtcagccaagccagccaagccggccacccagccaagccagccaagcctgccaaccagccagacagcccagccagacagccagcccaggcagccaagagacccaagccagccagcgaagctggccaacccagccaagccagtcagccaagccagccaagccggccacccagccaagccagcaaagccagccaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagtcagccagaaaagccagccaagcctgccagccagtcaagccagccaagccagccagccagccaagcggccaagccgcccagccagccaagatgccaagccacccagccagccaagcctgccaagagacccagcaacccaagccagccaagacacccagccagccaagctagccaagacacccagccagcgaagccagccaagacagccagccagccaagccgccaagccagccagccaagcaagccatggaagccagacagccagccagccaagccagtcagccaagccagccaagccggccacccagccaagccagccaagccagcgaaccagccagacagccctgccagacagccagcccaggcagccaaaccagacaagccagccagccaagccagccaagccagccagccagccaagacagccaagccagtcaagccaggcaagccagcgagccagccaagccagccaacccagccaagccagccagccagccaagcggggggagccactcagccagccaagatggccaagccacgcagtcaagccagccaagccagccaggcagccaagccagccaagacctccagccagccaagaaaggcatgccagccaagccagctaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccgcccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccagccaagccagccagccagccaagccaggcatgccagccaagccatccagccagctaagccagccggctagccaagccagacaagccacccggccagctaagccagccagccaaggaagccaagccagccaaccagtcaagccagtcagctagccaagccagccaagccagccagccagccaagccaggcatgccagccaagccatccagccagctaagtcagccggctagcccagccagccaagccacccatccagccaagccagccagtcaagccagccaagccagccaaccagtcaagccagtcagctagccaagccagccaagccacccggccagccaagccagccagccaacccagcccagccagccaaccagccaagacattcagctagccaagccagccaaccagccagccagtcaagccggccagcctgccagccaaccaagccagccagacagccaaggcagccaagccagccaggcagccaagccagccaagccactgacccagccaagccacccagccagccaagagagccaagccagccaagccagccaaaccagcctgccagccaagccagccaagccatccagcctgccaagccagctggccagccaagctagccaatccgctcacccactcaagccagccaagtcacccggccagccaagccagccaagccagccagccagctcagacagccaagccagccagccaagccagccaagccagccagccagccaagccagccaagccacccagccagccaagccagccagcaagccagccagacagccaagccagccagccacccagccagccagtccagccagccacccagccagccaagccagccagccatccagccagccaggccagcctgccacccagccagccaaggcagacaagccagccaagccagccagccacccagccagccaggccagccagccactcagccagcccagacagccaagtcagccaagtcagccagccagccaaggcagccaagccagccaaccgaacaagagagccagccaaccaagccagccaagccagccagctagccaagccacccagccagccagccagccaaaccagccaagccacccagccagccaagccagccaagccaatcagccagccaggcagccagccacccaagccagccaagccagccaagccatccaagccagccagccagccagccagccaagccagccaagcctcccagccagccaagccagccaagccacccagccagccaagccagccaagccacctagccagccaggcccgccagccagccagccagccaaaccagccaagccacccagccagccaagccagccaagccaatcagccagccaggcagccagccacccaagccagccaagccaaccaagccatccaagccagccagccagccagccagccaagccagccaagcctcccagccagccaagccagccaagccacccagccagccaagccagccaagccacccggccatccaagccagccaagccagtcagccagcccagacagccaagccagccaagccagccaagcccgccaaccagccaagacaggcatgctagccaagccagccaggcagccaagccagccaggcagcgaagccagccaagccagccaggcagcgaagccagccaagccagccagcaagcaaagccaggcatgccagccaagccagccagctagccaagccacccagccagccagccagccaaaccagccaagccacccagccagccaagccacccagccagccaagccagccaagccaatcagccagccaggcagccagccacccagccagccaagccagccaagccacctagccagccaggcccgccagccagccagccaggcagccaagccagccaagccagtcaagcccgccagccagccaagacaggcatgccagccaagccagccaggcagccaagccagccaagccagccagccagccaagccaggcatgccagccaagccatccagctagctaagccagccggctagccaagccagccaagccacccggccggcaaagccagccaagccagccagctagccaagccacccagccagccagccagccaaaccagccaagccacccagccagccaagccacccagccagccaagccagccaagacagccaggcagccagccacccaagccagccaagccagccaagccggccaaaccagccaaccagccaagccagccatccatccaagccagccaagccagccaggcagccaagccagccaagccagccagccagccaagccagcgaagacaccgagccagccaaacaagccaagccacccagccagccaagcctgccaagagacccagcaacccaagccagccaagacacccagccagccaagctagccaagacacccagccagcgaagccagccagccagccagccagccaagcctgccaagccacccagccagccaagccaggcaaacaacccagccagccaagccagtcaagccacccagccagccaagccggccaagccacccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccaggcatgccagccaagccatccagccagctaagccagccggctagccaagccagccaagccacccggccagccaagccagccagccaagccagccaagccagccaaccagtcaagccagtcagctagccaagccagccaagccacccggccagccaagccagccagccaacccagccaagccagccaaccagccaagacattcagctagccaagccagccaaccagccagccagtcaagccggccagcctgccagccaaccaagccggacagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccgctcacccactcaagccagccaagtcacccggccagccaagccagccaagccagccagccagcccagacagccaagccagccagcccagacagccaagccagccagccagccaagccagccaagccagccagccagccaagccagccaagccacccagccagcccagacagccagcaagccagccagacagccaagccagccagccacccagccagccaggacagccagccacccagccagccatccagccagccaagccagccagccatccagccagccaggccagcctgccacccagccagccaagccagccaagccagccaagccagccagccacccagccaagccagccacccagcaaagccagccaagagacccaagctttttcagccaccagccatcactatcctcttgttttcaaacaggattgggatttgattatttcaaacccttcatgggattgaaactttgtcttaagtcagtgactactacatttccaagtactttcgaggagacatattttcatgtgtttttttgcatagctctggatttcaacttacacacccagaaatgtcacctttagaggcccctttgttgagtacatttgatctcaagtattccaggtctggggatggatctagctggaaaatgttcagacactgaagtttctagagcctgaagatgctcccctatcaggtaccaggaccagccagatctcattctctgactctacataacttctgacaaatgaaatgaagtttccgtttttggccaaccatggagcctgctccgtgtctgatattcttctttgaagactgaggatgtgacctgattgttctctgcctcctttttctagctacatttttttttttagctggttctcacacgggctttccatggcctctctctgattgtggggactggccgtttcccaggcacagcaccttggcctgggggagccgtgagaactgatgagtgtcttttgaaggagtcactgggcttctgcaatgggaggatcttggtgtgtggggagcgtgggaacttttccttttgttggttcaggaatgaaattgttgtgtaaatggaccaagagacctaaggaaagggacagtccttttggctggtgggtcctctccactgatagatccaaacaacagagtggaaaatgtaccacaagaagactacgctcgttgcctggaactcagtagcccctgtggctggtgttggcacttgccttaccagtgtgagcctggttttcccgatcatttggccttccacaataaggacaatttaagagattatttctcaatgttaactacttccttgattaattttgtgatctacctttctcctttctgaccagtagtagaatccatttatgttttcaagatgttgctacttaggatacaattatttctaagaaatacaagtgacattgctttgtagaatgggaaccatgttctacagccctgcaaagacctgtcctgagagagctggggggacgcaggcttggaggaggtgagggcaggcactgagtgggtggagggaatcaaacggctgccagaataaacatcagatggagctcctgggcttcttgaggggtagaatttcctctgagctctctacaagacctcagccacaaccattcatctacttaatacattgaagcaattcacataaaaagccagacagatttttttctctgaatttaaaactggatttagagactagattaataaatattgtctttgtcatgtgagtcactttggagagaatcatgtccccactgtatggcaatgcagcagatcctgaccatgcatatttagtgtgtccttcctgctctcttgggcagaccatcccatcaggctatagcacggagctctcacccatctccctgctctgccatgcaccctccttcttgcctgctctttcttctccctatggccagcccctccagccaacatactttttatctctctttgttttgcaaaatccttttctcctatcacttccatcataaaactagtatttggcaaacaatcacatgtcggcataaagctcttaaattgacctgctttagattaaagcacaatatgggttttatagtttgcctcaggtgaccatttaaatgtcttgaataatgaaatgaaaaactggacagactaaaataagagtcctgtctgcctgtgacagtgaagaataagagtcctgtctgcctgtgacagttaaagaatgatccctcattgcctctcacacagctgcagtcagggttcccaccaccctttctgctgattctgaaatcagccctagttcataaattatcagggaatttggtgagttttctcttttaatgtcagtctgtttatttgactggtagtttctggccttaacacatcccactaatgtgttgtttagttgagcacaataataaatagaacttttgtttacttttacatccaaagataaatgttgagtgctattaaaaacttttctaacatagtaggcctccaatgaggaattttccttcagcaaatcataaaactgggtctagaagtgccaacccaagtaaaattactgatgaactaatcatagttgttatttttccttcatcttttcctttttttttttagacaatcttgccctgtcgcccaggctggagtgcagtggcgtgatctcggcttgctgcaagctctgcctcctgggttcacgccattctcctgcctcagcctcccgagtagctgggactacaggcgcccgccaccatgcctggctaattttttttgtatttttaatagagacggggtttcactgtgttagccaggatggtctcaatctcctgacctcgtgatccgcccaccttggcttcctaaaatgctgggattacaggtgtgagccactgcgcccggctccttcatcttttctatgtgctttgtttgacacttattgaggatacagttgctgaagaccagctgagtaggacataggctctgtcatgcattaactcatccacccattcatttattcactcatctattgagcatctgctatgtgtcaggctctatgccaaactttctgttcaggagccaatatatcaataactacagtgtaagctaagtcatgcaatgaaagacttagagaatagacaccaagttgaatattaacccaagtaaattattggaagatatattagttatctaaaataggcttaaaacaataaacatttattatcacaatttctgtaggtccagaatctggacatgacttagcttgatgtttatggctcaagacctcttgaggtttcaataaaggtgttagtcagggctgcagtctcatctgaaggctcatctggttgggggtggtgtctgtatctatgtggttattggcaggccttggtcctcactacactggaactcttcaaagggttatctcatgacacagaagctagctttccccagggtgaagaatgtaaaagaatgtgagaactcttaagacagatgctatagtcttttctataacttaattttggaagtgatattccatcacttctgccatattctttgttagaatcaagtcagtaaatccagcccagattcaagtgaaaggattccacaagagtgtgagtaccaagaggtagggatattgggagccatctgagaggctgcttaccacagagggccagccagttaggaagtgggttcagctgctgctgttaacaggctcgacctaagtggcttaaacacagaagagttgttgttgttgttgttttttctaatgagaaatctggaggcagtcagttgctggccttggctcaaaggctgagggcactgtggttcttgtagcctttcgcttatggccctaagctgctggaactcttgccatcatgtctgcattccaagcagcagaacaacaagaaaagaacagggggagaagagaaagagggcaccagcccactgactatcctgttcatcctgggaagtaccactcaacaagctcaactctcatttccacagccatctccagctgctcaggagtctgggaaatgtaatcacatgcaccattatccccaagtgcaccactgcctccagcccctttccacctttcagttatagccataaacatccagttagccataaacattcagctaatgcatgtgcagattcttgatctacagaaattgtgatagtaaatatttattgttttaagtctatcttagatcactaacatatcctctacttaacatttcacttgggttaatattcagcttagtgtctattctcaagttttccattgtatgtcttcgttcgcactctcctcattgaaatattggctcctgattagaatgcttgagtactgttcttttataccaccaagcctgctcctcaagccgattttgtgccccgcaagccagcgatggctctattaatggttgtccttgtcttttatgagttcatgtgactgggtgggggagattcaacacccaccctcatgctgctcactctcaagtaaacaagtaagccaacattagagtctcagggctatgaatgggagcacagaaatcacagtgcaacctcccaagtacaggtcaggaagcctggtttaaatatttgaaagcaatttgaggaagttcccagtgggaaatgaacttgagaactaggtcattcatatgtccattcaacatctaccttctgcttatctggagtgtgcatggcactgcctggggccactgcagtgaataagagagatgagaacccaggcaactccgagagacccagtcccacctgctttgctggcaggggcttaggatgcagtcactttccattaaagtcagagtcctggagtcccatctgctttgcttctgcattccctacaatgatgagtggttaggagtccaggtctcagagaaagactgtctaggtgtgggtccccaccttgtcacttctgtgtccccttgtgtgagctgctggacatctctgggcctcagtttcctaatttataatgtggttgcctgtcagaggattacatgagaagatgcatattgcttagcgtagtgccaagggcatagtaatagcccaacacttattaaccacgttgatgatggctatggagatgatggtgatgatgacaatgatgttgatgatgacaatggtgatgattatgattcagtttctattctaagatgtggttacagtttcctaactttgggagatatgcctatctgtatatatcacggcatagtctctttctcttattgtagagaaaacaccttcacattatagatgcaccgcttggccttcctatctctcagtgtagaggagactctggaattcctcttgactggtccagatgcccacaaaattctacagacaagcagcaccaaacttaagagcatacatgtgatccaaaatattcttttaaagtcaaagctgtcattgcatttttccagaaataaaatgataaaaactgtgcacaggactgcttatcatacttaactcttaacacagctgacctttaaatggcattaagagtaccaacctgagttctgggtcctaggaaccaggaggagataaaagattaagaaatagggaaggagagcccgggtgtggtggctcacgcctgtaatcccagcactttgggaggctgaggcgggtgcatcacctgaggtcaggagttcgagactagctggccaacatggtgaaaccctgtctctactaaaaatacaaaaattagctgttctgcagacttgggtctagaggtgatcagtttttccccagccaaagcccaagggcagccttgctcctctctccctcccctggcttatgttcccctgtgtatgactgtgtccctccagcccatgacctatagagaatgcagaccatctctctgccagtgttggagaccagatcccatggaagggcactcatgtccagcctggggccccctgccttggcagacactactagttgacataatccagctacttgggaggctgggacaggagaattgcttgaacccaggagtcagaggttgcagtgagctgagattgcactgctgcactccagcctgagtgacagagtgagactctgtctcaaaaaaaaaaagaaaaaaaaaaaaagagaaagaaacagggaaggaaaaatgactggaagaagatgaatatgctgagccacattctgagattgagaagtctatctatgatcacttgcacctcttctcttctgggtagtgtctacttccccacgtccctctgccattcttttgctgaagccatgcccaccttaccatggggtgcagggcagtgaagaagcagcaagctgcgaaggctgagccatacctggaaagagtgactgctaagtgcgtgtgtccctggaggcatttgttccttcacaaggaaatggttgtgaactcaaactgggttctaattgtcaacattcaagggagttggcaaaaagagtcattattcaataaactataccaaatactacagtatgtgcctggcatgttgtagatgctggagacacaggagtgaacaaataagcaaagcccctgccctgtcactgcatttctgcagaaaagatgttttgcttcagggaagccaaatcgctcaccaggagcctggccccgagtccactcttggggtcaacacccagggctgcccagtgggctgtgtctgctgtccccccggtcctagcccacaggctttttgaaatctccagtgtgctcgccatgaggaaagcaggggtgaagtctgctgggcagcctttgtcatgtctgtgattaaggacgactcttttctggaaattaaaatgagcagtcctgctatctcaccgtacaatcactggcatagtttacttttttattctgtgtctggattttccccctggggctgcagcagtaagcctgcttccttggttcaaagccagtgtgtgtttctgcaagaaagaacttctggatcagcagggccccttaacaggctgcaagctggctcttgagagggagcaggcagccaaacaatatttggcctgtccttcccctccatgccagccttagttctggttcctgctcagtaggcaaggggcagcccaggacttcagagggaacctgataacttgtctttgtgtgattaaggctgggtagcagagcccactgagaaccagctatgcttcaccataaaaatagaacttagctctgggtaccagggagttttaataatgtggaaaaatgcttatgttgtcatgttaagtgaaataaagtagagtcctaagcaatgtatacagtgtaactacaactctgtaaacagagagagagcagaaggaaatataggaaaatattaatagtgtgtggctttggaaggtgggattaatatgctctacttggctgggcacagtggctcatgcctgtaatcccagcactttgggaggctgaggtgggtggatcaagaggtcaggagttcgagaccagcctggccaacatggtgaaaccccgtctctactaaaaatacaaaaataagccaggtgtggtggcatgcacctgtagtcccagctacttgggaggctgaagcagaagaatcacttgaacccgggaggcagagattgcagtgagccaagatcatgccattgcactccagcctgggtgacagatgagactgtctcaaaaaaaaaaaaaaaaaaatacgctctactcttctaattttctaggttatccccaggcagcatttataacttttataatcatacaaaaataaactttatattaaaatatacatattttgcatattttaatacttttccccagctttaagaatatctgataaaagaaatttatgttactctaacgagcagctgctatcttggttaattcatattttttcacaattaataatataaacattaaacagaaactggtgggagcaattgtccattgggtaatcagtgggcgaaactgcccatgaaatgaaagcaaaacaaaaaacaatatgaaaataaaaacaaaaaatccacaaactacatcagaaatgaatttcctctttgggacatgctgaaaaatatcctgggtaaaatcaaggtattttgcaattatttttcaagtaaatattgtacagagggacgcagtgatcaatgctgctttcctttactgctttgcaggcctgtctagaaactttagtggccagagaggcggcctgcaggctcagggataactgtcttgccaacaaggaacttgttaagttccttgttgcagtttcctactatgaaaatgtggggtagttttgtgggaaactgttagttccctagtcaatttctgaaagatctaagagaataaggaagttcaccaaatcgcaaattacggtggggttacagccacactgcagatttttacaatgtggtacccagagttgattaggatggggcccactgtatcaattacacttaacggttcgttgcatatagcagaaacctacaataacaaaggctcgaatacaagacattttattgtttcacataaaagaaatccagaggataatgggtctggggttacctggccactgctcatccctgctaactcaggctccttcgacctcttcaccctgcctctccccagtggtggccacccccagctgcaagggcgataacacacgtggagttgttctaggaagaattattttgtgcccagctgaaaatcaggggcttgattatcagggaagggggagaacacatgtggggttaggcaatcagcagtcactgccgtggccatgactggagcatgtcgaatgttctgaggcctccagggggtgcatggcagtctctcagtagtgtgcaacttggcctttctcgacccagaagcctataaacagataataaagcaataaattagctgccacacacagctcggtaccctacagtagaacaggggcaggataatagcaacagcaccaccattccaagaggagcagacaggaggcacacaggggcccctgcctagcaataaaccttctgagcatgcagtgggaggcctttccccctggttttctggtttatccctggggaacctctctactcactgtcctctggggcccctagcttgtgctcagagagaccctctggtctctcactctggatagctgtgtatgatatgggattagggacatgcccttagtggggtctgcacagctcctccttcccacttgctgctgctgaaggttggaggttccacagttgaatagtcgaatgcctttaaaaaaattgagatgtcgtggggcacagtggttcacgcctgtagtcctagcactttgggaggctgaggccggaggatcccttgagcccaggagtttgagaccagcctggaccatgcagtgagacctcagctctacaaaaaaataaaacaattagctggatgtggtggtacgtgcctgtagtcccagctactcaggaggctgaggtgggaggattgctttagcccaggaggtcgaggctgcggtgagtcatgaactcaccactgcactccagcctgggtaacagaaccaaacactgtctccgaaagaaaaaaagaaaaaaaagggagggcggtgaaattcaggtaacataaaattaccatttaaaaatgaacaaattcagtggcatttaggacaaccacaacatcgtacaaccaccacttctgtctggttccagaacattttcctcaccccaaaaggaaaccttgtactcattaagcaattattctcattcccacctccccccccagcccctgacaaccgctaaactactttctatctgaatggacttgcctattctgaatatttcatatcaatggaatcatgtagtgtgtgtccactttgcataatgtattcaaggcttgtccatgttgaagcatgtattaatatttcattctttttatggctgaataatattccaatttatccataaaatatatttttaactcatggtttctttgacaattcaggatccacaaaaacacagtcagcttctgacctagttgcttctcatcagctccctggctgcagtcacactgaattcttgccaagacctatgcctcagacctgctttattgcttttcttttgtgccccttccctcactctcatttgatggaatggtggctaccttgactcttcccggaacaccatatggcaaacgccagtcctttcccttcatctcattctgagccgcttcagaccttgaccactcaaaggccagcacagtctcatctctaatatttgggctttataagcagtcgacttttctgactttgcaaagccctgaatttctgaactctattcctttcctaagaacaacaattccgttgacttctaaacagcattggttgcatcaccaaggggaaaaaaataaaccaaaaaaacccaaaaaacccaaaaaccccaaacctctgccagttaaaccatgtcatgccgtataaagcaagtgccattacaatgtgaaaaagaaatatgcaccgcagagttgacgacgtgcagtaaaacagtaccgatatgaatggctgacattagttgaggttctacgctgtgtcaggcattgtgaatcttttgagagagatgtcagaattgttatctttcttttacagaggaggcagtggaggcagagtgaggttcacacccagcaaccctcactcagaaggcttctgcttgggtagagcttgcattggccaaacctcatccacttgccattcattcagtcattcagtgacaagtgtttatggtcacctgtgggagtgtgtgtgtgggaagggtggaaaatttccctcttggtgttttcaatttagtggaggagtaaagccttgcagcaaaatatgaaagatcattcaaacattagggactcaagtgaacgcaaaggagttggggaaagttccgcttaggaagtgacatttgaatctggtcttcaagacgaagaaggaatttgcttggagagaggggctggaggagaaatgagcaggctgggggtggggggagcacaggtgtaggcagggagaaaagaaaaggggcttttggtttgagaccctgcgaggaggcagcatggaggaaggggctgcagggagctttggggttggggagaggatgcagctggaggagtccctgatgtcacttgggtattattaatgtcaataatcagcttatatagaatgaccttctcactagaataaacagtcataactgtggtgctttaatcaacatgacagcattggagaatctactcaaactcacttgggtctagaggggatcagtttttccccagccaaagcccaagggcagccttgctcctctctccctcccctggctcatgttcctctgtgtacaactgtgtccctccagcccatgacctatagagaatgcagaccacccctctgccagtgttggagaccagatcccatggaagggcactcatgtccagcctggggccccctgccttggcagacactactacttgacaacagatacccctctccccttcttgcttaatttaaaaaaattctatttcagatggcattgtgtcagttgaaagatcacattttctagactagtctgcagctaggtgagcccaggtgatctagttccatatgtggaaccattatgtggaattttcagtaggctccgtcacggtgggaagagatggcgttacacatttttctgtcgtccctcacttcctcctactgtcaatatggggaatacggacttgctggctggagtgccagcaggcatcctgggctgtgaagccactttgaagatgaaagccaggctctgggatggtggatcaggaagacaggggcccaatttcctagcaatgctttggggctgcacccttggcctgtgcttcctatgccaggctacttttacatgaaagagaaaaagaagtcctgacttaatgcattgctgtatttttccagaaatgtgcagccagacctaatgataggtggtttagggtgggaagcagagtaagatgacagaactttaggaccacatgaagggaaggagagggtcccccaggaaagggtgcagtttgttagacagaacaatagcatatccgttacaaagagctgccatttgctgggcgctaagggcctggccctctgtgaacctcaccatctgcatcatctcacttcatcctcaccagggtgggggcatgaggactctctcatgaccagggctattctcaatttacaaatgaggaaacaaaggctcaggaagggctctttctcaaggccactgagttgggagctacgttccactctgggtctgtttgtttcagggacaaaccttgaagccacacaagggccccgagaaactgtgcagatgtgaaacccagagtggcccgatcagatctatgactttgtgtcatcacaaaagtgaaagaagcagttcacagaaggagtggagtgtgcaggtcagaggcaggaaggacaggcagacactgtgatgatgataggctgtgaagaggtgggcgatgcctgggatgggagggactgtgttggacccagtgctgacctgagaacctcctctcaggccctcagtcaggctggcccctgttagacatgagatttgactcactggttcccattaacagccactagagatgaatgcactctatcaagtccatgtctgattaaattcaacaactcaggagtagtggtcaggaagtgtgctgattttttttcaatacaggtaaagtttttaattatgaacttttcagagggcaaactcagattgcttagggtgtatttgtccttgtagtgtttttgagggagtcattaggggcatggaataattaagtgaaaattaagaagctatgaaagaatcactcagctaagaaacaagatggtagatcaggctccgtctgatctcttggcagtatgcattagaccaaagggttatttaggtgtcaaggattttgttttgccagttatcaagcctaagaaacttcccagttacatcaaatcaagcaaaatgatgaaggctatcatccacccttgcttacaacaaaaagaaaccacttataagttcttcccgttagccaaaactgaagaatttaaactgccttggctcttaataatagttttactttatggttttcttgctagtatttcaaatacatagtctgtcttcaccaaactagaaatagttgataccaagaaaaacgtgtttgcccggactgaatgatgtcattgcacactcacggaccatgcactctttagcagcacccatctaattccatgctgacctgccttctccatttgtaggataactgcaatactcagaagccggctggtggatcccaggcctctatcattcaattgccatcactgtacttggtggggcctcaaaggatgctccagatcccattttcctgcttctctttttgaaagcattgtctatgggtgctgcacccactccctgcagccaagctcctgtgcctcactcatggaggctgccggggccatctccctggtcaccatggcctccatgtggccaggtcagtgcatcctgctctgctcctgtctgacttgacctctcagcagtgctggcaggtggacctctcctgccttcttgatacgctcactccttggcttctgagcggtgattttcttggtgttcttccaacctcaccctcactggctgagggtgctgggttcccttctcatctttctccacatattctctctctctctctcatccaggccaggtctttaattccatctgtagaacattaactcttgaatctgcctctaatattgacttttcccaagaattctaagcctactcaacatctccacatggatatctgataggcacgtccaaattaagatggccaaaaccaaatctgggatttcacaccacccatctctgtaagtggcactcctcagttactcaaaccaaaaatcgaaggattatgcttgattcatctctctccatcactgccctcgaacccaatccatccaacaactctatctccaaaacattactcaaacaggtcctcatctttctgtctctgttacactcatcagaccccaaggggacccactgatctcccttggttccacttggtcctacacaagggcttcacacttagcagtaagagttatcctcagaggctgggcatggtggcacatgcctgtaattcccgcactttgggaggctgaggcagctggatttcttgagctcagaagttcaagaccagactgggcaacatagtgaaactctgtctctataaaaactacaaaaattagccagcagtggtggtgtgcatctgtagttccagctatttgggagactgaggtgtgaggatcacttgagcccaggagattgaggctgcagtgagccatgatcacgtcactgaactccagcccgcaacagagcgagaccctgtccaaaaaaaaaaaaaaagaaaaaaaagaaaagaaaaaaagaaaaagttgtcctcagaaaattcaagtcagatcatgtcactctcctgtttaaaagcctccagtgtctcctcatcacacctggcacaaaattcaagctccttccttgccaccttctccagccccatcccatcttctcttgctgttgcttactaagcagcagccatcctggggactcttacttgttcctttgtgtcttggggtcttggcgacagctgctctcttgtcctggaatgctgctgactggctcctggacatcattcagatctcagcttaaatggcacctctccagagtgaccttcctagatgacctgcccatctcaagtatttccctcctaccctatgctaattttttgcactgttcaattcactagcttgtacttttctcatgtacttattttctgtctcaccctcctagaatataagcttcacgagaacagggatcttttgtgccttcttcttgctgtgtcccaggacctgagttggagcttggcatctggtgtgtattcattaaagattagttgaatggttgagtcccaaacttactgtcttttgctccatgtgttctgatatcttctttattatggtctgctttgttgagtaatgtgttatgatcatcgagatttactcataggcactgagtttcaaaagatgatgcatatttagtgtatgattcatttatttaaaattctagacttttgactgcagcctgtgactcaaatactgtattggtggaaaaactttcaaatcatcaaccacacgtatttgggttttaccagctccatggcacatacgaaaaatagccagtacttagagattgttcttattatcatcctagacatttgtggatattaatttttaattcttatataaccctatgagtatgaaactcttatccccattttgtaaattggctgaatgtgtcagttctctaatgctgtgtaacaaattcctgcaaatggagtgacattaaaacaaaccccatctatgagttcacagttctgtggggcagaagtctgggcagactccactgggttctctgctcagggtcacacaaaccaaaatcaagatgtcaaaggggttgggttcatgtctggaggctttaggggaaaattgacttgcaagctcatcggagttgttggtggaatccaattccttctggctataacctagaggtatctgttttactgctggctgtcagctgggggttgctcttagtgcttaaagacctcccgaattcctgacacgtgaccttctcctgctttgcgtctctgacttcctcttctgctttcagccagagaaaacgcgctgcaattttttttttttttttttgagacaaggtctcattctgtcacccatgctggagtgcaatggcatgatcacagctcactgcagcctctctgagtagctgggactacaggcatgcaccaccatgtctggctaaatttttaattttttttataggtaaggtctcaccatgttgctagctggtcttgagctcctagattcaagtgattcttccgcctcaggcttccaaagtgttgggatttctggtgtgagccaccacgcctggccaatgccttgcttttaaagggctcacctgactgggtcaggcctactcatctattctccttattttgtggtcagttaacttggactttattatacttacaaaatcctcttgcagtattacctattattagtgtttgactgaaaaagcagagacaggaatcttggggaagtatctttagaattctgcccactgccctgaggttcaaagaagttaggtgatttatccaaggtcatacaaccagcagtggaaaccagattcaaatcaaggcattctggcccccagagtctatgaccttgaataataccctgcagtgtgatgagaatccagtgctgcattggaaattctgctgggcagattttctgacaatctgatgtagccatgcaggtgagacgcactgggctactttgttcataaggaccggaactatccatggtgccttgtctcctcactcccatcacctccgatgtaaccgaagacagacatgaccaaagaagtcaggactctgcttttcaatggattgaacccacggatgctgcaccattttccacgagtcagcagcaccatttccaggtttttgctgcccccagaacttggttacccctcaaatcctttcatcatcagcatgagtgaaatcaatgtgactcccattaacaagaatattattattgtgcacatgagaattaagcccaaaatgcaatctgtgctcacacaggtttgatgatggatggatgcagtggtgtgctggcagtgacttgttctgggttttggaactaatttgttcatctctgcccaactcactttcagtgagagcatgctggtagtttgcaattggcaattggggagaatttacactagagaaatcagcaaacactacaaatcagggtttgctttattcatttatatttgaagatgtgattgctaaacatttgccagcacacctctggatggatggatggtagatggaagcggtgagagccaagagagcttggggattccagctttcataaccagaagcatggacattcttggaatgcttatgggggtgtggagggaggacccccagcatcagcccaggagaatgagtcttgtgagctgggagatgaagtctctaaataagtgagaagggaggtgatttgagctaggaatcttggcaaatagccccagggcagaggcagaggggaggagaaaaaagaaccatcagagccaggaagatcagtggaaaactggaggcctcacagaaagcaagggccttgcttgagcagaatgatgcctcttgagtttcttaaaaaggaaaaggtaggggtaaggggctgtttaatctattaatacttcagcccactctcagcacccaaataatagggtgggtgcatcaaatcttggtagccatatacataagaatacttgtaggggttgtttaatttagggccttataaagacaataaaatgacttattgagaatcactaaaccaacacccaagtatttaatgaaaatactttttagctcatatagcttgagacaccaaactatgactatgtaaatagctataccatgtttatagattggaagacttaatgtagtaaagaagtagattctacacaaattcattgataggtttactgcagttcctttcaaaatccaagggggggacattttgtagatacaaatgaactgatactagaatttatatagaaaaaaaccaagaatagccaaaataattttgaaaaaagaagaataaagttggaggaaacatactacctgattttaagatttaacatatagctgtattaatcaagattgtggtgttgggaaaggaatagactggtagattaatggaacagaattgaaagtccaaatataaatgcacataatatggccaagtgatttcttttttttttagacggagtcttactctgtcgcccaggttggagcgcaatggtacaatctcggctcactgaaacctccctcttccaagttcaagcaattctcctgccttggcctcccgagtagctgggactacaggcgtgcaccaccatgcctgtgtaattttttctgttttagtagagatggggtttcaccatgttgcccaggctggtctcaaactcctgacctcaggtgatctgcttgtcttggcctcccaaagtgctaggattacaggcgtaagccaccatgcccagccagccaagtgattttttttacaaagtcccaaaaacaattcaatggaggaaagatagactttttaacaaatggtgttttattggatatcctcagtcagaaaactcctcaatctaaacctcacatattgtgaaaaattaacttagaattgataatatgcctaaatataaaatgtaaaactctaaaacttttagaataaaacaggagaaaaatcttcattactagagttaggcaaatattccttagaagacctaaagcactatccataaaaaaaagataacatcaactggatttcatcaaaatacttttattctgcaaaatatattgttaaagaggatgaaaagaccagatatagactgggagaaaatatttgcaaattacatatttgatctaaaaagttgtacctagaatgtataaaggtggctctaaactcaacagtaagaaaacaaagaatccgattaaaaagtggagaaaagaatgagcacacggaaagatgctcagcatcattagtcattagggacatgcaaattaaagctatgaggagacaccatgactcacatgttagagcagctaaactaaaaatactgacaataccagcaggggaaaggatgaggatcaactggtctctcatgcatacattgctggcggaaatgcaaaatggattgtatggtcactttggagaaagtttgacagtttcttataagggtaagcatacagttaccatatcacccagcagtaaattaactatttactttagacaaaagaaaaacttacatccatacaaaaacatgtacacagatgtttacagcagttgtgtttgtcacagccaatgtggaaaacaaaacaaatttccctcaacaggtgaatggatgaacaacctatggtatatccataaaatggaatagttctcagacatcaaaataaataaaatcccacaacatcaccaaaggagactttagtttcatctgtaatgttttaaggttttaagtagacagactattttcatgttctatttgttgttgaatttttaaaattgatgtttcttttattacaaagtatgaaaactacaagagcatatctctgtgcctggtcaatgtcctgtcatgtagatagattctccctcaccatagccaaaccctctctttgagcagtaggttctagccttctttctaccccaccaaattccttctcattctctcttgcatcatcaatttttctctttctaccaaattatttctatcaacaagtacacggatgggctattatttttcccatcttaacaaataaggaaatctctcttgacctcatttccccctccagctatagctttatttctagaaagcagtgtctgttctgtcttcaatttctttcccctttctctcctcactcaattcagagtttcaccccctcttccccagcaaatccttttttttgccaaatccatgtatacttttctgtctccaccttacatgacctttcagcagtgattatgcaggtgatcagtctctcctccttgaagcaccttcttcacttgcccttgaaggtcctacactctccaggcttcccttccacctcaccagcccttacttcccccactcccatctttgctggctcctcctcactccctgacctcttaaagctgcagggcagggctcagttcttgctttctttttctacgttcatttctgtggtgaactcatgcaattccctaactttacagactacattagatccaatttaagatgtcctcaattataagatgcaccattaagttaaagttccactaaggaagaagaaagcactgccaattaaactcttttcaaactctttttttttttttttttgatatggctctgtcacccaggctggagtgcagtgacagtcttgggtcactgcaacctccacctctcaggttcaagcgattctcctgcctcagcctccccagtagctgggattacaggtactcaccaccatgcccggcaaatatttgtatttttaagtagagacagggtttcaccatgttggccaggctggtctcgatcacctgaccttgtgatccacccaccttggcctcccaaagtgctgagattacaggtgtgagccactgagcccagctgccaatcaaactcttacatcctatcatcccaatttcagatgtctctttgttctcagagtccctaaactgctctggagtgagtgatgatgcttctccttcccagcacccctcttggggaacagggttcgcacccttccttctatctctttccttctaactctcttcatcacccagcctgtggaatccttatatgagcttgggatggtatcgcctgtttctacacctagctttgccacatatggttgggcacatcacaacttgtatggatttactccattgggttgtgcagtatataacctgtacaactatacattgttgcctgacttcacccattcctccaaggttttttatttttctctttataatactgtcttagtctattttttgttgctgtaactgaacacctgaggctgactagtttataaagaagataaatttatttttagcaattctggagtctgggaagtccaaggttgaggggctgcaactggtgaggggcttcttactggtagggactctctgcagagtcctgagatggctcagggcaacacacggtgagaggacccaccagagacggccaaagtggctttcatatgagacccacttttgtgataacccattaatccattaatttatgaatgggtccattcatgagagcagagccctcatgacccaatcatctccgaaaggccccacctctcatattgctccattgggatccaagtttccaacacatcaacttctgaggaacacatttaaactacagcaaataccttgtcctgaacttttgaaactttaaagcaagaaggagactctttagttctgtgcattcttccctgttatttcttgcctgaggcaatcgctgtagccttggggtttttgctccagttgggcacccctgagcttaccacggtggctagaaaaaacatgccctcactgacataggcctgggagcccatctaggagccattcacagtggcaaggggtggcccttattttgcatagccaatgagaagactcccctggctatgagggtggagtccatcttaaccaaatgtcaaggttgctgccaagggaggaggaatggaatgaatgtgggggaacccattgggtctactccacagtgtcaaaggcagggatagtattactgggatgaaagagacttgagcctgtgtttaggtctacagacaggaagcgattaaagacgttggaggaaagagcctaaatttggttaggagcaaaatcctagagaacaaatgaggtgtacgggggagggtctagatttgaaatgaaggcatgaaacttctcctggatggaggatgatgaagagacctgctttgaaggtgtaagcgaaggaagggatgtgagggcctctaacagtcttgtgtcctccaggtaggaggagcagcgcagctggagatattggtagtgtggacagcttcatggtactttctgggaagtgtccaatgtgtaattttaattggctcttttcattaaatagaattgatattattttaagagacagatcacttgaaaattaggattttgattcacttctcaaatgaagagaaagtgcctttgcctcatgtatgtgtgcagaatttgggagaatacatcatgagctcagggaatgtgtatgcgaagatgtttgaaaagtcacttgtgggaatttgcctggcttggtggttaggaatgtggactctgaagccaggaggcctgggctcacatccaggctttgcagccttgggcaggctcctgaacacctctgtttctttgctaaacagtgggcaggatatcactatttttggtatagacctactggaaggatcagaagacttaatacctgtgtgtgttttggagagttattggcacatattagatagttttactgtgaatcatcattatttataataattctctgacatgctggaatgtacactgtctttagaaatgaaatttgttttgttttcctaatttcgtgcaacctacatttttccagtgctattttctttggggaaagagcatgcagatgttccgtgttttcaatgtagcggtgtataaaatgtcatcattgtttcctttctggtggaatattaagagccagcttaaagataatctactcccagaaagttccatattagcaattatgtggggctggtgctcatatgcctcaatgaatgatttatttattagtatattgggaatggcctccctcttctcacactagcaccttttccccactttccagcccatttccaaatgagaagggctgaagtcaatcaggaattaagatttagcatttgtgggattatctttgaatgcgacactgggggggacacagtttcactcactctccatggtggcagtccaaattgctctttcgggaccctggctgtgtctaaagcctcagaatgatccagaaggctcctataacagtgccactgtggaagaaaccacttctaatatggcaggaaggtgtggccctgcttggagcccatgttttctaactatttcacatttctttctttcatccctggtgttattttttgaaattaatttttattttcagttctcctaggaattaatgagttaacttaataaaagtaaaagtcttcataaagaaggtaaaggctggctttccacatagagaacaaacataacaacccacatcctctgcagagctcctggtcaatgcattcttctagtggggctgccacacccctggggcctcaggcaagcaagccccttgtggatgacaggggctgggctcaaagcagtctctggggctgtgcctccttcctgttctccactcttttctctaaaggaaatgcactgcaatgaattgcacaatacagacattcctaaattctggaaaaccagcaggctttgaactctcctgggggaaaaaacccataaaacacaaaactgcaaggaatgagactatttggccaaatggccaatatgctacaactttcatagggaactcaccgcacttggtattgcctgatggaaaaaaatgccctgaatttcccaataaaatatttgagatgtggcaaaggaataaatattttttccctaagataaatctagctgtagatgaaaactgggtctcatgcctcggacaaaatattatttccttatttactctaagtctatatcagaatatagcctacacagcatcaggtactaagccaaaaaaggctccaagggcaccattgttcatccatgactttgactgtgtcaccccccagaaaccttgagttgggcagatgtaatcacagcagcctttggtggtttcttgagcagctgctaaggatcacatggattctgctcacacccagtgcttctcataatttaaaaatgcttgaagctgtgggaggctgcccagccctctgcattattcaaaagaaaaccaggaggcagcgacaattcttgattcttgcagataaacattctccaacaattattaagagttggattgctctaccttcatttaattccttggtgctttactatttgaatctagaatattcttgaagtctgaaagatggatagaaaagaggtaagtcatgtaaacttataaacagggcacgaaccccgctaacagacagctttgaagagatgatgattttagatcttgtgaattgttatgtcagaggaatacatgcagaagaaaacaggcaccgaaatagttattaccagagcaaagtaaatctgaacacctaaaagaataagaaaatatcttatgcttctctctactctgaactgccttgaaaagagcaagaatttcatacatgagcctgtagcacattacaaaatctgagtatgtatttgaaattcaaatgcacacaaagttcatgcattttattttccagttgttctcaagactcctaaataaagcatttcccctgtgtgggcgacccctgggtcccatgtggggtcagtgtttgggtctctctgagaggatcaggaaggctgctcttccaggaagggctgcagggaccctgggaaccggaccagtccagctcacaagtatgaagagaatgtcgggagaggaagtggtggctatgagtcagcatgagtcatctcgttccaatgagaatgaaggctgaggtgtgcgcctttttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccttggtgagtatgtttctgtcatttttagggttgcttctgcagtttgccttggagtctgggctgtgggaaaggctgctgcgtcctggtgaggacactgcgtttctttcagactttgaagatctgtcgttttagaaaagtggctgcctctgtcaccagccccatggttactgtcctttagtgtgactgtcaggaggtgtttctcagtccttcgttgtaagaatgtagatgccggttgcaccttctgttgtcttggaagagactgcagtgcttggctggaaaataagctgctcgggactcctctgagaagccaaagtgaagctcagagatggaagtgggtatacttgtgctaacccagggttgctgaggttgggtgagcttccgcttctccgaggtggaggagaggcagctcctgagccatttctggcctcgtggtcagagctgcccaatttcagtgtgagaaataccagagaggcagaactttggctgccttctctaaaagcatatgaatgattgcaggagcgtattttacgtcctttccttttccttaacgttgaaagtcacaaactgtagtaaaatcaggaagaacgtaaaaatgctgggggccagcgctgggggtgggggactggggaggactgaggagggggccactcagtctttgaggcctgacttgatcttgataggtatttctcaggctgttagtattccgatgaagcttagctttactgtcaagtaaaatacaggaaacatttttttttaatgttgttctagttactgtaaatgaaacggttaaaatgtcataaataccttatgataaacatttttcaaatttgcttaaaaagcaacacatcagtaggcagggtatgacagggagctttttcagtacagtcatttgagtgtgtgggcttcctgagttaataatgagtcagcacccaattctaaaattggagcagctaagagaatgttcaatctgctcctcagcacagcacggtggctggccggccccccgtaggaaggcttggggttaaaatcgacttaggatgccgcccttatgtaagtgaccagctcccagcttgggtcccagctcctctgggctactgctgagagaccccctctgctaagggatctgtctctgaggcaggagctaacacatttggcttccaacctttggctaatgttgacgatttttaggttgtcttgaggcaacaggttgaacatagtttctgaaatgaaaaatctagtgtttattaaggctagggcagctgagggctgagcctgcatctggagccttgagatgttccgcttgcacgtcaccctcgccgagggattgggcgggagagtcggtcaccgagtgaacttcaaagttggcgctctgcatgtgacgtgtagcgtgggaagattaagtcagcttaaaatgagagaacaagattccaaggaagaaaacctccccagaaccttactcgtttatagataaaagaagataaatattgagaaaattaaaaaaataaaacgaaatagttgggctgcaaaccagcagctctgggaccagatgcagccctggtgaaggcatcccccaccaggttctgtttggcctgctcaggattgtttttttgtgttgagataactgtgggtggggtccacactctccggatctcaggccctgccacaccctaatgccacaaagcttggagagtgcgattacagcgaggctcagaagccaggctgagggcctgccagcctcgtggggctgctgtgtggtccccatgggttagcatctgcccggccgccggaacagggcctggatggagaaggaactccatcagcactaactctgctagactctcttattaatctgccctctgaaggcatttgggcttgtggcccttgagttagttccatggctttttcaagaaagatcctgcagttccaatgtgagcagcagttgtttccaaggctaacaatttcacgccaactagaagcctccacaagtcaggtgccaggcatttctaagccagtagagcagctccgcttgtttctctgggtgagtcctctcagggtgagaccctgtctccttgtaagcactcggagacgtgccaccttcatggagacgggagccaatcaaaggcaaactgcgttagacagctcttccatgcggtatggacaccaacattcgatcatccttgtttcagagaaggtgccgggccccagacatgtgcttatcactgggtcccatggccttcaatcctttaaagggttttaaggtggctgatttttatcccagacattgatcatgttttttttcatgcagaatttgggcagttgtctggacattaggagttgagtcacctcctacccatgaggaacaagcctgtggggggactgatattatcacttctgtcatcaagaaataaggccgcaggcatccctgaatatagagcatttattaatcgaactgtgaaaatgaaacacagacagtgatgacagctggaagttggccaatgtcctgttgtcatattgccctcagcctagggactggcctgtggctcactgaccctgtctcccactctccacctctcatcagcaactggacctggtgcacctggtctacctcatgtccagtgttttccgcagtacctgactggtatccccacccttggttgttgtgtggtgagctcgtccctatgttggcaagttacttaattcctaggtgtcccgccttcctcactgtaaaatgagaaaagtcatagcacgaatgtcatgagtccttgtgaagattttatgattagcacacaagttacaaggagacacgataactgttacgtacgtactcattcgttcggaaatataacagacagcttagtatctccacccgggtccctctgccctgtgggaatccataaagaattgattctcatcccccagaagtgagatcccgcttgtgtcatcaattacatggcatgttctgcatttacaggacatttatttattaggtaagtggggaatcctccttggttctctccaggaaaacctggagttctagttatcatcatcatcatcatcatcatcactgtcatcatcattgacatcatcacaataagaactcccattgtattcagccctaaccgtatggtagcaactttatggtattccctttaacctccccccaccccaatatccatcctggaagatgggaaggatgataggtttgttgactcactcaaggcggtgggactctccagcaggtatcaggcacagcatctgcttcaaagaacacatcggcgacaggggagccccttgcactcactcaggacaggagaatcaggaaaagcagcagatctgcagggctttgtgtgtaatccaaccagactgatgccacaggccaggaaaccgaggacggttggcttcagacctaccctggagtggaagcagctggattctgtcctcacgcttcctgtctaaagccagctagagtaaatttctagtcatctagattctggttatttggaaatcatcacagtatctggagatgactcatattgaaaaaaattaaataagatacacttaaaacttaacccagggtgaacataacatggcctttccttgtcaattctgaagaagatcattcaagtttgtgcagtgccttagaagccagatgctctcttccattctgccagggtcctaaagaagtactactgtgtcctttagatcactctgccttgatcactctgtcccgtcactctgctatttcacctgtcagtgaaatacctggtatcgtcctgccaacatgaagcattgaatgctttatacgtctccatcctgattgtttaggctttgaatgctgagaagtatctgcactttgttggtcaattgtagatggtgctaatttgtggggagtttttcctgcaaattccccctgtgccataatccagaggacctccctctgcccccagtgctgtaggctaggcagctatgggcctggctcagggctgtcgggcaaggattggactctctataggttccgtttggttctggttagatcacagagctcaggcaaggaaaagccgacaatagatcagaaggaagttgagcgctcaggaaggaggagtgggcaggatgcttggtggtgtcagaggattccttcggattaaaaaaaatagatgttattgcactttgtgtaatcagaaaagctaaggttgacagcagatcttatccactgtggttttcctgcttatcttttgttttaggagtgataaccctgcgagtgagggcttctgctacagggtcttgtagctcttctcttcatcctgccctttaaaacatttattggactaaaaatcacaggatttttaatgatgacagaaaatgtattattttagctgttctcactggacaaatcacttacggagtgttgattaatacattgataagtttctatcaattcagctagatacaagggaaaatgtataaaatagcaagggctccgaaaagagtcaggcttaatttctcttgcacagaaaaaggattctattgctctttctgttccgtcctcaaacaggaagcaggttttctgggacaagggtcaacaggcagccagttcatccatctgcctactcagccatccttagcactggcttccttcctccaagttatcttatgcttcaagaaggctgctggagctcctgccatcacttctgcattccagacagaagagaggaaggaagtggagggcaaaaggcaaagcctcctagatgtcagactcctctgcaggcctttccttgaattcccagctaaccctttcagcctagtctttcactggccaccctatctgtaaaggagctggaggaggaagatggaggagtgaggcaaggccctgagatgatgcagagcaaggggcacacaagaggggactcaggtccaaggtgaaatagcagcaagcactctccctccaaaacccaccgcctccttatgaatccctttggccttgattatgccagtagataataggtatgtgacagttttagcttctctggcctttgatcaggttgatttatgtgaatagactccatgtccttggagatgaacctgttctaaaaattctaagcaaccagccatttggctctttgctggaaagtagcctggcttttgaagccaagtctggacagtttccttgctgcacctcaggactcaaaggacatggtcctgactcaggaagagctggctttgagggaaggggtgagtcatgaacccaagcacagcagagattcttggtgtgtgctgcagaaggtgagagtagcccccatctccctgtgccagtcttctgggggaaatttatgatggccttacataattgggcttatatgtgtttcactagaaagacaaaaaaaggtgagaccttgtctgccaattcgctaccacctccttggggtctaagagctaggctgtttgttcaaagctaggctcctttgtgtattaacagtgtgaccccgggcatcatccttaacccctctttgtcccaattccacatctgaatgatggggatgataatggtagactctgccacatatggttctgaggactaagtgaggccacatgtgcaaaggatccggaacagtgcctggccccaagtcagccctcaggcaacagaacagtgtttggattgtccttgttgctttattggatacgtgataagtactggtgaaatgcatgaatgaaaagaaatcccacttgattttaatacaagaatcaagcaagtgacttctgtccctttgaataccctcctccaagtggtccaaagtccttgaagctaccatctccttggtacccttcctgatgcttctggtgtgggcaatgtggttacttcatcaagtagaccctggttacagagaagttaaatgatttgtccccaggcccactcacaggagagagtactatacaatatcaagctggttgtcttcagcactctgttgtagagacttccagtatgcattctcttctgcttcctctgttgtcaaccacaagtccatgttgttagggacaacagtgtgcccagttaaaaaacgatatttcctagtctcctttacagatacggtggccaatgaaagatataggctgaaaggttagctagggattctagaaaagctctctaaaggagactgacatgtaataggcttagcattttgcacctgaattctctccttccccctgtctggaatgcagacgtgatggctggagctccagcagcctccatgaagccataagacaatgtggaggaaagaaaccagtgctaaggatggcagagcaggcagatggtcacaggtctttgggtgaccagctattttgcctgcctggagatttgactatttttggagccggatgcagagggaggtgggaaaaatattccagctgaaattcaacctgtaggagtatttttcagggtgtcagggtcacttctttgtggagctgcctttcaggtctctggtatagggggcaagggtcatggcctcatggtgatgcccagggaccccaggtgctttggtctttgcagaccactttcttatgaaaaagcagagtgtgactgctctggcagaaagataaatgtcattcaggctgattcattattatacattcattatcatttatttgtggttttcctctgattttaaaataaatcaaaattaaaacacttttgcaggcccctaacagtatcatgggccccatgcactgtgcccagcatgcccaatggacatgtaggccccaagagggcagagagcaatcacagaaggacttgccctggccaacataggctggtctctctaggggcagcttcggaattgtgaattacccagagctgcgtgccaggaaatgtggacctaactcttgcctctgaggaaggcaggcaggcttggtttcatgtactgttgatgagcccgacatcctcaatgctcactcgagctttggaaatgacaagcaggattttcagaacaggattctctgtcctgtccctgttttaatttcagcctccttattccccatgtaataattccccatactggctcaattatttgtttaacgggtatgaattccagtctataatgccaaggtatcaaaatgtgacgtacctttactctagaaatctctaaattatattaaatctgctccaagatcgccctgccctacctcaccctctctgcctggttattgggagattcaaattctgtcattattggggatcctttcttgtcataatgctccagatgtcatcaaacaaacttgggcttaggtgatgccaggaaacctgggggggagcatccattgtctgcggtggctgctaccattgcaacttcgacacctgcagtctcagtgtgtggggggctctgggagctgctcagggcctgctccagttggggtggaccccacacctctcgtgatctgtcctctaactgtaggctccgctgctggaaatgtgtcgctgctctcatggccactgtgtgagctcccagtctcagcaaatgcacccagcaatgtctgattgatagggcaccctctgtgggctttgtcctgcttgctgctagctgctgctgggcctctcccagcctgggcctcctgtctcagtctgaaggccaagagacagcagcgacagcagaggaggcagaaacagaaaactctccgaggacccggggaagtcacaaggtggcttcccaaactctctagtgcagcactgtctgatagaaccttctgcaaggatggaaaagttctgtatctgtgctggtcaaagcagcggccacaagtcacatgtggctcctaagcaactgaaatgtggctactgtgactaggaactggattgaaagttttatctaatttcagttaattttaatttaaatgcccacaactgcatgtggctaccaggttggacagcatacatgtggaacacagactcctgatctgggagccttgaaagatgagccgtcactctgatgaggtggagggcctgaattgagccctgcggtggcactcggcaggtcttcagaggggctggtgacccctccaaggtgcacagcccctgggctacgagcagtggctagtcaggttggggtccctggcctctgccacgagtggccactagtggaagcctcaatgtctccacttccagtgggctctcaggcctcacatgcccatgccagggtagggggcctgtcgaggaggatgccctggcacccagagcttctctgctgtttgtcctgagggttcccttgggctgggggcctcaggtgcagggcacatgcagccggactgtccagccttgtggtatttgcacatgaactttcctgcgtggggatagacagccttattcttgtttgtgtaaagccattccaggaactattaatagttagactggcataaataagcctcaggtttggttcttgttagtgtcctacaaatccctcaaactttactcttttggctttttaagggagaagatttacagtatgttcaggcacaattgacaagaaacatacaagttgtgcggagatgagcagacccagggccccaggcctgagcctcttttctctcccatgccctgcctgctcaagttaccttgagcacaaatgatgtccttctgtgtgtgggatcacagactgagacatggggctgttcctcccctgaagtcacccctcaagttccccacatgattttactcctggctactccccagtttgctgtagtttgctggaccatgtgaccttggaggggctcacaaggcccagtgatgaagccaccgccagggctgagcctcagctcagccagctacttaatgcatgcatagcaagttacttaacacctactgacctcagtttcctcacccgtaaactagaaatagaggaacaattaccacagagagttgttctgaggatgcaaagagttcttgcatgaaaaattcttaggaaagtgctgcacatagtaggtattcaatagcattagctatttagattggaattagtggctttttgccatttactcctgactgtaggagctgttctctgggccccagatctccattccagcaatgatctctctcctccaactctggcattggaggagtaccacaatcctgcctccacatttcatttgctgacacccaggggcagcattaggtgtagagtgctggacatctaagggaagaggttcaattgtccatctgtttagttatttactcattattcaatgaatgttaattgagaccagtcagggcagctgagaagcagtgcggttgtgaggagggctgttagtaggggagatgcaggtgctggtgtgcttccgtgtatgaatatggcagctagtgcagggtcatgaagagggaatcagggacactctggggatgttaaaaactctgttgatgtggaatcagaatccctgggccagtcctgccttcctcttgctagctgtgtggccatgatcgagggtcctctttgatcctccctgatacatgggcgaggtgacccacagtggcagatgcttaaccatccaacatggagtcatcatcattacttagacacccttcatttggaatcacgattctcagtgtgaagggcacttcccaccatagaagcccctctctgtgagccctcagagggctgtctaatccataagccctttccctcccaaagaggcagcccagcgcatcactgcaaagcgccagctgagaagacgttctataaattatccaaagcctattctctggcacatccatattttggacctagctctgcccccgaagtcatataagcatagccacgatgggaaggatggtcataactcaacatgcccattcatataccttgagcacatatcctgtcccagagactgctgaattattgcatgagccccagctccttccacaccaaagcccttccgactgcatggacctcaccacttctgttcaagctcttccttcttctcatggttcctggaaagattctttatgtgctgaggtgttcagctacccttgatcttgtgctgccttccacagcatctacttggcaactttccaatgtcccacttcaggtgggcacagtgacctcctttgtctggtttttggcaaccatacctatctgttggacctgggcactgcactgacagccagctgacctccctgcctctctgtgtgggaacgtgctgcaaagccacatctctctaattctgtgtgtgtgtgtatatatatatcttttagagacaagatctcactctgtcactcaggctggagtacagtgaagcaatcatagctcactgcagccttgaacttctgaactcaagtgacccttgacctcagcctcctgaagagctgggactacaggcatgtggcaccatgcctggctaattttaaaatcttttttttggtagagacgagcgtctcactgtgttgtccaggctggtctcaaactcctgtcctccagtgatcctcccacctctgcctctcaaagtgctgggatcattctgaatatgaggtggtgacttttttaaaaaaaacttttttttttaacctaagtagaactttgcattatcgttggtgttgtcttttagatttagcccatgtattctctaatataaaacatgaagcttcatgtcatctataacttggagtggtatcccctttacatcttcaccagaagaccacttggatcagtgaagaccaagagcagagacctgtgacatccactagcgattgtcttcactgttgccactatcccagtgctctcgggcactgcattgaacacaaatagctccccttgctgcacaagtttcactgatgggggtaaagggggttatgaaacgtatcatatgatcaaatatgtgatagtgatcccacagacaaatggagcgtgtggggatgatttagacactcagccagccttgtcttgatggatacccatccttctctgctgttctctctttcctccatcctcaagcacagggagcttttggcgaggttagctaacttcggggcagctgtgaattagatactggctgtaagttacctccaacatccagagcatttaaacgctcggctgtcaatgattgtcattttcattgtttacatatagtcacatcctcagtttgtggggtggatgcatttgattcaattcagatatgcctttcaagctggccctgctgagctgggcctgaaaggcacatggctcatctcatctgcatgtgacagtctctttgaagtccccagaagtgcctgctcagagtcatgctcgggagggaagaggtaaggcacagaatgagtacagactgccacccagccgcaggaaaggtgactgcacaccagaggttcctggtaaggaggtgactcacccgcgactgtctcacctgtccaaagtgtgtgtcacctgctctgtgttcacccactgggttcatcagaggggcacttgaacaaaacaggaatgtcactggagaggggaacaaatgctgtccccaagtccttccctgccgtttagagtaacgcagcccctgtccgcacatcctcacccccatctgccctctgcttgccagaattatcagaatctctcaattctaatttcagccattctctgtgaaaatgaaaagttagtggcaggcaatggacaccctattgaaatagaaattgttcttcatatgtcagaaaagtcccagagtaatctgggagtaatctgagcaaactgattcaaaggattattacaatttcttagtcttctactgctgcaaaagtggcactctttgattctcatgtttgaggttctaattactacctcatgcaggacttacaagagatcagccatgctgcttacattgtgtgtagtgaatcaatgttattctgaagggcctcctggaagcagtagggattggagaatgtatgtcttttaacatgatcattcccatcctatgggggttgggcactcttaactcatgttgcagatgagtaaactgaggcttttgagagtttgagggtgcacagcttgaggcagaggtggaattcccagcttcatccaagaaatcacgaatctccaatggcttgcacacatccaggtttgctggatcctatttgtcaagaccacatgcagattaggagccttcaaacaaattatttccaagggagggcatctttctctgtaacccctaccctggcaattctccatggcctcagggagtccagccggaagctctgcaatgagtcctggggaactctcatctggaaaaaggcgctcatgacaggtggtgccaaccttccacggatgcttttcagcatctcttgggatgaggatacagaatttctctttcaccctgtaaatgtggtaaatgagggaatagaatttccagctttaatttttctgaataggattcaaaaatgaaattgtataaaaaggtatccagtgaaaaacacacacccatccccatctcccatccagttccctccgtaacccttttcttagtttcttatatgtcctttcagagtttctttatgcaaatacagtataagcaaaaaagaatgggcctttttcttttcttccttattttccacaaaatctatcaaaatgggttttttttgttttgttttgtttgagacagggtctcactctgttgcccaggctggagtgcagtggcacgatcacggttcactgcagcctcgacctccccaggctcaggtgatcctcccatctcagccttctgagttgctgggactacaagcatgcatcaccaggcctggctaatttttctattttttgtagggacagggttttgctgtgttgcccaggctggtctcaatttcctggacacaagcaatctgcctgcctcagcctcataatgtttttttttaatgttaaaccccttcttgtgttgagaggcctggcttgtgtgtttgagcgcagctgcctacctttgcagctgtaaatgtcagggctccaggagggctggctgggtctcccctcctcccctgttgggtgggtggggccctgagcttatccaggcatccctaggtggatggatgggtggatgggtaggccctggccttcagggaatgcactgtgtgtggtcttccagccccagcaaagtctcagggggcccgagcgggaagtcgccatcctcagggggtccgagtggggagtcaccatcctcacggtcagccgtggtttcgaattgagctcccaggggcggagactccattcccccggggaacaatctgatagccagaaatgagagcagtgagtgacttggacgctgtgtgattcaggagggtcccagtccctcagagtcgcctggacaccagattgtatttacaaaacagatggatgaggaaatggagattgggtcttcaaaagaattaacctcagattttatttatttattttaaaaattttaatttttcccaaggaccctttccaagtcaagaattgttttaaaaagaagcctggtgaaggcaaatgctgtctgtggccgaaggcaccgtgaggagctgaggctgacttatgtttctcctctgggctatgtgcgcctctaaggagttcacacactttaacccccttaggaaccctacatgatcatcctcgtttcttaaagaggaagcagagccagcaaacaagtgggggagccacagttccagcccaggtgtcactgggccctgcctgccccagccagctcctcaggagcacacggcaccccacgtgcgtgcaggggacagctgtcctcacaggaacagccccgggacctacaggacttcctggggtttaccctcagagcacccatgaggttagaatcacaaagcccgggagtcaggagacacagggcagctggagggaggtctttactgaggctactgaggcacagcagccccgtctagaggcctccccgagaggcacttcctgaggagtctggtggattttgagctgctttttaaacaaccttctccttagcatagacactgacactgaagggaaagaaagcaaatggtctgttcttagtgggaaggcaacttgctttcaggggaacgagtttgggggaagaggactggtagaagacacgactaagaaagtgagtaggagtccagacgtgtgtgattcatcctttagggcctctgtgtgtgatgggttgacttgtgtgtcccaaaattcacatgtggacgtcctcgcccctggcagctcagacgtgaccttatttggaaatagtgccattgccgatgtaattagttcaaatgaggtcatgctggagtcgggtgggcccctgatcccatatcactggtgtccttataagaaggggaaatttcaagacagacacacactcagggagtacaccatgtgaagactggacttaaacagctacaccaccagaagccgagagagaggctggaacatagccttccctttggaggtagcctggcccggtgggcactgtgatctcagacttccagccttcagaactgtgagacaatattttattgtttaagccacttattttttggtactttcttacggcagccctagcagatgctaatccagcgtgcgtcctgacagaggttgaagggggcttctcaagtcccaggtccagcttggtgtggttcagctactcaagagacatctgctgctaatggatgagcagtcaacctggacgcaggaaatcattttttatttgggtgaatacaatattctccttttgttttcacttttcctaaaagttaaatcaaggttcaaaagaaaatcgaggttcaaaagaaaaatttggtctttacatgtgctaaaaagaaaaaaacaaaaagactcatttcatctttatatgggatgggatccgtgctctggtgggctacagagtgtgtctctgtgtgggtccctgtactccgtgcgaggttggcggccgagccacggttcccatgtgagcaggacagcacagtctcacctcacacagagaacctcgcccgaacatggaactttcacccacgttgccattttcccgctccctttccctcctttgaggttcacactcgtctctccaaattaaaatttacaaagagaggagatggaggctcccaagtggccacaaagtcacattttatgtgagacctttttgcctcatttgctagttattgaacaaaggtgactctgaacctagcagaagcacgggttcaacacacagttcagaaaaacaggaaccatcaattcataagaacttaaagaaaaaaatagtttaaagaactgagaagttgccacattatagtgaaagaatgttgggttttggaaatgacaaaaacgagcaatcttcaccttgaaaatccggtggagtcagttacacaagacataaccgcacacaaacatggcatttctgatagtataatggcatttacagtcaagaagcttctttcagagtatttcatggaaagttattttagtagcaagggtagccttaagcagtgagtattcgtcaagagagtgaaaccttgacttcaaagtcaagaggcggaggagtgaggactcagatctggaggcgacctgcagggcgggtgcccacgcacaggtgtcccagctgtggacatcccacgtgcacaggagtgggccaaagagaggcccatggatccctgcccacctcagaaatgtgagcaggcagctggggggcatttggactctagccgggacaacctagtggccgggcaggggatgcaggcaccacaggtcacagtggtttgctacgagcgtcagcttttaaaattttaaataatcctcttattgtaaaattgaggacattatttgaagcaacgcaaaaaccatgtaaaaaaatgtctgtaggatgtgaatagcatgtttctttaaggcaatatctgaagaaaatataaaagccccaggtgaaagacaccctgggagcagaggtgcccctgagggtcggctgccccaggacagaggagggctctgctggtgcccaggtggcactgcctgtcttgatgccaggtgcaggggtttagaagaaaagacaaggaagaaaataaaactcaccaccgacattcctaccactagagttacccactgttcccagtcaggcatatttcctcccaatcctgtcctctctgtgtatttggtaattgcgtaaatcatctctcccataattaatctcctttaaaatttggaataatatagttgttagaataatataataatcatgcagaataatttagaataatgttgtttagaacaatttttgtagtcatgctaccttgcagtcattcataactcagaagaactctgcatttagaaggtctatttaaaatgtgccttctttgctgaagagttagttttatggtaaaaatccaataaaattgtagctaagcactgaaaaaaagtaaagaattaagctcagcctccagaaatactgattttatatatatttgctctggggaagattggtttaagaagacctatagcctgttaattgcccttttataaattgcctccctatattttttgccctcttttcccctccctccctcctttattccctctgtctcttccctttcccctccctccctcccttcattcctttcttccttctccttttcttccttttttttattgttgttctgggggaacttttctaatatcctggattttaagactttgatatatatgctgcaaatactttctctcaacctgtcttaactttctttactgtgtcgtttatattatggaactatttaacttttaagtagttattattttccttttaacacccaggttttgtcttgcttagaaagtctgttcctacccctagattcgaaaaatatcctcacatttttttcttctgatacttagtaattttatttttggtttaaaatgtcaagtcaagtagaacttatttttgtttataatttgaagtaagggagtttcattttaccctaaatgtgtagcaaattttcccagactatttattaagtcattcacttttttcctgctgaaattatgatatttaagttgataagttttatgtgttggggaggtgtcaaatgggcagtttccagttggaatgtgggattgggtagagctttgacacaacgtctgtgtctttccgactcccatgtgacttcagggcaaagaggcagaggaatggagctcagagcttttagagaatatgggccagaaacaggaaggagtcaggacctgataacgggaaccagcggacagtgaacgcagtggagggccactggggccggagcagccgagagatttcaggaggtgagcttcagagagcctcggcataaatggatccagggtgtggtcagctcagggaaagacagacaaccagggctgagcacaggccaggccaggccaggcagggcccccggagaatcacgttttagtatctgcatattgagaaagtttgaccttgagtgtgaaatgtagacaagcaacccaaataaaaaataggcctgattggggccaaaaacaaaacagattgatgaaaataatctcaagagtaggaatggacacaacctacaagaaggagactgaacccaccaagtgtggcgcttgagtcaaatcaaacgattagaggctgccaagtcggcccaaaccccaagagcgtgggaatctgggagggcaccgagggctgggctgagagcctcttttcaaggaagtctttccaggatgctgtacttctgtcttgccaccttgcaggccttacagtgagaccatgaagtccctggcactctccctgccggacccgtggccgatgttgatatctgctcggccggcctcacaggtgtgcgcgctgtgcagtcgcttagggcctcccctgcgcagaaggtcctggcttggtttaatgccctgctgttaccatcttaaaattcttaatggtttttgaacaaaggccgcacatgttcattttgcaccgctttgtaattacatgatttaaaactctgtgcttttctcttcctttttattaaaaacaagaatgtcagaaattgcccctttaaaactgtaaaacaagaaggcattaaactcttaatatttcaggtcaaatttgacactgtctctggacatgcaggtctgggtattggtgggccttagcccctttcctgctgagcccagaacatgcttctagtcacctagcataggtctctagggggcctctgccacaaggcagggccaacgccaaatgacatgcagttgcctttgatgaatgggactctccaccactgctttatgtaaacagcaggtcctgatatatgaaatgtggcttcaaagcaacttaaagaaatgaagggtcaaggatagaatatgtgatgagattctgataccatggagcctccagccccatggcttgctgtgcttgggctgtgttctctgtcctggaagggtccacagagagggcaggctgccagcaggaggcctgcctgctccaccagactgatgacacttattccacttggttcccagaactaagaggtcaggggccatgaaggactagttgcaggagaactctctgtcttaatttaaggcatgctctgtggagtggggctgttgggcagcctttccaatttatccacccatccctgggatctcttgggattgagaaactgagtttctccagggttcttctctcaccactcatatcctgcaaccttagggtcctccctgtactgggtatcagcctggtctcagcattcagggactcagagagaataatcagaggtgcatttctatcactgtgaggaccttaggctcaggccaataatgtaaagaagcaccctacctgggagaaacttactgtctagttgtaaagaaagcaccagggggccatgatgcccatcccacccatgttcccacccaaactctcctaaacccacagctcccaaacaagttctggattgtacagatcaggctccagccaaggtgagctcactgaggtcagagcttacagaatctgggagctcaaccaacatgatggcttcagagatgaaatacccagcacatccagctgcagttgccccataaggagcagaaagtttgctatcacttcctctgtactgtttttatgttcaggtgacctgtgggtcagttgttcgtaatgtggtgatgcctgtaaagggagcactggaggtcagggggtgccagtgagtggaggagaccattataaatactgtgtccccaaagggtgtacagtcaaataaatatagcatgggaaaagccaggttgacccaagagaaacatctttttctaaaaatctgcaagacttctcagagcctttggtcgtgcattttaaatatccaaatatgtgttttgaaaatatgtgaaacagcataacatttgtggtatatgttaaatgtagatgatggtggaactttctgtttttttcttagagaatttcatgggaccaggcttccaaaaaacacaaatgttttgaggacaaaacatatgaatattgtagaagattagaagcgataaattactataggcagaagataagtgacattggattgaaatttttaaaatgggaaaataattacaaatggaggagtggcatggtcagaggcggagtgcaggtgcctgtggcacatctgggctcactggctcaggcaagctgcggtggagcagaaggctggggacatgtgtgtagagtcccaactgtcagatcacagtgttgggttgggtctttcacctgcaggggcgtgtgtgtgtgtgtgtgtgtgtgtgtgtgtgtgtgtgtgtgtgtctgtgcacatgtgtgtgtgtgctgcttagagtttttgagcaaagtttggaatgatcaatgtgcagctttagaataatgacttggtgggaagaattgaagtgaggaaacactggagatttgtagccctcctagaagtcactttcagcatggatcttggtgtggcctggaaggaaaggacctggcttgtgggaggcagcagcagaatggacacatgagagccacaatcaagacagacgtggcagggtgaataactggctgaattgtgaaactctaggctgcccatatcacactgacattttgagaattcagaacagatggcaacacctgggcccctgcctgtgcagatgggccagaaaaacgtgacatgtgtgaaggtgggcatggggtggcagcagtttctctcgcccaagcattaagagtgttacagagcagaactgttattacggaattggtgaagcacctctgggggactccctctccttcccccaagtatatgttggctaagtagccaccaataacaaatggagacacctgcatgctcctgcagccactgcagtgtggccagctcctctgctgggctatacacgtggagatcgtgtaagtgaccagggccaatgtctctggcagccatggagaaacaggtggcccagcccggccctttcactgcccgtgatggacagcttgccatcgctggtcaatagctgcactcccagatagtattaggtaatatataattaataaagaatattccagttgatctggttcttttaaaacaaggaaacttcttgctatttggtacccacaaattccactactccctgaattgtatgtcctgaaatctcacaaatttgcatgctgacattgttaataaaagaacaggagataatttaaacagccctgtggtttggaagtcacaggttctgctgcttcatgttcatgcacgagactaagagcctttgaagaagatcacttcctagaccaaggctttatgtttggattaaatgcagctcctccagatcatctcccgaggagattcagccagcctctgttctctctactatccccgtcttcttgcctcatcccatgcacacatttatatgtgttcacatttatgcatggacatgctctagtgtgccctctagtgcagacattttatgcatgaaactttaacccctcttgcatcaaggcatataagcagaagagatgagtggaaagattttagggcttggaagggcaaacgtgatagtcactgtacattataaagaacaccaaatgacagtgtgctttggaatatactactaggaatgtttctgctttgcaattggaaagtaatgacattgaaaagaagtgaaaaaaatcacaggtatataattcagcaccaaattgatgaggacacagaggtgaactagaaaggcatcccagcggaaaccacttacagccccataaaagcaagatctaagcaatggggatataaaaaaggaagggaaattgatgaagatgacttggggtgacgtgacctggagtttagggagggacagggacttgccttggactcactatgggtgctcatgaaggaggcagcatttggacaaggccctgagaggcaggtggatttggatgtgcagtggtggtccgggtgtgtggagtgggggtcagcatgtgcaaaggcatggaggtcagcaaaccaaggctgagagcacaagaggttcgctgtgtgtcttccagctgcccagtgagcacatggaggtaaaggtgcacaacttggtaagcgacaggagtttgtgtggatcaggcctgctgtgacataaatatgcaaatgatgtggtccctcgtggtagcaccctcaggatgacgcactcttctaccaaaacatggctgaaaatttttggtgtgtgggggtgtaccctgggagcccatttagaagctacagtgaaaagagccctcattgcttcagctttgagccatctgggccctcccacctggctcatttcacctgacagtttctaaaacttctcacaaggaatttgtcggtttattacacatccatagaatgccctgaagagctattccaaaagaagagcttgaaagtcgaacgctaagcagaaaaacagtgacttccaaaccacagggtttgttcgaattatcaacttagtcctttattaacaacttcaaggtgcaaatttgtgagattccagacaggcagttcaatgagcagctggattttgctggttcccaagagcaaggaaaattcccttgttttaaaaagccagatccatttggaatagtctttcttccccacatattacagcatgaacgtgactctaaagtacctgccgagggtctttctttttgtgacggtgggcgctgttccccactgtcgtggacttctcacagcgctcagtgtgcattcggttgcttctctccataacgcctctcagctaactgtgctgtttctgtgctcctgggttgttaatgttcaagtcttggctctataccattttccttatcatttaggattccactgggaagacatcactaagttgtgaaatcaaacttcatgagttggctgagatcatagggttgggtgtcctctgagcacttgcaggctgggggaagacagaaaacctggacaacttgcaattgtttgcaacaaagtggaaaaactaaagtagttttgatatgtgcattagtttgcttggactgctataacgaaatactacttggtggcttaaacaacagaaatttcttttcttacagtcctggaggctggaagtgcaaaaggaaggtgtcggcaagatcgtttttttctgagagctctctccttggcttgcagatggcagcctgctcctggcacagtcttttctctgtacgtgctcatgtctgtgtcctgatttccttttcctagtagggccagtcaaattggattagggcctaaagtaattatctcattttactttacttctttaaaggccatatgtccaaatacagtcacattctggggtgctagaggttaagatttcaatatataaatttgcaggggacacatctccacccataacaatttgtttttcgtaatacgtttaaaatacccatttctgggctggatgcagtggctcatgcctataatcccagcactgtgggaggatcacttgagcccaggagtttgagaccagcctgggcaacatagccagactctatctataaaaaaaaatacacacacacacaaacttggccagatacagcggtgcacacctgtagtcctagctgcttgggggactgaggtgggagggtcgcttgagcccagaagtttgaggttacagtgagctatgatcatgccactgccctccagcctgggcaacaaagcaagactgtgttacttaaaaaataaaataaaacaaaaagacccacttccatttatttcacccatggataaattgtgtagcaagtggttaggtgaaatgtgaaatgtctggccaattattgtcatcatgctcaattatagagacacagtatgctcccctttgcattcttcattgctgattctgtgctttacatctggcagctacaaaaatttagtattttgctagcaggtgcatcaaatctatttttggtttcaaacaatacactttttgttttcagcgattctgaccagtagtcaacaattgcaagtatgtggaatgtgattctcctgctttgggaacaagggagctcccagttttgtgggcaggatccgacattcccatcataagggcggcctcacctgtctgtacctctgacacctcagtcagagcccttggagtcggctaggccagttttggccctccttactgagacctagtcattctgtagacatacttcattctcccaggcttgggcttctggttcaacctgtggctctgtcattatcaccagaagatatccatctggcccaccttctgtggcttttttcccatgcacctttcagactaaattgtatacgctcatcctccaaagggttggctgtctttggtggtattttggcctgagttctgccttggatttatgttttttgttacatatatatatatatatatatatatatttttttttttttttttttttttttttttttttgagatggagtcttactctgttgcccaggctggagtacagtggtgtgatctagattcactgctacctctgcctcctgggttcaagtgattctcctgtctcagcctccagagtagctgggattacaggcatgcaccgtcatgcctggctaatttttgtattttcagtagagacggggtttcaccatgttggccaggttggtctcaaactcctgatctcaggcgatccactcgcctaggcctcccaaagtgctgggattacaggcgtgagcctaccgtgcccagccttatttcataatttttgatcgtaattccacccacatgttctattcatgtgaaatttactaaggtgagaccaagtggagataaaaactatctaaacgaaaaacttaggtctctctttcagacttttttttggttttatggtggtaaatacaacccacttggcctttcccctgagactactggttcttttgtcactggagtcccagagatcagggtttgaactagcccaccacttactggtcatgtaactttgggcaattcagtttgcatccctaagcctcaatgtcttcatctgtaggatggaggtaaccataatgcctgtctcagaggctgctgctagtgttaactgtgggacacaacacagagtgaggcacagacgaggtatgcagaaaacatcagcttcgtggttttttactcttctgcacttgctgtagcattctgcaaaactattattcctttcctagactcatgcccaaagttacggaggacccagcaaccatctcctgcagcccctggaaacctcttgactcttctgtgatgtccccagtgatccagcagccctggccttcttttgatggcttgaacatttggtcttcattgaacagtttgtatattggaaacttgccagcctccatccacattccaacctccgtctgcatccctcggtacaaaatggttcaatctgtctacctcctttcacattccaccaagatattccaaggcccagggttcctttgaccacctcacacctaacaagttccctcactgtctctcactctcccctgaagattctaagctgcctctgtcctgctaaaactgtagacctgagaatgaagtaaggtgcttcaggtgaggcttgatcagcccagagcagaaaggggccacctcctcccaccctataagaccctattagtgcaccttggagccctttgcttggctggtggctacaatacacttctgttaatgacggaattccataacatttttccccattaatttctgctacaaaacacaaaagtcttagccaggtgtggtggtgcacacctgttgtcccagctactcaggagtctgaggtgagaggatcgctgagcctgggaggcagaggttacagtgagccaagatggcgccgttgtactccaacctgggtgacagagggagaccctgtctcaaaaacaaaaaacaaaacaaaacaaaacaaaaaccaaatacacacacacacacacacacatacacacacacacataaaagtctcatattttacacttatgaagttaggtgggttttttttgtttgtttctttgttttgttttgttttgttttgtacccaaaagtacataacctactactacctacctttttggtttttttttttttttgagatggagtcttgctctgtcacccaggctggagtgcaatggcgctatctcagcttactgcaacctctgcctcccaggttcaagcgattctcctgcctcagcctcccgagttgctgggattacaggcacctgtcaccacacctggctagttttgtatttttagtagagacaggatttcactatgttggccaggctgattttgaactcctgacctcagatgatccacccgcctcagcctcccaaagtgctgggattacaggtgtgagccactgcgcccggcccctttcctaaggttttctaaagcatgtttgtggcaatctatcttagaatcttgtcaaaggtaaatacaaggttcagggtttacggagccaccttctagccctttaagccaccagaattgctgatgtcttatggactcctgagaagtttgtggtggtgattcttagagctcagctcccgactgctggactgtcggtcactgggcagaaacagaactcagttctcatcacctggatgccgtttcatactctccaccctctcctgggcttcagttgccccacacaatgtcagtctctttgtgatggttagttttatgtgccaactttgctagggcatggtacccagatatttggtcaaacattatcctggatgtttctgtgaaggcactttttagcagattaacatttaaatcagtagattttggcaaagcagagtcataatgtgggtgggcctcatccagtcagttgaaggccttaatagaaaatgatgggctgggcgcagtggctcacgcctgtaatcccagtgctttgggaggccgaggcaggcggatcatgaggtcaggagattgagaccttcctgactaacatggtgaaaccccgtctctactaaaaatacaaaaaattagccaggcgtggtggcgggcgcctgtagtcccagctactcgggaggctgaggcaggagaatggcgtgaacccaggaggcggagcttgcagtgagctgagatggcaccactgcactccagcctgggcgacagagtgagactctgtctcaaaaaaaaaaaaaaaaaaaaaaaaagaaaagaaaatgacgaacctccccaaagaagattggattctgtcagctgacccaaactgcaacagggactcctggggtctctgcctgccagcctgccctgtggattttggacttgccagcccttaccattgtgggaacctaatccttaaacaactcaatctccactaccctcctcgcccttctctctctctctctctcacacacacacacacacacccacacacacacacccacccacacacacccacacacacacacacacacacacacacacacatccaattgattctgtttctttggagaactctgactaacacagtctccttctcagtattaatgtttttttcttggacagaaaatatagataaaatagaagtctagaagttctgttttctctcacgaccaaattcttctatttctcttttaacccattcagatttgtgagtcccggagcgtgctttgccagggctctgttgagttccacagtgcattgagcaccactatgtgggaggcactggctctcaacaggcagcaggcaccttttccctaatgaactgtctttccaggtttcactcaagccctttctatcagacttctaccatgcagctctgccaatttctttaagcatctctcccttcttcctgactgtcctgaccaggaaactccctaatctctaatatctaaagtcatgaagccaattgcatcattagatgcgcagtatatataaataacatttacttacaagaatatttttatagaaatgtatgtaaacatacttacatacatttctataaatacatttaaattcctaaagacttgtttgagcaatttaaaaaaaaaatgctccagtttaacttcctactacaattaggaatttggggcagggtgcataattgccagtgtactcacagtgactgcaattagaatgtgctgtggagtcagaggaactgcctgacagtgccgggcagttgaccctgggctgggttcagagctctccagtggccactgagaagtaggagagtgtttcctgcacaatcctgatttcttgggggaggaggtactactgcacgctgctgggaggagcctctgaaactctcctgggccaggtctcctcccgtgcttcctctccctgaggcagcctcacctcttgacgcctgtccccagcacacccttctgtagctttcctctgactcacccctctgtgtgtctttctctccaactcggggtcctgtcacctaggcctctctcctttttcctaggtggctggcagttgctcttcccttggttttctctaatttgatctctttcccacccttccagtctgccacagtcacccttgatatccgcagaatccaccctccttggaagggatgaggaagggggtttatataactcaatttcatttgtaatgtttcaaatggtattttttttctgggaataattggcgctggattctgaactatctttcctgttgcaaagaatgaaatcccttctaggtgatggggcttgatctttctctgttgcaatagcagcgatgtccaaaacaatcaatcagaggcattttctaccgtacctgagccattcagtggtttcgacctctgctccagattacccagggttatccagatgggttaatgcgagtccttagaatggtgtttcccaccttgagagtgggttgttggctaggtgtgtgggggagctgtttgtctacacctcagaaacgctcacaacagcaggttccagggaaagtccctgggtgtccagtaaaagctgggtcgccctccctagggggctctgagactagcagaactgatggccccataatttgagcacaggtatgcatatttcttaggggttggtgggcagactcattcatgttcccatcccaggggtgcaggggacccttctcccttccccacatcagcccagggccacagaagctcctcaggaggcaaggaagggaatggagaggacaagagtgcctacagagtgggaaggagacaagcattctcaggtatttatccagggtaagggcaagggcttttctgcagtccaggacattagaagagtcctgaaccaagaactccacccctgccccgatatcagctgtttttattgactgagctgttggagaacagttttggtgtgcggaaacagtgagatccctaaccctacacccctgaacccagcagatatatccacactgaccagaaaggactggctaaccacaagcctgcctgtgcatggcagggaaaggaaagccattcttgagtaaatggtgttcaaaggttgggcaatatatgtatatggtgttctcctgtggacataattgtgcacaagggtcagaagaaattgctttcattgggcaagctacttaacctgtctaaagctttgtttttttatgatctgtaaatgaagacagatcctatctcatggctctgcacgtcacacagcgatagcagacaggtaattaggatgcaggtagttagcagacagcctgggtgtactttagctgttcaagtttcctcaacctggcctcctagccatgacctttcacagaggtgcaaatcatctatgagtttgcacagaatcccctgcaaggaaatatgttcttgttcttgacttacatttgagttggttggtcttacagttaaggcggaggtcatcactcttaataaaggccattttaagtggagtgacaagtcactaagggacttgttggcattgtttacttcttatccagggctttccaagaagggacagtgtgtctgagtttttatcttatgaaggtttcccacctgcagtttagtttactattattctaagggctgtttataaatgaactagcttgtctttgcactcagggtaattcacagatttgtcagtgacttcattgcagctgtgagctttacacgaaccttgcaatccgccttgaaaaatgaaactgagtataagtggggaccaaggaagaatgtttttgagggaaatagaaattaccatcctaaaaatggttccttctgtgtgtctgctgatagaaacccttgacctctttagaaacaaccgcaaaattattcactacaattatctgaatctcataaataaaataatgattacagctgcatggaattattcaggtctaaattcatataaacatatccctaacaaatttatttatcatgacaggaaaggaaagcatagctttgtgcaccccatcccacaccctccaccccctacaaattttactaacactgtttctgggttcagaatttttttgcctgagttggtacctcaaatcacttgagttaaactgcaaatgaatcacacataatgcagataaaatgacttcatgccctaatttctagaacgtgacctgaatgtgaactagacattcgttttcctaaaccccatgagacccaggtattcttgacatgtgtagagaggattgaaggggcccgaggctgtctgtcctctctccgtgggcctggctctccttggaccaaatcgaatgcatgggaacacaccccccagttgtctttttccttcggtttatataattcctggcatgtgcctttcaacactccgtttatgttagaagtttggtattagcctcggggctttactcttgacactgctactaattctctactttatattcgtgattgcccttctgaaaggagaatcttgtttcaaaattgcacctgggcattttaaagtaaataggatgcaaatccttagttggcctcttgtgtacattaacttcagagtgaagaatgaatatgtaagacagtgatgggggatggggagttgagcaaggaaaataatttgcataatggtgtttgctccctggtgaaactgaaacccagcctgtgtgggtggggccttgtttccaaacgtcagcgctgctgcccacgaaggcctgcaccaacgcacggtgccctccgggccgcccacagaggccggcgtctggccaggagcaggggctggggacagcaagtgtgaaaccagctgaagcacctgcagctcaggcgggctgcaggctccctgctctccccctgtgaagaagcacacattgttctttcttcccgcacatttgaatctctcagtggggtctcattttctgtgacatggcaaacctcaaaaaatgggagtaaatcatttctaaagagcttagctaggcatggtggctcacgcctgtaatcccagcactttggaaggtcgaagtgggatgattgcttgagcccagaagtttgagaccggcctgggcaacatagtgagacctcatctccacacacacacatgcgcgtacacacacacgagcgcgcatgtgtgtgcacacacacacaaattagccaggtgtggtggcatggtaattccagctactctgggggctgaggttgggaggatggtttgagccagggaggtcgaggttgcagtgagctgtgatggcactgctgccctccagcctgggtgacacagtgagatcttatctcaaaaaaaataaaaaaatcaaaaataaagagctcctgatttccatcccccaccgagaatcattttctgagtcagctggagtgtttcagagcccaacacccaaggagcagtgcagggatggtgcccagttacaggggacaactcagctctgaatgttacaaagggcacttcatggaccaccaccttttctctgcttgctctgtacccctaaagtactacaaggcatttttggttaataataatttgaatactatgtgatcttgtagattctactgcgtttggctagctaatgtctctaagtagcaagatgatttattttttctggacaataccaggactatatgctgatacaggactggcttgctctaaggatcagattttccagtgtaaaatatatactccttatagggttgtaagagcagaagcccttcatagcctgtttctttttgctctctcttcagccagcagttggcctggatctttgctggtagacacagggaatgttctccttgacgagtggttcccaccctggcagcctcagatcccaccatgttggcagggatgctgaaatccacctgcctatcagcctttgtaaataacaaaaatcacaagtggctctagcatttatgtattctatgatattgggactcgtgatataaataatacaaatgcttttacatgcataattcaatttatactatgttttatctttaattactggataataaaaacataactactctcaggaagtgtgggggattgtgactcaggctaaggtgagcctcacagcctggaggctggctttagtgctggctgggagagctgcaaggagatggcatatgctgccgatgaaggtgttctccaggaattttcagttagaagttttgatcattgttcatttggcctcaggatgaacatcatggtactgctcttcattctctataattaatatacttttcaccgtcaactttgcatttgaaagtatttattttatgggaaacagtgaaaagtagataattagcacatgtgcaaatctgtttggcatttgtggggtgtttgccctgaaaacctatggatgaagcccaaagacaggagctggggggtttcatttagttaacttaaaagttttaattggtctgtgttactcttcttgttacatatttttttaaggccctaaggtgagcaagttacattttaaaataaggaggaaaagccagttttaaaagtagaattgagtcattgcatgtgttttttttcccacaaacattagctgtgtgattattatgtcccaggcacctaaggaatagtgcccttgtcctggggaagttcacagtttggaaggggagatagttgggaaaggtaatgtgaatattaacactcgtgtttcctgggggccaaaatgttccagcttctgggccaggttaattatctgaattatcttatttcatccttacattgggaaccagatgtccccaatgcccttcagtgatttttttggtggctttgaggaaaaatgaggcccagagaggttatgtaacttgtccaaagtcacacagcaggtagatttaaagtcaaacagttagctcccaatgtgcacactcttaattaccatgccactaaaccagactctgaacaaagcactctgggagcacagagaagacctctgagggtctgtctgtgtgagtctagggcatgttcaaagttaagagctgatgtttagctcagcaggaaagggctggggcacagtgttggatacacatatcaggtggcatttattgctgatgacagtaaaagaaaagtgtaaaacaagataatttgtttacatttcaagatacattaagtttttttttttttttttttttgagataagagtcttgctcggttgcccaggctggagtgcagtggcgcaatctcagctcactgcaacctccgcctctcgggttcaagtgattctcgtgcctcagcctcccgaatagctgggactacaggcgtgtaccaccacgcccggctaatttttgtatttttagtagagatggggttttaccatattggtcagtctggtcttgaactcctggcctcaagtggtccacccacctcggtctcccaaagtgctgggattacaggcgtgagccactgtgcccggcctcaagatgcattaagttttaaaggcccctggttatttctcgtcttctgagatgtcattccagtgtgacatggttaacatcagtgaggatggcattcctgtcccacacagtaaaatgtcacctctcacacatgtaactctgggtgtaaagtgagtaaaaatatgagacttagaagaatatttcatcatggtatgctgactggggatttcacttactgatactagaaaggttttgcatttcagaacacgatgaaataggtaatatttatctgaaagacgcagacaagtggtggaggaaccagacacccccagtgccatttgctggcttttatcagacagaaagcagaaaggagaaacatgttttatcccatgagaaggaaatattggcttgatgcctaccatgcccagccttgcactagacatccaggtagctgctccatggagaagttcacagggtggtcaggatagcacagggaggaggtaatacgcttgagggaagtccaggagggactcagggagtgtaagccagtaggggggtgctcctgagaaagggaatgaggctgtgccttgaaagactgattagatagaggaggaagtgaagcatcagaggctgcccaacagaggcaggagctggggctggggtgggcaaggagaaaatcacgccatcctcctgtgtggacagtagagtttcatctgctgagggcagaggccatgttttatccatctctgtccccttctatgtccctttttctcctcccttccccattccctggcatcatattgggacttgttaagggctgaattgtgtcccatcccaaattcgtatggtgccaccccaactccagtaccttggaatgtgaccgtatttggagaaagggtctctgaagaggtaattaaggtaaaatgaggtcatatgggtggcctctaattcaatatgacttgtgtccttataaaaggagattaagagcacaccaacatggcacacgtatacatatgtaacaaacctgcacattgtgcacatgtaccctagaacttaaagtataataaaagaaaaagaaaaaaaaaggagattaggatatagacatacacagagggaagacccacatgacaacatagcaagtaggtggtcatctacaagccaaggagagagggaggcctcagaagaaaccaccctgccaacaacttggtctcagacttccagccatcagagctgtgaggcaatacatttctgttgtcagtctctaatactttgttatagtagctcaagcaaactaataatccagtgctcaacatatttttgttgaataaaagcacaaagagattcatgagaagagggaaatgttgcatacttagggtaggagcaaaccacagaggtctttctcagcctgggcaaagaatgtcaactctgtgttggagccagtagggagctctgtgggtcctcgagcaggaaaatcccatggcttaagcagtgtttcaggaagactgggatgttaggctccggagctctgagcaagtcagatgggactgggagtcataagaaggcttgactgtggctagtgataaccaatgagcactggaaacatggaggggaatctttcctcccttttatatcagggttctctcctagaggagcaggtgaggacctctgatggaccaggaaattggaattctgcctgggaggcaagcccatggaggccctgatctgcttggacagagagtagctcccttcacctgtaaaatgagagtgaacgagctggtgtctaaggaattcagaatccacacccatggagttccacagggtatgtgggattttagggggaccagggtgtccccagtgcaagaaggaggctcccaccaaggggctgcagcactgcagataacccccaggggtatgaaaagaggctgaactgggggcctccacagtcagaatccatccattgacccaggatgccaggaagggggaggcccatgggcagcagaggctcaacgaactccgtggcctgacttggccactaggttttttcagctcttcagccactgcctgtaggaggctagctggcattccttccttggcccttagcttgcatggatcggggtttcacgttaaattctaagcccaataacatggctctttttatttaaactcagtgctgcacaatgatgaatgaatgaatgaaagatcagggcagatgaactgtcaaacctcagcagttgcccttatagttagaggtgtttctgtgaagcaaatcaaagcttatagtatcaagaactttttaaaaaagtacactttgatccaagttggatgttatttctaagtgtactcagggtgaacacctcttaaaaccccttattatgtatgctgagctattctgaacctcagtgagaaatcagtaatgtcaagaaacctatacataattatttgttataatataaaaatccagagctcttcaagcattattctatcctagttggtcagattctgcaggaatctgagcctgaaggaaaataaattccttgagttgaagaaatttgtgtcttgtaaaaaagctgaatgagaaataacgttaaaaatggaaggaggcctaatgatgatattatgccatctcttgtcattacttagtcctctgttgtttcagtcatttaatctggttttctttctggatgctttaacttccatcttaattttccttataattgttgtgcaattataaaagacaatctgagggacccgccttgacagcctggggtaatatcactgggagtaggatctctcagaatgctaaggagcagatgcactaagagagctgcatttcactccattttattggatcttttggtatatacgtttctgtgactttagttcaatgggatggactgttgcataatactgagggctatatgaaggaggagtcgtctacacttgtaaaaaccttcttctttaggggtgggtagtgtataattgcaaaggcatttctgatttaattaagagttgtttggttggccgggcgtggtggctcacgcttgtaatcccagcactttgggaggctgaggtgggaggatcatgaggtcaggagatcgagaccatcctggctaacacggtgaaaccccgtctctactaaaaatacaaaaaattagccaggcgtggtgttgggtgcctgtagtcccagctacttgggaggctgaggcaggagaatggcgtgaaccctggaggcggagcttgcagcgagcccagatcgcgccaccgcactcccgcctgggtgacagagtgagactccgtctcaaaaaaaaaaaaaaaaaaaaaagagttttttggttacaagtgacggaaaactcaattcaaagtggtttaagcaaaatccagagttttaccatctcatgtaagtgaacaatctaggaaaagggcgtcatacatacagctcaaaatgaagtcaagatatttcagatctgtcttctcctcctggcccagtttttaatgctttgaccccattctcaaataaactcaaccctcatgatcccgaggtggctgccatttgtcctttcaggtccaaatccagcaggaaaaacttttgtcacagcattcctgtaaaaggtatgaggttcgccctgattggaccagccgaggtcacatgcctacacatgagccaatcacagtggataaaggactgtgatgtactcattaatttacccgccattatctccactcctgtcctgagggtggagttatgaagcttgctaatggggcactaggatgtccactaggttttactcagtgacataggtgacccactaaatttaagcatattggtgtgcaaaggaggcatttgttgacttgcaagtagacacctctcacttatttgtcacactcgctcttccttttgtaagcttcctgggagagggatctcagtggctttcaagatcaccccttgcaaattaggcatcatgcccatcattccatcccctgtgtgagatggcggcagaacagttcctattcagacacctgccctcatgcctcttcccccgtcctcccagcagccccagctcctggttcccagcatctagctccttccttatcagcacagggagttgctttttgtttgtttgtgtttgagaaagacttcttatttcgtgcatgcacatttcctttctgtgaagcagactcgggagctttgcctttctgacttattctgtgcatcctatcagtgaagtcagtgagtggcttcaaaaatgcttgctttctttctttttcttttcttttcttttttttttttttttgagacggagtttcgctcttgttgccctggctggagtgcagtggtgcgacctcggctcaccgcaacctccgcctcccgggttcaagctattctcttgcctcagcctcccgagtagctgggattacaggcgcctgccactgtgcccagctaatttttggtatttttagtagagacaggatttcaccatgttggccaggctggtctggaactcctgacctcaggtgatcctcctgcctcagcctcccaaagtgctgggattacaggcatgagccaccgctcccagcattttgtttgtttgtttgtttgtttgttttagacagagtctggctctgtcacctaggctggagtgtagtggcgtgatcttggctcactgcaaccttcacctcctgggttcaagccactctcctgcctcagcctcccaagtagctgggattatagtcacccaccaccgtgcccagctaatttttttgtatttttagtagagactgggttttgccgtgttggccaggctgatgtggaactcctcacctcaggtgatccacccgcctcggtctcacaaagtgttgggattacaggcatgagccaccgctcctgacccaaaatacctttttctttttttttttttttttgagacggagtctggttctgtcgcccaggcaggagtgcagtggctcgatctgggctcactgcaagctccgcctcctgggttcacgccattctcctgcctcagcctcccgtgtagctgggactacaggcgcccgccaccacacctggctaatttttttttgtatttttagtagagacggggtttcaccgtgtgagccaggatggtctcgatctcctgacctcgtgatccacctgcctcagcctcccgaagtgctgggattacaggtgtgagccactgctcccggccccaaaatactttctgatgctgataaaatgttttgtctactcttatgcccaaggaacagttcctcccttagcagaagttagtggttaaagcttcctctatgtttgccagtcaagaatgccacagggccagcctaagtgtccatgagtggatgagtggataaagaaatgcagcacacacacgtatatacacaatggaatactattcagcttttaaaatgaggaaatcctgacatttgcaacaacatggatgaacctggaggacattatgttaagtgaaataaattaggcacagaaagacaaacaacacatgatctcacttatacgtgatatagaaaaaagttgaacttacagaagtagagagtcgaatggtggttaccaggcattggcagggatagggtaatggggagatattgttcaaaggatacaaaagttcagatagataggcgaaataaacttaagagatctactgtacaacatgtgactctagttaatagcaatgtattgtattctgaaattattgagagtaaattttaattgtcttcaccataaaagataagtatatgtgaattagctcaattgagccattccttaatgcttatttccaaacatcatgttacacagtaaatgtaatagagtttttgtcaattaaaaaaattaccaaaaaataaaaaatgaattccatagagacgttctctccaggaagggtccccttcctagatctgactactggttagggttaatcaatgccccttggcaaaacaaaaccaaccccacatttcttcatctcccatgtccaagacacatgcagtgagttctcagtgtttactaccagcacacaaatgatggctgctttattatttggtgacctttgttgtttgctgtgattgttctgttcagttttagtccctcacagcactttcggccatttagaaagacagtatttgttctgctagagcatttgcaatctgtttctgattagcttaactggtcttgaccagtgctaagttcacacttcagctttgatttatgccgtctctatctgcagatatgtttcttgttacactatacaagaggaggcctcttcttattgacttcttattttcatgtgaacgaggtaataggtatcaggaataattagacaaggccatacgcgctaatgtcataggagactgagatatggagagtaaataataacaaaattcctgattactagggcatagaaaaaaaatcataggcaactccccaagttgataatcccaaatgtctaggcgtccttctcaaatagggaaacgtgacattaaaactactcaaaataaatgagactcagtggtatttataaccatagataaaaaagagcaagggtcctggggaactgtgccaaggcccagccctttgattcacaagtatccacaaaaacagactgtacgggctgctttcaagagaaaatgtggccatcaaggtcaacactggaagccctatggccactcattcattccatctcattggccctgagcctttcgaaaagtaggcagagaagaagcccaaagaacaacatggcaggcaggttaaggaagaaagcagagttcacagacatcactaacaatttcgtaatgacctcatgacttcgctggaaggattccagtggaggcgtcaccagccctttgtccacctcttaggctgagaacctcaaaggttgcccacaccttgaccacatactttcttccttttcttacacaatcaagctctgcaccaaacattagggggacatttgcattttcattatattcatgcgtatttctagcaaaatacaaattcttacaagatgttgacttgtacagtgtggcaaggaatactgtcatacagttgtgccaaaaacaagcccatttacttatttttttaaaaattaattatatataattcttataaaataacaaattccatttatttcctcttgatctctgtcatcagagacatttgaaggtcggaggtgggttcaattgaaagacataatgcacttgacaagttgttgtatgtgtgcattgtgaataggccttaacagtgcattcatttgttttattttttcccatttatacagacttttgttctgctcttagataaaatactaataaacaggaagttgaaaaaaaaatgtggtgcaattgttctgaatgttgtttttcttgcaaggctttatgggctacaccacaccatcctattcaaagcagtccctgtaggtggtggtgttaataaagaaatgaggctgcccagggccgcctgcctgagcctctctgcagctgctcacctcctgctgaggcctctgccttcagagctagtggggcctgctcacacattccagtagtttcctctttatttgtcctgaaccaagttgtagaatttaaaggaggtgaagtaaggcgatttctatggaaaatatatttttcttctttactcctcatgctgagtgcataagaatttattatttcccctgaatgttcaaagtggtgtgtgtgtgtgtgtaaaagaaccaggagcaaacaatcttaataggaatgtgcgatcttgtgtttatctttagcacacttaattagctacaacccgggactgttgccatttgaacaagttgttaagaaaatctgccatgttttgctcttttttaaaaggaatgactttaataaccatagcaacacttactcagttttgtgatccactccaagattatgggagcaagaacagatactcctgaaagcaaccctcacctcctcccccgccccctgccctcagcaagtcctggcctgtgtgaactgaagggtttggaagctctggtttctaggagtgcccagaagctagaaagactagggtgtactagttattgaggggcagttgtcagtggcagtgtgggggcaccccagttgttattcgaggcactgcattgcttttttgtctcctctgtaagcatcctgcctcagtgtcagggcttgcagaactaggcctggagttatgccccctacccaaccaaggctttgccttttgccccccactatggtgccacctacttgggtttcccacagttggtagtgccaggcaggaagcaggagtgcaggttgcaggaagggagagcagaggaaacagaagttgcttaggagggagttgggcaggctctgtccccagcagatccaagggtccctgacaaagagaacacctcacctccgcccctccccagaggcacacagaatgccccctcccaccacctccaggctgttaattcacacccacccaggctgcccccaggctccccagacctgtgccagtcaagcctggcctgtggctgtgacacctgcattaccccagacggttgcctgacctaggcctgtccttctatctgctttgtttttatgttgattactaggtgaagcacagtgttaaaaacgggaagaaaaggctaggaatgcagttatgggagtgtgaggctgggttggaataggtgggagaaagtccagggctgagtgtgtggaccctgctctagggatctgaccggctcaagctcccaggccattaaacaaagttgttaatgaaaaaaaaaaaaaaaaaaaagggagagagtaaacaaatctctcctctgttattctgcacctggagaaaagtaaaccccttgggcataataggctgtcaccaattagacatccgggaaaggcttttctgggtttagcccttttggggaagcatgggggtagatgtaagtgtgtgaaccttcacccaagttctggagaaggattccagagtgaaagaggtttccatgctgagtcttgcatttaagggaccttccatggcatagctgcaaagaaacctgaattgcccaggattaaccacctttcctttagacggtgagcagtgtgtttcacgaacacattacacattttagggttgtctatggaggtatcggcactttcattactatttttaacattttattctctgttcagggttaagaacttcacccacctaagtcagctcctgatacaacatggaatgttccagcaatgaaatgtgaacttaagatatttggattaaaaccccaaagttgagtcaggtttaaatattctgcaagaagcagtgagctccttttgtctatttgggcacagttttcgtgaattatttaggcttttcttagatgcctgagctccgtggttagacagcagataagttatttttccctttaatgctgaggcattttcactgatttcagtcttactcattagaaaattctgtgctcacccacagctgccagggtttctagaacacaacaccctaccttctcctgtagacattttagtccgtcctcgctcctgcactgtggctttcacagtcaaatgtgagttgaccagccgtcatttgtgagctgtgagcggtatttttggaacttgcccacccccgttcccccagagtcctgtggaggtcatgctcatgggttctgccaccgggacaggaaagtttggacattactaccaaaaaaatgcaacgtgactaagcaccgtttaaaatagcctttcttattctcttgtaaaattgcagggatttccatgacagatgtcgttttagtcattttaaaacttcagcgcgctgaacctcatcagcatatttttatttttgacatttcatattttagagtggattgaaaactaatttgatccatttcaatttggaacatccctcaaggtcattttaccagcatttaggccagtgttgatcttgctttcattttaaacatagttattttctctctgtgaagtgattactccttgcttggtgtgtggtctggtgacttgttaatttcaaaattctacgatgcaagcgggtttggacgtggagcctggcccggtgtggccaggctgtggctttgcccatcgcaacggctgcctttgcctcaaatggctcgaggctggcacctggtcaatatttgcttttgtccaaaagaaggaaacagtaggggacttgggtggtgtaattttagaactttactgttgggttgttggcttgaaagatccattctcttctataaatacagatacatatttactcctccaacctttccctccacacaattaagaaaccctacaattaattatgccaaatcaagatttgcttttctacatgattttttcccttttccctaggaagtctgtaatgaattttcttctttattgtaatattttatgtttttatatacacttgtatattcttatagcacatatatgtatatatgcaaactttctgaggcttctaaaaaagagaaataatattggttgattaacctcaatttcttttcaatatcaaatgtgtaacaataaccccaaaaggagaggtttcagaaattaaaacaagttgacatttgcccacttctgaattaaaatgcagcatttgacttttgtactgttttggctgtcaagccttagttttttcacactatcaggtattttcagatcaaaggtaaatatgatttagaattatatttcaaattagaactgtcatatgcccacacatacattttgctgatatacttacaaactggtaaacaatgctctttaatcaacaattcataatctgggtcagcgatttttatctccatatttgctcatactgtatgacatcaatattttatattggcttgcccataacttaatattttataaaagcctacctatgaaattcatatttcatatttgcttggctatgaaattaatttttgtgatgctgcagttcaccttgtagcatacaaattgagaaaattagcaagctgcatgtagttccttgctgtacaaaaacaaatgacacatggtgtctttatcacttgttttgtatttacagataaattttaaaaataaaacttgccatttctgttaacgtggaaaactccccaccccactcccattcttgttgactcttttttatttttaaacaacaaatacataatcaacttcagtcatctcattttcaggggagttactcattgtattttctacttacagtcaccggggctgatgttgggatctgtgatcagtttcctgttgttacgcatagcttttctcagcggtgagagagacatcatgtacagagtacacacggagggttgagatagcagcctggtttatcttacttctgatatgacttttaaaatattgattttaaaagtgtgtctttgagtgtaccaaaatagtatgtccctgatgcttctcgctggatgcaatccctgcgcaaatgctttctatgcaattagattttggggctcagcttccattttttaaatctgtgaaagcattgatcatgccagcggccctggagagggccactctgttttagtgccatttacatgtatcaggacaggacagaaaagggacagcatattacaaacaaaataaaactataatcttgttcaatccttgtcatgctgaggatgtttgtaaatataaaaaaaattgtatggattccacttacatgagataactggaggggttagattcatagagaaagaaattagagcagtggttactagtggctggaggcaagggggggaatgaggagttattgtttaatggggacagagtttctgtctgggaagatgaaaaagctctggagatggatggtggtgatagctacaccacagtgagtgtacttaataccactgaagagtacacttaaaaaatggttaaaatagtaaattttatgctatgcctattttagcacaataaaataatacacattcatggaaacagggcatttaaatcattatgcataataaagtgagaagctagttgtgatttgcaaagaattatagaaattatagggagaaacacaatctcaagagccaccctggagtccagagctctcgttttacagattcaggagtggaggctcaaagaatatatgctttcttaatgactggaacccagacggcaggacccccacacagggctccttgctgaccctttgctgccttcccccctcccttagaggggccattctttattctgagtaaacgtgccactgattagatgggcttcatgataaagacctgcagtaaggacgttttaatcctttaatctagacggttcacgagttccactggtgtgtctctgggggcaggctcccagatcacagactggttccaccgtgccccgtgacctcagcgtgccattagatgggaggccgttatttcaggggaaaaatcatgtttgaaactaagtgggtccccggcagtttgcagcaacactggctgctcaaaaggacagcacgaggcttttcacagcatgtagatgccatggctttatgagagctttgagcttgggagggtctacttgtgcttttgcaaccttagtttagatttcatttgcatctactatttgtaagtgcaccatttttctacgggaagtatgtatgtgagaattatctacatgatttttgtaggtggctcacaaaacaaatgtcagtagccattctatggccttggagtatcatttcccacaccttttctatggactgtctttatttttgactctaatacgtatcccttatcatacaaaaagttcttgagcatatttgatatattttaaaacttccaccccagtggaattaacactaattatatttaattccacacaaacttttgtcccagttgtagaccatttacctacttcctgacagcaaacactacaccgctgtgaaattttattttaacacatttgtgcccattttcagcattaataatcgtgtgtggaagtggcagcaaaatgaagatatcgcctgagcatggaaccacaaatgcctgaacgtgtgatggcatttgtgaaacaaaagcatgacatactttttctttccaaatgaggcagtgccacaactaaaaaagccagttcgcctttcgctttctaaaatcatcttgctggagagaacggttatcaaatcccatccactgcccatgtaaaataaataccattcagaaaagcgtggcatggatggccatacttctgatgggtttataactgtagattgcatacgatcccaacgtgaagcctgaaatacgacattcaacgtcaggcttattccaggctactgctgtggctacttttgtaattcaaccagtggggcgttttaggctaacgtatattgcctctaagctgataagcattttcctgatcccaggccccttctaaaattgaacacacacgttcagctggggacacctagatggaaggaagggaaagaggagaacccgaagtgaaggaaaagtcaccaagaacagtttcatggaaaaaaaaaaaaaaactctcaagaattaagaatgttgagttgcttgaatggagcttgggcaggaaaaagaccataactctcacacacgtgaaggttactgatacccaggaggtaaaagaagtatttaacatgctctaaagaagggtaaccagagtaatggggcgaaaccaagggaggacgtcctggaatgtaatattagaaataaacttccaaacagggaagtgtccatccgagtgtgaaatgggtttatcagaaacaagctgcatgccagtttcattgacattgcaaagaaggttagaataaaaagctaatgaacagaaagaagaaagaggcaaacagggtgtgtgttgagagtggtggaatatgaaggatggtgcatttgtccaggctggggctgctggcctgaggaatggtggtggagtttttttacagagcatcttctgagcaccaggagagtcccggaagctgagtttgacactagcaagacctgccctgaattggggactgctggatgcctggaagctcccctacacttacgttcctgaagttgggctttttatcaccttaggactatggcttcccaaacttggcagtcagcgtcccggcaaaagcctctctattactgcgaggtagtgtttatggagtcacagctaagaattacagaaaaaatcataataggtgaatcttttttttttaaaaaaaacaacattttttgactttgcaaataaattgcagaattatcaccattgttgaaatattttccattaaaactagagtttattaaaagtgcctggaaggatgccccctgctgcctccctgagtcatcgctttggatttgttcttcagaggcagagatttatttccatagcaggggttttcagttttgtgcttacagtcccgcagtaagtcttactggcttcatcttctgacctgcttttaaaacagtcctccaccgtgctaggtacacaaagggatactttttgggtttttttgagacagagtctcgctctgtcacccgggctggagtgcagtggtgtgatctcagctcactgcaacttctgcctcccaggttcaaacaattctagtgcctcagtctcccgagtagctaggactacaggtacgcatcaccacacctgaataattttttttttttgtatttttggtagaaacagggttttgccatgttggccagactggtctcaaactcctgacctcaggtgatctgcctgtctcggcctcccagagtgctgggattataggcgtgaaccactgtgctgggcccaaagtgaaactattataacaaggtaagagcaacttttcccagagttaaaggatggtgctccatggaatagtgaaagtctgggaccaaagcaccttttccctttaatttctccaattgcttttaaaatattctatgcaataagcatctgagtccaaagggaggctgtgtcttcctctagggtctctctgaatgaggtcagtttctatgttaacttttacgcttccttttttgtctcatcccaaaccatttctcctcttgtcatcctctttttcctcctccttttccttcttatttctcctgttgccttttttctacctttttattttttgccaatatacataaaattgcttgttaaaaaaagatcaaagacagcatttttatatttttttcttaaaaaacaatatgaagggctgggcacggtggctcatgcctgtaatcccagcactttgggaggccaaggtgggcggatcatgagctcaggggttcaagaccagcctggccaacgtagtgaaaccccgtctctactaaaaacaaaaaaattagctgggcatggtggcgcacacctgtagtcccagctactcgggaggctgaggcaggagaattgcttgaacctgggaggcagaggttgcagtgagctgagatcgctccactgcactccggtttgggcaacagagcgagactttgtctcaaaaaaaaaaaaaaagaagttaaaccatgaaaccacccataatatattagtcttcagaaagaaaagaaaaccaaggtaagatgcaaataacagaagtacaacttttatttttctaattgtggagtgactccaagaggattctgctcccaccaggtgggcgataggcgtcctgttggtggcgtgtaaaggaatggaaagctaccacgacctggggggtccaagaggggctgctgcaggtagcctacccccccagccttccccatgaccacagccacccactccctcaaagtgggacttcaggccaagcaggggaagatctcaggcgaggagaaacagtccatccgagagctccctgggagaatcttgtagactacacgctaatgagataggcctgtcgccaaaggtcacctccgcactgtcttggccacaaatgaggcctgaaatcctgctattagagttgcacacacacaggagcctcctctgggagttctgttaaccactggtctgggagaagagacggcacagatggcctccccagtctttccagggcagagcggtgggggcgggaaggaaaggaagtgccgagtagttcaggagagggggtgggcatggggttggggggcagcctggggacactatggccccatcctagcctggtgggagctagaggaacagggaaagtaagtctaaagtaagctagactcaggaaagggaaagaaaactctgcgtgtctttttttctttccttcttttcctgacacacatagtcttgtgctctctctgggctggttccactagtgcagcgatgctatgggggaggggcccagggccctgataacaggtgggcgtgtgtcaaatagcaactcaaccaatgaatgaatgaatctgcctctcctacctctccggacagttttgaagtttaggtgaaaccatgtgtacaaaagctcctgtgaactgggagacactttgcaatcccaaagtggttaataataaaaatagtaatacttttaaaaaatcataacaaataataataatgctattggaaccatcaatctaatacactttttttctgtgagagacttattggattctttccttggcatgaaagccctgcttctcccaacacaggcaggctccctctggcacagggtgattgcatcatagacctgacccaacgtgacagagaagcggttctttctgagttaccaatggccatccatctttcagcaggcgtgccttcccattttccttgctctgcccatgagaattttcagcagaaccttggattaggtgtgccagacatgttctactcttgattgtgaagattatacacactctcaccttctgagataaatgttattaaattggataaacaaccttgtgtagttttgcttttctgttttatctcaagatcctgctgacatggctaacagggcaactgtgaaaagatttttattcgtgtctacatcagtgtgaaaggcttcatcctggtgtgtactaatcactcagacagtggtatgaataaatgaaggaatgcattgacaaactaatacacaaggtgattccggaaaggcgcacctcctgggataaatacggtgacagtggtgagtctgctctaggtctacgaagttcttgctcttagtagagatccagacacccaatgttgaagacagttcctctttgctttagaaagctttgtgtgcaagagatggcaaactacttcttaaaaaacagagagtcccgtaaacatatgccaaggtccacggtgctccaggcagggtgcttggtgccagagagacagagtgaactgagctggccatggcatctgtcctggagaagtcacactccaatcaggaaggcaggaatgtgggccagacctacagcctctggggaagggtgtccataagctgtgaggtggtggctactgactccaatggcagagaaggtgtggtaaaaaggcaaggacatctgcaatccttctctaactcttgacttattgttatctgcagcaggttaaccacccctctgttaacttccttctctctaatgaggatattaagagtagttgcctcagaaggttgagcaaatttggtaatttacacaatgtgtagttgtcccttggtatccatggggaattgattctaggatctcctatggatatcaaactccaaggatgctcaagtctctgatacaaactggcataatatttgcctgtaacctacacagatcctcttgtgtactttaaataatctctagattacttataatatctaatgcaacataaatactatgtaaacacttgttatgatatttttattggcattatttttattgttttattatttttaaatatttcaatccatagtgggttgaatccagtaatgtggaacccacagatatagaggccaagatacctcaatgattggcagttccagcattgcccatctccctgtaccaatctgtgccaacctcggaactgtggttgagtcccaagctagggggtcggttcacaccatccatcccaccactgcagcagatgctcacccagcgtcaactctgaaccaaacaccattctgggcaggggcgaaggtgagaagcacagaccttggccctgctctcccctcctcaggagcccagcagagccagtccccacaggtgggactccactacccaagggaagcctgaggcatgaggcctgtgtgttgctcagtgaccgggtccatcctcccagtgccagagaaaaggaggtgcccctcaaaccacaaagtaacccttggacttctctttagctggggtggtggctgctggagagggccctgcttgctcatctctgccagcttcccagtccctgcaaccagcagtggccagcctctggccacccccatgaaagcacataaaagggttggggaagccgcaaccccagaattgaggtgagctagagtttgaggacataggttgcttttcacttatctccagcaagaaccatgttatagatcattggtacagtgacgattttatgcttctaattgaatactgatgaaaaatggcaatggtttctcagttacttcttggaaataaattgtgggtaaataacatctgcttaaagcttggaaacccagtttcctttggtttgtgtttttaaatgctttgacgatgcggtttgcttttttactccaagaaaaaaaaaacaattaaatagaggctgacaactaggtgagatccacagccaagctattctaagagcccgaagtcaccctggacacccagcttgatgacaaagggcagaaattcaatatggaaataggatccactccaaatgcaccatctccgacattatgatgaagagaatatgtatttcatgacagggcaaatgttgccatccttctgagggaagatgtaaatgaggatgcttttagggatgatttctacattgtcactaaactgagacatttgtgcttgctcgtgccaagtgaagattgctgttgctgttgttctctcgcagtgattagggttcattccctagcaacaggcagcagcagaaaggaagctttgcaggcagagtcaccgaataaacgcagtgggaacagtatcaacaacaaacccagtgatgaagggaggggcatgtggggcacaccacattgcctctctggcttctcgtctgcacctggggccagaggcaggtgggaaggagaccttgacaatgtgggaagtccctttgatttgctgaaatggaggagttcacattttactgtgcagtctaacattgcccattctggattagctccatcagacacgcttttgtgctttactgtaactctttctttatttgtcctcctcgaaactgatccataatgccaatttgctgatcagctgtccctgggacttcggtgtactgggctagaacctcagtctagtgttcaaaggagctggcagaatgggttgtctcggcatggaggacccaaaagcagagctccctggtgctttgggggagagtgaagcccttcattccactcctcattgcagaccagctttcctggtattcatgcactgctttttgtaacgcctcaaatgaaggccacagctcagccaagtagaagagagctcctaataaatgaagtctggttgcctttgaatttataaaataatcaaagttgctatttcctgctaaggagacagatacagaacaggtgataggccacagtcattactgtcccctgcttgttccctgagcccctggccttctaccttttctaactgctgtcagaaccctggttggggacttccttttgcctggttctcctgggcttgaatggcaacctatattgacagatttcatgccacagttctttttcaaacaagatgattcacaatggaataattgggtttgggaagaaggcctttttaaagcaaactatggaaaataattgatgagtagcgcagttttataaaacttttttttctattaccctttaaaaactatgttgctaactgcacatcacactgcattcatatcctgggactaataccccttgacctctgccatatgaattaaggtgaaagaagggtcataagtaacaaagtttcaaagttgaatgaaccttttttttcctgtaattttactgaccatttccctttctgtttgagagatctgtgcggtcctgttgctgaggttctgtggttcaggggtgttatcggcgacagagtgctgatttcacttgggtctgttctggtttgtcttaatttctcttttagagcttaattttcatttccaacgaattaggcaagacagaaagtgacatttggaaaagagtgaatggatgactaaacattcaccagacgtcattcttgtaacagttaaatggtagtgattcatgtctccatctcttgataaaatataaagcattaaatcttgatggctaaacacactgacaaaactaccgaaccatgttcctggttgaggatacctgaaggtcgacatttatctgggatcttttgctgctgctttggtatgacttctatcaagatagctttcgacgaggtagaacgtttgctttcactctgggttttccttggtttcgacaatttttaagtgttaactgaaggaaatcccgtcttgtcagaatgttcttttcaatacaaatcgcagtgaaataacgggctagaaagatgtggatccttcttgattttaggaagcacacacctatcggcaactctctctgcctggcctgtgttcacggcggtatttttgcctctgtcaccatccttgggactaggtacaaaaataggcttatgttccacgtgtcacccaccacttcacttcctttttaatagatcatgggtaaggaggtgagaggacatgagaaggattggtatgaagtaaataacagttaaatcttttcagccaggggtggtggctcaagcctgtaatcccagcactttgggaggccgaggcgggcggatcacctgaggtcaggagtgcgagaccaccctagccaacgtggtgagaccccgtctctactaaaaaatacaaaaattagccgggcgtggtggtggatgcctgtaatcccagctactcaggaggctgagacaggagaattgcttgaacctgggaggcagaggttgcggtgagccgagatcgcgctattgcactccagcctgggcgacagagtgagactccgtctcaaaaaaaaaaaaaaaaagagttaaatcttttcagatttctaggctggaaatcaacagaacaagatctgctagcagaagttgttacatctcaactaagtatagactggagatgaatctgacaacctgtgacatctttaaatgtcaaacccaccgcacatcacagatgacatcgtacctaatgatcaaactccctttaaaatatacttcatgtaaatacatttttgcgaaaccacaagctgtttctctcagttttgttttcagctggctttgataaggagattggttggcagcctacagctaattaagcagctttcaagccaacatcaatgaaaggttttaggtgactatcagaaatccattccactctccatggtccaccggtgtcgactatgcctttcaattgtgccgacagaccctgtcagaagagaatggtttcgcactaatccaagtttacaaccaaaatcatcctgttttcagtggtgtagatccagtgtctgtatctgtcttgtcaactcacaatagcattagcacagggggctggatttatgctctaagaaatgcaatttacctttctaagctcacttatatatatttgtatctaacatattgtaaatttcttaaacttgttacacatttaattttataactagaaatcaatttttatttatttatttatttatttagtggaaaacagaaaatgaagtgcaagagaccctcatttccggggcaagaattctgagttccttggcttctttcattcttgtctgactttcccccctccagttgcagttatttctagattttggtaaattattcattgcttttaaaagagaaaaagctcgattttctaaatctacagttgagctagccctaacctctaaagccagattgctttaacaaaattgtcatcattttatacatgacagattggcttcaaataaaatggtaaatgggaggaaaagtatattttgcttacacttaggaatgcctgtaaacgtaacagagtttaaaaaaaaatcttggtgttttaacaaatgcatattgtgaaaaagaggaagaaaaaattagctggttgcctgtgaagtaattgtgctaaaaacattcatttttaatatataagagttcacattttaattcatatacttgcaaaagaaaagtgggattttttttcttaaggctttgactatttaaggaaagcttttgtgctgtgccagtctgcttttaagaaattccagagttacagatacaattgagggtgaacttgaatttgttccgtgggcacggccttttctgttgtggtaaaacaaagttaaaatgacaacggttctgaagaaagtgcttcaagaccatgtcctgtttcactctttccagatgactaaaatcaccctcatttcccaagtcttacatcgggggaagaggatatgtggtttaaaagagtggcaagtactagttaaggtcaggctttttctgaatgtgaacattcagttatgctgcatgaagataggggcaggtattgcagagtaaaattctcatacagaaaatgtctgaaagtaacaaattaggtgattaccacggtctccttatccactgtcatctttaatcgtcgtgtttttttttcaaggctgttttgtctgtttttaaatgctgttgtcttatataaatcaggctacttgctttaaagtaccagaagaatcctataatactgaaaaaattgaaatataaaaaagtgaagtaagaattctgagtcacatgttttagatacggtgttaaacaacataacacattatcttgaatggaagatgttattaccttggtgctctcatcagttcagcttgcccagaagcaatgccaacctttcactgagaatcttttaaactgaccacaaatgtccctattcttctcaatgatttaaaatgtcctgtgctaacttttctatcagtcaatatgtatttttcagtgttcttactgagttttgttatttgcttttagttcttttcactgtttatttgctggtttatgttttatgaagaaatccactttcagaagaaatgatgacttattttctgtgggtgtttcctttcttcactactttaagaattttcaagtataaataaattgtgagaatacatatgtgtgcaaggagtgtggggaagagttaactaatttttaaattgaaatgagggaaatactgggctgactctactggtgtttttcagagtgttcctcaatttaacaaagcaaagcactgagtagtatttctttctaatatagatgtttaaaaacatcttccaaagtaagtagcaagaactaatgctcaaagtgttgtctgaaaaatctagaaatatctgcatgctgttatgaacaattctgtttctttatggagagttgtttgggctttttagaaactcattaatttgattgtaagcacctcactgttatcaggaaaagaagctttagaaaatggtttcagaatgtgtcattttctccttgttttaatctgagacagtgtgtgggcatgctggtattttaaaaggctaaaaatgttgtacatattgctgtgtcttcaaatatgagggaagattacaaacagaagttttcttcaagcctctgtctgaaattctgcttttcttctcagtagtgattcttaaatttttacggagagatctttcattcttttttttttcattttcaatctgttgttgaaattcagcaaaacaaatattttaaaagccaagtcagctttctaccgttttgatctgaatatttaatgctttataaaataaaaccctgtgttttaattttaactagtttcattctttttttatgaaatgatttgcggtattagactgtcatttggtttcaatattaatatataacatgaactacgtgggtgtcacttattttcagtagtaaataactgcttaaccgattactttactttaacatagttctactgttctccttgagcctcgtgatctgcatcttcaaacaatatttggtgtgtgtttttgcaaaatagcatttacatactgtgtcattaaaaactagtttcatggtgtcatggtggtcggaatcagggaatgtcgtgtagttggtttcaaaatccatcagtaggttaatcattaattattctttttccaggaaaaaactgatgaggttgtttcagaatttgaatttactagaattccttttttttttttgcattaaaaaaaaacttttgcattttaagcttaaagggggttaatttggtaagaaaaggtaccttttctgtttgtattgtggcttgttcattttctcataaactgtatttggtagctaaaatgttgaaagcagtttgggaacaaaatgtctgctcaaaccatgacaaaattggccacaatttgccgattgggctgataacaaaagccagcaacacaaaataggtagaaaaacagtttgttcggtgatgtgagaccactgaagctcttttttgcatgttttttttttttttttttcattctgatgcttatgttgtgatggaaatacatgaagtctctgcttacccattgtttctgattaactatttcatctttggatttcttttaaaacttcagaaaacaagctgccccctgggcatctgagacaaatttgaaataagagccagctctgcacctaaacattgtgttttctctagaccccacttggttgtaaatgtcccaaaactcttgttttgatcgtttaaagcagcatttaaattccatttcccccaccaccccaatgttcaacattgaattgtatggcttttactacacttttgcaagtgtaaaacaaaaattctagtttgcagtttaaaagaaaagttctccacctgggtatatagttgacaaaaatgtcaacagctaaaagtacatattgactctcatattatcttcgcagactgtaagcaactattaatgttttacatgagacaatacatttttttcaaatgatagaacgagataacagcctcctctcccttgcctctgctgttgtaacttctcataccttgtgttgcctctgtgtgtgtgatggtcttatttttttggtcttaaaaatcagatcctccaggacaataattaggatgaggtttatgtttctacttatctaatctttgttttcacaaataaatacaaataactcaaactgaaacttgatggctttggtgataatataatagcagccacggggaaattttcttcattttaatgttctttcacaacccacattcagtttcggtaggaaaattattaaccttttcaaaagcatgctgaaatatgggttcacaatagactcctgagtatgatttgcaggttttggttctattttgagattttggtgtacagtttttctctttttttctctctttctttcgttcgttcattctctcataccaattgctttctttgacaccaatcgcaatgacttaaaatccttcagttgatatctttttaatgtgtgcacgttatacagtgtttgcatttatttttttattatgagaagggagaattcctatttccttctctcctactgattggttctatgaaagaggacatactctttattctcactgtttttctccactctaatcctcatgtggaggttgtgagtcctccagccccatttaaaaaaatccagttgagccacatttccccgagggcacctggctccatgtcaggcatcagatctgactcctgtctgcctccagtggcctcgtgtctgtgtccatcacaccaaagcaagtccgcccgtttgggcttgctgtcctgaaggtctgcacggcctcaggcttccaaggaaggcctgggtggcggtgtctccatagctgactgctgctggggctgcaggtctggaagggctattggagggaggtgatcatgattttgtaactctggcttcttcacctgaaacacacacgagggcaggacctggggccagagaggcaggtgagtaggaggatctcggataacagtttctgttttaggcatccccttctccaagtctggctgggacagccacacctgcagagagggccctgattggggtcgtggtcctgccccacatctggcaagcctgtgcctcatgtactcacagtcaccttttttatttgatccccatccatcctaagtccccaccccaccgcagtgccctaccctacctgttcccaccgtccctgcaaagttgaatatggaaactgagaaacacatattttatctgtaacaaatgtggacatttccagtattttagcctgggtttttttcttcttcttcttctgcttctcatacttcctgtatgaggttagtttttttaaaatgataaacaaactattttttttttcaacttttttgggaggcctggttgtctagtgcctcctacctgtgttgttgtgagccttttgctggtgctctctacctgggcacagaggtcggtgtgagcagagcctgaaagtgggagtgggggatgtggtgttttgcatagggttgcagtgaggagggttgagctggtgaaaacacttctgttctcctatttgagagagatgcagcagaattcatggctgtcgtgttctgtgcaggcaaaatgagctgaaggatggaaggcaagggggataggagcaggggtggagcatggctagaagagacatttgatgtttagggagagaacactggtgcagattgaatatcccacagtgctcagtcccacgctgtgcagatgagcaacatctggaaaagaagattaagggatgaagcatgccaacatttctccccaggtcaccccaaaaatgagttgaaaattctggatggcttctgagctgcttgctctttccgcccccagtcgggatctcaggagagagcgtccggcaagtagcttgggtacagttgactaagtgtgaacatcagtagccagccgcatagccaacctgcagtcacccatggccctgcatacaagagtgtcactaggagcagatatcacttgccactggtggttgtgtgtatctgaatcacctgggcactgtgaaacacacattcctaggccccagccccagggtttccttcttagaatatgtgaggtgaggccggagaatttgcatttctaacaactctcaggtaatgagatgctgccagtgctgagactcccattgagaactgcagcctagagccagggtgctggaaatgcctaaaaaccgtgtctactggagtctgcaagttgtctccacttttttcctaatgtccctttgtgtgtcctaccacagacttaaaatccacaccagcctctcagaaggccttttgcatttctcagtaactgcacagcaaggttacctgtcatcttggccttttaccatgtccatcagactataaaatggctaaaatgtttttgaggtttggttctctgaaaaatgggttgtattttacagatagtgaaagggtcaagctgtagtgtatggtatcactagactaggaaacaatctaccaagggccaacccttgggttgctgccccttgacaatttccgcctttattataaactaagggagctgtcataggttcttccctatatagagcactcttgacgtaagtgacaccatcttagaaaaagactccatcttacatgtcaaaaggcatcatgccaacagggaacagatggccacctaatcaataaagaccacacccaaccagacagggacatcaccagccctcttctactatcagtccttgccagaggtctcagggctataagaagagcaggatttcaccggcttgagatggtcgtcttaacagagccttgctctgttgttgctcgtgatcagcacctggcatctgctgccaaagactctgcccacatcagagactcttgatgtctgtccggaacaggccaggacactctcatccacgttgctctcattggattggctcattaaccctttcttctatccccttctcactctttttttttcaaagccacacttatgctctgttatcccctttctctcgatgttaaatgttactgttccatgtggaatgtttaatatagcatttatatattgattaagttaaggacactgctgtgtatggtttgcaatattgactgacttgcagagtggcttgagcctgagtgctcacagctctgactaccagttgaacaggacgtactaaggagaatcacttccttgggaactccatgtaacttgtggcttttgtgattgaaatagcatcagtaaaagtctgaccctgtggaaagacacaaatgtgcgtggacctggctatgtctgactttgtgctgctcaggacactctctgtaaccaaaagtgagagagcctggaagacctcagggggtcagatgtttgaaggagctgctgagtatcctggcaggcagcagagcctcaccatcagtttgctgcatggaaggctgtgtgcctctatttccctgctatttgttgaactcccttgagctccggtccttcctaagtgagagagatgataccaatagcaccaacctgagagggctggggagatgtttgaaggaaagcttggctggggagctgtagctggcctgtggtacatgcttggtaactggtggccaggagacccgggtgtgtgtcctgggactgtcacactctgctgacgagggtattgaaagtccccactcaaagacacagaatcttcctgaccaagtgtaggtctgtaatgacgtgtggagcactttgcagaaactgcttctcagcgggggtccccttgaaaaggtgctaagtctgctcagagatacgtggctgaagctctagacgcgggagcctctgtcagagacaagggcagggggactcaagtgctgctgcctggctcccctgccctgacagctctagcagcacacgagtctgatttatacaaagaacccatctcatatctccctaaaattagtctgtgataagcaatatacatttcctgagtgtgcggtctaggttttaatattctgaaaaataaaaacagtggtctcttgagagctgaacagtttggtagttactgagcaggctccatcctccttggcaattcttttgaaatctcaaaaagttggcttcctatactgttagaatctgatgtgagtcaagaatggacaggctgtgagttcctcactcgtcccttttctatgcattgaggaagacctcggtgctgccaatggggcagaggaagctcaagtgtgtttttgcatgaggctggctggaagctctggcttgggctctcagcagtgaggtactggcagttccttggatgtcacagcaaatcgaagctcgtggtcttcacttcctcctaccttgagacttactgcgcagaaagtagaggcttggatggttcaacttcaggggcaaaacagcctgccttgggggtgggactgggggtatgcatctgtgccactgcttctctccctttgtcagtttaccatgccagcagccttctgtctgttatcgggaacagaaagagcacgatttgggagctagctggggagcttcccgaaggttgcctgagctgcatttggggcccctgatgagggcttctattcagggtgatgtgtgtgaccctgaggccatctctcagatctggggggaagtgaggttgtgtacccacagtggggagacctacctggcggctcatcaatattagacacctgcaggaacagcaggtcagccaagccaaagagtaagagtggccctgtctgtgactagacgcttcttcagggttgcctcaacaccggagtggcgctggtggtctccacccactcccagtgtacgctggcgtctaggaagccatgtgtgtgatcggccctgaattaggggcaaaacttttagttctcagatgaactgtcgtgggtttattcagtgataactagacagccaggccaacatggagttgattcatccatgcaaaacctcccagacaaggcctttcagtggagaactggaattcagggtcttctcagctttggccagaagccaaaggtaggagaggtaggagagacccaggtcctggtcccagctgtgtcccatccagagtgaccttgggaaggttgccaacttcctttttcggtgagccttgctttcttcacctgcaaggtgaagggttggttggatgatccgtaagggccggccacctctcactctgtgactttggcccaaggtccacatggttgggtgttccatactgtagccctcctgggctattacattttggtttttcattgcactcaaaagtgggggtaactggtgaggggcacgggttggtaaaccacctctctatttcagtgatgaaactaaagaaaccaggtttccccttccacccctacaggccactgatgcattacttagttcctgtttctctttgcccacccaggaagacactgcgtatgaaatcctgggcccagatgctggactttaagccacattagaaaatgctagctcataggactcaaaacgggaagctggctttcccaacagattcatctgggcagtgttcttcccagaatgtgtaggaatcatggggccaggttcgccaaggctcaggaagctcgatttttcactgtcactagccaatgaggcctttaaggaaaaaacagataagactgtaggagtttatatggatccgttaactcacttgtacaagacattgggaaagatactgggggtgggggggaaacaatacagagtttcaaaagataaatagagactgtcataatcaccacatgtcctggcagccagggctacggggtcaggagaagctttattccctggcctgcagcactgcaagagaccctaggaggaggagagctccgccaggccctgcaggctgggcagcctgcctttggccacatttcctaacaccactcagcagagccctgccagcaaaggtcattgtgcaaaaaatgttatgccccatatatgtttgggaagtgcacaataatttaaacagctttcttatttcttaacttctctgggtattttgtgtgctactgtatcttgtgaatgaatctcaagaggaaggatgaagcttttccaaaatcacatgccttcatctcattttacagaaaaatttgtgcctaatattaaccaaaggaaatggggagcggcagggccagtgggttttcatggtgaactgagggttgcatcttggacaggttgcatgtggaagggacagcagggttcccaaggaagctttgcacggtcatgggtagagccatcccttcttcatccatagtgaatatggctggaaatagcgggtagtcttggatttgacctccctcccatggaagtgctgtctccagctcgctcctggaaaaactgctttctccccaaagtgtgtctgagcagcagatttaagcatgaagttggttttgtggggctacagtatggactttgggaagatggtgccatctgtatttctgattctaccgtccctctgtctgtctttggaagtatcctttcacttgtttgggagactgagaatgattttctgcaaacagtgagccagaccatgctggtctcaagcggcagagcagttattaacagaatcacagtctttctggagctgctgtcagtcctgtgctgtcctcagggcctttgcttggtcaggggccccacttcttatccacccttccctctacctcaccgaggctgctaggcccaggtgtattgtgattatttgatgtacctgggaggccatgtctcccggggaggctcaggacctcattgggctggaattccacagggatctctcattgggtctctttgggcctttggagaggggagtgcagggcaccacctgggcgaacacctgtgccatcctgtaagtccttgtgtgactcttcatccaagtcaacaggggcatgtaggggaagagcctcagggcccatcaggagtcagaccctgaccaggaagtcagaactgaatcaacttttcaataaacacacaggctggccccaaacaaagcagcaggcttttgggaacatctgccttttcagtctcttctgaattctgtttatgtggacaccccatgtcccgcaccaccattgccgccagcaatgtttgttgcttgccaatatttgaatagatgctgataaatttgattctctggcttattgtggcattcatgatatgtctttcccttttcagtttccatgtactagagcgactgtcagtgtggttggcagtgacctgtgtttttcatgcatgtttttgtttcagaataactgggagatgaaacaggaagctctatgacacacttgatcgaatatgacagacaccgaaaatcacgactcagccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaacagaattgtttgcttattagctatctttaaacgctgtttgaaaggatatcgaatagtgtttgagggaaccctggcacgtccacacagctcatctgacatgtttaaatgtgtgttgggcttgactctctcataactcagccacgcttgccttgctgcttctcatacctctccagattgctgtagagtcagtgtgggcagactgacatttgagagaaacgtcgggcttcatctggaagcctctttccacacccaccctgatcgtggcctgtaaactgtggccccaagatctccattaaccttgggctttccactagagacatctgccatctctgctgcctccctcccctcacacatcctttactgcttcacttattcatcccataaggatttcttaggggcctgctgtgtgctggttctggagacaaaacagtggatgggaccaactcagccccggtccccacccagcacctctagccaagtctgagtgggctctgctgaagaagtgttgggtgcagtgcacagttcatcatggtcgatggctccatcccatttcacttagatgccccgatttcctaaatgctttcttgaactctgacactctgggactggcacctgaacagtctataaaacggtgaaatgtcgaagcattcctgctgtgtaatcccactctcttccccaacctcaagcaggacaatttgaccccctcctgaggacatggccagacaggccattagtagaagccttccagaactttctggcaatcttcacttttaagcttagcaaacatctaagaataattttaaatggccatgtttactcttttgtacttgttggaattagtttaccaataggccatgatggtgatcacaaaaccccctatgtacatgcacagtgttcattgcaatgcatatccaggtctcaacccaatgtccctttctcaaggagaattccctgagcaccatgtcgtgagagaaccctccttcctccccaccatttctctctatcttgtgattttattttattttattcatagacttatcattatcagcacttatcctgaatgttcaattatcatctgtctgtctctcactccactcccaaaaggcagactgtggtctgtcttatttcccggtctgtccccagcgtttgagatccgagcctcatcaacaactatgtgctgactgggttcatcctcttattacttctcaggcacaccgagatgctgagcagcccagtgctctgaccatgtttggtggataaggaaactgatctgagtctggtgaatggcctcactagggtgaggacccaggctttcctctgggacatcacccagcagaaaagggtgattgtgaactctctactgtctggacagtcaggttctcatcagaaaccaagctttgccctgctgatgaacttcctaaagtttatgtaatttgcccccatcctggaagataaagaccactgtgttgtggagggaaatagcctcagctgggcgtctctggatgctactttctccagcagaacactaagaagatcagatgagatgaacacaaagattccaccctgccctgagtttctgctggttctacctggctaggttctagcagaagagaaggaagtatacaagggtaacatgtgcaagggccgtgtacaagggtaacatgggcatcagggacagtcctcctgaggatgtgaggagccaggcccaactgtgggctggcaacctgccccaggggttgctcacactcacctaactccggcccctctggacacaccccttgcccaggtgcaaggggctccactgggaagaacatctccacccaagtgatcactcttcctctgcgtttttgagcaggatgaaaccacattctctacccatttcgcagtcttacccccaggattatttatgacctcaaaaagatggaagtcacaggtgcagggaggaccagacgtaacccatatgatgcctgcaggatagttagttcacaaggatattaggagaaagagcaaaagagaagtgaccacacaattctagatggttaaggcaatagttctgaccctggccagacattagaattacccagaggttataaaaaatccagacacccaggatccacttggaccaatcacatcagaatctggggattgagggggtgtagacatcagtattttttacaactctgcaggtaatttcaatgcatagccaagactgagaaacattggtctctcaacgtaccatccaatgtggtagctgttagccacagatatctatggaacctttaaaatgtggcttgtacaaccaagggactgaatttttaaattcctttttattttaaatttaaatatccacatgtgacttgtggctgccatattggactgtgcaggtacagaacatgtctacggtcacaggaagttctactggctagtgtggtccaggggaacctggagtcctataactgccgagtgaaatcctgctgatcctgaagggactttaaggtaattctgtctgttaacttcactaacaagccctcctgtcttgggtttgctgtatatttttcatctatgtttcaagccagggcttgtgcagcagcaagggtgacaaactttcaaagcactgcactgtaggattgaaaagcattgaaaatacagttatgcactcactaatgtctcagtcaacaatggactgcatatacaatagtggtcccataagattataatggagctgaaaaattcctatcacctagtgatgttgcaactgtcataatgttgtagcacaatgcattatcttttctgtgtgaagacatgtttagatgcacatattcttaccgttgtgttacaattgcctacagtatttagtgcactgaaatgccgtacaagtgtgtagcctagaagcaataggccataccatatagcctaggcaggtagtaggctatgccatctaggattgtgtaagtataccctgtgatattcgcatcacaaagaaattgcctaacgatgcatttctcagactgtatccctctcattagcaatgcatgattgtatctgtaaaaatctaaggcccagacctcagtcttttggtgttcattctgctggtttactcagtttgcatcgttgaagacccagtcctagaaaggagctttctaaattattgtttaattagtgtaatccaagaatttatgagacttttggaaaagcagagcgctagaagtgccacctttcggaggtcacggatttagtcaggtgacccagcaaactccactcgttggggttagagatggagaattagaaccaaagctgaatcactttctgcttatcactcatagactgccagattttcttttttttgttggagggaaagcaccttacaacaaataataatactattttgaatttcagagctttccctttttcaaagcactttaccacctatgacttattttgtcctcctaacaaggccataagataaggaagggagggctttttagagcctgtctaacaccctaagacagagcttaatattgctgaaggcattgaaaagtataggttttgttctctcatccctggccacactcaagtacttagtggcacaacttgaagcaaattgacatagatgtttaatcctacagtggactgtgtttttaatagacactagagcttcacatttgttccctttggttccatcccaggtttctaaccttgtgcctaaatttttgggggccctttcttcctcagagctttgtgtgatctgcaaatttggtaaatatgccttcatttaccatgtctctttccaaggtgggtttcaccatgttggccaggatggtcttgatctcttgacctcgtgatccacccgcctcagcctcccaaagtgctaggattataggcgtgagccaccgcacccaacctccaaggtgttttttaaatggtgaatgggacagaacgcaggacagagtcccatggctctccatgaagaaagtcctgtgtcacttcaaaggatgtcccctgtgcagaaccaaccacgctaggctgacatcctcacttttgggtccccaaccttctcatgggtagagctgcagagagtcatttcaaaccacacttgcctgtgggcagaaagcacggaattgtctgtccaactagggactcaggagcagcctggctgtctgcagcagctgcaaagggagcaaaggcaagcaggacttccatgagctaggaggtggccttctttggagatgagtgtcctgccaattgcaagtcctcctggtcacaccatcatctggcccatcttttgtatcttagatcggatagggtgagaggttttcaaaggctttactgaaatcaagacacactttctggggcattcccctaatcgactgttctggtgaagctcgtcaaaacaggaaatgaggttagcatggagtgactttctcttagagaacttatgttgcttccttgagaccaccaatttcttcccaaaagcttgtgagccttatttcgtgtctcttttgggttttcttggaacttggaggaagtctgttcttctgtagtttttagaatccattcctctggaaaatggtggtggtgtttgcttattcccagctttccagactctctccctttttctccagtatctctaagatgtttgcaagtttgtctgaagtgagatctgcacatacttgaactacagcaagaatgggattgacccacatgctctgtgcccacgaccaggctgacagggccgcatgtgggctctctggcatgggctttaggcagctccttcccctgagaagctgttggatccacatgttctcacggtatcaaaaatggcaggaagagaaaactaacctggtggagatgaaacttagtgggaacactccgctttcctcccctgctccgtgtgtgagcacttggctcagaaatgcactgtggctgagacagccctatctggcttcacctaagcctacccccgtgttgagttctttaacttagttatcaaagcggcaagggtttcagatctagacaagctgcatcatgcttatttttgctgaggttttctgacaaatggctctacttgaaatttccagatttaaatgtctgttttattaaaactaaagtacttttgagtcatatttgcttttatgtagtagaagcaagtagaagagagtccatgggaaggaatagctggctttgcctcacaggtgtttagggaggactgctgtctccaatgcaagacctggattaccgtttagagatccacctacccctcatgatgctcttgttgctggaatcatggtctgtttcatgctttacgtgacttagcaggaccttgaaagctgtcctgagtgcccatgctggaatggggtagatttcagttccctctccctcactcccgcatgaacctcagcctcactctactcaggtctagggtacttagtgtgttcagtgatgattgtctacatagatggattaatacatatgcacctttataatcatcccagctaccatctaaggttctagctttctctggagacatttttggtggtttacaatgttattttccagtgcgcatagcaggccccagaggcaaggtgatcacccctttgtttcagttaagaaaactgagttttagtgaggacaatcaatttttcccatatcacaaaactggtcatgtgatgctgcatcccatatttaagtccagagcagtgagcttctccctatccctctattatgctgccattttgtattttgtaggtgtgtaaaatcaaatgtcattcttccttaaaaaggactgtgaatggtaagcaacagttgggaagggtgacaccagacaatggctgaaaacagggcgactggaagttgactgatgggtgctgagcacttggcatcccttcctgctgcagaccccactggaatctcctcagaaggggacactggtggcttccattggccctgcctcccgccagggctgtgtgaggatccacatgggctgggatgagggtggatgttgttctctgaaaactgtccactactcaaaagtgatgttgtggccgggcacggtggctcacaactataatcccagcactttgggaggctgaggccggtggatcacgaggtcaggagttcaagaccagcctggccaacatggtgaaaccctgtctctactaaagatacaaaaaattagccaggcgtggtggtgtgtgcctgtaatcccagctacttgggaggctaaggcaggagaatcacttgaacccaggaggtggaggttgcagtgagccgagattatgccattgcactccagcctgggtgacaggggagactccatctcaaaaaaatttaaataaataaataaataaatagatgttgctgggtcaaaaagggagaggccccaccctggccccctagcaccagaatctgcatttcagcaagatcccagggggctgtcacagttgctagctctgctctttatgcttgcctcagctaggtgctgagtacctgctagaggtgtgaattcggtctttattcttcagaggcactggtcagagggtggaaacatcagacagggactcctgggcccccaggcaggactccatggggatggagcgggggatggaacatttgagaatcaccaacatgcagcaaggacattagtgagaaatgagttccacctgccagaagggaagctgagaagggaatgcacaaatcaggaaaatataccatcaaaaactacgactcttctacctccagccctcgccaccaattcctatcccattattttatatccgagagggttgataggcagcagacacactgattctgtaagcattgtccctagtccctgtaggcgaggtgaccatgtacccaagttcactcaaggtggtcctgtccatgcctattagaaatgagttcataattcctttcagctccgcctttcactctcgagcgtgcccttgcttgacgattcctatctggcttggataccctcacttatattaccttatatctgctattatatttccccaagaagttgctttacaaacactgactcctcaacacacggtcatctctaaaagaaagggtgtttggcagttcctcgacagttctggaaaggctgccttactagaagcagagtcagccatgggggggtgagaacgaaagtgtgcactcaagcatgtgtgtttggggtgtgtgggtatgggtgtgagacatggtcttatgggttctgtgtacctgcatgtgtgacacaggtgtgggtgcagaagaggacacggggtgtctggtgcatgggtgcctgtatgcacgtggggtggttgcgtgcatctgtgagtgcacatctatggtatgtgtgtatgcttgtgcatacatgcctgtgtgtttgcatgtgtggtgtggtatggtgtgcgggaatgcatgggcggatataagtgtgggtgtcttagtggatgtgtgcatggatgtagtatgtgatgtggctggatgtgggtatgacgtgtgcagtatgagagtagggttctgtagcacgtgtgtgtatgcagtatgtatgtttgtggtacatgtgcattgtgtgtggctgggggtgggttgcatatgttgcatatggagtgaggtgtttgtgatgtgtgtgggtgtgtgcggtgggtatatgctggtacctgtgtgcatgtgtgttggtgtgtggagtggctataggtgacatgtgatgccatgtgtgcttcctgagcttgtttgtggttgttcccagacccactgcagactcaagcatggctccacatggcaccaccacaggataagcctctgtgtgtatgcagtatgtatgtttgtggtatgtctgtgccttgggagctggtggggaggagggtctcacccttgtctgtccctgggcatccactatggctgcactgggaagccactgggtgcaatggtgttgctgtgtgggacggggcctcaggcccacaggcagcaagcatagaccagatccacccagcaccctgactgttgaggatgggccctggctgtgtctctctagcccagctagctcctactgcatagtcaggctttgggaggcaggaatctctgaatggatttccttcctcctgccctgcttggataggggcacttgtggatgcttctggctccaacttttgtgtgcagtgactatgatggagaagcaatgagctccctctacagccttctgggctgctggcatccccagtatgtttctccctggagacactctcagtgaggccaattccaggctgctgggggcttttccttctgtcactgtcgggcctccgcagggatctgcctggctgcaagatgctgatgggtggaggggtggcccacctggcctccagaagcaggagctccctgcccactgcccgcatggccctcagccctggccctcacctgttgcccctctggaagaacgttgctcttgttagctaacaaccacctgactttcctcgatctgtctctccctgaggcaagaatgacctaggtctgaagactgaagaccagtgctggggcccctcttggaaggccaaggaagtggagaagtgcccaggtctggtctgcttagcctcctgctagttgttggagctctttgagccttggtttccaaagccataaactgggagaatgacacctaccccagcagcacagagggatctttgcaataatgtgcaaacccactcagcatgatgcgtggcacaaagcacaaacccaataaatggtggctattatcactattattttatttcatagattcaaatattgagaatgaaataaatatatcagaaagtagtagcatcgtgccatcagaaaaatactctgatggggtcctagcgatcttatccatgaaaataaaatatcaaaagaaagacaagacgatctagaaagaagggatgccggcagtcttagaaaaaacaaataaacaaaaacaaacaaacaacaaaaaacaaaactggtggcagagagtgagacaacaggagcaaatatagggccagccagacaggcactgcttcctctccctttgacaggcaggacagcggcccgctcccaaatctgcagggtcagacgtggtagatgaacagtgatttgcctgagtgtaaatattgtgatgtctttcttttcttgaacttttaaccttgctggtaaacagggtgcatccagaattgtttttctgagaactgagttttgaggaaataggggggaaaagggtttttattagctaattttcagtcttgtgcgtgactcaaaaccttcttattctgtttcttaactttgcttcaggagacacttggccaaaaaatagctttgtttttaattgatgaaagaaaaatcattacaatgtgtaagtatgccaattcaaacatggcaaaactttcaaagacaaagcaggggtggggaggtcattctgaagaagatttctgagacaagaaaaacaaccaatccaaatccccatttgtgttttctaatgagaaactcctcacacgccattgccctgctgaccccggtcttaccttgaccacctcgccccatcttcatctgttataacttctgagatattgtaatggaagtatagagtaagcctgagatacactctcagcattcaaggtgctgccttcctttctccaggcaggaggctgacacagccgcctttatttacaaatgccgtaaattgactgcaggatcctttcgtgagaaaggagaataacggcagggaaccatcccagcaaaatgaagttctgggctccaccgccagcttttccctcgaaggtcatatttcacctctgccctgtaatttcatgaattgttcaatgaagatgtgacttattggcttccaagcttcatggaggtgttgtccaaatacaaggtccataaagtgctttggaaggcttggaggaacaaagaaacactcttgatctgaggttgtgatggagtctcctcaacattgtagccgatgatggcgagtgctggagggttcatcagacctgacagcaaccccagccttcaaaccactctctcccctcactattcatacctgcatttgtgtctgttcagttgaatgctggcagaccgtctttcaaataatgctccagttggaaagtaaactgagtacattgagaataaatatctccagtcttctaagctatacggcagtgttgctgggacctgtaagaaagtttctctctgccatcttagaagaaggaggaagaggagaaggaagcaggaaaatggaacaaattgccgtacctttgtaaaagatgagattgaaataaatcacaaagagtgttaaaacaggcagcttgcgggaagccaattgctaacattctcaggccccatcctttcctcctcctcttcctttcagaataaattaaagaatgggcccaagtccaagttgtgtgtatggtatctttatctgattgacctcgtactcctaataatatcttatcttcgcttgtaaatcattagcacccttttccgttctcccggcatgttacttctttaaatgtgatgaacactcacaggagtccgctctgcagacagacaaagctactgcaaggatcctctgtcattcatttggcgatttggtcccgaaggcctcagctggctttactagcaaagtgtttcacaaattcccatagccctgcaaacagccactcccccaaagcaaacaacctgagacatcaggtaaacactgaagaatggaaatttcattcattttcctgcctgcatcctctctagttgacagagaatgtcagtcaatgcaagatttgttgagagtggtacatttgaggatttatttgtaggctgtgttaatatactttcgagaaattcagttgtatctaattaatgcttttttccctttgattcattccaaactatttaaattggaaaattgtgtgctatttgaagatgcacttcaaaactccttttgttgtcatggtgcctgttgtcactgctttttgttggttggttcttgtttctatagggcccctcctctttgggatcgtgtgggtacagatgagactcacagttccctagccagatgatctatagaagtttttcaaagactgcataggtagtgttactgaacatagttcatatgtggtgtgtgtttctaaccttgcaagctccttgcaaaactacataaatacttgtatttaagttgtgctgtgcatatgaacataccttattatgagaaaggtagattttaaagtattccttccatgggtaaataagtcttccctgatgataaatcattacagttgctttcacctcccaaactcctttagctctcctctcccattcagcccctgtagaaaagggctccctttatttactgccccacttgttgcaagttgggggctatttctttaagtctaacttaatattccttgtatttagttcaaactgaaaaattctcatgtgtaaccgccgggcagggcagagggaagtagtgtctactttaaatctgttgcagcacatgaacttaaatgacaaaacaaacacagaagactgaaaagtcagagaccctcttaaagaaaagcttacaaaattatagtgtccactctaggcaggactttcatatcctttatctaactgtcacatgatggggtgacatgttgatccccccacagcctggatgatagaaatatttgtggtttgatatgcgtcagcgcttatgactttggcataaaatacaatctcctttgtttcttccccaaattcaagaagtgcatctttccataatattgagaatagaacctaacatttattgaaaatctactagcatattttgtctttaaaaaaaaaaaaaagcacttccacatactcagcaatggcccagtgaggcagataatagcttcatcccatctcacaatggtgaaataaagatcagagggagccagtaacttacccaaaatgactcccttaggaggtggcagagcccatactcaaagtcagtttgtttaaccaaactgcttaaaatgtcaacttagtttgcaaaacagccctatgtggttggtggtattatctgcaattcatcaccaacacactaggcccagggcaaagctaaaagcaaagctaaaaacaaagctaacagccagagtgaccagaactgggtctcacctctgctacacctgtgccagggagaggagatgaacactctaaagtgctttcatgcacttgggggccttcctgtccaagtgcagtataaatgttctttgtgccacatcttaaaggaatcctcttacagaaagggcttcccatctgagtggcaagacccaaggctaggctgatgcctcttcctttgctatgtgagacctgaaggcaaagtctgcctggactgacagagatggatgtggcctccatctgtctgtgtgtcatgacagaaaggaggtgggaaaacttggaaaatgggaaccctcactttcctgaaattcccagcaatcagttccaagaattgtaaccttgaagcacaggaaagcaagaccctcagccgggaacatgaaagcttttgtcgggaattctttgaggtcctgatgaggtgacacagtgaccagatgttccagattcaacatcaaggccggtgggggtggcactgcaccggtcacgtcaggaagagcagtgtagtcagagagcgtggcaaccaccattcgcctggtagacagctcattccatctgccttgcatattttccgctgagctcagaatggagaagatcgaatacagtctgctcttatcaccctgaagacttttaaaaaggctctgcatactcacacaaaaatcgggaacttgatcactgtggcctgacaatgtgttttgaaaaggcgggggttgggggcggtcagtctttccctgaaagttcccatccattgttgagtaaacatcataaatctatcgcagagagacaggctgcctgtactcaaattaccgcctgctacaattttagcttcaagttttaatgccctaaacatgaataacgtcgtatcccagcacaggtctgattaatgaggcaactttgccaacttcagggtcggagagtggctccccacctccttccttttttccccctgtggcttagtaaccatttcagcaaatttcctcattaaatatacaaggcgactgagtgcaataaaaactaaaggatgtggcagataaacaccagcgtctctctgagcagacctcgctgcccaacagagcaggccagctcaggtttgctgggaggaatccagaatgttccatcatgaattccagcataaaaatcatgcacgcattgccctttgccatgggtcattttcagtctgtgggttacacttacaggaccgtctgctttccgagctgtcacatggtttatacatggaatgccactcatgccctacttgcacgtaaggtgaccaatggctggctgaaggtcacactcaggagatgacccaaattagcacgtaatgtccaaccttgaaaggaaagagggaagttttatcttgcccagatattgtctgttccccaaataagattgtgtgtcgcttgagtaattcccgaataggagcccgtttgttgagcacttaatgcaccctgggcactgaagaagaaatgcggaggagtccccaggacttgctgagtctcctagagacagcagaggtgctctgctcacaggagctcattttctgcccacaacaaccctgtgccatcagctacattatctccaggtttctcatacaaccaaagctgaggcttatagggtggcacaacttcccctgctctggctccgaattcaatattcctaagccataaagcatttctctttcctccccatcctgttcccattcccagtctctccatgaacacacacacacacacacacacacacacacacccttgtctacacttgagctgtagtctgggcccgttacatcaacaacacaaccacggcagaacgtggattggtccaaattgcagagattttaaatctaaatttcccatgctattgagactttacagaaccagtccttcaggtgagttttgattttctgtttaagccagggttcagcaaacattttttctaaagaccagagagtaaacattttaggctttgctgggctgcatggtctctatcacaatggctcaactctgccattgtagcatgaagcagccaccggtaatacatagaggaatggcagaaggtgtgttttaatacaactttatttttaaaaacaggcagagggccagatttggcctacgggccatagtttgagaccccatagtttgagatctaagtcatcactaaaagtgttatcagtaattgagggttttagacattgcatctgtctaacctatcagaagtaagattgggggccagggccattgcagtgaggctgtggaagttcacagctgcttaagaagcactgtgaccaacatcgctccttaccccagatgggccaggccagcagtcacaacatgtgctccatggggagacagcaataggcatttcgctagaaaagaattctctggactagtaagtttagaaaaccttgggctattattatcgttattattatattattccatgactgcaggacttctcagggctttcataatgctgatgaacatgaatcttcctagatattctggatctctaggaagggaaggtttgtgtgcagagcatgtctgcacgatattctttgggaagactgcgctggctcccgtcctagagattctcatgctgtcttttctttctacctgttttcccaactgttcccacttgagagtactggcctgagttgctgccaaccttacaatatccagctccgtcctcagagccacactgcggtcccactggggactttggtggccctgcctccctgcaaccccaggtactcagtttggagggtgtggagagggcagggttgaaatgcaggctgctgtgtctctttccttcaattttatcaccagctgctgaccatgcttgcttaaaggtctggtatttatggtctcctagaatctcccagaacctcacaaatacccccgggctcctggtttgagggactagatgggaagcccccctccctgggagaacacaggcctagagcttcctggaacttaggcagcttggtcagagagtgtgaggactctgacaggagcacgggtgtgggacattcatgcctggaaggccctcgacacctgagacctcggtgtggaggcgggacttggaggaaaggagtccctgctatagtggaaaaaccagccagggtaggtagttttgtataagactcttaactctgtggagacttctgttcattatctgcaaaatagaaatgtgtatcccagcagcctaggcttagattgtggaggactagctgaggggtgtgtgagaaagttttgcaaacatggctgggcacagaaggctgagctattgtctggaggaaaactctcagggcaattcagacctttctgggcccttctgaggcaagaggcattgaggcaaagtttgagatttgacttcagggacactgttctctaagcatatgcttcagtcacgagcgctgaacccactctcaaaagctaagtagtagcaatgaaatgcttaaaaagttcgacccagactgcaaagacccacagaaaatagagcacagtggctggcttggggagggaccctcggtccagacagcagccaaggagttcttgagccttatttatcacgttgtagtattttacaaggagggctatgcattatttctctaattgaacgttacttttaaaaacagacaaagagaatcaggaaaaatgatgtgaggactttaggcccagatcagtttccgtttcaacaagatgtgtcaggatgatgaaaatgtcgtttggttgagccgtggtcatcaccccgcattgttgttctttcatgtgtttgtgtgtgtgtgtgtgtgtgtgtgtatgtgtttccctctgagtttcccagtagtcattactaaaaaaaaactcctaaactgactcaaaacaacaatgacaaaaacaaaagcaaacaaaaagacccaatcaccacaggcgccattcaggccctcttgtctgacggtgttcacagactgtgcttgtgtttttggatgtacccgcttccttttctctcttactcaccagatatcactgggaatccctccttcttgctccaggaccctaaaggagacactggggtaagactcatgtgggtcttggggcagcccatttccaggagagcatgacccccaccccccaagccccaggaggacggacccttcccagctgaggtctcctctgcatccggaccagggccctgggcctgaagccaggttttagtgaaggccttttgtgggtgcctctcttgcccaggaaacacaaggtctttaagctaagcctgtttgtggggagagcaacccatttcttagagggactcaatccatagggaggacactagtccatcagggggcccttgtattttcatcctggaaagcacagtcccctgtttccttctgggacatgagaagttgcttctaatggttcatccccacaacctcacttccccatccttgatttgcaaatgggtccatagagaggtcccaggcagctacttgacccaggcagcgaaggtgagcgtgggtctcctcactgccatgagccaggcagaagagcaagcaaaacagctaagaaccagacaggccagagttcaggttgcagctctgaacctgactaagctgtgtgacccaaggcaactcacccaacctctctgagcctcagtttccccacttaaagtggaaacaagaccagcccctgcctcatggaattgtcatgaggaagagtgaagtggtgctcgtgcagagctggtgcccagggaaggggctccggtgccaggcctgacagctcgtcagggaagcctgctgccggccatcccagggagacagtgccagatcagagggaagctcagcaagccacttaaaagggaccttgactcattttgtggtaaccgaatgtgcagttcaggaagtgcttcgcaaaagcgaactgggctccagccgccccctcgtccccctgccctctgctcaggattcactgtgcgaggacccacctgacaccacctgatgcataccagcagcgtggatggcaggccccacgtgttctcaagcccaccaaaggctggtgggtgtcggctctcggaaagacagcctgacctcctggactgaaattccactcctctctttagtcgaggtgctcaatctccctgagcctctgtttcctcctctgtaactggcactaccgcatactagggccggtgcaaagcccttggcaactaggtatcatttaatccccacaagcagctctaaaggcaagtacgaaaccttgccatttaaggatggggaagctgagggcaccttgagttatgcaagggcacacgcagggtgagtcttggagctggaatttgaacctggggaatggcactcctgggccttccctcctaactcatagtatctacaacctggattgtagacctagctagtaggtcttgggggttcttccctcctaacccctggtatctagaacctggatcgtaaacctagctagtaggtcttggtggttcctcacatggatggaagagatgccaatttccattaaccatgcacactgctgcttggtgggcaggtgaggaagtggtctgagtgtggaggaagcccaggacaggaccctctttgcctccccgtgggatgtcctggctgccctgggaggatatgtgtggtgttctctacacccacctgaacctctagctccccagagcctctgactgcatgttctgagggcagtggcatcgggaacgcatgggcgcagtgtgcagagactggccgaggagagctgtaggggttacctattaaggaggcaggtcccagcaggtactagggactgaagagggtggagggagacccgaggggggaagaggctgccctcgtcattagcccagatccatcccacccacttcttcccatctccctgtacttgccccatagggattcccaaagagagggaagtagagggggagaggagtacatggacacaggagagcgagtgagcaccccaccccacaacagtgtcctgaggaaggcccctcttttgtcccctgcttcacaagccttgggaacggggaactctgcaggctgagcggcatccctgctgggaaatgagggcctgtcttagttcctcatttaaggcacccaccctcattcccaaggcagttaaaagccccaagttgcccaactcggtcagaggaagcctgtcccatcagtctcacacacccagaacttgattctctggcctccgagactgggcagggaccagctctgtgtccccgagcccacatgtagaggagggagccgcgaagctgatagcccaggaacatctattccccacttgtcattgtcaaactctgatgtcttctgggactaaatttgaaggacagtttttactgttgtaaccaaaaaagcaaaaggaagcaaacaattaacaggcccccttcttttcgggacttttttctttgtcagtagaaagccatctcagtaaacaagagctgttacgaaatgtacctcaccccacactatgcctgtaaagcatctcccttccccccgctgcacaacccattgtacaagaaatattgtgatagatacctttgggttgaggctggaacaaaatgagccatcaggaagcattccattttcagctggacttgtttctgcatcttttggaggatttctgcaaacccacagcccagtatggcatttcccatactctgtgataagaacctccaggataacgttggtggctcagggatcatctgagccttgagcagcttccattctgatctggatgtctctgatgtgtgcttgttcaagcaatcgatgagccagtcatgggccccagactcatgggaactgggggagtgcccaagtcaaccctgcttgcttttacagctttcctataaaagcttctccactctttgcctgggcaagcccatgcccagatctccagcacacactccagctgccagagggggtgggggggctccctcctgcgtctggaacctattcagccagcctgagattcagaagggcctacctgctggagctgagggtgggtgaacccacccacttggggctagcgaaagattgcatcttgtcccaaggctctgctggacctcggaggattcccaccattgtctttttgggatttgagggaggtgtttcagactgggagactgggagaatgtttcccagcaaaaggcagaggttggggttcctgggatgtggctccccacagaccaggaggctgacacagttcctctctctgtcttcctgcttttctcatgcaaacagcacccctttcccatggctgctctaacatccttggtagcttaacacaaaacacaaatgtattctctcacagttcccaaaggccagaagcctgaaatctgtttcaatgggctaaagtcaaggtttcggcagggctttggggagatcagcttccttgtctgttccggcttttagacatggccaacgttccttggcttgtggacccctcctccacttaaagtccatcactccagtgtctgccccatcgtcacatggctatcccttctttaaccttcttgcctccttcatataaggaccccagtggttacgttaagggcccactcagataatccaggactacctctctatctcaagatcttcaacttaatcacatctgcaaagtcccttttgccgtgtaaggtaacattctcaggttccagggatttgtggatgtctttgggagccattattcagactcagatagttatagttaagacctatgagacagtcttctacatccctgagtgatacttgaagcagcctagcaacaaaaaaagccacaaaactttgtcaggagagctgtttttggggccaccccacattgacccttacctctgcagcccctggtttcctctggcccctgcacttgtgtgataccttgagaaggggtggatccacatgccagcctacgcaggagcaagaggaccagtgctgcctctcctttcttggtacatgccagcatggtctgtggctgggatgctgctctctgagacttgggagcttacttgttcacctcagcaatgaactctgaccacattttgccattcctattctcaggcccctagcaatctcattcccaaactcgatgacccagtcttttgcatggctcagagaactgccagaactgttagcacctaggccctctgctggagttcacagatgcaaattctgttgcttgcactccaaatctgtgatgcaggattgtctgctatgtggaattaattcaggacttgaggaatccttgtagtgccaccttacaaatgggttggtgccttggaaacccagtcctggcatcaaggccttggcatctgtcaagcagaagtgtgcctggggtgtattggggggggggcagtgttggagccgatttcaccgatttctgtccctggctctctattgtgcaacaacaggctcttctattccttaagacggcagcattattgccaggtccttctatttgctcataaaactcccatttacacagcagtttgcaggacacatcaaatacaaaaatggatgtgaggtttagtacagggagaccacagccataatgaatcctggcagggtttttattttggttgcatctcagaagcactttgccaagcaatgtatatgtgttgaatgaatgaatgaataaatgaatgaatgaatgccggtggactgacatggccgtatagaactgtagtcacccttcagagagaagcctctgcaatgcacctgaaaagcaatgaccatctacatgttcttccttttcttgttactatgttttaccccaccaggatgcccactgaccagaaactaaacaaaaaaactcatgttcctgaattcatcttttacttgagggtaaaagcttggggtagtgaagtgaatgttggtgccatatcatgttcaagcattttggaattatatagctctaatttagacaacagcaacaacaaagaaaagagactccatcatcagaattgataggttagtaaatttacagatcactcaaagatgttaaaacaaaaaaacaaaaaactttctaaactctcggtgttcttgggaagtagcctgctgtcgttgggctagagataccaagaagagccaaggcagcagattgtggttgaaatttaacacggtgtgggggtggtaggctggcggcacaggggctgctgtcagagataacacacagcccggagaaccagggtgtagatcagtgcatcagagccctttccaacggtcaggagaggaggcagctgccctgggggcagggaggacctctgacccacaagtcctgacctactggcaggagaaccattcctggtttgcttgctgggtctgagacatttctggagatgtgggactttcagtgttaacacccaaatagccctggggaaactaggatggttgctcacccaagctccaacttgtctatagaattatctggctttgaaagaatgtcacgtgcttttatcttgaatctaaggtcactggcatgcccctctcatccactggttattcttgatggtaagggggcggggtgggtagggtgaggggagggtgaaggggaggttcctcctgccattccttcctggagaagagaccagggcctttccaggattttggactctgacatggaaggaaaacacttaaagaccttcaggatttcgtgagaataacaagattttattttaaccataaattgtaatatttgagaaaatgcagacatattgtttctcagagcccatactaagtcagtgtggaaaacagcctttctctggaggcaaaattgcactgattaacttgaattacaaagggagcattgcttaccttaagctaagacagctcaatgagacctgctgtagcatttttattacatgtgcaattgtgcacatgtaccctagaacttaaaagtattataataataataataggaacctgaaaatctagacgtggagtgcttgcggtctctggacactcaggtctctcctcttacctcctttcacctcctctcagagcccatcgctgacatttagttcctctagaaacacaagcatagctcagctgcatgtcagaagtgcaaaaatatttaactttaatttttttatgtatatgtctaaacttgtcttacacttaaggtccctgtattagtctgttttcacactgctaataaagacatacctgagaatgggtaatttataaaggataggggtttattggactcacagttccacatggctggggaggcctcacaatcatggcagaagacgaaggaagagcaaagggacttcttacatggcagcaggcaagaggcatgtacaggggaactccccttcataaaaccatcagatctcatgagacttattcactactacaagaatgccatggtgaaaacctgcccccaagattcagttacctcccactgggtccctcctatgacacatggggattatcacaattcaaggtgagatttgggtggggacacagaaccaaaccatatcagcccctttctattggtggcaacaaaatatttcattttactaactaaagattagtaatctctactgtattaaaacttacgttcattaaggttctaagtttctgatgccactcaaggattccccactcccctcctttcccaaaatgcagcccaggtgccaggagaagtgggtgtgtgtgccctgtggcatctggggagaaggggctggcctcccaaggaagaagagcttctccctcctggtctttaggtgccaccctcatggggtccctgcctaggtgtctatggctggggttgctcatgacctgttctcaccacaggcacagcattaaggtccgaggtgacttgtatgtgtccccagattggctgagaagtaattcattgtatgattatagcacagtttgtttagtcattcacctgctgatggccatttgggctatttccaattttgtagtacagtagtccccctcctatccacaggataggttccaagactccccagtagatgcctaaaactgtggacagtactgacccctatatacactgactgtggatagtattgacactatccgtggatttgataactgagagggctactaagtgacaaatgggtgggaagtgtatatggcgtggagacactggaaagagggagtatcactgtccctggtggaataaaacaggacatcacgagatttcatcatgatactgagaagaaggcacaatttaaaacttatgaattgtttacttctggaattttccatttaataattttggaccatgattaaccacaggtagcaaaaaccatggaaaacaaaactgtggaaaagcagggactactgtatcatgaataaagctggtaagaacaagtacaggtcattttgtggacaagtgtttttacttctctttggaaagtagaagtattgctaaaccatacataagtggatgtttaatgtataagtaactactaaataattttccaaagtggcgtatgttcccactaacaaagtatgagaattgcttcatgtcctcaccaacagtttgtgtctttaatctctataatttgagctgttctagtacatgggaaacggcatttagttctggttttaatttgcatttccccaattactcattatgttgactacctttgcaagtgcttattgaccatttgcaaagtgtctgttttaggccttttattagacctatctctaggctgttccaggcctatttttatatttggccatgtattttttattatggatttatagaaattcttcatgtatacttgatataagtcctttgccaaataaatatattgtgaatattttctcctagtctttggcttatctctttttcattttctttctttcaaagagaagaatttcatgaaaataaatttattactaaaataaatgtataattaatgtatgagtagtgttttttgtatcctaagaaatctttgcctaacccaaggtagcagagatcgtttatgctttcttccacaagttttatagttttaggcttttatttttaagtctatattgataaacctaaaagtgtgttacttaatttttgcatgaaaatttttaagatattatatggttgttgatttctaatacccacttagttagagaatacactttgcataacatgacatagacaacagggataagcaatgggcaattattttttaaagaaattagagaaagacaaagagagtagtcttttatggttacacacatattttacctatccatggttgttaacatcttggtatctgctttccattctcaatacccaagtttccatctgatgtcatttctcttcaacctgaagaactttctttcatatatcctggtgatgaattctctcagcttcacttaactgaaaatgtctatattaccttcattttttgaatgatatattttactggacatagaatttcagcatttattatttcgttaccacaaaattttgtcatctctgacctcattgcttctgataaaaaaaccgatatgatttatatcattggccccacacaggtaatgtgcctctggctgctcaagatttttctctttctcttaatttttcaacagtttgactgtgttgtgcatgtgtgtgtgagtgtgtgtgtgccctctgtgtgtgtgtgttcatcttctttggagtgttttgagatccttgggtttataagttagtgcttttcatcaaatataagacattttcaattacattttctctctattcctcttctgaaattataattacacatatgttaaactatgtgatattatgccagatgtcgctgatactcttttattaaaaaatattttctatatgttcttaagattggatagcgtatattgagctctctgccagttcactgaccttttcttctgttgcctccaatctaatgttaggcttatccactgaaattttcatttctgagttctagaagctctatttgtttttgttttttgttttaccccaagttgttgctattttcttctctgattttctatctgttccttcattattaaaatattttcctttatgtccttgaacatatttataatagctactcaaaaattcttgtctactaattccaacacctagagtaccttggagtttgttgctattaactttttttttctttcgagtatgagtcacttttttctgtttctttgcatgtttataagtttttattatatactgtgttttgtggataatagatttagagattctggattctattgttttcctttggcaacatcaatcagttaattatggaatgtcaccttaaagttgcagaaccttggttttatactctttagggtaggcctatttagatttttccttagtcttagggaggatctttaatcctgggggcatagttattactcttaggtatgaccccttcctaggattttagtgaaatgcccaagatgtttccaaacagctcttttggaaaaattgataggatttaaactccaaaatctgtctcccaatcattgagcaatgggcaattggttgaaatcattattcagctttaaaaactttagctctttccaggatttatccccctcaatttccagtcactctggcagccccaaactctgtcctctgacacctcaagcaataagatcacagctttctgcctggcggactagagagagcccttagataaaaacagggtaagcataggaagcacgggtgcagttccttatttcaaaggtcaaactccagtttctctctgccagtgctttcaatttttaaaaaatattttgttcagagtttataaatcttatctgcaggaggattgggccagtggaggatactccatcatcattaaaactagaacttcttctatacccactttatggttcttaaaatgtattccaaaattgaccttcacaaagattagacattctcactggcaagaaatgagagtccctgatatcctttccccttggcagccagaatttcttagaccaaattgcatagaatgccagaaccttagaaaacaccagacccagtacttcccagctcaaggctcctgaatcccaaaagcgtttatgagggtagcacagggtcaaatggcagcttctataaattataagcactatgtatttttccaagcataaaatatacagttattcataacacaaatcttaaatgtcattacttttggttggaattacatcatagttttcctgcagacataggttttctcttgctcatcagaagcactgctttatagttaagtacatttttggtcaacctcaaatggcaaggtgtattattattattgataagtgacatgtggcttttaggacataggaacctcagaaagaaagtttattagaagaattcttggtggccctgggcactttgaatagtaatgagtgtttctggttgatgaatttagatttaatcattggatctatctttgtttataagagctgctatagctttagcttcattatttgctgaggccccaagacatgaaagcacttgcctggagtgacacagactgacaccccttgtgggttcagagatcagaaactaagatcagactttgttctgaacacagcagcatttataactgtgaaggactaattctgatacctaccatgtttcagagacaaaatataaaagggtaaacttagagaagagcactttagagaggcatccagagagaatgttgatgattggatggacatgaccttttgaaatgcctgtgatttctgttccatttcttaccccggcaagaataaaccaattggaattcaggtgaatgaattttgattgagcacagattcatcatatcttgccaggtttgtcctttatttgtctccaatgctgatgcatctggattcacatcaactccatccactacacttacaaaggcaaatgcttccccaccttctgtaatcatggaggaaatgtatggtatagggcaagcacataggtggctttttctttataactcctgtaatatccaggccaatgttacatattccttaatatatatttactgcagcaaaatttagatttatttcaccatatttttccccagaaaagccagcatccccatttacagaagcaatcacagaaacatggagaaattcattacagtcttagtgcctcagaaggacataaatcaacttttaattacctctacctggagatgcttggtgcaatgtgctgtgtgtgtgagactgaatgtgtgtgtgtgtgtcggagattgagtgtgtgagtgtctgagaagtgtgtgagggtgtgaggtgggtgtatgtgagattgtgtgtgagagttagctacgcatctcctctgtctcctcagagccatttcttttctaattgtgctctcagacaaccagccagctaagcagggtctggcgagtctgagacattcatgctggggtttgcatgaagcttgtctccaggaatccaggacacagtttagatttgctcagacccgtctcagcagcctggagttaggatgaccagatcctttgaaaggtaaagaagctgctgcataggaaacagaaatgagtcaatttctgggaagttgctagagtttgaatatttgtcccctccaaaacatgtgttgaaatttaattctcggtatgtcagtattgagagacagtgcctttaacaggtaactgagtcatgaaggttcttcccttatgaatcacagggttatcataggagtgggactgatgtcttcataaaaaaggaagcgagacctgagctagcaggtgagcatgctcagcccccttgccatttgatgctctgtgctgcctcaggactctatagagagtccccaccagcaagacagccccactagatgtggcccctccaccttggatttcttggcctccagaagaaaataataaatgcctggtttcgagtgctctgttatatgccacagaaaaagacaggagtggagaggcttataacccccaggatggccacaggcttatatcccttttatcctcaggggtgaacccttgcctacctgtttttccatccagccaggccagcactgtagcagagggaaaacccaagggccccatatcctggcaatgcagccaggactagtgtccaaaaatatactgggaatggtgctgtgactacatgctgtgaatggaaacagcctgactgcagagggaggagtcaggaggggcttcccagaggacagggtggggtggggttcacccctagtgcagcctcagcaggagaatggggggttgttctctctccactgtgaacctggtgttcttcccttctctggggtctggctcttctactgagagaacaaggtgggcaacagaagtcaccaaaacctcctccagttgtgcaatgctaaccttgagagcagggccaggctgagacaaacacagaacccagcttcttgcagataagatgtgaaaagagtctgttactcattccaggtcctgtggcacttttagcagagatggatgtttccagctggggcttgccttagtttactagagacactgtaacaaaacaccttagactgggtaatttgtaggtaatagacatttatttctcagttttggaggctggaagtccaagatcaaggcgcaggcagatttggcgtctggtgagggcccactctgtacttcatagatggtgccccttgctgtgtcctcacaaggtggaaggggcaagcaagctctgctgcagctgttttataagggcactaatcccatctaggaggcctccaccctcatgacttaatcatctcctaaaggcccacctcttaatactattacactggtagttgtctcaacatatacatttcaaggggacacattcaggccttgcagggctttagatcccaccacttcatcttatcctctttcttgtcccttctcccttctcctgaagcttgaactgaaagatgcttgattttggcctctactttgtcctcattgccatttgtgacaaatgaagaaattctatgtatggtgaggacagcaccatggagccccttagactttagacttgtccatttggctctgtggatatgggttgtattttctctacttttctttgagctctccaaataaaaacagttgataatctgaatacattgaccatgtattctagaggtatacagaaacatgtgtggactctgaagccaaactttctggtttagtcctaacttcaacacatattagaagtatgacttgggcataaattatctgggtctcagttttctcgtctgttaaaaaagacagtgatacagccaggtgcggtggctcacgcctgtaatcccagcactttgggaggctgaggagggcagatcacttgaggtcaggagtttgagaccagcctggccaacatggcaaaaccccgtctctactaaaaatacaaaaattagcccggcgtggtggctggtgcctgtaatcccagatactctggaggctgaggtgggaggcggaggttgcagtgagctgagattgccgccactgcacccaagcctgggcgacagagcaagacttcatctcaaaaaaaaaaaagaaaagaaaagaaaagaaaagaaaaaaaagacagttatataatagcaaagacatggaatcaacttaaatgcccatcaatgatagactggacaaagaaaatgtggtacatatacaccatggaatactatgaagccataaaaagaatgagatcatttcctttgcaggcacatggatggagctagaggccctcgtccttagcaaactaatgcaggaacagaaaaccaagtatcacatgttcttacttacaagtgggaacaaaatgatgacaacatatggatacttagggggaacaacacatattggggtctgttgggtgagtaggggatggaaggagggagaagatcaggaaaaataactaatgggtactagtcttaatatctgggtgataaaataatctgtacaacaaacccccatgacataagtttacctatgtaacaaacctgcacatgtacccgtgaacttaaaataaaaatgaaaaaaaacagtgatagtacctacctcatagtattgttcttggaattatgttagccattatataattcttaaagagttcttggcatgtagaaagtactatgtaagtgacagccatcgttgcttttgtaatgattattttgcttcctttctttttgttcattgcacatttaaatttctaaaagagattccaatgtctttattattaaggtgagaggaaagcctgaatttaccttccccctcttcccagctctgcccctcacagcccccagacctttgctttgcttgctggacccaaagacacacaattcttgtccctgtgcctgggaaggggtgttgggattcagggcagatgtatttaccagactgtggtttgggcccctgtgttgtcttttaacttataaaatatctgtataattatttttcattactagccaccacattcctttgttataactgcttttttgaaaatgaatatatgcacattgtaaacaatttcaagtgaaaccgcctccccatcccttgtctgatggctagtctccctcccctgagggccgacgccactgcttgccaattttgacataaggcttgaaaccaatgagtgtccagtgactgggtgagtttggttcctcctacttgtcttggcaatctcaaacagttccaggagaagattgtttcttggagagtgggtggcaatgaaataatagcaatggtggtcaacctttattgagcaggaattgtctgccaggcacccttccaggagctttgcctgagggatctcgtgatctttgtgatgagctatcgaggcggctactgctgcgacctgggatggagatgcccaggtggaggcccagagaacggaagtgtccttctaaggcctaactaacagataggggacttccatctgctccaaggatatctagttccagagtccacactcttggaatctagaaaactccatcaggactaatttatgagcatcttagaaccactttccctgaaatttcctttctacaaacctaggaagggttttttctcccttcttcctagcaagttcttagctttttatggaataagaaaatgcacagagtggccttcatcctggacaggctcctttgatgtgagccacgaggcacctagggctgggtcatctgtggtctctgcaggtggccaccacgtgtccttgggcttccccatctgctccaggctttggtcttttaatttcaaaagcagggaaagagcaggctcacctgaaccttctccagagttctttctattactcagagtccatctagctaaacatgtttttaaaaatatttatttgcactggtgagcccatggccatggtggaagtggggacatgggtaagcaagagtccaccctgccccacggagctcacgttccgcaggagtggaacacacagcagccctgggcaaggcacctctggcctgtccctcacctgctttgcacctggttatgcttcccttactcccagtagcaagtgccccaggaaccccgtgggtgacctactcagtggtaggctgtgcctgcttgcaggagggaccagaaggctacctggggttacttctcaggcatgagccaagggtcacattataaaagctatgccagattccccatagatgatcctctatccaaaaattaggagctcttaagtcataagatgagtcaaatctacccccttagaactcaacatagctatgttcagttttactggaaaataagtcactggaaagcactttttatggttttctaaatctctcttatgcccaaagaagtggttcagccctggtctaaggcactgctcacttactctgattgccatcttcagcatcatcgtgatgatgataatgatgatgatgatgatgatgatataacaagatagtagcaataacaagagctgcctcctcccagttgtgaaattatgtttatggatatctggggctcactgttctctttaggaatgacccctgagggctcatggctcccagcccccagtaccgcaggtaaagcagtgaccctatctccagaaacgtgggtaccaccaccacagtcatagcttagatggggcaaagagtgctgactccagaagccgccatcatcaccgactgtgtcgaatttggaaatggggacagaaatgtacacatacccatgggctttgcagagaggccatcaaatcgactgtttctttttggttgtaaaaccctgaggatctctctgcatttcttcccttcccacccccattgtttaagcctcagtttctcctttgagctacctgggattctgatgggcaggattgctcggtaagcgctaagctctgtccacaactcagccattttgtgtctctggtttgctttggatggcagttttccccttatcctgcccagatttccagtatccaagcccgttattttcttatattcttctttatgacctgtatttttccaaagattgggaagcaaaaatgtcaaggtgatagatgcatatagataggtaaaaagatgacagtcagttttaatcctcattttgcttttctgtatttccaaaatttctacaaggaacatctattgtatttgtaataagaaaaatagtctaatgaggccgggcgcggtggctcacacctgtaatcacagcactttgggaggccgagggggcggatcacgaggtcaggagattgagaccatcctggctaacacggtgaaaccccgcctctactaaaaatacaaaaaaattagccaggcgtggtggtgggcgcctgtagtcccagctactcgggaggctgaggcaggagaatggcgtgaaccctggaggcagagcttgcagtgagctgagatcgcgccactgcactccagcctgggcaacagagcgagactccgtctcaaaaaaaaaaaaaaaaaaaaaaaagagaaaatagtctaatgaaaagcaagttggtgccttgaagttgagtgttttggttgaatgttggctaaggatccagtcccccagaggttagttaaaagcttttcctccagccctatgaccacaggggtaacaactcaactcctcaggccatgaaatttcagagggttatctttgtcctgagcctcagacttctgtggatccaacaagggaagggctgtccggcagtggagacttgacatctcactggctcccaatacttgcagctgcagtgtttcttgagcactactgtgtcacacacggcctgagtgcctgcccccatcttcagagaatggcacccgggtctggttggctcacctcactcaaagtggcaggaccgtctctactgcatgcattttctgtgtggtatgtttttctttctttggtagctcataaaatttccctatctgtgctgggcctcttggtctttaatcttcaacctctgctggagctgtccctatttctttttaattatgcctctttttttatggaagtttcctattaaatttttatgactatatagagctgtggatagactccaacaaaaatgaaatctttatggaatagtcatttctctccaggagcccctgatagatgttcctctgtggatagacacacatgtgtggtgggggtggggaaagtccctctggtcttggctgcagctgggcaggatgcgggagaggcagctgagctgcttattcctcagtgtgagggctgctgggagcgtggggtgcagctcagcttggggggtgggggtgacgtgggatgcagaggataagaagtaaatcttccctaggtgtaatttctttgccttggtgtctgctgaattagcactgctccctaatcccaagccatcaagctacatggctgcatatgagcggagacatgccccgttactccttattcagaaccttcatggccaggcacgttggctcatgcctgtaatcccatcactttgggaggccaagtggcagatcgcttgagcccaggagttcgagaccagcctgggcaacatagtgagacccttctctatataacataaaaatttaaaaaaaaaaaaaaaaggagaagaaaagaaaagaatctcctgcccaggtctgccagctgagcttgcaaaaatgttatccttggggctaacattctgtattagttcattttctcgctgctgataaagacatacctgaaactgggaacaaaaagaggtttaattggacttacagttccacatggctgtggaggcctcagaatcatggcaggagatgaagggcacttcttacatggcagcggcaagagaataatgaggaaaaagcaaaagtggaaacccctgataaacccatcagatctcgtgagacttataaactatcatgagaataacacaggaaagactggcccccgtgattcaattgcctcacccctgggtccctcccacaacacgtgggaattctgggagatacaattcaagttgagatttggatggggacacagccaaaccatatcacatcctaagtgactgtctggggtcactggaccctggcatgcttccccctgtgccagctaccagctatgtggtctgggaatggcttgggatccacagatagctctccaggggggtcacggaccagagttgctgttgcagggtgtgagtccccttgccagggagggaagggacagtcattcacttataaacagatgttgggactcacccaaattgagtgctgggcctagatcagggcaccagggatttctcattcttagtcccgtggagctgatgttcctgaaggaggaaatggagaaaactcaagaaagcttgtaaacgagtgaggtggttttagattgtggtgaatgctggggggcaaacggagatattaagagggctgccaagggaggaggagggaggggttctcatttcaacaatgttcagggaaggctgcctgctggggcgatcctggagctgggacaggatgatgaggggcttgcatactcagatcaggggcagagccttccaggcagcaggaccaacaagtgcaaaggccctgaggtggaatgagtttgtcaagttgagaaacttgtcaagatgagcgtggctgggacagtgtaagccatggggagagtggagagacaggaggctgggtcaggcatgggagatttttaatccttgctaacttactttaaatgtctaaagacaccattttgactgctggacaaagaatggactatggaattgcattaaagtccagaggtccagtttttggaaccaccaggaaggcaacacaatgcgcctactctcaaagggatttggggaatggaagaaggtggggttattgtttcatcaggctgcttggatttagacctgttttcttaagctgcaagatctcctacaaaactggatcctcacctaagtttggaggacaactgagaagtgatagttatgtttgcctccctgcagagaataaactctcaggagaggatggagcactgcagctcttacctatgaaagttgataaggaagggagtctccaatgtgagtgtggcaactgtctactcactggaaggaacagtgatacatatcataatagggaaggaaatgaacagcatccattatgtgatggcgtctatcccatgtgttaggtcctgtaactgacaacagccgccctgaaaagtattattgcatatgagactggagaccagagaggttaagtaaattgcccaagatcacatagctactaagaggcagagctggggtttggactcacgtcggcctgactccaatgcccttgcatctgtcactcgtgcccatagccctagtcaacacccacatgctaaaggcgtcagtggtcccctctaacaaaagctgttatggcttctcagagagactggagtccatggctgggagaggcaggggtaccctgggagaaccatgtgtcatcagggttctttccaggcccttccagccacccacccatgggcataaggcctaccccagctctgcaaggtttcaaaaaaacatgcttgacacttgaacaaaaattggctccaaaacataagaagaaagctgcaaaaccataattagtaatttagatcaataaagaataaggactataaagaagagagtaggggaagtagggaaaaaaaggaacatgatgtatttattaccattgaacaatacacttaaaatggtaaagatggtaaatcatatatgtatattttacctcaataaaaaagaattaaattaaaaaaataagcaaaacaaacgatcttattttaccttcatttatgctttctctgccctgcatctctgcctgatgctgaccccagtttctgactaataaggttttccttctgcctgaagagcttctgcaaagctgtccttaggacagatctactcgctaggaattccctcagtttttgtttgagaaaaatatttatttctgtctcacttttttaaaaattaagctttgttttgttttgttttactataattatctttttgtttgtttgtttgttttgagatacggtttgactctcccacccaggctgaagttcagtggctcaaacatggctcactgcagcctcaaccatctgggcttaagcaatcctcccaactcagcctctcaagttgctggaaccagaggcacacgccaatacatcatgctatttttttttttttacttttgtagaggtaatgtcttgctatgttgcccaggcttgtctcaaactcctgggctcaagcgatcctcctgccttggcctcccaaagtgctgggattacaggcgtgagccaccacgcccaggccaaaattaagcttttttatctggagatcattgtaaattattctgcagttttaggaaataaatcagaaaatatactgtgtgacctttatccagtttcccctaaagataacatcttatatgatagtataatagcactgccagaatattggcattgatatacttttacttgtcctcattgtgtgtatgtgcacacatgcatgtgtatttagttccatgcaatcttatcccacatgtagggtctgtgtatccatcaccacagggttcctcttgctgcctttttatagccatacctccttccatactcttctccttaacccctggcaaccaataatctgttcttcatttttataatgttgtcatttcaggaataatagactcgtggtgtgcatgtcttttttgctcagcacaattctctggagatttttccacactgttgggcacatcattatccaatgcccccttttcttgctgagtaggactctatggagtggatgctccacagtttatttaatcagtcaccgaccacacagagtgaggctggagagaatggcagatgagagaggggaggggtcgggacagggaaagaaaaccctctcagagatgtctcacgatatctgcagtaaaacctatactctcaaacaaaaactttcttggtggactcttttcttcttctgggaaaagaggcaacataaatggacgcagatcacctgccacatacacatgtgcatactgatatgtcccctcgtgtgctcatgtgtacacatttttgcacatgcatacacacacacacacacacagacatgcctgtgaagaggccaaccccagtgtgcagcagctgtgagggggctctgcccctcctctcctagaatggaacatacgttcttgtgaacatagagagtggcattttcttatgtcgatgtaatgtgaacaactcctggtcaccagcccccttgaccactgatgcctcttcatgggtcggtgagtgagggagacacagccatttattcctggcatcttgaattaaacttgaaattactgcccactagaaataaggcctggggcatagagtcttattattaaaatcttttgtggaaagtcacagggctccaatcaccccaaaaacattgtgtctatgggaaaatgcaccttgagttccatcttacaaatggatttgtaacagtttaggtttcatgtaagctgttcacagtatcctagtgatacatgtttatggtaaaaaatcttggagggtaaagaacaaacactgcccataattttttactgtatacacttttttttcttataaaaatgttactctattgcacatagtgttttgaatcatgccaatttttatttggcaattatataaaggcagaactttaaatatcacccccaacattctgtgcctatgcctcagagcctatgcttaaaaagagcaatcatattcatgactacgtatttaatgcaacattagaaaactaatgcagtcataacccacaagcgttttccatgccaatgacctttttgccatctggtttagtgactgcagagtatcccattacatggttgtctcacaccttggcaagcatcccttaaggatggacactaaatcatcatggggtttaatactctcatccacagaagagactcccaagccagtcctcacatatcttgctctcattactagggcagagggttctaagaattttcctcttatgggccaccaccagagcagaccagactcactgtttccatgcctgctggctcttgctgccaccatgccctgatttcaaataaccactccatccatgagctaactgaccttagaaagatatacttttaaaatgcatatcctcccaattttcaattaaggccaaaaggagtagtagagaccaaatatatcctctttcatgaaacaaacaaaaaatggcaaaaatatgtgaatctacgaaaagatactagaactcttaagtgaatttagaaaggatacaagctgttatatcaatatttaaaaagtcaatttcatttatatgattaacaatgaacaatcagaaagtgaaatagagagtgtcatttataatagtatcagaaatataaaatacttagaataaacctgacaaaggatggggaagacctgtatactgaaaactacaaagtattcctgagaggaattaaataaaacttaaataacataccacattcatgtgttcagtctgaattacaatgtctaaagttaaacatactgaccacaccaagtgttggtgtggatgtggaggaactggaactcttatatgttgctggtaagaatgcaacatggtacctccactttggagaacagataggcagtttcttaaaagttaaacatacatttactatattactcagccattccactcctaagtatttactcaagagaaatgaaagcatttgtccacacaaacattcttacatgattgttaataacagctttattttcaatcacttgaaactgaaaatgatccaaaggtatagcaacagataaatggactgtggcatatccatataatggagtactatcaagcaataagaagaaacagacagctgggcagtggctcacatctgtaataccagcactttgggaggttgaggcagatcacttgagctcaggagtttgagaccagtctgggcaacatggtgaaaccccatctctactaaaaatacaaaaaattacccaggtgtggtggcgcacacttgtaatcccagctactgggaaggctgaggcaggaaaattgcttgaacccaggaggtggaggtttcagtgagccgagatcacgccactgctctccagcccgggcaggcgacagagagagactgtgtctcaaaaaaaaaaaaaaaaaagagaaagaaagaaagaaaagaaaagaaaattagcagggtgtggaggtgcacacctgtagtcccagctactcaggaggccaaggtgggaggattacttgagcacaggaggtcaaggctgcaatgagttgtgattacattgctgcactccagcttgggtgacagagtgagactctgtctaaaaaagaaagaaaagaaagactattgatacgtgcaaggatatggatgaatctgagaacaattttgctgagcgaaagaaagcagaggaaaaaacatacaagcagcatgatttcatttacataaaatttttaaaaatgcaaactaacctatagtgacaaaaagcagaacaatgggaatttataatgttaaacacatatgtttattagaaaaaaaaagatctacagtcaatcattcaggtttccatcttaggaaactaaagaaagaggcctaatttaatttaagcctgaagcaaggaaaataagataagtaattaaaaattagaacagaaattaataaaattgtaaacaggaaaacagtagagaaaaatcataaaacaaaagctggttcttggaaaagatcaataaaattgataaacatttagtcaggccaatgaagagagaaaagacacaaattattaacattagaaacaaaagagaggtcatcacaactgatcccatagacatgaaaaggttaattaagtaatacaacaaacaactttatgctcataaatataattaaggtgaagtgcaacaattccttgaaagacacaaactattaaaaccccccaaagagagtagtcttatattcgaagagattgaataatttaaaaccttccagaaaagagagcactaggctcagatagtttcactggtactttcaacagaatacttaaagaggaaataataacaattctccacaatatcttccaaaaaatagaggcagaggcattgcttccaaactcattttatgaggccagttatcttagtctgtttaggctgctgtaacagaacaccacacaaactgggtggctcataaacaatagaaatttatttttcacaattctgaaggttgggaagtccatgagcaaggcactggcagatttggtatccagtgagggcctgctctctgcttcataaatggttccttctagctgtgtcctcacatggtggaggggatgaggagtctcccttaggcctctactataagggcatttaggtctcttctacaagggatcacccattcatgagggctccgccctcatgatctaattacttcccaaaggccccacttcttaatacaatcaccttggaagttagaattccaacatatgaatttgggggaacacaaacattcagaccatagcacagtatattaccctaacaccaaaacctgctaatgacattttaagaaaggaaaaactacagaccaatatctctcataatcatagatacaaaaaaatctttgaaaaaattattgaatcatattcagtaatattatataacataaccaagtgggattcattccatgtatacaaagctggtttgacattcaaaaatcaacgtaatttaccatatcaatgggctaaagaagataaatcacatgactatatcaactgctagagaaagtatttgaaaaaaatcaatacctatctacaataaaatctctcggcaaactagaaacagagggtatctcttcaacttgataaagaacatgcacaaaaagcctgcactaaacgtcatacttattggtgagaggctgggcattttccccctaaaatcaagaataaggcaaggatgtcctctctcaccactcctatcgaacatcatactggaagtcccagctacagcaataagaaaaagaattaaaagaaagatatacagactggacaaaaagaaacaaaaatggtctttattagtagatacactgtctatgtaggaaatgccaaataatctgtgcacacaaaaaaaggtgaaaacctcattggaaaaggtgagtataacaaggacacagcatacaaagaaaatataccaaagtcaattgctttcccatatacaatgaacaattagaattttaaatgaaatttacattaccatttacaatagcatccccccaaatcagtatttagttacaaatttgacacaatctatggaaactgtaggcaaaaagctagaaaatactggcaaaataaaataatctaaataaatggcaagatagtccctgcttatctgttggaagacttggtattgttaagatgtgaagtatttataacttgatcagagcagtccaattcaaaatcccagcaggttattttttagatattgataaactgattctaaaattaatataaacaagcagaaggcctagaatagctaacacaatactaaagaagatcaaagttggagtactcagagtccttcatttcaagaattactataaagctataataatcaagatggtgtggtattggcaaaaaaaggacacataaatcaacaaatggagatgccagaaatagacccccccacacaatataataacctgacttttgacagaagcgcaaaggcaactcaatggagcaagtgaagtcttttcaccaagtggtgctggaacaattggatgttcataggctaaatgaatctggacacagaacttgcaacttacacaaaaaataactctaaatggatcataaacctaaatttaaaatgcaaatttataaaacttttagaagaaaacataagaaaaaaatttatgtgaccttgggtttggtgaggaatttttagatacacgaccaaaagcatgaaccatgaaagaaaaaaaaatagagaagttggactttattaaaattaaaaacttctgctctacgaacaattctgttaagataatgaaaacacaagctgcagactgaaaagaaatatttgcaaaacatgaacctgataagaaacttgtatccaaaatattttaagaaatcttaaaagtcaacaaaaagaccataagtaatccaattgaaaaaatgaataaatctgaacagacacctccaaatcaccaccaaagatgatatttgtgtgtgtgtatacatatgacatatacatatgtacatatatgtatatatatatatcttacaaatgggaaataagcatgtgaaacatcatctgtcattaaagaaatgcaaatgaatacaacaatgagctttcaccacacacctattagaatggctagtatacaaaaaaccaacaataccaattgctatgagaatttagaagaataagaacccacatgcgtttctggtgggaaggcaaaatagtacagctactttaaaagatgtttggaagtttcttaaaaagttaaatattattttactgtatgaaccagcaagcatactcctagatgtttacccaactgattgaaaactacgtccacaaaatacctgcatgcaaatgtgtgtagcaacgttattcataaccaccaatatctggaaaaccaggatgtctttcagtaggtgaatagattaataaactgtagtacatgcatataaaggaatactattcagagatataaataaatgaactatcaggctatgtaaaaacatagataaaacttaaatggatattgtttactgaaaaaagcttatccatttatattatgttctagaaaaggtagaattatcgagatggtaaacggatcagtggtttccaggggcctgtagagatggaagagtagagtaggcaaagcacaagagatttttttttagaatggtaaaattattgtgtatgatactgtggtggtgaatacataacactgcatttttcaaaacccatggaattttacatcacaaagagtgaaccttaacatatgcaaattaaaaaaataattaaagatgttgggggattccaagatgggatgctgagtatgacagaagactaactgtattacaaatgtataaaataattccactgaaggggtgggaggaaagcgtgctgaccaagtggcattggaagtgagtggagactgtaagactaaaaacataaggaactgtccacaaccctgtattctagtagataaagctctttcccaaaaggatataaattctgaagccactagtcacacactctgaaatgtgaagtcactggatggaggatggtgggagccaggtttatctttgttggaggggaggctaccaacaagcaagcaggaaaggttgcagtgattcatatggcagtggttagtgttggggacatcaacgtggaatcgagttcagctcaaaatagatgcagacggatatgtacaatacacttacagatatgggttggtatatatttccttgttctgtctcctgacagggcctgaataagtgtcatcccagtagcaatgagcacacctactgtttacgtcttagtttttgatgctgttcttttttttttctttgtaacatttaataagctcaatctacatccagaataatttacatgaaaggacaatatttatttaaacagagctcagtggggtagccatggtatcatcagagtgcatccagaggaaaagagggaggaagggccgaagaagacacaatcaacggcactcccacacttttactgtttgagccacgctgccagtgaccacatagggtgctgtcttgtggaaatccaatgaggtaacaaagtgttcatacgcattgagggtcttcatgcattgcctgttcttgtaatcccatacgtgtagggtcttgtcatcagcacaactcaaaataaatttccccccagaactgaacagaacttcacgtacccagttaccatgacccacgagggtcatgaggcacatgccggtactgacatcccacatcttaatagtcttgtccctggatccagacagcaagaatggcccagatttaccactattttttagtctcagagcctgttgcttcagagatggaggaatatgagctttctggagcccaggaaatgcattctaccacatgctcatgttctcggagctcacccttgcattgcattgttgctacaacccatacacgcacagtctggtcattggaacagctggctatcagagtgccatcttgatttggttgtacaatatgtacccattctctctgtcctgtgaacatcttcacacagtagccagtttgcacttcccacatttttatagttttatcccttgaggcggacactatatgatctccactggccatgatgactactgaggaaacattatggtcatggggaaccatgactatgcatggttctgatgcattcaaagtcctgaaaatcccatggtttaatggtcatagctgcagaacaggaagccagaaacttgccactgtggtcaaatgaaatgtcctgtacagagtctctatgtccttcctttaagagttctttcaaaatctccagtctcataatcccacaccttaactgtagcatcctctgaagcagagaccataacactgaacacaggatggaaaatgactcgaatgattggactcctgtgaccactcaatgtgtattttttctggcagaaaatacccattcttttgggtcttgtttctgaccaagaggtccacctgacgtaaattcttcttttgcttcatttagcgttgattctaattccataaacttcttttgtaatctaataacagatgtccattttttccccaaaacaccagcctactttatttcttcattcatatctaattcagcttcctttttaaaaactgaatatgcctcttcgtagccatttgaacgaagataatctgctttagcttgatttagttcatctcgttgtctctgggacagcaccatcttggctgtaatgtcaagcttatctcatatagtggtatgtccctcctttgggaaatgaaaaagctttttgatccgtggacgtataatataaatatgacactaagtgtcttccactcagcggaaaatgattcttttacaaatgaatccaactagtaaccagaagatattcaacaagtaagattcattctactctcccggccgctggattctgccactgccccgccgctccagctctgtctgtcacaggagctgccccaacaccctgacgtcactgtgccaccaccgccactgcccccaccaccgcccccactgttcttaataccatttaataaaaggaagtaagccttcctggagaaatggctgattctaggacaggcggggaatgtacaaaatgagcctggaggagcattttacagggccagaaagtaagaacgtgttcagaagaacaaacaataacacacaggtcaaggagacacagtgaccacttgaaaaagctttcaatggcctaagctggaacaatttgagcaataaagtagtattggattataaataacccaagtataaaataaatatgcatgattccatactgatttacatttatatatttagttaatcacatacatatgaataagtaaatggcagagaataggcacatctccagagtggtggaatttcaggtaatttatgtaatagtgcacccccaaggaggtggagcataattctcccctccttaaatatgggctgcacacagtgacttcctttcaaagtgtacagtgtggaaagggggcaggggagaaacttcacagtggagacgtccaacaaacactgcctcagccagatgatcatggtcaacatcacgagtgacgtcatgttgataggatgtgctcctgatagaatgtgatgaaagtagcactttacttctgtggtcttctcccaataatcataggagaaaacaccaggcaaatcccaatgttgggacattctacgaaatacctgactagtgttcctcaaaactgtcaaggtcatcaaaaacaaggaaagtctaagaaattgtcacagccaagagaagcctaaggagatgggacaactcagtgtaacatggtgttctatggtggaaggacagctgggtcaactaaggatatctgaatgaagggtgactttagttaatatgcatcaacattggccattaattgtgacaaaggtacctcattaatgtaagatagtaacaatgagagaaactgggtgtgatatctagggaaactctctggactattctcaacttttctggaaatttaaaactattctaaaataaaaagtttatttttttaaaaaggaaggcaatcccctttctctctcctccctctttctcctttccctctctttcctcatttctcccttttccttcctcctcttcctcctgccccctcctcttttcctttaacaataacaataatgtgtagtccattctcacactgtgataaagaactacctgcaactgggtaatttatgaaggaaagaggtttaattgacttgcagttccacaggctttacaggatgcatggctgggaggtctcaggaaacttgcaatcatggcggaaggtgaaggggaagctaacacatcttcacgccggagagagagagagataagggggaagtgctacacactttcaaacagccagatctcgtgaactctatcaagagcacagcaaggcggaagtccacccccgtgattcacttacctcccactaggcccctcctccaacactgggaattgtaattcaacatgagatttgaggggggacacagagccaaaccacatcaaatggcatcacacatgtgaccagtacgttgtcgtttccagctctcttcccttgcattattctgcaggagcccttgccacagtgcagtgctggatgtggtattcttgaattcacagttgggccagggaggtgaaatgacccacctaggaggtagcagaggtgctagcagcactcccaagactcatagtgaattctcctgggcctgtccgtcaccctgttatgccacttttcatttccctctgatcacaaatgactcagcacacagtgtaagtgctacaattttactccagaatttgacttgtattgtcctacagactgcaggtaccctcttgttgctcctttcccttgaaaaaaaatacatcatctcaaaagaacgcaaccaggagctggcaatggcactggaatcccttcctggtcacagaattgatgctcatctgcccagtgcatggcacttttacaagaaatcttatttggtcaaccccccaaatatcacagaaggacattattattatctccagtctgcagttgagaatgctgaggctagaaagtggttaccactaaaagcaaaccttttctctctttcccattgcctatccaccctgactctgggctctgacccatacccacctgctcaaggtcccaggtaggagttgcccattcttttaagtatgagttcattcatacacatcaccatgtgaggcttgatgtgacctcagtaacaagcaggtctcatctgccctgtgcatgtgaatgtgccttaggaagcttatcaaatcccaaaggagaaattacatcctctaggaaaagtacagtgaggtgactgtcccgtttcctttactggctctggaccacagctgagttcccatgcacgcactgtggcacacgagagtgtgggcagaggcacttctgctgagtgggatgaaacatcttaagtgctctgagggttgaaactttgaagaggttgagatctgtgagagctgaagaacctttgaatctcccttcagctctccctaccccaaccacagcccttctcttgatgtaaaacatgtgttcagatagaaaacaaatgaggcttacttctatgccagtaggactgtttggctttaagcttccccagtggttgaaaacagcaatctccgagatttgcccaaaactttaaatggaagtcactcccatgggtcacatccatggatttgtgagatagggcaggaggctgtgtctctgctacccagcggtgggagcaggggtctgtgcagcctgattgtattggggatgggcccctcgtccagttgcctatgaggataacctgcggagaagatcagatggagatacctggacttatgcagaggcgtgttcgggttaaatagaaatgcccagggtccaatagagggaaccttccaacaagtgtatgagttggcctctcacccgacgctggccacccagatgacagcttcttggacatgatgaatggcctcacttccaccagaacatcttcctgccaggccctgctgctgcttccccagctgtgtggccttggatgagtaacatggcctcttattaaagaaatggatgaaatactttctaaagaatcttccaactctgaagatctgtgacatcttgtcactgaattaataggaaatcagctccttatagatttggtctatgttaggagacaacctctgttgatgggctgaccgaatgtctgaagtgggaaggatttggggaccaaaacaggtaacaagagtagacgaacacaagaaattcaggttgaattaaccttcaacagatatttattgagtaacttctacatgtaagtcaccaaaatctgggaaggggaaatggataaaagtacgattctctctctggaaagcctatagtctaattaattgatgtattaagtaatgctgggtggaggaacaataacccaggacttgtataaacaataggaaactctgggggaagagcaaggctagaagagacattatctgggaggcaattctagagcaggtagatttcaggaacaggacaatcaaagaaaaggagagtggcattcacacatcaagtctaataatatggccttattttatggtccacctgagtactgcagaatttagccctaggtactaccaggtccaaagctgcttctttaagctacactttaagctcctgtcactagaaggggctgtcagggtgccagggattttggtaggttccgtgcggacttccctagtcctagaggacgttggagtcactggggtgtgaggacattggagagacaggaatagagttccacgctgcgatgaggagatggagcctgatgcaaagccacagggaggctggcgttgttggggtgggaggaattcccacccagtgggagagttttacattgaggactacatacctggtcagggtataaggcaaagtgggctcccactcctgacatgttcctctttaccgatgttccttgtgaacttattccccacctaggacagctaacactttaagctcttgactgtcatttatactttattcatgtgaatgagtttttagttttctcttgaaagcaagttgggatactaggaaagttgacaagagtttgagtttctatgttggttgggaaagagtgatgtctccacatgtaatttgtagagggtcccatcagtttccaaaagaggaagtgggtgtttgtcttgcttttgagacattttgggagacttagacacaatataatttctattgagaacaaagtagggttaggatttggagaaggaagacagatatttccttctctctgctaaagagatggtctggagtagaaaacttgtggactgtgtttacaattgtggagtactactcttggttaaaacaataaagcagaatcgatgtctgtagaacagagctggaaggggcctcatggttggttttcaaggtaaactaaccacagacatcagttttccactcctctgcctttttagcatctgggttcatcttccaggaaggccataacaaaactccacaatctgaggatcttaacaactgaaattgattgcctggaagttctggaggatgaaagttcaaggtcagcttgggcagcgtaggtttcttccgggtgccatgagggagaatcattcgtgcttctggtgtttgctggcagccgctggtgttccttggctggcagaagcaccaccccaacctgtctctgcatcttcacagggcattctccctgtccgtgtgtgtgtctgaatttcccccttttataaggacaccagtcatgttggattaggggcccaccctactctagtataatctcatcttaactaattataccggcaatggtactagttccagataaggtcacatcctgaggaactgaaggttcagacttaaacacatgaatgtgggggaggagacgcaactcagcccataaccacattctttctacacagggagttcaagttagagagcccatcaaatcatgcagggaaaggagatgaaatcctctgggtccgtcactgtttgaggcagccctagacacatgctgagctattgtccccactttgccaatgcagactaagcttgtgtccatggaaaagcccagtgtgaactaagatcactggatgcccaccttggtgctgggggccggggcccacacagaagtcccaggcccaacctgaggggagcaggctataccaggccgaggatggcccccttgatttgggtgcacactcaaatgtacaaactactgcctgcaccacagagactggcccggaggtgttatcttcccagagggctgggcaaagggctatctttgaaccagctgttcccactcaggcaagagtggctttgctgggcctccacttcctccactgtaaaacgagggtgatgctctgccctgcccgacccatctagggtcaggtgaagatcaaatgggataataagatagaatgtcttttgaaagacccacacacgaaggtggcatgagggattgtctttatgactatcatgttctatgcagccctgactgttacgtgctagctggctgtctcatctcctcgaggtgtcctgcgtgcctgctgatggggatgattccaatgactaaaaggtacctggccttctccatgcccagctttacatccagtagaggctcaggccaccctcgatggcagcctgcccgctgcgggcctgcttgtctgctcaaagcagaggttgacttgcgcccaggttgcattccagaagtcctggcctgctttctccacatggttagcttcgagcagtgagcttgggagcagcctttctgcgagttctgccaggtgagccagcccgcaggagtagggggtatcccaggcacgcacctgtggctcaggtttctcccttgtggcccgctctctccccactgctgttttccagagcacctccatcctgcaagattgacagctcactcttggtagggaacagagtgtaggaagtgatcgtttcaaacttctcttgcagctccatctgccaaaagcccctctaccagttgccgtatttaccctggctgccaggcctctctcagctgccctaagaaaacagattaccgtccagagcaaagtcctcgtgtgtttcctttctggagatgaatcaagttctgaaagaaaggtttcctgtagcccattacaccatttcagtttgttttatctgtctccacctgcagagcagggaattaacctgctgcccagggccgggccagcgaatgcttggaaggaaagcaaagcgcacgggtgtgcattttttgacaacagaccatggccttgttctcctcagcagagcattgtccccatgaggcccaggcccaaatctgaataggactttgtgtaactcgatctgttttccttcttggctatagtctctgtgccaaatttaactgtggtctgtatatatagtgttgtgggagggtgggggtagaccagggaaggttgggggaggggagtatatccatgcagtttttttcctgtcttcctttttttgtgcttgcctgctttgctcactgtttgctatatataactcaacatgactgtcctcgcatctccagtcattaaccctttagggataactaatgcacctctttatgtaggcccctggctgggaagcgctggcactgttggagttaacgactggcccctggaaagtgaacttccccagaagtgcttgtgaagcaattaacagggccccactcagatagtaaaaatatcccctggcttacaaacaagcagagaagcgcctccaagccaagagtcaccgctgtgccccaggcatgtagtgggcgctccctctttgaaagtcttgtatcttagactttgcagaaatgctacgaaagctggtgatgcagcaacgatttcaggggagactgaaatctattgtccaactgaaagcctgtcagggctgggcctctctcaggaggtgaaccatcccaagggtcatggaaagagctactcattgtgggcctggggtgacagtgacccatcctgggtgaacagaagcctcacttcactttgccggagggagacagtaggctgacaaactattgtggaatctcctaaaattggttgctaaagggagcttctcaccagggccagcttgcctgggctcttctttcaaagggtggagtgttgtctgccagtccccaggctcaggggatgcaagtgaaagggcttcgggctttactgttcatttcctcagaatcatagaagtgccgaaaattacaaaactgcggtctccctgcaagggactcaagatgtcttgggtcatcttaggctatatttagaatggaaaatgtgttggctctgaggaaacagggtatgtgtccttctccaagcaggatgctatgaaccttgccccataggccctcctacccatcctcacagagccctgaaactcctcctccaggaacccttccagccagtgggaagaccccacagataggacccagtttcccctgtgaatcaacttctctagcacgtcccactgcccagggctgggaaggtccagtgtgcccagtgtggcactgttttccagggctggatgcatgtttggtcctccagtgggaactctgctatcgtccctgcttcaccaggagtgatgatggggacaggcacggcagagagtggacacagggatcctggccttagggggcagtcactcatccagctcacacttgtacatacgtcaccatggacacagaggttttcagtatgttaacgatttgcacagtccacatcagcatcccgttaactttctttttgtaaccctcagcatggttttaagaacctggaagtttattgcgtaactgttttgcttgtgaagttgcacatgatttctcagaaagatcaactcaaacccaccttgtcacccctctccacccaggccccacttcctgctttgctggggctggggggtcagaagtaacatagctagagacagatgtccatcatctgtgcttgtgatgacaaaaggaggtaacaggagtacagtcagaccctcactccttggagccctgttgtgagccgctcatggcatgcaccattctctgtcctcacaacagctcagacgggtaggaattattggattctttctctaaacgggaaaccaggggttttaggtgccttatccatggaccctgccctcacctccctcacccagtgcccccctgtgccttgctggctctatctgtgaaatttatccatggaccctgccctcaccttcctcacccagtgcctccctgtgccttgctggctctatctgtgaaatgtctcaagagtccatcctgttgtctcccatcccatgtctcccacttggcccacagtccagactcttacctgtccagactcctactccagagagagccggcaagatctttgggaaaggcacattgagccatgtccttctcccccttggaactcaacagtggcttcctgtcactctgagaacagaatgcagcctcctccctgtgcatgacaagcacctccctgaggtcacagctgtgtctccctgactctgcactggtccagtccagcctcaaggccttaaatttgccactccagacccctggtttggaccctggactctgaatacattctggtcttttcctcagggaggtcgaggcactgtcctagcttgtgacctgctcccatacctattttctcagggtggaagcagacgctccaactcccacactgtgaggctggtaccattacctccaagacccaaagcctgtaggaagtatagcaggcctcacccaataccctgcagttccctcacttgctccaagtgggaggtgggtcttcacgggtccccaagatgagggtcagtggctttcctctttcacaggctacagtgggagcgagtcttccaccatgggacctctggccagatctcagggctctgtggttgggggaaaatggctctctttcatggggctttaagacatgaactgacatgacatgtcctagagactatccagagagcatgtggatcactttttgctgctttagatcaccttctttaaaatcaatgcattgacatactttcagcacttaaattttcgtattctattatcgcatcatctcagaagaaaagtctttcataattaatgaatctcaggttgggttaaatattcagtggctgcccacacaccacttactctattgcttcaaaataattggctttcacttatcaggtctactagaatgactgtcttaaaccagtcacgtggtggaagcgtcaccatgtttcttgctcagaaaataccctttcaagggcttttctaggggagccggaacagtagccaattctagtgggacctttaagaaacaactttgcccaggatgatatttgagccccctaaagggccaataggggtccctctattcaactttccctccgagtcccaccaacctccccactttggttccatacagcttggattattgccctactagttcaaaactgaaagtttcaaataaaaaccaaaagacaaatgttaagtcacattgaattgataactgagacaatctgtcaagcatattttgctttcctgatttttcaaaaaaaccctaatgttgcaccttccttgttgtcagtttagtacgttaacatttttttaattaaacttcagtatcattgaacaggtcatagagtgtgagcaatattgtctttgttccaaaactccaaatgtaatgaagctgccattcacaattgttttccgctgggctgcttattttaaaaaaatgattttgatgaataaaaataggtgcattttcacagcgtggggtccagcaagaatgaaaaccttacggatcacagcccggcccctgggggtgcgggaggaggtgttgtcagatgtcaattttggctgattgtttttgaggtcatgagactgccattcctgtgtcctgtggtgcattttagagactgatgtcacttttttgagataaattattagagaaatgtttatagatgaatatacatttcacagtgtgccagagttgaggagtctaatgaagtttagaagggacactgggatgagggtgctgagctgcggtgcctgtggcctgtgacagacacctcctgcaccaggaggcaaggatcctgatggtcagatgctcagtccccaacaagagggggttcaaagccagtgcagccccttcctcccaccgctgggggcagcaaaggacccacagtggagattgcaaactatagcaggggctgtgctttgtgtttgttttcaatatttgagccatcatacaaaaatctagtgatttctcattctctatacaaaaaccagaagatctgggccacaaggtctgcattttccccagtatcagtctgctatggccccatattagctgcctagggcccctcactcctgctcctgctagaccctgtggatatttgagtcatgaccttgcctcaaggcttattcatgtattatttgtttatttattgttaacataggaagggtcttgctctgttgcccaggctggagtgcagtggcacaatcataactcactgcagccttgaactcctgggctcaagtgatgctcctgttaaggcatatttagatgggaggaaacatctttcttcctttagagcatctaattattggcatggccctggacaaattatcctagagcctggagcctcaatttgctcatctctgtaaggggggtgacaatgcaacctcatagggtggttgtgagtactacatagaaaaagactccagaaggagcacagggcctccattgggagcccctcagccaacactccctccttgctgcctgcacagcctcaagagaacatggagtcctttgggatgctgaaaactgtaaggaagacaactgtgcattctctgtgtaagcagtgtgcacactgtcttcctcctaaatggctagttggaggagtgaagacagactcactcagaaatgggtgattccctggctgcagtctcctctctgataacaaaggactgggcccagattagagacgaggcaggaattatgtgctgcagaaaggcggtggggacatcttgagtttgtttgtagctaatctcaaataattcaggtcttttccatttgcagcaaatctgattccctcaacacatctgtggtaaaatgttatgagtgcatgcggagaccaagtgtggaggggatttttttttccaccaccaaatccatagttaccctccaagttgtaatcttatcatatttaactggttccacataaacagatctatgtatattttcagtagtttcagctgaaacctgttaagaacagatgtgccaatggttccctggcactgatccatttaaatatattttttccacgaacaggtttttctctctccctttccttagaggggagaaaaaatatgaaagtggaaccaccattaaagtggatattacatgcttctgtgttctctgcaaccagtgtttgccattggttttccaacagcaatttggcacatgaggctatgaacacagagtgtgcatttgatggacagtatttgctctgagactgtgtggctgggagaatgggctgagagctctgtagttgctacctaagctagggtcagccagggttagtttttccctgctgctgctgctaagcagcccctgggcaaaggcttcagcaggccgtctgcctctttgagcctttagtttttcagttgcaaacaaaaaaaaaaaggtccagggagtgggaagataaagaactcctataactcagcaacaacaacctgattagaaaatgggcaaaggacttagatagatatttctacaaagatgatatatattaataaatggccaaaaagcatgtgaaaagatgactggcatcactaatgattagagaaaagcaaataaaaactaaaatgagacatcacccccacaccattagaatggctaatagcaataaaacggaaaatatcaagtgttggcaaggttgtggggaaattggaacccttctgcacttttggtgggaatatgaaatgctacagccactgtggaaaacaggatggcagttcttcaaaaaatcacaaatagaacaaccatatgacccagaagttccacttctaggtgtgtattaaaaaaaattgaaagcaagatctcaaataaatatttgcacatccttattccaatatagcagcattgtttgccatatccaaaaggtagaaacaacccgagtgtttacagatggatgaataaacaaaatgtggtctatacatacagtggaatattattcagccttaaaaggaaaagaaacagtgctatatgctacagtatggaagaacctggaaggctttatgctaagcgactgaagccagacaaaaaaggacaaatacactatagttccacttatatgaggtacctagagtagtccactgcatagagatggaaagcagaatggtgcgctaggcacggtggctcacgcctataatcctagccctttgggaggccgaggcaggcagatcacttgaggtcaagagttcgagaccagcctggccaacatagtgaaacccctctctactaaaaatacaaaaattagccaggtgtggtggtgtgcacctataatcccagctactcgggaggctgaggtataagaatcggttgaacccaggaggcagaagtggtggtgagctgagatcgcaccactgcactccagcctgggtgatagagactctgtctcaaaaaagaatggtggcttccaggactggggaatggagagttgtttaatgcctaagaatttcagttttgggggatgaaatgagttttggagattggtcacataacaatgtgaatgtacataacactactgaactgtacacttaaaatggttaagattgttgaaaagaagaaaataggggagagggtctaatttgtgacaccaacctcatcgatgggggaaggattcaaaagagaggtgcacattcagccagacactgagcctgttgcccgtggggattatgcctaagaggaatgagataggaggggttatgttttctcagctttgaatttctttctcaagaacactcctctgtccaccttcccattgcccacacgacagagttcaccaggcctcctagctctctaccagcctatagccatctgcaggaatgtcctcactgggccctttgggccatgccctgtgtctgtgactctggggcctagcactctgacccactggcctgtgttcctctctggttggaagacagtgcaaaagggacctattccaccttcagtggcctccgagtaacccacctgctccagtctgcagatttccatctcactgactttgccctggcactgggaggggggacgtgagggctgcaggtaggagtttgatggcagatgagcctcaggggttcaatgtcagctgggagaagcaaggccacttccagactcagttctgccactgtctggcagtgaggctctgggcaaaccattttgttttgtctctggtaaaagaaggctgtgggcaggattgggctttgtaattgccaaagattccagatctttgaggggctctgtcttcctaaattctgtgcagcctgctagcctctgcaggacagtatcagggaaacttaacatgcctgtgtttcgtagtgaacaggatatctagggttgagaattactgcgaacactgttatgttgtcacgtgagctggggctccatggtgatgcaccctgggctcccagaacaatgtgaagcactgagatgccctgcacctgggcctgggtcagaatcctggtagaggggtctttggcaaggacaggagaggacctccttgggattggactcagctgagcagcaggatgcctggttggcttgggaggtgagattagcttcctgggggcaaaaaggagccatatttgtcttaatgaggagaaaagagcaaaatcaaagcattcaaagaggataaaagaacacttcaaagaggataaaagaacatgttcagttcacaattactgcctccctaaccaggcaagtgtatgatggagaatcctgttatcctaattcaagaggacaatgccaaaggcttctcttgctggctgagaattgttggggagctccctgcccacggagggcctgtttgccagatccccagccccctgcagacctctgatctgtgaggagctggttctagtgattcacacttgcttgtgaaaaccttgatcttcatcaagcttttaaaaaaatctcatccgtattttttcccaattattttcctgcctgctcttttttttttcaaaagtaaacactcaaaagccttcatttctataactaattctggagtttacagaagcaaaaatcaataggctcaaaactccattcctttattcacttggctcagactggcttggggcagcacctctgagcccaagccagaaattgccaaaagggggttcctgtcggaatcttggagctcatcccccaaacttgagattactgagcaagtgagcaagatgtctctgtctggtccaggaagatgtcagccccacactgcccctcccagataaagagatcaacacgggacaggtcagtctctcccattctgtctccacctttgccagtctgcttctagatccccttcatgtactcatgttgctgccctccattcactagattttcaggatctatttatatccatccaccacatccaccactctgttttccaaatattatcacaatcagcgcagtagtgcttccccccgaaagactggcagctctctgacctttcttttcagctacaaatgaaaggggacttaaaagctgtgtgtgcatgtgtgtgcacacgcctgactaatggacacactcctcatgaaaaacaggataaattacagagaatggcaaagtaatgattacagaaaggtatatgaggcagaacccattagtgagctgcattttgttcaaaaccgagatactggcaggcagaataacatgcctttgtaccagaacgcattcagctgtagcaatgactaataaagtagcgaggatctgtgcacattttcccccttttgtgcctattttcataagttaataactcaagcatgaaaattgttttaaggctgaagactggtggtaagatctggtcaaactgtgtgggaaacaacttttgttgttgttgttacttaatttagtttggctgtttttaagttagaggagtggaaatgtcaatgtcaatgtgagtcttgcaatgtgtttttgttaagcccaagagcatttgggattgcatcatacaaagcacatttttaatgactagagatcatagtttctcttcctacaggtgtatgttcctatttggtacaggttgggattgttggggagggaggaggagatggaagcaaaatcttataaatgacatcatcctgggcttacccttcttcagctagaaaattcctattccaccagcaaatcagcctggtgagcaaacagctgccttagacaaatggggttgagtgtaggggtgaaacctgctgcaggattttagtaaattctcagagcaatggaaggaacagaaatatcatgaataattgtcatacctctcattcctacaggactcaggttttgtgagcattttcctgtccatagaaccagagaaagtctaagttaagggtaccagattttgcataactcctctttcttcttgccttttattttctttttattggatgagaagactttgaaagacacagaaaaacacagagaataacataaatacctgtgtagccacattctaggagtaacaactgtaatattttataatgcttactgcaatttattttttaaaaataaaataactgaagcattactgataaagatgtatcatctcctttatctcacagacaagcaaagtggatcagcaaaggctgcagtcaccagcatcttttccaaccttaatgaactgtatcctcaaaagaacactatcagactggtaagacaagcattattgtcccacttcacagatgaagagcttgggggccctgtggatgtgtaggagagtcggccttcctttttataggccttttgctgagctcagaggacagagcagaagacaaagccgaaagcagccctaagcagacactatcccagcccaaggagctatgcagacagctcctgcctagaggagaaacaattctctccttcagccaggcatgtggcacagaggtgaacaggaaatgcttagggagacagttcacagatatatatgtacttcacagggcacaatttaatccataaatcaatcatggatcactgctaaagaaaacaaaatatgctgccactaatttgccaccaccctgtgagcatgattggatgatgtttattttgattaggagattgctccatttataaatcttcaatacatcctgtccccctaaaacggcatctggatcttttgagggttaaaaaaaaaaaaagtgaaattggatgagggatgagagctggacttctgtgtgtcccggggtctctggatccacagcctggtgcctagcatcagttaagcccacgctggggtcgcatcacatcccgcaaagccacgtgctctgtgaggccaacaggagccccgccgggtggaccagctggaatctcagagagcgccgactctgaaaatacccggctctgcagaagcacgctgggcccagggggcttctagactgacagctccatttatcaactacctattggttttaaaaattggagtgtcttttccgcgttgactgattttggctctaagagatgtcgctggtcatttcagagtgactgaacctcccctctaacagatcccgggaattgttttcaggaaaggtaaaaggcagccttttctgtcacaacacaacgctgagccggcagcctggctctgtcaggatctggggctccagcgcccgagaagcccagcctcgccggcggccaagttcaccgcgaggccacgcgctgcctgcgctgcgctcccggacccgcaccgaccgcagcgcgcgccgccggtgcttctcccaccccagcctggaagctgcctccctccgcctatccctgcaggataagaagcccgaggaggcggagcatggaactcgacagttaaaacatttaagagagaaaacctagtgtcttgctggcctgaaatcgagtacgcagcccggggtgatcagggtctcccggcccggatgtgtgagacttgcttcccctgggcaataggcgatacgatgctttaggaggaaggtatctctccctcctaagccccggaggggagaacttccaaagacagaaaaccacagggttcctggcacagagctttccctttatcagctaaagcagaatcttttctggccttaacctggccccttcctctaactgtaggcagagaggcagacagaaaagcacttgctgaaacacaaagttttgttctgtcctcaacgaactgtctagagttgattgctgatagtcgtggtgcattatgccttcctggttttcatttaattgggcaccacgctgcctttcaagacgccttaaaggaaccaacaaccaaatccaagagagctggacagaccattgaacacacagtaggctgtgtctcgtggctttcgttgtctggtgcctcaaagaaaacaccagaaagattgtttctaagctagagccaccccagattgcttaaagtgcaaagctcactgctgttgggggtacccttgtgagacactggaaagctggttttaccgtggccctatgaagaggaagactgaaatttagacagtaatacctttactaggattggaaaagatttggttaatgacagccctgttatttctaaaacccattatcactgtatgagagattcctttgcgctgcatcctcgacagtgcttcctaaggtccgtcttttctattgtattcattttaatgggtgcatagccgtatctcgttgtgattttaatgtgcatctccctagtgactaataatgatgggacgcttttcatatacttgtttgtcattcataactcttccttggtgaaatgtctgtttagatattttgtccattttttttatttggattgtttgatttcttattattgagttttgggagttctttatgtattgtggatacaagttccttattaggtgtatgatttgcaaatattttcttcaagcctgtagcttgttctttcattttcttaacaatgtcttttgtttttaatttcaaagaaatccaatttgtcaatattttcttttacagattatgcttttgatgtaagaaatctttgcctaacctaagtcacaacaatattctcctagaagctgtagaaatttcaatctgtaatgatcaattttgaactcgtttttatatttatttatttatttattctttgagatggagtctcactctgtcgcccaggctggagtgcaatggcactatcttggctcactgcaacttccacttcccaggttcaagcgattctcctgtctcagcttcctgagtagctgggattacaggtgtgtgccatcacgcccggctaattttttgtattttagtagagacagagttccaccatgttgcccaggctggtttcgaattcctgagctcaggccatccacccgcctcggcctcccaaggtgctaggattgcaggcgtgagccaccatgcccgacccagaacttatttttaaatatggtgtgaggcatggagcaaagtttacttttttacatgtgtttacccaattgttccctcaacatttgttgaaaagacatttctccactgcattgttttatgtctttgtcgaaaatcagtgtatttttggactcttgattctaacgttccattgatgtttgtcttgatttatttttttggccttgaaacaacaatttattttcatctctcatgatattggaggttggccaggttcagctgggcaattcttacttgggttctctcatgcatttgcagttggatgatggctggagcagcaatctggaggctcaaggaggctgaaggccacatatgactccttcatttccatatctagcacctcagtggagtaggctggaacagctggggaatgattgagcttctaattctctccctacctcctatctatgtgtctagttttcacttcttcacagtacggcattctcaggaaagtcagacttcttagtagtggcttaccctagaatgacttttccaaaagcacatgtttcaagagacccaggcagaagctgcaaagtttcctgtgacctagcttacacatcctatagtttcttttgccatattctgtaaggaaagcaagttgctatggccagaccaggttgaaggagaagggtatgagactctacctctcgatttcaggagcattattacggagagggaaggattgttggttgcttctgtataagcaatgccaataatagaaggctccactgtcctgattaatgtagctttataacaagtctcaaaatcaagcaatgttagtccttcaactttgttcttcctttacaaagttgttttgactgtgctaggtcccttccatttacattcgaattttagaatcagtttgtcaatttctaccaaaaagaaagcccttatgaaattttgatcaagattgcattgaatttatggatcaatttaatgagaacttacaattcaaattattttaagatcaatttggtgaaaatttacaccttaaaaatattgagtcttttgacctatgaacctacttaggttttctttaatttattttagcaattacattataattctcaatgtatagatctttctatcttttatcacatttgccctattttatacgttttgacccattataaatggtatttttaaaatttcaatttccggttgttctttgcaagtatatagaaacataattgatttctgtacattagccttatattctatatttttgctaaagtcacatttttagttctagtagtctttttttcataggattttctgcatacacactcatgtcatctacaaataaagatggcttttcttctttatttccaatctcaatctcttttgtttccatttcttgctgttgcactggatagcaccttcagtacaatgttgaatttgtgagagtttctgatcttaagaggaaaacactcagtctttcaccattaagaatgatgttacctataggcttttcatagatgttcccttagcaggttgaagaagtttccatctattcttagtttgctagactttttatcaggaacgtttgctgagttttatcaaatttttttctgcatctattgagacatgcaatcttctagtgccatcattttacaagctcaagtgaagtgtagggcacttacctttctttacgtcctactatcctctctgtttataatataattgcttaaatattttctctgcatatatttaggatcacattagatagttataatttttacttcaactgtcaacataatttagaaaagtccagtgaagaaggaaagtctattatacataccaatatttttgcttactattatgttaatatgttctttcttccttactgatgctccaatattccttcctttactgtttgctttttgtttagaaaacttttttttagctgttcatttatagtatgtctgctggtgacagatacttttagttttccctctcctgagaatgcctttatttccattttattcctgaaggacctgtgattggggtggggctgtggtattttaagtggtgtttggctagagtggagcggttattgcccaaagcttttctgtcttgctgggctgccactgtccagctccttaggctggagagagcaggcttttgttggggccttcttggtctcatttggaatttctgagttcagtttcttcaactatatatctgggatatacaagacagaaagaaaccagggcactctccaccatgttgttcctccagtctcaagatctctagacagtctgtcttctctccatctttcagagtcttcttgtgcatgttttttatataacatctacactttttagtggcgcttagcagaagcaatgggacaagtatgtctactgcagctttctggaagagaagctcctcatttctttttttggatacatttcaaaagaagttgcaaatatatgaccctacacatttcagtatgcatatcattaactacagctcaacattagtttatatttttctttttcttgtgtgagatgaaaactatacatacattgccatcaggctttgcccaggcatcagaactcactagacagcagaatatacatctttgagaggaaccacagaaatgtaatgtgcatgctaaggcttttacctgaacatcaaaatggaaacatcagagtattcatattagagagcaaccttacaattataatggatgtggtaaggctttttaaaaaatcaatgttcaaagacatagaatcaaccaaaatggccatcagtgatagactggataaagaaaacgtggtacatatacaccatgggatactatgcagccgtagaaaggaacgagatcatgtccgttgcagggacatggatggagctggaagccattatcctcagaaaactaacccaggaacagaaaagcaaacaccacatgttctcactcataagtgggagctgaacactgagaacacatggaaccagggagaggaacaacacacactgaggcctgccactgcaggtgggggttcaggggagggagagcatcaggaaaatagctaatgcatgtcaggcttaataagtaggtgattggctgataggtgcagcaaactgccatggcacacgtttacctatgtaacaaacctacaaatactacacatgtaccccagaactaaaagtaaaataaaagaaaacaaatttcaaaaaataaaaagaaaattctaggtacattgaaatatgcaattcttacgtgcaccatttgatgagtaccacccacccctctgtcaagatacagaactcatccatcaccccacaagttccttcttcctccttcacagtctaatcccttccccagccacctcgcggggacaaacattgttttgttttgtttttttacacctcctagattagtttcatcttttctagaatgcagtatgaatagaagggatatcatgcactcttttctgtctggcttctttgtttcagcctaatgtttttcatatttagcaagttttataagtcatttgtttctgttgctgagtagtattccgttgtgtgcatataccacagcttgttgatccattcttctattgatggatatctgagctgtttccaggttttggctagtatgaataaagccaaagagagccattttaatttggggcatttaaaaaatggtgtgaataaactttcatctgaacacagggttccgtggtaataatgtttgaaaatatcacctccagctctgacgtgccgagtttgtaattttcgtaaatgatataaaaagtcatttcttcatccattcatttgttcactcaacccttatttagtgggcctattccctgtgccaggaatcattcaaggctcagtggggaagagaacaaatgtaagtaagtcggcctggtgcagttgacatgctagtgagggaaaagacaaaaacatcagttagtgaatacctgttatgacggaaaagaagccaggtaagtgggtagggcattacagttggtccagaggtagtcagggtgtcattttagctctggaagtagggagaggaacttagggagatggtcaggggagggacttatatgatttggatctgtgtccccactcaaatctcacaccaaattataatccccaatgctggaggtggggcctggtgggaggtgattggatcatgggggcagtttcttatgctttaacaacatcccccttggtgttgtcacagtgacagtaagttatcacaagatctggttgtttaaaagtgtgtagcatgtccctctgtctctcttcctcctgctctggtcatgtgaagatgcctgctctggctttgcattctgccatgagaaaaagtttcctgaggactccccagccatgcttcctgtacagcctgtaaaactgtgagccaattaaacctattttctttataaattacccagtctcaggcatttccttatagcaatgtgagaataaactaatacagaaaattggtaccaagagtggggtattaccataatgatactgaaaatgtggaagcagctttagaactgggtaatgggcagaggttggaggagtttggaggactcagaagaagaagggaagatgaaggaaaatttggaactttctagagacttgttaaattgttatgaccaaaatgctggtagtgatatgaagagtaaagtctaggctgatgaagtctcagatggaaatgagggacttattggaaactggagcaaggtcacttttgttatgcattagcaagaggttggctgcattgtgcccctgctttagggatctgtggaactttgaacttgagagtcatgatttagggtatctggcagaagaaatttctaagcagcaaagcattcaagatgtagcctggctgtttctaataacctatgcttatttgcatgaacaaagaaatgatctgaaattggaacttacatttaaaagggaagcagagcatagaagtttggaaacttgcagcctggccatgtggtagaaaagaaaaacccattttcagggggaggaattcatgcaggttgcagaaatttacataactaaaaagaaggcaagtactaatagccaagacaatgggaaaaaggccctgaagtcatttcagagagcttcatggcagcccgtcccatcataggcccagaggcccaggagggaagaatagtttcaggggccagaaccagggtctctactcccctgcacagctttgggacactgtttcctgcatcccagctgctacagctccagctgtggccaagagagcccaaggtacagctctggatgctgttccagtgggtgcaagccataagccttgatgactttcatgaggtgttaagcctgtgggtgcacatagtttaaaagttgaggcttagaagcctccacctagatttcagagaatgtatggaaaaacctggatgtccaggcagaagcatgctacagggttggagccctcatggagatcctctactagagcagtgcagaggggaaatgtagggttggaccccccacacagagtcttctttagggcactacgtagtagtgctgtgagaagagggccaccattctccagaccccagaatggtagagccacaagcagcttgcaccctgtgcctggaagagccataggcactcaatgccagtccatgagagcagctgtgggggttgaaccttgcaaagtcacagtggccaagctgcccatggctttgggagcccaccccttgcaccagcatattctggatgtgggacatggagccaaaggataatattttggagctttaaggtttaatgactaccctgctgggttttggacttgcatggggcctgtagcctctttcttttggctgatttctcccttttggaaagggtatatttacccaatgcttataccgccattgtatcttggaagtaactaacttcttttttattttacaggctcataggtagaaaggacttgctttgtctcagatgagactttggactttaaacttttgagttaatgctgaaatgagttaaaagactttgagggactgttgggaaggcatgattgtattttgcaatgtgagaaggacatgagatttggggaggagccagggtcagaatgatatggtttggatatgtgtccccacccaaatcttatgttgaactgtaatccctagtgttggaggtgggacctggtgggaggtgattggatcatgggggtggtttcttatggcttaacaccagcccccttggtattgccatagtaagagtaagttatcacaagatctggttgtttaaaagtgtgtagcaccttccccctctctctcttcctcctgctctggctatgtgaagatacctgctctggctttgtcttctgtcatgagtaagtttcctgaggcctccctagccatgcttcttgtatagcctgtagaactgtgagccaattaaatctcttttctttacaaattactcagtctcaggcatttctttacagcaatgtgagagtggactaatacagggaccttttaagaggaagtcataggagagtttttggagaaggtaaggttggaagaaggtacaaagaaaaaagcttatgtctttaaatcatcttcattcctgataattcagcacactttagaggcaacttccaagtcagctgttgatggtagtgaagacccaaggcccagagagggagcaactggccctagagttgcatgatgagtcttcagtggcaaggccgagattagaggtctgtactcagcattcagctattggtggacagaactcgtcctttgcttcctaagtgcggcttcagtcctgtcatggccctgcacttccccgattccctgcccactccgtccccacttcttcaggtgcttccccatgggaactggtagaatagtgttagaaagccacatccatagtatggcctcttgaggatttctggtttgtgtgactttgagcaagtcctcccctgatgttggaggattcttacccctgaagttggggaaggagtgaaatcttgatggtaggacatccgctcacatgtcctttgagacttaccacgtttgtcaccatgtatttagcacagctgcctttcatctgcgaatacagcctgggagctctttatgttttatctaatttaattcttataacaatcccatggagttgttaggtagtaaagtgctctctctgtttttacagatggaaatctggagactgagtgaggttgagtaatttgcccgaggttggcaagaggctaaagtagaattctaaaccagatctgtttgattctgatgctcttgcttttagccacaatgttttagcatctgttcaattctgaacagacggacagaatttgcagaggtcagagggaggttctagaataaagctgttctctagtttacaggacagaaatggtggtagtgatatgcctgtgccagttctgggatgtgcagctgggagggaagccttctgtggaccaccatgtaggagggagagcatagcagggtatgatgggaggagcatgggttctggaattgaaaaatcctgtgttcaaatccacactctaccacaaatcccacgaatggaggacatttggacaaattgttgaagccctctaagcttccattttcatgtctgtaaaacgggataataatggtatctccctagagggttgctgggtaggtacaatgagatgatgcaaataaagtacttagacaataccaggctcacagtaaatgcctaataaatgctggctgttgtttttattcgctattgttttgaaaaatggcaggcactacagacatacaaagtgcagagagtggaaagacaacaatgtgttttagggccaggcagcccagagctgcccaggctggcaccctgcccagaagtgggagtgatctagcagaggccagggccttgcaggaggatttttgcagacacccaacttcctgcatcagtggggtcgagtgatctctggagtgccttccgacctggagaggtcatttcaagtctctgcaacggtagcgatggtagctccagcaagggagggagaaggggcttccactggctcttggacactccagctgtcatttttgggaatgtgcttatctgccccagagggaaatagatgattgagaaaggaggcaaccaggggacttaggctttaccagcagtgacctactagctccggtgtgtctgcctcagacagcaggccaaggctagtgtcacggcagtttagggggtcctgcacattcactgtgccaacgagcggtattttgcaaacttattataaacagattatatttcttatcctaatgtggctgttggctacctgcccatgaattttagcctccaggagaaaaacaattgcttgagctgagtgttctgtgcttttactttccatacattactcagggctccttccagttcccccaacccttaatctctctctttctctctctctctcgctttcattctctctctctctccatctttttccttcttttcagaaagtcctctttcatcttgggcataactagaaaatctgtaagctgtgctttctgccatgcattagccaacagggtcctttcctcccaagccagggaagaaagcacaaaaaccaatgtccaggctgggcctctcagggtccacagcatcacaggcaaaggaagtaactgtctccatgcctaccaacggatccacacacatctcgctgggcagcatctctgccccaggaagcagcgcgcttactacactgggcacccagatgtctggtcttgcgtggcaggcagccactttctcctggccttttcttgtcccaaaagtcagaggggcaggccagttccagaatgggattccaggcagaccaggagactaggagtgcatgtgaacaactgcaaggggatgcgtctgtctgcctggtgtccgtgtgttcatgtgcacacctgtgcacgcgctcccccagacttacacactcgtgaacacatgctcacacaagttcatgcacgggagtagctccaagcctctcactcagcactttgctattaatagctcacttttctaaaaaagtctgcttagccgtttgtaagaataaccaccactgcctgtgtgacagcccaggcccccgcagggaggacagggccggccctctgctaggactgcctgactgcctgcctcatgttagaatccagagggagggccaagaggggagatgaaaacccctcctgagtggccagggcagcctccagtgcctgtgcccagggacaaggcaactcactggtaatgtctgcgggcaattggccaggcccctgagagccaagatgccaccttcttcatggtgacagcagggagcatgctccatgaaaccagaatgagcctgttctccactctggggtcctgctgtaaaagccaagaagcagagagccaagctgagcccaccaagagcttggcacgaggctgtcacccacaacttctcgctgatccaaaagacaggctctgaggctggaaattcaagtgtggtggtgctgtgacacagcacacagccaccgtgcacttgtgtccctggcagccgcaatccgggcctgagagggcccagtgtctgtgggtgtttgtatttaattgcagtggggtgagaaaggccaatggttgggttttatttcaaacctgctttgaggagaagtaacattaggtggcccagagctgtgaaatgtgtcctggtcataaatgcctcaccatcaattaacacctccagaatacctaagagttgccagcaacttcccattcaaataacctcttaaaccttcctccacaccacactgcccattccctcgcaggcagacctgcatggtttgatgacgactggtcacactgctggccctatctgtataaaagtccagacagttgggctgtgaggggaaatgcctacctcagagtagcttaagaaagaaagatattggtttacttctgaaaagctcaagaccagctgagtttaatggcatcattaaactcattagacatggggctgggaagtggctgccagcagtttggtgcacagcctgtcctctcagcagcccaggtggcaggtgtcttgggagtggcaatgatgagaccagctgctcatcctgggctggtcattgtgactcagatgtggagtgggctggttagtggttctgggccacttgtccatctctggatctggcagctccatctacacagtgtcgggctaggcatgggagcattctgggccaggagaaaggggattggatcctggatggtgggaaccgcaggtgtccccctccacgtgcctgggtccaagactgctctgctctggaccttctacgccttcagaggtacaagttgcagtgctacccttgctgaacctacaaccctgttcaagtgacaacttctctgagtctcatacgaggatattgaaagaaccttctgcacagggctgttgtgaggattaaccgtaataatacaagaatatctggcacttgcattcagcaactcaccgcttacttgttcaaccaggtaaaaaggttctgatcccagtgttgcaggacagaaagacctccccctctgtagctgcagatgtgacccagcacagaaaaaatggcaggtgaaagacaggcaggaagagcaactaagaaggtgggaggcacctccataagatgcctgaggccatggggatgaccgttcacagagctagtccctcgagcaatgtgttaaatctactgaactgtgataaagcaacttctgggtgaattttgtcctgctacaagttgtcatggaatggcaaggtggcagatctcagaagtggatccaatggtttttttttagttaaagcagaacattcctggggatggtgtcaaactcccttccatactgttgagtctgctgatgattacactggcttctcctctttgccccatcatttcacaggttcccatcttaaagaggaagagaaaggaaggagggaacgaaggaagggagggagggagggagggaggaaggaaggaaggaaggaaggaaggaaggaaggatggaaggaaggaaggaaggaaagggagagagggagggaagaagagagggaaggaagttatcaaacccaagctctgtgcagagcaggagacgtttccatgggacccctagaatagataggttcttgctgctctcctggtggatggagatgcccaccagtagctgtgagagtctccccgaaggcctgattgtggctccaagttccgtaggactcactagtctttttttccctagagggtcttgccattgagaggcaggtgatgtgctgtttcagaaaacaaaattgggacatgtcctgatatgacatccatcaaatatatacagataggtgtcacagcccccgaaaaagcttatctcttctaggccacacatagctatttcctccaactgtgtcagacattacaaagtttctagcaatcaaaacaagtcaaatgccattctcaggacccgttggaggattttttgctttgttttggctttgtacggtatccataccattttccaaattcttttgtccttacatattttgtttttcttaaaaaaaaaaaaatcacctataatcccatcaccagacaaaaccactagaaagaaaccaacattttagccatgtttttctgtatataaaaaaagtgtgtgtggaatttttcataacaatattgggaccatgacatctatcacattttttattaggaaatggccttcaacaatatgcatttaacaatatgcttgatgtctgtgtaatatttcatctaacaaatatatcatgatttatttaagtattccctgattgcttgcttctaactagaaaaaacaatttttctaagtgtcaccactgggttagagtaatctcagccaatcctcctaatagcactgtgagaccagagttatgataatcttcagttaatggacaagggacatgatggtgtggaaggataaataaactacccaaagacaactagctagtgagaccagcatggacagtcaagcccagtgcatgtaatctgtgctcccctgcactgttgctcatatacttggacccttgcatacatgattttcttattcatcttgaaagagaaatgttagcttactgtttttatttgcatttatttcgttgcttttgagtttgagcatctttccatttcttatagaccatttgcatttgttttcctacaaaatgcctgttcatggcttttgcccatttttctgttagccttgtcctatgtatacacacatgtatattattagttcactatctgtcaggtaaattccccagttttcttcttgccttttaatgttgttatggtcatttaggactagaaagttttaaatcttgtatgcctatcagtattttactgtgtgactattcccattatttttatgcttagaaagttttcattcctatcaagtatagataaatgttcagttctactattttattttaactgtgcagtgggttcatttttggcattgaattaattaatctatctggatgttatcattagtttccttctgaaaaagtcagtccaggctgggtgtggtgactcacacctgtaatcccagcactttggaaggcctgagtccaggagttcaagaaccagcctgagcaacatggcaaaactgtgtctctatcaaaaatacaaaaattagctgggagtggtggcacatgcctgtgttcttagctactcaggaggataaagtgggaggattgctggggcctaggaagttgaggctgcagtgagccatgattgcacccctgcactccagcctcggtgacagagcaagaccctgtctcaaaaaaaaaaaaaaatgcagtccagatgtactggaacaagcttgtgtgggatggctacactcctttcctgttccaacacacctgttacctggatgagctcctatatccttatccaggtaccagatctgccacacctggtaccggcatgagccctgtggggaacataccagcagagacattatacttccaccgagacaaaataaagccacattgacttttagtactcatattattgactgacattaaacccatggcaactaaaatctcgttgttgttttttttttattctgggggtgagggtacaacttttagagaaagtatctctccctaagactgccaatcactctaaatttgcatctaacacttctacataactttatctaccgagtaggcagtatttaccgtctgctgtttcatcttgtagcataattttcttttatatttccaggtgtgaaaatattcaaactgacccctaattctcagctttcagagctatctgctacttcccaggtcactttggtttttaagcgctttcacatgctgttgttggacatctgggttattcccaaatcttgttttcacgtaggcagctgtcaagtcaagatagccatggccctgcctgacatgttctttaagattgcattttatttttattattttattttatttttcttggagacaagagtttcactctgttgcccaggctggagtacagtggcatgatcttggcttactgcaacagatcttgacttactgtaacctccgagtcccaagttcaaatgattctcctgcctcagcctcctgagtagctgggattacaggcaccagccactatgcctggctaatttttgtatttttagtagagatggggtttcaccatgttggccaggctggtcttgaactgctgacctcaggggatccacccagcttggcctcccaaagtgctgggattacagatgtaagccactgtgccaggctgcatttttaatactgtgtttttcttgacatatattccaactaaattcttctgggtgttgttggtttgacctcatattcggtcctattgaaatgaatttgaatcattcatgatttggttatttattgcattcattgtccttctcagcttctggttacccacacattagacacaagtgcctttggcatcttttttcaaatctacagatgaggaaactgaatcccagaatggtggagtgatttgacgaatattgcaaaactataatggggagatgagatggggatccaagtcttgtgcccccaaagacagggcaccaggcagcgtagaggtggccagtaccagagcaacagcctaacaatggtatgtatgtcacacacccagctcactcaatcctgaccacaaccccccactgctctgattcctgccccatcagtagcgtctgaaaggacatctccaagttcaccttcaaggacactgttaaggctgggccagtagaaggaatatgacccctggcactgtcccccttcataagacttcaaagttcatcatttcatttgggcatcattttacaatttgctaggaatccctcttatcttattttcatctggtccatattcctccgtttcaaaaacaagactatcctgaaaaactgtcagctgcttgctgaggttatttttggtatacagtacttaccagagtcacctggtcagcattaatcaccccatcatgaaagatttatggttgtttggggggtactgaacccatgttgtaccctatgttttttctgaaatattttcaatctagatggtcagtagttctagaatattccctcagggattgccatcgacaattgaccatttttataaatgttagaaatggaccgtttgcccaggagagggcttccctgtgttgagtttctgtgttgctgccaggtcatcgaagagttttcattgttaaacttgtgtagggcatccaagcaccaccttgctgtcttctcaccaggccaggggtccaccttttggaagagcatctttctaactagaagagagagacgtgaagttgaaattacttggctctgcctccttttttttttttttctcaagtttctacattttagcatctttcctgtgtaatccctttcttgtcccactcttcaaatagctttgaaaacccttctgagatcacgggcctattttcagcctctgcttggtgtgggcttttggtttcccagtgtggttctcacaggttcaggcccccccaaccccggtattgactccatgtcaacttctcatcttctgggtatgcctttctgaaagtctgagatcaccagtggtaccctgtgtggcccacactggatttttctaactatttcctctttttggtcctcactgggcttattcaggattattgacgatacatatgcagaatttggggttttctcctaatctcttttctcacttgggatctgtgtgtgttcagactccctagccccagccctccaggttaatattgtgtggcactaggacattagcctcagtttcttcaatttgatataattgtgtatgataacagaatttacctcctggagttgttatgaggattgaaggaaatagtgcttagttgtggttagtattaatattattatctacctattactgacacactttgtggttataagtgacagaaaactacctcaaactggcttaaacacgaaaagagaatctgttgctcagagaagtttcccctaggaattaccatcaagcaacatccaaaggtagacctggctttcggcacagctgggttcacagccctggtaatgtcctcaggactcagttgtgtccatctggttcctctgacgctctgtgtggaaggaggaggtggcgcagcagcagcctccagcttggcatagccatggtggggagcaggaccccagcgcttaggtttggctcctatctcagcaaactggtgctctgccaaactgaatttggaagacttgctttcccagagaagagagcacatgagccttcctgactgcgagtgatattgctgacacaaactggacacttcctccactctgtagctaaggggcagctgggcctttcaatgcagctcttttctagcaagggagaccccaccagaattgagatgggtaaccccgagccctgtgcacaggtgcctgcttttattccctcattcatctcggtctgaacattcctgaccttgactcttgcctgcgacatcctctgcactcctccacatgctccactcagctcgctcctgagagctggtaattaatcggccttgtctttaccctctgaccccactgagcctcccagatgggtttccacacctggcaaatgaccttggagttactcctaactttgtcccacaggcctgctggattggatttaatgtttgcttgctaacttctctgactcttgacctggtctggtcacttgctgtggttgtgtgtgacacctctgtgttatacacagtgccgggcattgctttttcagcagcctggaatccactgcctcttctttccccaattcgatgtccttttgtggcactactctctcactgggcgccgtcttcatggtaaatccaggtgcttttccccctgcgtggaagtggaaagttgtccacagtgtctcctcccttgccccagggtggtcctgagctgagctgagctgagtggtctcagggggagggacagcaggctgtttgttccctgtagaggcgcttgatggtggagcgctcttgtcccagttgaacctggttctccagctcagaatccagcacccctgttgacctcacaagctccttcatagcttccaattcattcccctccctgcttgagtcagcaagggtcgttccttctgctttcaagagtcctagctcatattcctgtgctgtgctctatcttccctggctttatagatttacttgggctcttttcactcctccctctgaagttaccaattgcactttttctggtctcatgggctggcctcctgcagcatgctctgctcttcccagctttgggccagcacttcctgcttcctgccaggcccccgctgttctgaggtggatctgggctgcagtccaggagacaaaattctccactgtgacaccatctacatgcccagatgttccctccatgtacttcctctttctccttttcttttccaaactcacaaccttccagtgagagaaggaatgaaaacaccacctgtaacaccaattcctccaatttcctccccagaacttcaaagtaaacagaaatgtattgggcttagactgggacttatggatggtcagagttggaagaagccttagaaaccatcacaagcctttgctcccagggctgtctctgatcgtttggttgtggctgactgggttgtcacatctggacacaggaagaaaagtgctgggagtgattcccaatgtctgagtggatgagggaagggggagtgacagcatatgagctagttatttgcccgtcctttaacaatctgctctgtactttacaaaatggggaaactgagtcacacatctatcaagctgtctaaggccacacaggaagtcagggcagatttgggggtagaatccaggttgtccagccttctctatcaacaacaatgacttctctttcccattggaattcactgtcataggatgtcatctaagtccacttcctgacagcatgtgtgtctcccagtctgtgatgtcatgctatactcggccacctctgtacaggacagtgtggcacgaaagggatcctgctggtgcctgtggggctggggctaatactctgggacaactttcagaatcacagttcttctaccctaggacaagagggtggtatacagccaaggaaaggtggtcctgggctctgcagccatggagctccagggtttggaaggtgccgtggaatcttactccttagtttggacttttgtcaaactgcagctggaaaaaaattagaaattgctgctccaaatggaacatactccatttcattccaaatgagaagtaaacaaatagacgggtgagcctccccaaaatgataaaactcttcacacttaagatgagaagtcagttcaagtgcagtcctggcgtgactcactggggtttgctgcaggaagataggggcgaaatgtcctcatcctgcctatagaagccagctccttattttaaatcccatcctgcttgactatcaaagtcagacagagccttcctaaaagctgaaacacacgcacagaatgagaagtccctgcgggagcaagttcactgtggtgagaaccttgcagagcagacagctccaggggccagcggctgcctgcaaacacttgctgagcaagtccctgggagaggggcctttctcccaggccaggaacgccaaagtggggtttcctgataaggaacacagaactgctgtttcttggagagggagttcacacggactgggatccattctcaggctgggccttagtagtgggacagcatcctgttttattaaaagcctgttgctggcagggaaagccatctgcctgctgagtgggcaggggcccaagatcgctgtgggcaattccaagccagtactgggagctgacatcaaaccaggaaagaacacgactgtttttagctgatgtagcagtacattttctttctttccttctttcttttttttttttttaatagttctattgcccggtttcactgtgtacattttgtgtgtgcaggcatgcgtgtgacatcctgtacccagctacagccgaggttcactctgagatgagcccaccccacttattctccccttctccctcctttccccacctccccctcttccccatccttcccccactgacctccccagctctaaaacccctgatagacataaagaacagagggaaacccaggctgtaacctggggttattcacagggttggggtgggtgagagaagaaaaacagacttctttgtttatcttttgagtcttgaaattctaaaaaattcattcatttccaaggaagccttaatttgtaggattccaagaaatttaaaaaaagtaaagggagattcacttcaaaagaaactaggggaaaagctgttttcttttttagctgatttgttcattattcttattttatttaaagttaggtttgttgaaggcaggcaaaggtagtcactttttcatatttgtattacattcttactttcttcctccattgccttatcagttaagagggcaaataatatttcaagagactgatagaatatgttctgcactctgctcatttcatagctctctggggaattggggtttttataaacttttataatcacattttctgctgaggttatagatgactccaagaatcttccattcatgctgtaaattaaagtgactcaaattgcttccacttttacaaattaaaaaaaaatgtacttctatacagatttttaacaattaacaaaaggccattttaacgctctggttggttgcctgtacgtgatttttctggcttttcttaaaatttggagtgaacagctcccatgtcaaatataacatgttaacttattggcttctctttaaccctgcacacaaacaataaacttttcatgtagagccagaaaatggtatatgttgtgaacttttttttttttttaaagatagagtttgtggtgataaagggatttcagaaaaaaaaatgtacttgaaaatatgttacttcacattggaacattcaattttatcttaaggatataaatattcaattttaccacattaatctttgtactgagataagccaaaaataacgtaaactgacaattgtttgctatacattctaatattttacatatttataggagttttccaagtcatgagatatcatataaggcacacaaaaaaagaatgacataaatcatgttaagtgcagtctactttttcctgagctatatctttaagacaaaagatatttaacaaattgaacttgttttttgtgggagggtccactctctggttacttaagagaaaaccagaggattatcttcgtggtgaaggaaagtgtatagaaggcagtattttttttttctgttataaagggccagggctctatccgttggtgcagtgttctgccttttgtgtttttttctggttaatttaaaacattagctccaagtttttaatgtagtagtttcccgtgagtcactgggctgaaagcccatcctatctgtgtcaggcaagggtccaagacaagaaacaaggagaacacagatataagaaagctttattagtgcagctaaacattgataattaggaaagttccagttcttctatggtagtttatttgtagataaatgtagttgtaaccttttggtgccaaaggaaaaactcctcattcaagacaagggatacggaataggaagagctcaaagaaaacacagttttctgtgttacagacaagtatttacattactaatcaacttttggttcaggaaagaagtgataatctgtttagatttttaaaaggaattcaatatcctgttgactaaatgcagagcaggttcagaggaagacgactgttgaataatgcaattgattccttccaagaaagcatagggtgtagtttttattataggaagtgccatcgatagtactttttctgctttctggaaaatcacccaggaaataaaatttgttttaaacattatttttaaaacaggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatggtaagttttctaagttttcttttcgtctcccatatacgctgggctgtgctggaatcaccaacaggcacagaaaaaatgacaacaaaacaacaacaaaacccccaagaatatcctgttgtctttggccaaagttcaggaaaggggagccccaacagagacccagtaggaagctctagcccctgttttgtacaacccagggtccttgcagagagattgatctgccagcagtggcatcagcagcaatagtagcagcagcaaagccctggacagtcctggcccccagtccacaacttagacacagcacatggcctaattcacccacagaagcagccactgtgaagccctgtgtctccccagactccatccagtggcataaggagacccaggccctgcagcttcctccccatcatggaaggctgtccatctacagagtttccaaacataataagcactaaggaaacaacataacatgatatgccgaaaaaaaaaatcacaattaaatcaaaatgaaacatcaaaaaatgtccaagtaaaccacaggaaggcaagaaaaaagaaacaaaagtgtaataaacaaaaggatcaatcagagaacaaataataataaaatatcagacttagtcctaatatatcaataattatcttaaatgtaaatgttctaaatgcatccattaaaatgcagagattggcagagtgtattacaaaacatgacccagctatgtgttgtttacaagaaactcacttcaaattcaatgatataggtagactgacagcaaattgatggaaaaagttataacgtgtaaacattagtcagaaggaagcacaagtggctatgttaacatcagaaaaagcagacttcagagcaaagaaagttactataggcaaagagggaaattacataataacaaaaagaattaattcaccaagaagatgtagctctcctgttgtgatgttatgatatatgtcggttttcatccgtgggtcctggctcataactcccacatcccgtgttagagtcttttgttatattgttgggggtgttaggcctcagggacaggcctctgaccttctcctgccttcctttcactctaatgttctcccacctttctgcctttctcattgtggatcttaagaccctcccatgagacagtcccaccctatatcctgggggaaggaatgctgacatcatgaagcttccataaaaagccaagaggacaaggttgttaagcttccagatagctgaacatgtggaggttcctggagagtggtgcacccagggagggcatggaagctccgtgaccctttctccatacctcaccctaggcatctcttcatctgtctcctttgcaatattttttaattataaacccgtaaacataggtaaacatttctctgagttctgagagctgctccagcaaattaatcaaacccaaagagggggtcatgggaaccccaccttgaagctggctagtcagaagttgtggaggcccagacttacaactggtgtgtgtatgggggcagtcttgggggctgaaccttcaacctgtgggatctgactctatctctgggtagatagtgtcagaactgcattggaggacacccagctggtgtccgctgctatattctagctgattttctccctagtagtcctagtagtcttgagtgtggggagacagtgggggattgatgccccaaccacaattgtggatttcttctttcagctgtcttagtttttgcttcagatatgtgaaagtctgttgtttggttcataggtatatagagaaaactctccctagctgtgtttttcttctgctgtcacaccatgacaacatcaacacagaagcctttcttcatatcgtataagggcacaaaaaaggaatgacataaatcatgttaagtgcagtctatttttcctgagctgttatctttaagacaaaagatattcaacaaatagaattttatttttttgcggtgtggggtatccactctctggttacttaggagaaaaccagaggattatctttatggtgagggagagtgtatagaaggcaatattttttttcttttataaaggcacagggctctatctgttggtgcagtgttctgacttttgtgttttttctggttaatttaaaacattagctgcaagtttttaatacagtagtttcccatgagtcactgggcctttcttctgtgttgatgattgtggtgtgacagtaaaagaaaaacacagttagtgagcattttctctacatacctatgaaccaaacaacagactttcacatgtctgaagcaaaaactaagacagctgaaagaagaaatccacaattgtggttgaggcatcaatccctgctgtctccctgcactcaggacttctaggactactagcaagaaaatcagcaagaatatagaaaaactcaaccacaccatcaactgacaggatctaattggcattcatagcacaatctgtccaacaacagcagaatacacatttttttaaaggtcccatgagacatttaccaagatagagaatatcctagatcataaaacaaacattaaaaagttcaagagaattgaaattatacagactatgttacctggccataataaaatcaaagtagaaatcaaggcagaaagtcaataggcaaatctccaaacccttggaaactaaacaaaaaacatttaaataatccatgcatcaaagtggtaatctcaaaggaaattttaaaaagacaagaaaagaatgaacatgaaaatatgacatgttaaaatttgtaagattagctaaagcagtgctgagaataaaattgataggagtaaatgcttacattagaaaagaggaatgatctcaaattactaatctaagtttctacttcaagaaattagaaaagttgagcaaaataaactcaaaggaagcagaaaggaggaaataaaaaagagcagaaactaatgaacttgaaaactggaaaaagaaaaaatgaaacagaaagttgtctctttaaaagaattaataagattaataacttttagcaagaatggcaaatataaaaagagagaagacatgaatcaccaacatcagaaatgaaataggggacaccacaatagatgtctttagctataaaaagataatttaaaaactgtaatcaactttatgctcatatattcaacaagtttgaagaaatgggctaattcctcaaaaaccacaaagtactaaaacttagccaaggtgaaacagataatctgaatagctgtgtagatatttctaagaattggatttataataaaaatactccccaaaaagaaatctccaggtccagagggtttcatccaagaattttaccaaacattcaaataaaaattaatgccaattctatgtgtatcttccagaaaataggagagaagagaaaattaggaagttcccaattctctttatgaagccgtcattactctgatacccaaaccatctaaagaaagtatgcaaaaagaaagctacagatcaatatctctcatgaactttggatgtaaaaatcaccaatcaaatgtaattaatcaaaatccaacaatgtataaaaagactaaagcaccatgaccaagtgaaatttatgccaggtagacaaagctgattcaatatttgaaaagaaattaataaaatttatcatagcaacaggctaaagaagagaaaccatataatcatagcagttggcaacaaaaaattatttaacaaaattcaacacccattaatgatgaaaatagaaaatcctctcaaatacactaggaatagagggagacttcctcaacctcataaagaacatctattaaaaaactacatcagacattgtatttcatgataaagacagaatacattgccttatacaatccaaaacaaggcgaagatttctactttcatcagtcttattaaacacagtactagaagttctagccactgcaataaggcaggaaaagggaataaaggtcatgctcattggaaaataagaaatgaaactgtctccttttttaggcagcatgattatttaaatagaaaatcccccaaaaaatctatgaaaaataggttgtcctccttctgttggctacattgatcaggcaagtgctgctagttgttcttaggggttctgcttaagtgctgcaggagatggcagcacagaagctgaggcacagcttgggcatggtagaccagggggacacccaactccattactccctagctctatgcccctgaacaccttccttgatccagctgaactttggtcccctcatctgcaatggtgttgatgatagaacccagaggccataattcttgtgagtattaaatgagagcaagtgtgtagtaaatgtgtcattgtacttgctgcgggtactgctgctgttgctgcagttgtatgtgatactgtgctatttgttctgccactcccaggcactgccactggagcccttgttcagtgatcctatgacttgtcagctcagtcaattgctctgactcttactgctttcatttatgaaatggagacaataacccctctctcataggaagggtaagaccagaagagcctacactatggttggaataatatttgtatacagtgatcaagagaatgttctctgaaaccagactctctttaaatcttacctctatcacttattagttatatggctagctgttaaatgaggtcaaaagagtgtgttcttcataaaactatacagaagattaaattaattaaaacatgtacagtccttttaaaaaagatcaagtgaaacagcatacatgaaagtgctttcagcacgctgagaataacaatagcaatggctagagattatggagcactccccactgccagcaccaggggaactttgtacctacaactttttacttagtccacataaccatgaattcgtctcatttatgtagaccgggaaacaaaagcctagagaagtaatttgcccaaagacctagcttacaaagcaatagaatccaggtctggactctcgggatctgactgtgttctaatgcctcccagagaaagtaggctagagagggcaggaatagcttgacttagagatcacttccactggcacggtgggtacaatctgatgtgggaggctctgggtgcagcctgtgatggcagagtggaggagccaggagtcattcttggcctcattgtcactgccttcaaactaacaagttgcctgagagctaaggttccatttgataggacaccgggtgggatgtgcatcagaatatccatttccttgaaggatccaatgattaggctgaggcaaaatgttttagaccattcccaggtctaaaaataactccatcatcacctctaataaggactcagtctggagtgacatcactccttcaggtgcagaaaaggaaagcatgactgtgtgtcactgacttaaaataggagtgaggtgagaggggcagctgggctcatggacgtcaagtggacagtttctcagctggtatttcctatatttcctgttttggacagcaggttcctgcccttctaagctgggggtaggggtgagggagtgtatgttaaaaagctctgtggacttgctttttctcttctccatgtgtgttctttccatcaataatctgcgttcatctttactggctgttcatgcattatctggagatacgctagttacagaaattcaaacaggcaactcttcctctttctccctagctttacactacagatccatgaagttttcttgactgtccctgcctagggtacaacaaggaaaccactatttggataattcccctgattccatggtactgtggaagtggtgggctctccatatgtcagggtattctatgtctatgaaaaggtatctcttttgagaccaagggtggacgggatcctaagagtctaccaatttttaaaataatttagctatatttaagtcaataaattgtattcaaggctgactttgtagtgatgtattccatgaattatttcattcaaaataattttgaaaggacttctggtccagacaaaatagcatagatccatttctgtcttctctcctctcagttaaatgcaattataaagtctagaaataatgcaagaggtaaccaaaggagaactctgaaagatggaaacagaaagaggaattagttagggaccctaagactggaggaacaatagaggtaggatgtcttaccatcaccgcatccaacaagagaaggtgacctaggcctggtattacctgatcccaacttggcaccaaaagacagccaacatagactcattcctcctgcttcctggtgagcctggtattctcctccacttccactgacagacatgtagggtgactgggtggtatcaacaataggaaccacatcataacaggcagcctagtttgggaagcactcttggtctccgtaggcctgagactccttttgcccatctagaggcaccaggtggcccagcccatggaaattccctcagccccagaaaggggcaccagaaaggaccagtgggagctccagtaggctataatagtatgaaggctctgaaatgaagttgccactggacctacagcccactaaactaggctaggaccttaggtgatagcctgaaaaaaaaaaaaaaaaaaagacccagagtcttttaacataaaaaacaggatgtgcaaatacaatgaaaaaacacacattataccaaggactaggaaaactacctaaatgagaaaagacaagtgacaccaacactgagatgaatcagatagtggaactgtctgacagactttaaaacagccattataaaaatgtttcagaaagcaattacaaattctcttgaaacaaatgaaggaatagaaaaatctcagtgaggaaatagaaattgtgaaagaagaaccaagtggaaattatagaattaaaaaatataacaatagaaattttaaaaaaatcactggattctactcaatagtagaattgatatgacagaggatagaatcagtgaaattgaggaaagaacaatataaatcccccagtctgaataacagagagaaaatagactgaaaagctctaccttgaatgataactttgatcacaaactagtagtattaaccacgtggaagaggagttgctaaatcaacttaagagaacaaatagttttaggtgagtgacaaataattggaaaattaaaaagttaaatgatgtcatgtataataacatcaacatacagagaaataaatctaataaaatgtaattaaaaactataaaatcattgtgaagaggcattaaaagaatccaaaatatatattcatggaataaaagacaatatttttatagtcagttctgtccaaattgacctatagagtcagtacaattttacaacaaattttagtggaattttgtttattttatttgaggaataaagtttatattttatttggaaatttaaaggactgaaacaatcttgagcaagaacatttgttaagacttattctgaagctttagcaaataagacagtgtgagatacacacaagcatagacaaatagaccaatggaacagaaaagagagtactagaaaacagaccacgcatattcagtcagttgatttatgacaaaagcaatactgccatgcaattggaataggacagataatgtttgcataaatgttgcagggtcagttggatcttcatacttaaaaaaaatgaatcttgactctacctcacaccacacacacaaatcaatcagatagaatgtagatctaaaagtgaaaggcaaaataataaaacttctaaaagataacataagagaataatttatgaccttggagtaaaatcttttcaaatgtaatacaaaatatactaagcacaaaggaaaagactgattgatgaattggacttcattaaaactaagaacttctgcccgggtgcgatggctcacacctgtattccaagcgcttggggaggccaggaagggaagatccctacaaaatatttaaaaaattagccaggtgtggtggcatacccttgtggtcccagctactcaagaggctgaggtgcaagaattgcttgagtccaggagtttgaggctgcaatgagccctgtttgcacaactgcactccaaaaataataaaaataaaatacataaaattttaaaacctaagaacttctgtttatcaaaagacaccattaagagagtgaagaagcaagcccttgagtaagagaagatatttgcaaatcataaacccaatacagggtttgtatctagaatatttaaagaatttccatgagtcattaataacccaatagaaaacatgggcaaaagatttgaacaagcacttcacaaaagaggctttgtaattttctaataaatgctagcaaggaagtgcaaattcaagtcataaggagataacctctacagagccaccagggttgtccaaaatgacagactaataatactaagtgccagagagaatatacagcaactacagctgccatcctctggctggtgtgagtgtaaattagtataaccacattggaaaactggcaggatctactacagctgagcatttgtgtatcttatgacccagaaattctacaaaaatgttcatgactctctagttatagtaaccaaagactggaaacaatccaaatttccatcaacagtggaatggataagatgtactgagcaatgaaattaaaggacctaatgcaacagacagtaacatggatgaatgtaataaacatcatgttcagtgaaagaagccagaaaaccaagagggtaccctgatgactccatttacatgaagttcaagaacagacaaagctaatcaatggggtcaggagtcaaaggtgatagttattttgggtatgtgactggtaggggtacaagtgagacttctgtggtgttggcaatgtcctacttcttgacctagtcagtgatttctctggtttgcctcctttgtgaaaattcatcagtgtgttctggttattatttgtgtgcttttctctatgtatcttctacttcagtaaagagtttactgaaaagaacatacttgggtttgcagagttgaaaacacccgcaacatcttcattgcctcacaaagactattttacatgatgtttaaaaactttagaagctaaaatgctgttctttcattctgagctgattacagattacagattagtaagaaagtaagtgggctacttgtttaaagatggtctatgttaagtaccctgatatcttcttttgaaagagaggtcagtcttcctttcagcagagcattctgttcacctgcctgcccacctacctcatggaccttacagagcttggttaccctgactctaggcctctcagctcttgtactgatcctcccagctgctctattctgatgccatgaccctgtctggagactagagaggctaggccacattcagctcttccttgtcactgtacaactcacctggtgacttggtttttttttttttttttttttaattccatgccgatgtaccctgacatggagaactaaagacagaattatttagggatttcctctctctcattctgaaaacgtataaatagcctttgctgagttactttgttaaaataaccctgacatttttttaaatgagcaaaggggctctaacatggaaggtagatatactgaaggaaagagcccttaaagacaaagggctagtttatttcattatgagatgtccagggctttccagtcccttaattctatcaatgaaccgagtgagaggtaacaatgagctgtacattttttacaaaacctctctgcgtagtcccagtagtaggttgctgaaattatgttaaagtcaggtggggacttctagaaaacccactgtaaccctcttgtttggatgacattgaggccagggaggggaaaagaacttgcaagttgagcagtaataacacagatcccacaggacagctggcagtgaccccacaacagggatttgaaaacaaagtaaggtcttgttgtacccttggttcctcttctttacttcctactatcaaagtcaggttctagaaacttccctaggaggcggcaagaggcagtctctgcctcctcccagtagcaaattggccacaggaagtcctcatttgggatggactggaggagagaggcagctgtgtggaaagggcaaaccttgaaaacacccaagtccttgattgggcttgcagaaggatgtggcaaagagtaaagatcttgagttctggaggcacaactcataggttcgaatcttttttttttcttttttttttttaaatggagtctggctttgtcgcccaggctggagtgcagtggcacgaccttggctcactacaagctccgcctcccaggttcatgccattctcctgcctcaacctcccaagtagctgggactacagcgccactacgcccggctaattttttgtattttttagtagagacgggatttcactgtgttagccaggatggtctcaatctcctgacctcgtgatctgcccgcctcggcctcccagagtgcagggattacaggcataagccaccgcacacagcccgtaggttcaaatcttacctgcacctcttaacctctcagggcctcagtgtcctctacttgtgaagtagggataacagtcatattcacttcctggttttgctgtgcaaaatgaatagcatgtgatgctgaggcactgtaagtcgtgagggcagatgatcacccgctttaggagccattcttccaaaatcttaagtgagtgaaaaagaagcagagatagctttttgtatttgcgcatggaggcagagttcatctgttgcctgagctaacagtatactattcagcccctagtgaaactctggccccagggcaggaccaactaactaggtagggcagtgatgaaaaagggagagtcttctcagtggagtctggtctgggtagagatgtcaaaggcaaaccatcacctccttgacttgttggctctaggtgatgatgctaacctgacctggagggatagcccttctatggggtgggcaggggcagccagaggtgttctgaaaaccagagaagtctcctcactggaaaacatttattcctgggatctgtcagttgatggcagaaatgttcattgttaaagagccgtttctttggcttattaattggtcctctgttagccagtcaacaatactgtacccagcacagatatccttgagaaatgaaggagaaataaagtctttcctagataagcaaaaactgatggaatttatcatcactagactgaccctacaataaatgcttaagagagtcctacatctggaagcaaaagggctatattcaccatcatgaaaaccctaaagtataaaactcattggtaaagcagacacacaaataagaaagagaatggaaccacatgttatcattacagaaaaccaccaaactgcaaagataaacaaaggaaagaaagaaagaaagaaaggaaggaagaaaggaaggaagaaaaaggattatttaaaattatcagaaaacaattgaaatgacaggaataagacctcacctatcaataacaacttttttaaatggcttaaatttcccagttaaaagatatagactggctgaatggattttaaaagtgacctaactctatgctacctacaagaaactaatttcacctgtggagacacacatagacagaaactgaagggatgaaaaaagatattgcatgcaaaaaaaaaaaaaaaaccaaaagtgtgcaggagtagcaatacttacagcagacaaaatagattttaagtcataaaacatagagaaaaagaggtaattatataatgataaagggatcatttgagtaagaggataaaacaattataaatatacatatactcaacactggagcacccagatataaaaagaaaatataattagagctaaagagagatagatgcttatacaatcatagtttgggactttaaaactcaattttcagctttggagagatcatctagacagaaaatcaacaaggaaacattagacttatactgcactagagactaaatgaagctaatagacatttacagaacatttcatccagtagctgcagaatcacatgcttccctcttcagtacatgaaacattctctaagatagaccatatgttaggccacaaaacaagcctcaacaaatttttaataattgaaatcatatcaaatatgttctcagaccacaatcgaataaaaccagaaatcgatgacaaaaggaactttgaaaactgtacaaatccatggaaattaaacaacgtgctcctgaatggtcaatgggtgaatgaagaaattaagaaggaggtcaaaaaagttctcaaaacaagtgaaaatagagctgcaacataccaaaaccaccagcattttttttttagcaataatctatttttaaatcaggtgtgtatattttttagacataatgctattacatgcttatgggctacagtatggtataagcataacttttatagtcactaggaaaccaaaaaatttatgtgactcactttattgcaatattcactttattgcagtggtgtggaaccaaactggcaatatctcagaggtatgcctatagttaacaagaatatattgcatatgttcacaaagctggaagagaagattttgaatattctcagcatgaaaaaatgatatatctttaggtgatgtatttcctaattatcctgatttgatcattatatgcatgtactgaaatatcactctgtgcaccataaatatgcgcaattattttgtgtcaactaaaaataaaaggaaaaataaaaggcagagccctctgggaggagaagactaattaggcttagtgattgctaattctgggagctgcatgcaagcaggttttaaagaaggcagaaaacttaaggatgtggatgtaaaaggaagttacaatgacaacacaatttacagaaatcacttagtcacctggaggactccaatttcaaatgtgccatgcttggatatttgcttacattttgcacaatgacttttctgccatctcctgtgaacctctgagcaatcctgtaaagcagggatcatgcccattttccagatgaggaaacagagtgcccatgccctgcccatggttccagaatgcagaacagtcatccttgggagatgggggtgtctggtccgagtacctccagtctcacctctgctttgtgtcgcaggtggggaggggtcactgaagacaaaggctccttgtggctataggaagggtctgcccaccaggagaggtgggaggggaggagtcttattcaggctgccaaggttaagcctggttaaccacttagacccagagttaactagcaaggggcacaggtacctgcctcagagcatttgtctctgcctggagtgtttgactagaggtcctgagagcctggaccctccgacgctcaggtctcagctgccacattcccaaaggtcatgatcatcctagaccactcaggtgctctttgttcttcaccctgcttaatttttgttaggagtgcttctgatggcttctggtccatagcctgcctctgtctctgccctgccaactccgtgctctgtctcaacgttgcacctgaaactgtgcctgccatggggtgggtattcagtagccaactgatgaatgaatcaatgaataaatgagcagataaatgaatgggcaggaaagctcctcctgtcactctctacactaacatgtaggaagtgttggagggacacacgttagtggatgtcggtcacttagtcctgataaaacagagtagatggttttcttagtaggagatcttgagggctcttctgtgaagcctcttgtggaaccagtgaagtacctgaaaggcaaggattgggcaaatcaattccttctggttgtggaggagaagcccttctagggttgatgttaatgctgcattttaatgaaagtgacttttcaggcttataattggatgacatcagctctatttctgcttttgcttctagaatttagtgtgattctattttaagagactaagaagaaaaagcaatttttagactctcataagaatactagcaacaatggcaatagctaatgtctctgcagcacttagaaaagactgtgccccctgccaagagcttgacctgggctatctcgttgaatccttgcaacacacagccccttgtatagatgagaaaactaaggcctgagccagctggccactcatccgtcacagcctcctttcctttccagtgttggggacagctcacagtgggctgtaggatgccactgggcatcagcctggcaaggtagcaggtcatctcatttttcttttttctggagggtgaggttatcctgcaaaatggaggtcatggggcctcctgccctggaatttctgcctcatccctgacatcttggatgttatcccaggctgctctggtccagttctggcttcattttctcaacatatcagatgcaagagaggcctggcctgctagctcctgtctccctgctctgctgcattccctccccacgcggtgcaggtactgactcgttctcaaaactgtcagatgggctgccacctacctgggagtttcatgacatgtcctgggatcctactacgccagaggctcaatgcctggcagagtgaacacttagtaagctgcagttgccctgaaatattttcctgttgctgattcatttcctcatctgtggataccatattccaaacttgctgtgccaccctctgaaggggcaagttctttcctaggagtagataccaagagagaggaagcccatgtcatggggacaaccacacaggccaaacacaggtgtcactgcctgcagggacagcctgcaggcatcaggcctcccaggagatagcaggcaggacaggaccatttcagactcatttcagcagtgtgtggacagaaccccactgagaaatgcaagcatgagacctggagtctattcctgtcttgtcctggggttccttccactggatgctcatcaggggaaatcctccctctggatgctgatgtggggaaaatggccaactagttttaaccttaaactcatccaaaacttattttctctccacttgagatagttgtcaggagatctgagttctcaccttccttctgctcttcccttgtatgtgaccttaggcaagttgcttaatccctctgagactcagtttcctctcttgtagctgcaggatgatggctgggctctattctagatcagtgagactcaaacctgccctgtggcatcagtcaggaacagttttgccgagtaggctccagtccagaccaatacatcacgatctgtgggagtgaggcccaggcgattcccaagcactggaagggttggaaattcaggcatatggtttctgccttaaattccatctatgaaagccgaagcgctctctttaccaccaccacctctccttcccacccttgtcttgtttgctgctgatttctcgcctgactcaagaacaaatgtgtttaagccccaagcccctaaaaatgggaagctgtctatttcccttctgtaccagctcccacatgtgtctggacacagactctgccagggaagtcccctcccatagggaccgtgtgcctccagagttgtgtggacaggacttgaagacatccaaagcccccacaagagatgatgacaacaaaactctgtgttaaagagtttccaagatggagaactcctgcctgtcaattatccttctcagacactgattttgtttgtttgttttctggctagagacgattattccacacaggaatgacagacagtccctctgttctttgtctgctggtcctgggggcctcttgcgtcagtgggaatggaaagtatcaactttcttatttctccatgttccctcttgccttgcatctttcttcctgctttcatttctaatttcttgggccctttgactttctcttcatctccctcttcattcttcacacaataatgtttatttaattttggatgttctcttctggccaaaagttgacttggtccagaccaaatggaaatatatgtgattaaatctgttctctgcggagagggactaaaacaaagatcaatgccagatattgtcgtgatgatgaaatgtcagggcagagggcaccaggaaggacagaccaggctcacagaagcgtgccattctttcacagcacatgcagcacacaatatgcagaggcatgacattccaaccttctccaacccaccgtttatcagtgtgtcccctggactggtagtatcagcatcacctgagacttattagaaacacaaattctcaggctccatcccagaccaactgaatcagaaacactgggggtggggtccagaaatctgttttcacaagccccagaagactctgatgcatgtggaagtttgagcaccactgcttctagtgcgtagacgttttgcttgctatcattgaaaactcgcttgacctctttggagaggggcatggcggcccccagatatctgaggaaggctgagcaggaggataaggtgagctgaggaaaagggagggagcaatggggtattcacggcaggggagcctgagatggtcccttaaggatttgcattggttaatgggcagactggtgcaaaagaggctgaattgaataattaggaaactgggagaattcaattcaaagaagaattcttgttcgcaaggtcaatttttatactatttaagtaaaataactctggtaggttctatagcaaatgctaagtaaagtaaccgctggtttctaaattattacgataatctgagaaaattatttctttgaaaaaattatagaactttcaaatatgcaaaaaactctagagagtaatataacaaatgcacttaatagggacaacctttaacattcagcagagaacattttactctattggcttcagatcttgttttgactgcagcttgattcccacagtcctctctcatccccacccatcgtgggtcctcagcctcatctcaccaccctgagttgggtatagaatttcctgtccaggtgtttagaattctatacatttatctaaaagcaatatagggtatcgtgtgttgggttttatatgctgatgtaaaaggagttgttctgcaatttgctttcttctctccatgttattgagctctatcctgttgctacctgtggacgtaactcgttctcattgctgggtggtatctatcttatggtccctttctcatcatcatgagcatttaagtgaagatcgtcttcaggatttccatgtgctcatgtgggagagtaagtcctgaaagtggaacatcacctgtaaatatattaaagacagggttttccaatttaactgggaaagtctccagactcagctggagctacattatctgtttctctaagaaagaacttttctgtccataaactcattgtattagtccattcttgcaccgctataaagaaatacctgagactgggtcatttacaaagaaaagaggtttacttggctcacggttctgcaggctgtacagcgagcgtagtggattctgcttctggggaggcctcagaaagcttccaatcatggcagaaagcaagggggaacaggtgtcttacatagcaggagcaggagcaagagagagtgagaggggagatgcttcacacttttaaagaccagatcttgagagaactcagtaccacgataacaacaccaagagggtagtgctaaactattcatgagaaatccacccccatgatccaaccacctcccaccaggccccacctccaacactagggactacggtttgacaagagatttggtggggacgcaaatccaaaccctatcactcatttttttctcccttcaatcattcaaccaacaattgctgagcaactcctgtaggtcaggcactgtgctgggggctgggaaccagtgggaataaatcctatgggtctctgcccttgtggagattccagagtagggctgcccggatgttcttgcattgtgcacagtgcagagacaggaggctcccggatattctggcctaggcaactctaaccctgaaaaatgaacaagcccatcacattctattcatgtggttatagtttacctgaaacctcaactgctccacagaatcagatctctccgcagctcccaaaagtgtcccaagggttagcactgaccagcttgctgggtttgaaggaaccacaatgcatcgggtgtggctctcttcctgctagctgctccgaagtgagctcctactgattctattcagttggacgctcacattcagcgagtccagggggtttttcatgctttgagcatttttaagagtctgctatttgcccagttcagtgaggggcactcaggatgtatcagtggttcaggctgacttggttcctgcctaggggaagacccacaagaccagtacccaatgcagggatggcatggatggtaggggaggcttggaggccctaacccactcttgaagggatgacagaagcctcccaggctgggattggaaggatgaaaggagcagacaggccagggtagagggcattgagtcccagtttgagcgaagggctggagcaagagagagcctggtctctgcaaagatctgaaagaacctcagagcaggggccaaagggtaagggtgtcagggcagaggctgtgccaaaagaggtgagcctcatcctaaactctgttcttgatttggggtggaagtgtccctggaaaggcagatcaacaaaggaaggagcatgagccaattctcaccacacctcttgtgcttcaagtcctctcttgggttgggtgatgtcatacagggacccacacttgattggactgccctccccaccttttaaacctctcctgtcactgagggggtacaccactggagcctggcaaaggtagccagtactcagggggtgtgcacaaacctcacacccatgtttataaggccattacaaatgctggcccagttggtgaccagacaccaatccttgtccttccacgtagccaacagtgggctagttggcaggtgcatggcaggcgctcagggctatagacaatgcaggctttaatcccatgagtggagtcggtgccaagtctagaattcaaggatgactcttcacccaactgaccctcttacccaacaaaccaatgagaacagcttgaggtctggaggacccgtgcttgatatctgtccactcttgtatttgagtaaggtagtggaggtcacaggctcacatcataaactttgtactttatttgaaacacttttctggctctgttagtggctccaacaccatacttaagcttacttcaaaatgacttatacatctctattttccttaaagtatgcgcacagataagaaaagatggggtgaattttttttttttttgagaaggggtcttgctctgtcacccaggctagagtgcagtggtgcgatctcagttcactgcaacttccgcctcccgggttcaagcaattctcccacctcagcctccgaagtagccaggattacaggggcgtgccaccacacctggctattttttgcatttttagtagagatggggtttcactgtgttggccaggctggtcctgaactcctgacctcaggtgatccacctgcctcagcctcccaaagtgctgggattacaggcgtgagccacggcgcccggccaagatggggtaattttgatgtccagacacaagttgtcatttaagatgaagcttcgattgtaactctatgaagccctgctgaatattaaaagcttatagaaagcagcttttctcccccaggcaaaaagagcccttcgatctgtggtgggactttgcaaaaagctgagctgccactcaaagaaataattccccgctaactgcaagtttctgtcttgtttatggagggcctgttgagaaggccctccaaacctttggttccagggtctggcaaggggaatctgtcatcattcattgcaaactacacctccacccactgggctgaagacctgtgcaaggatagaccaagaacttcctctggggtggctgtgctcatggatgctgatttgacaatttccaacctccctcattaccaagatccccttccttcacctgtgaaaccaaaattccatcttcttctcttccctcctttgtgacagagtggggaaagatggggactgagggaaaggagagtagaaactcagtcccttgagagatgggagctgatgggaaggaggtagaaacttggtcctttagccaggaggctctgcaggcattcaggcctgatctaccatgtaaggtgatttctttctttttggaaagctcccatttcatggggtggacaggtccaaggactgctctggaccacttggtgatcacatgggccgaagtaggggtagaggaccccaaattgaatgtgtggaggggactctgaagcaggtgtgaatgccaggagaggtgggaggaaggacaagggtggtgcatcaagaccacagaagccggcccggccagccttcccacaaagttacttgaactgagctctccataagtacacatgcgcacacacccaagaataaactggacaaatggcagcagaaagagaaagaacagaaaagagagctgatgaatacatccataatcagcactaacacagccctggaaagaaaagcaaaaagaaaaggcaagcgctgtggtgtgcagctcttattgtctaataaaagaaaatataccaattctttggggaatttaattttttctggaaataaattcttggaagaatttatgtgacagaacaccccaggggaacatccttgcgttgggaaggaggccacctcgtctggcggcctcgggcattccagtgatgcaggggaggggcccaggcagctgtgctggtccaaggggctccaggtagaatgagctgtatccttggccagaggatgttgcgcatcctctggggggatatgacgggagaatgatggggggagttggggagatgtccccaggtattacaagtggaggctggggactaccactgtcagttcattgtcaactatgtccgcctcatagacagggcacaagcctatccttagggacacacgtgaagaggggaggcaggaagattcaggcgcgctctccggcctagactggctgaaggagggagattttaatgcttggcataggtggtgaggggtccaccaaaggtaggaacacatccctggggctctgggaggaagaagcgtcaggactgcagctccagcctcttcaggcccagggtcctagggcggaacaaggctggaaaactggtgcatggaggaaagaaaaaaaatgggaagggagaatggacaggtaggaaggaaggaaaggaggaaagggaaacggaggaagaaagacatggaaagctgggaggacagagggcaaggcagaaggtaaaggaggcaaggccaaggctgtgaggaggaattccgcttttattctgctgtctggcttcatgccattgcatggggccctgtaaaataaaaaatgatacctcccagggctattggtttttatcttagaggactctgtggggagatgtggaaagctgttcaagtggcaagccttgggagctgagtttcatgacgatggccgtctagggctgttcaaagttaagatgacagattggcagagtgcagggaggtgagagagtattggggaagttttccatacaggggaccatgtagtgttttgctgggaagatagacctgggtggaggtgagactggtgggtgccacagatgattctaactcctgctccttctcttgtccttccaacaaaccaaccacacatgtaacatagtcataagagcttgcagggaggagaaaagagagatatcaacagaccaagggagacagagggtggagggccatgctgtggacagtgaggggaggaggtccttcctctccgccactgccctcaaggctgcttgaggctcccacgctgaggtgtccacctggctgagaggctgctgcttatctgttccccaacttctccacctgctggtgcagctctcccttgctgtgctaggagagaacccactgggagggtcttggcatctccaagtggggccctcctgctgagacactgggtggctgtggagggagctcagccctcattcctccccgagctcatatctacagagcagcaagtctccccactccaccagaggagagcacaggagagctaggcagctgcctccaccaagacttcacccaaccacggtccttcactcccaccaggacaggacaacccagcctcccgggtcccaggaggacttggcatggctgaggacacccaagaggaaccaccagcctatccctgaaaaagcaaagacactttggggaacagaagaacgtcttaaaagatatcaactttgactcagagatttcaagaagacgctctatccgaaaaccaaagaagaagtgtcaaagctgttgtaaatgtttaaaagaatagccaccttgattgcattttgagtgaattgtgaattccctctccctgggtcttcctcattcttctacatcctccccatttctgtactgaatttatagcagactgaatttggaagttgatttgaatgtttaaatatatgagacactctttgttactttggaatgagtaaggcattaattcttttacgttttgatttttaaaggttttatagaaaattgcatgtttcatcaggaaaaaagttatctagttctactcaaaataacatcttatggaaactttcagagtttcaccagacaaaatgccccaggctttggctttgcagctggtgtctacagctgagcctagtccttgaagtaatcatgactcagcttattcaaaataaactcttcaagaattgcaaactctcctctcagcgcatgccctgtgacctccatgtccctccattacatctcctcagagtaaggcccaatgccactgactcatgggggaaccacaggcagcaaatggccagagctcacacagagggatgagtgcacttcacctgcagtgtgactcagcaggccaacagatgctatcagggaagagcactaaaaaccaaagggtggctggctgcgtctcagcatctgtccgcgagaaacacgatgccatggttattttgtgattttggtggtaggctgctggtcaggtgtctccaagcaagttggtcaaaatgggaacagttgtttctctgggcgggcaggggtcaaggctggtctggaaaaggccgaggcagctgcaccctcttgagccactggccagcacctgtgccctgtctggggctttcctctgcccacaggagacccttctccatgcaggtgctgcgtggcaccaggcatgagtctgaagttccttctgccacaagcaccctcgttatttgtgattgtgcaaaaaaggaagtctctgccaagaaactaactgaatgttagtgcctgttctcaggactttccataaccctgctctactaggattcctttcaccctctttgaaagcagccaaagggttaagtcatcccaggtgcatctcaaagcagggctgcgagcagcaggagtttgagctttgttgcaattagaagttgagtgtgagaaaggacattcaggcacagcttatctttgaatacacatgcaggagtatcaggagcagttagagataaacagctggctaataaacacatgaaaagatgctcagcatcattggtcattagggacaggcaaatcaaaaccacaatgagactctacttgactcccattaggatggcgacaacacaaacaaacaaacaaaaaagaaggtaatcagtgtggatgaggatgtggaaaagttggaaacttcagacattgccgttgagaatggaaaatgatacagctgttttggaaaacagtttaatgtttccttaaaaagttgaatagagaattagcatatgacccagcaattccatttttatgtttgtaccccaaagaattgaaagcaaggactccaatagagactagtataccaatatttattgcagcattattcacaatagcttaaaaaaagtgtaaacaacccaagtttctgttggcagataaacaaaatgtggtatgtacacacaatggaatactattcagccataaaaaggaatcaagttcttatatatgctacaacgtggatgaaccttgaaaacatgctaagtgaaataagccaggtacaaaaggacgaatattgtataaaaacacgtatataaggtacctagattagtcaaactgattgagacagaaactagaatcgaggttgccaggggctggggagaggggagaatggggagttattggttaacaggtacggagtttcagtttgaggtgatgaaaaatgttttggaaacagtggtgctggttgtacaacattgtgaatgtacttaatgccactgcattgtatacttaaaataactgggttaggggcatttatggattttcctctcattgtaggtcactaagaacatggtgggaggaggagccactgcctttataggccccgactgccccagagcttcattcctcaccaggatgaatgacaggattctggactagagggctcttgcctgagccaccagggcatccgggggatccctgtgagcagggtgagggtgagcacccaggttccacagggctctgtcctgggcaggccagcagatgcagtgattgcaaatcctccttgtacaaatggaacaggcacgtgcatttgtggcacactcagagctgctggccactagtgtgctttggagaatcagttgtctcccaggcagggaaggtccctcagacataaaatactcacccatttagaggaatgacaacagcaaacgaaactatattctgctaatttactggtaagagaggaaaaactctgtcatgcatacacagacagaggctctgccaaaagagagaggcagcagatacagatattagcaaatgactcctctccagaagaaacacaccagccaggaacggcactcacacctgtaatcccagcactttcggaggccaggcggtaggatggcttcagaccaggagtttgagactagcctgggcaacatggcagactccgtctctacaaaaaatgaaaaaaacaaacaaacaaacaaaagatcagtgtggtgacacacacctgtagtcccagatattccagaggctaggcaggaggatctcttgagcccaggagatggaggctgcagtgagctatgatcctaccactacactccagccggggcaacaaagcaagaccccatctcttttttaaaaaaagaaagagaaaacgaaaagaaaaaaaacacacacgatttcacctgcttgaaggcctgtgcttctctttgttgtccccatgacactatacccaggccactgtcagggaccctggggggcttacagtggcttactgaaggctagacagtatccccttgcagtatcagttaggattctatcatcatgagaaagaggctccagctcgctcaacggagcaaactggaaggtaatgaggggctcagggaatttgtcctgggaaggcaggaagcacaaccctgtcttatggcagaggccatcagtccagggtcccagctggacctgctgatcctctgtccctgtctcactcattgcagatgccacctcttcggtgagggcctgtgagctagggttaggtcacctaccctaccctgtgtgaccacaggcagggagagacaggatttcacttcctagacttccacggtggaggccaggcacctaagattattctcccacccacaccaaacacagtgggggaaaactcatccccaaaaggaaactggggccaataggcaggggtggatgtggggcagcccaaaaaccaacacacagccaccgaccccatcagccatgatttatatccatgcctttcctggacaaaaaaccaaatcccactgccctgggcatcagcgggcagggcccacacaggcttcatagatgtctcctctccgggaagtggagggtgtgtttgtgcattcggagtagctggtgcctggtagaaaatcagtgcggttttggctttggcagagcagcccaggctccctttgcattcccacaaatcgaggcagctctgctgtgctactatcacagttttggcggctttgaccgcaggtcctcctgaggccgggagactgctggggcgtggtatatcagttgttgggggccgtgcttccccagggcagatgcatgcaggggctctggggcagagtgaccgtggaagttcgatgatgtcaccccttctcatgcagctgatcgttgggtcaggaaacgactctcctggcatgaacctgttcctggtctcagcaacccgcacattgtgctggtgccaggtcaaaggcagggcaggaagccaagggatggggcaggcccagggggcagagaagggcaggtgggtgggatgtcgggggcaggtgagggtagagcatgtgtatttacccaggcaagggtccggccaggctcgcaatcagaagagagagagaagaccctgactccaagccaaacccttcaccgagggaaatgcaccaacactcagagggttcttgtttagtaggtgagcaagcagccaagcattggccttccccagggcaggggcataaggccggtgagcagctgagccaggatttgaacagcagtcacccttggtgaggcagaagcagatgaggatatgaatggggatggctaaggaaaggtgggcttgcttgcactggggagaggccttactggggattcagaattgagggctggggtttgcttccccggagggtaatggtttcagctgcctgagtttttatctcaccccttcttacctcctcctgcaatgactgaccaacttccacttcaaagagatctttgattatgactccatgacatcagtaagctttcaagtcagtgaatttaccttctaatggtgattggaactcaaagccagttcacagcttgacctgcatacatcaagcagctgggtgactgtcagatgtgtcatctcatgtgggaggagaatttgttaaagtagggagagaggacctcaggaagaggcctcttgaaagtctgtgggtgcctgaggctggaggccacacctggcctctggccttcaggacaatcctcaaaaagggattaggattagcccacctggttctcagttggctgattggttaaaaacgtgaacaccaaatattaatttgcttttgtttttatcaagcgattctatttggggtgggatgggggagaacgagaaacattttaaaagttagagtaaaaacccagcgctacattgccaatttcaagatgaagtaataaagaactacctgggagggagaatcatttctaatgaagttaactttgcaaactgagcattatgcatttttcactcttggtggttaatattgggaaagtgtctggtggtccttggggtttagggtgctgtctaaaacctagagctgcctggttgtggccagtttttgtttttaaccacgaattaagcttggatcattcagaacagactgacttactcatcagggatgcaaactccacacgcccaaagcagtctcgagtcttcagtcctgggtctcggcttctttctgtgtttcgcaggcactcacacccccgtgggcttggttctccaaacaagcccttatggaaaccaggccagatgtagggattaaagttcccgaatttcagcaaagttaaataataatagtagacacaaaacaaccaaccaacaccaaaagacataggtgcaaactatgctaatcccagcagtggagaggaacaggcctttgatgatgatggccctgatggatggaggacgatggaatgctctaaacacgaggcctcaggggacagccccggtcctccttgtcagagcctgctctagtttgggatccagcaggaacctcaggagcctccttcactttggtggagaggactgagactcagagcccccaagcgcaccttgggacggtccccacgcttccctagggtgggtctggggcaggcctggggcatttctatactgctgtttgggagagcgccccagacctagtgtcctggctggggcagatgaagccagggcgctctggctggtagaggcaggaggggaggccagccaggccccgcttgaccccgcattgacaggaaggagaacggacactttctttcaaggtgctcaaatgtcccacatcacttctgtgaaaacccaaacacagaagccacccctctcagctgctacaggccagaaatgaaaattactgcaatccccaggagcctgggaagacctctgctgacattccctatgaccactgtgacggtgcccccttcggctgcctcccccctccgtatggagagcgttccagccccaggctcccagcgcctgctcccagtgcctgctccccggcctccatcactccacgccccagggacctaaagtagaaagcttagttttctccttgtttgagtgcagttgggataatttttaatacattcctttttgctcttcatcaacttcaaatgtctcaagatgtcctgagggcaaaagagctgatttagctctcagattaaaagagagtggcctaacgcctcactcattttgaaatactgacattaacggggaaaattactcaagctctcctgttacttcctgtgcttaattaagtggctctgcaggtgactcactcccttatttttcagaatgacatcagacttattttccattttaatagcctggttacttcattgattttttaaaaaatccaatttcactttctagtgcaatttctttatctgattttttttctccacactaggaaatgctaactctcgtagtggtaaaacttcgacttacgaatgcctcaatttttttttgagtctagggccccaaatcagaatttaaagaagaaattagaggtgtaatctttatttgctaattacctaaataatttcacgaagtgttggagttgttaatattattaactattcctgagaaggggcccccggggccaccaaatgaatactttgtcttggaggcaggtctgtgtccctgcaagaagccacatctggctctcggcaccctccacacccacagaaatgcctccacttttgtcactttctccatcaatttgagaaggatgattccaaattcagaagcttgttttgagctcattcaatatgcatcaggtggcggtaacatctggaggtcagtttttcttgcagtttggtaaattctgttgtctaaagagagatgtgagaattgctcatcttcatataccacacttggcactcgtaggtttgtgaagcagcagatgcaaatgtttcacgtggtgcttggcatttatttattgtttatttgtttatattttgtttttggtttgtttgttgggtgtctgggctggccaggtgaacttcattttctgccctcactgagaggttttcctccattcagctctgactctgtttccccataggagccacaccggtgagggcagggagagggtgctggttctgagccaactttgcatggaaggcccagcagaccacgctcattacttacagccagcatcatcggggaactccggcacagacctgtagtcagtgccccacagcgccccagccttctctcccgacaggagtggccaggacagggagcagaaggtgactgctgtgctgcctggagctcttctgtccggaggcttagtgaaactagagaaactcagtggacacactacaagacttcagagatactttttgtaaacccaggaagaatcaaagatatgaaacatgcagtaggcactcactaaatgttaattttcttcctttttaaatatatgcattatgatagttaaattaatgactgcacgactggaagaatacacactctaatgattcttttccctaaaataaatgtgtccactatttgctgtctaccttcttgaacatcctgcttcctctaaataactaaggagattgattctacactaacatccagttgaagcaaagttgcgtcatgataaaatctggcatgggctatcccttcaaaaagttctttctgaaccatcatgaccataaattgcactaggcaggaggtggtgctggagggacaaagaaatgccagccagtccctgcactggagttgccagcaatcacacgggaaggcctctagtctagagagacgggtaggagagagacgggagcacatcagaggagcgcagatgctagtgcacgggttaaatagtctcttacacatctggttaagatcacctcaaattgctgtggggttccatagctctctacagcccaattccaagcttctgctctcactggattagttccacggatacatggtcctctgcattagctgggttctctatcttgggtgacatcaaacctagagatgaactctagcccctcactgatacctcacaactcagtctcagaagacatttttgcatggaacagactttaatgaatggtgggtgagggggtgcctgctattgaatgaataagtatggggggaattagtcacaggacttcatactgagcattagagtccggcgtctttgttcttggaagtcttcagctcccgcccggtccctgaggatcttcccccgactgcttgatcttgcatcattgccctccctccccgagggagcaacacagagcggccctagtccactctcatgatgcctccattaatcccccggtcagggaccttccagccctgcccacagcagtcgatgccttcagtgcatctcagtcttccacccccaaaagccgtggggggtctctgtgcgggatcacccctctcctaatacccctggtcccaggagatggggaggatggagacaaggccggtgtgggaatgaggtggcaggcttctcaggacatgagctgccttgctctgcccccttgggcctcatggaccccattctccctgctggagttgatgttctggcagactgggctgccccttggcccagttcctggaataccaagtaattaggtcatcatcggggcagcggaggccagcctctgatattctgcggcatgttacttgctcttggggcctctgtttattggggctacattgccctttctttgcacagctggctttgtgcttgctactaatttttttttaaactgaagaatccattgtttagagatcacacataaatggtaaattataaagaaaaacaagtggatgaccgacataaaaatcaggaggtttgctagccctggtgagggagggaggaagacaccatgtgagagaaacacaggaccgttttgtaagatgctgcttttttgttttgttgttttgttttgttttgtttagcattgggtgtggatactcaaatgttcatcttatgattattctttaaatcgttcaggtacattttgtacagtcttctgtatgtgtgatgcattttataatatgagtggtatatttcacaatcaaaaacacttttaagaagctcttttgccttggctaactctcgtttgccgtttccccagggccagccagcccggcggagcatggggaggacctgaatctgccccggcactgtcctaccctccacaacatgctcaagtcacatcctgtcctgctttccattgcctctggtcactgtcacttgccaacattctgaacatcccactgccttcaaccctccccacttgttcggcacaatatggaaagtgaaaaaaaaaatgagttgcagagagccttgcttccgggtttggaatccagctccatcttgagtctgtttagagaggtatgagtgctttctgacgtagggcacttatcactttagcacacagggggctgtgtgatggcccagtaagagcctgagctttggagttacagagcctgggccttctcaactccatccctcatgggtggtatagatggttcttccctccctgctttccctgactaggattaacttccccctgagcccaggacacttgttactcttgtgccctaaccttcacgtcatctttccaccatcttccatctgcagctttctcaggtcatccgctccatggaggtccccgttcctaccttggccttgcctttccccctgcatgtaaccttggtgaacttttcacaagagtctgcgcagtcttcttgtaagcagattaatgccgaggaaaagccttggtgaatgcacaccccacctaccacctccaaccttgcacagctggccggggcagtcggtgccaaggatgcctcatggcccttcggactctgaacctgctatgggtcccactggccagacacgtgctttccttttggaagtgcttgtctcaaacatagacgcattgaaccaaaccattgtgtgtgggctattggaaggggtgcacagattcatttgttggttgcagcaaatgcttggtttggcaaatgcttgagggccttgtggctggaatagctccactgcatgtctgcagatctgtcacgaggatcccagctcaggtgggagaggataggggctattggtcagactttctcaggccaccctattcccttcctccatgcaaggcagcgcggtatgaatgctttagatgggcctgggtgcaaatcactgtgtgatcttggggaagttgctcagcctgtctgagcctcagtttcttgaagcatcaaatgaggatgataatctctgtttctcagggtcagcaagggacttaagtgagaaaattgaggtaacccatgggcagagcacagggcactttgtgagcactcagtaggtgcaggctcctttctcctcccctctgcctttctctccccacttactcctgtcaagtaacttcacctctcagaaagcagcaaaaattgtccagtgtctccctcattcccaagacccccactggcccctcacccagtggcctctcagggcactcccccgtcctcagaagtcctatcccagcggagatggaatccacatagctggccctttcctccacacgaccctgccagctcaacccttccccgtatgattacgatttgtttctggttgtttaccatgagaagctcactgaagcaacgaaggcttcctaggtgcctctaaagaagcaaggtaaattttagaaccttggtttaaaaaaatgctgcgctgtgcagagaagcccgtggagagagccccgctggtgaggaagcacggggaccctgctgcagggctggtggagggctccttctgcagacttctgagcttggagcacagatgggcagcacacaggtgaaatgtgatcctctgtggggctgtgttttctgccccaggaagaaagaagagtcaacaacttaattatttcgtcatggttttgtacaaagcttgagaggaggaaaaaggttcccttttttgaataatagacaggagttacagcctgaagggagcctgctcagggcgggcagggctgctgctgtaccattggcatcagagacgtgctgctgtcccgaaggctccgccctcctctgactggctgctggccctggctcctgcactactatggccttttggctcaggtgcatccttcctggaggctggaactcatcccccgcccccggcatcacctccatagccagggggccacccaggaaacgcaagccaacatctggggaggccagccatctccaggcaagttggagaccaagagaattgtgtgaatttagactcttggtagatgctgcctgaccctgggctgcctggagcactgcatccctgttgcctggcacacagtagggttattgtctctgagtagctgggtgaatgtaggtcagagctgggaggcgctgtgggctttcatagtcaaggtcacatggctcattagggacagtgctcgaaacatttcagtagggactcaccattcagtcaacaaattttggttgagcatgtattatgtgcccgccactgcattaggagctaagagtacagtcaggaacaaaagagcattcagtgtactccagacagatgttaaacaaatacatagaagccaaattatgtacagtgctaagaggaatggcatccaggccagggcagggttctcccaggtggtggcatttcaggatgagtgacattgaccacgtggagaagtgagaagagggtctcaggtgagggagcagcttgtgcaaaggccctggggaggcccacactgcaggagctggggaaagggaaatgtggtaagaggtgaggaggagaaggacctgatggtgaggatatcacagtctgatttttattttttaaaggacaccttggttcctgcaaaggtgggaggggaggagaggggcattggtgagtccataggtgatgattgcagggggtggtggcttgtggtgccctgtcactcaccagatcagtgactgtggcaagcaactggcctccccaggctcagcttcctccatgtgacttggggacgcatgcttcacagcactgttgtggggcatatattattgcaaggggctggtgctgggagggagccaacactgccactcttcccatgcataccatcc

SEQ ID NO: 1297 - DNA, 962306 bp, Homo sapiens
aaactgacttataaaaataatgtaatgtaaacatttcacaaaaataacttctattttgaatttcttgaatatcatggtattaactgctcaacagttattttagtaaaaataaggtatataaatcagtgaggaataccgatatatttattaacctacctgtagatgctttgttctttaatagttaataagtaaatgaatgatacttggatgaagtaaagtttattttttgttgttgttttgggtttttttttttgagaggggtcttgctctgtggcccaggctggtgtgcagtggcgcgatctcagctcactgtaacctctgcctcccgagttcaagtgattatcctgcctcagcctcccgagtagctgggatttcaggcacacgccaccgtgcctggctaattttttatatttttggtgcagacggggtttcatcatgttagccaggctggtattgaactcctgacttcaggtgatccacccacctcggcctcccaaagttctgggattacaggggtgagccaccgtgcccagctgctttttatcttctatattatgtcttggcagactgcaggccatgggctaaatctggcctgcagcatgtttttgtaaaacttgtgagctaagaatggtttttttttgtttgtttgtttgttttgttttttttttgttttttaagacagagttttgctcttgtgcccaggccagaatacaatggtgcgatcttggctcactgcaacctctgcctcctgggttcaagcgattgtcttgcttcagcctcccaagtagctgggattacaggcgtgtgccaccacactcagctaattttgtatttttagtagagacatagtttcaccatgttggtcaggctggtcttgaactcctgacctcaggtgatccacccacctcggcctcccaaagtgctgggattacatcatgagccaccgcacccaacataagaatggtttttaccttttaaagggttgtaggaaataacaaagattatgtgatagagtcagtatgtggacagcaaactgcactatttagtctttgatcttttacagaaaaagttcaaattttatgttgttactaattgcagacaacccgaataaacatactagggcctgggattaaatggcatgcagccttttttttttttttttttaagtacaatttccattttattttttctctggagaatagtctgtcttcaatctttttattttcattttgttttttttgagacggagtctcgctttgttaccaggctgcagtgcaatggcacgatcacagctcactgcagcctccgcctcccaggttcaagcgattctcctgtctcagcctccctagtagctgggatcaggggtgtgccatcatgcccagctaactttttgtattttagtagagatggggtttcaccctgttgcccaggctgatctcgaactcctgagctcaggcaatccacccacctcggcctcccaaagtgctaggattacagacatgagccaccacgcctcgccttgtcttcagtgtttaaggactcagctccttacatgggctttggtgggggttgtggggcagcactcctcgaaggtctaaatcggggtgggtgtgtttggtccttgtgggctttacaaggtggattcctgatgacttttctgtgaattgcacatctcacacagtaatttagcttcccatacagcttgggaagcacataggcattgaagacactcgcttcagaaatgtccctgactgctgcagcctccaccacatttcgaatgatgaattaatttctttttttttttttttgagacagagtctcactctgttgcccaggctggagtgcagtggcgggatctgggctcactgcaagctccacctcccaggttcacaccattctcctccctcagcctcccgagtagctgggactacaggggcccgccaccacgacccgctaatttttttattttagtagagacggggtttcactgtgttagtcaggatggtctcgatctcctgacctcgtgatccgcctgcctcagcctcccgaagtgctgggattacaggcgttagccaccgtgcccagcctcgaatgatgaatttcttaatggccttgtccttgggcacgcgtcaggcacagtttgtgcaacgaataggctgcatgtggctgcgcccctttttggcacgattgttgttccttcttttctttgtcttcttggaggcacggactggagggaggagtgcagccattattgatcatatttttgaataatatttagtgaactagaagttgcttatttgtaatgtcaagtaggatacaaaactttaacacagtatgattataattttgtaaaaatgtataaagtgtgtatatatgtatgaaaaaaacaaaaattctctaatgtattaatagtagatattttgagatggtggcatgatttttatttataaagtatttcttatgattataaaatcatattttaaaatttttcaatattttaactgaatgggaaacatttcctgtcaaataaggatatggagaccagtccatggtactttagattaaaagctgaactcactgggaaaaaccttattttgcatgtgtaactagtaaagcagaaacaacagtgtactgttcggcactgtctgaatagtaattatagagtacagctttcatacagaagaacagaaccaataaggaagtcaaacttggcagaatagttgagtgcaatttataaataagtcagttgaagaaatcatcgaccttttacctgtggctgattcgtgtaatggtgagagtcagcacaaatcttaacatttagcaacagcatgtatgtgaagctaaaacttgtaatgctctcatctttaatgtattttaaggaagttgatgcctaaagtaaatttattaaaaattcagagttaattatttaagatagtaatagatttcgtgctctctttggcttggttgttctttatctttaacaattttaagagctccgttcataaatatcagtcttgtaaagcccgttgttctatacctgatttttctattttatttttaaggtctttttggttcattacgggtgcaatatgttgtagatcatgcaatgaaaattgttttcctcaatactgacccctctattgtaatgacttatgatgctgttcaaaatgtgcattctgtgtggactctccggagagtcaaatcagaggtaaggagaaaggcaagtcacttctccttaacaggaaagggtaggctgggtgcactggctcacacctgtaatcctagcactttgggaggccaaggcaggcggatcacttgaggtcaggacgttcaagaccagcctggccaacgtggtgaaaccccatctataccaaaaatataaaaaattagccaggtgtggtggcttctgtaatcctatctactcgggaggctgaggcaggagaatcacttgaacctggaaggtgtaggttgcagtgagccaagatcgtgccactgcactccagcctgggtgacagaatgagactccatctcaaaaaaaaaaaaatgtatgtgtgtgtgtgtatatatatatatgtatgtatatatatgtgtgcgtatatatatgtatgtatatgtgtatatatatatgtatgtatatatgtatatatgtgtatgtatatatgtatatatatgtgtatatatatgtgtgtgtgtgtatatatatatatgaaagagtagttaatacttcataccctcacattttttttttggaaaaatcacttgtgaatagttgttttattattattatcatcatcatcatcatcatcatcatcatcatcatctctagagacagggcctcactctgtcacccaggctgaagcataatggcacaattacagttcactgcagccttgaactcctgagctcaagtgatcctcctgcctcagccttccgagtagctaggactacaagtgtgtaccaccactcccagctaatttttaattttttgtagagatgggatcttgctatgttgcccaggctggtcttgaattccttggctcaagctatcctctcgcctcaccctcccaaagtgctgggattatagatgtaagccacggcacctggcctcatttgagaaatagattgagcttcttaggaaagaagaaatactgtgtctttagtaactgacttcaacttgcattcttacaaggaaattgctattttattctaattattgtttttttttcctctttctctttattttgacttaaggaagagaatgttgttttaaagttctctgaacatgggggaaccccacggaatgtggccactagcagctccctcacagcacatctcagaagcctctccaaaggagattcccctgtgatttcacctttccggaattactcctccattcacagccagagtcgctcaacctcatcacccagtctacattctcgctcaccttctatttccaacatggcagctctaaggtagaagggtttcctggtttttctttctaagctttctgttttgttttgaaggatttagaattgctgttgacagctgtttttaggggaaatatatttaggggagttttttttaggggaaatagccattatcccaattgagaccttttttttttttttttttttttttgagacggagtcttgctgtgtcacccaggctggagtgcagtggcgcaatcttggctcactgcaaactccgcctcccgggttcatgccattctcctgcctcagcctccagctgggactacaggcgcctgccaccacgcctggctaagtttttttttttttgtatttttagtagagatggggtttcaccgtgttagccaggatggtctcgatctcctgaccttgtgatccgcccacctcggcctcccaaagtgtggggattacaggcgtgagccaccgtgctcagccctgagccagttttactaagatttctaagtttaccatgtcacattctttcctgagtcatattttgaagctgcctatgcttgtcctaaggttagttgcctcatttctaccactatgtgggcaacagtttgatgaatattaattcccaaaatattgtggcactattttatttttgccttaatttatgttagtttttcttttttttcttgttatttgatatctaaatgtatctatttctctatatagatatttatttaaatcaccagatatgtatatctggtgctacagggacattgttttgttgatatatatatgtctgactatacagggacatagtttagagctttttgaataatcattcattttccgaaaaagaagatgatctaagttttagttgtaaaagatgagttcttctaataataattctaaatctttagaatatagtaaagcacattgacatgaaccatttaaatagctactcctttttgaaaaattttaatttctgacctggattatgccatgaatgctcttctgtctgtggaattttgggaagtgtcattggagtgtgtgtcatataagcctgccctgctaactgtgatgtactctctcctctgtttcttttgcagtcgtgctcattctcctgccttaggagtgcactctttttcaggggtgcaaaggttcaacatttcaagccataatcagtctccaaagagacatagtatttctcattctccaaatagtaagtctaatggcttctttcttgcaccagaaacggagccaattgttcctgaactgtgtattgaccatttgtggacagaaacgattactaatataaggtttgttatatatattattatattcaaagaaaaatgttgctgaaagtcttgggaaatatatggcattttgtttaaagtttccttttaatgtgatcagttattaatatatgtaaaaatatatagagatatgtattaaggccacctcagtttcagtagaggatattaatgagattaaagtgatcataggctggacgtggtggttcatgcctgtaatcccagcactttgggaggctgaagctggtagatcacttgagcctaggagttcgagaccagcctggccaacattgtgaaaccctgtctctactaaaaatacaaaaattaactgggtgtggtggtgcatacttgtaatcccagctactcaggtggctgaggcagaattgcttgaacccaggaggctgagcttgcagtgagctgagatcgtgccactgcactccagcctgggtgacagagtgagactatctcaaaaaaaaaagtcatcataaaaatattattttgtcatctgatatttcttcctttatagtaataatctctcatttttcaggtgttttttgttctggggagaaacagttaatttctatccgtgaggaaatgtgggttttttagcacgtttcctaagttttatgttcatgttagttgagtgccagctttactttttgggaaacatagcttagatctctgttctgggtgacctttcttcttttatattctctttaataattcacgtgttaatttatatgccaatgtgtgtgctagttaacagtctaataagtcactgtccctgtcctcaaaagaggcagatagctgaaggatggtgacacaggagggactacttttgctggtagggctttgaaaaatgaacaggtatttgctaggcaggtaagtttagaaagaccacagacggcagctgggatcagaacaaaagttctggtgagtgcgtggtgtatttagggaattataaatactcccactctggtttttgcagaggggagggaaaaggctaatgaagaggaggcttcctaggtgcagtggctcacacctgtaatcactcactttgggaggctgaggcagatggatcacttgagctcaggagttcaagaccaacctgcccaacatggtgaaaccccatgtctactacaaatacaaaaattagccaggcatgatggcgtgcatctgtagtcccagctactctggaggctgaggtgagagagtcatttgaacctgggagttggaggttgcagtgagccaagagcacaccactgtactccagcttgggtgacagagtgagactgtctgaaaaaaaaaaaaaaaaaaaaaaaaggaggcttgagagattactgattgccctttaggcctctggtctgtttgatgacagcggtaagaaggcacttcataagtgtgtcggaagtttgggaaacagcagaacaataaatgtggaattgtcagcttataagtggtgattgaggtaagagaattagattagaattgaagaattattgtattcaataattgtgtgtacatgtagtatataggccttttcccaaggagagggttttaacagtccttagattctcaaagggatttgtggcctccaaatagttaaaatccagtggtgtagaattagaagagggctaggaactgaagtcctggaaacttaagatttggggaatggaaagagacaaagctggcgcagagagacaaagcaaaagaagtcagatgggagaagcagcaggaaatacagaatacaaaaaagaacatttcaagaatacagagatgccagtattgccaggtactggtgaagtgtggccctgagagttgaacccagagaggaggtacctgggtggcagtgggttccttggtgaccttggccagagcattttaagctgggagggtggcgggggaaagtggggtagaaaaagtaaatggggactgaggaaatgaacataggcatacagactctttaaggagtttgcctttgaataggaatgaagatacaaaattagagggagtcttggtcaaggagagttttgtttttgctgaactataataaaattagttttcatgacatcttgccccagtattttctttttctttttttttttgagacagggtctcactctgtcacccaggttagagtacagtgagtgactcaatcacagctcactgcagccttggccttctgggctcaggtgattccccaacctcagcctcccaggtagctgggactataggcacacaccgccacgcctgactaatttttgtagagaaaggattttgccgtgatgcccaggctggtctcaaactcctgggctcaagcaacctgcttgcctctgcctcccaaagtaatgggattacaggtgtgagccactgtgcctggcccccaatattttcttacctaaccacaatacaagttttatatccagtcaaattgagaaggtcttttatatactctaatgttgagtctattttatattttaagacttttaatgtgaaatagtaggctatacggactatactcaagggaaagtattgaaaatacagaagagaggaaacgattgatggaacaagtaaccagaaaggtgcacaagtggtgagattagcgttgggataaagaagtgaaggttgatcagatacgtaaggcaggaggttgagctcaagccttagagcctcattttatctgaaatggaaggcaaatgcataatcttagagagaatgaaatgggggataggtagtctgaagaaagtaaagatgtggatacaatgttgaagtagtctctctggcttgtttctcatatatcaaataaaagtatcctacaattatagatcatttttctttaaataacttatttgtaagttgaatatattatagactcttattttttagatttatgggtcttctgtagcactttatttatttatttatttatttatttatttattttttgagatagagtttcgctcttgttgcccgggctggagtgcaatggcccgatctcggctcaccacaacctctgcctcccaggttcaattgattcttctgcctcagcctcccgagtagctgggattacaggattactggctaattttgtatttttagtagagacggggtttctccatgttggtcaggctggtcttgaactcctgacctcaggtgatctgcccgcctcggcctcccaaagtgctgggattacaggcgtgagccaccacacccggccttctgtacactttagaaggaagggtttgggaattagagatacaatttcaaaaagagatgtgaatgaggtctaatctgagaaggagagggggtagataggagaaacagcattatgaaagatctggccctttgcgggataggaattcaagtttgcatgcattactttacaagtaggtggcttagtttgcattacaagtagggagcttagatagtatgtaatttaaaagttcatcagtaattgttaaatttattgtagctttccccagcaaagctgtgtaatgagctcataatcaaagaactgaaaggatcttagagatcatgaagtttaattcttagaaatgtttgtgtctttgagattattgcttgacctaagtagtttttagatttcttgcagaatattttcaaagactttttttttttttctctctctttttgagacggagtctggctctgtcgcccaggctggagtgcactggcgcgatcttggcttactgcaagccccgcctcctgggttcatgccattctcctgcctcagcctccagagtagctgtgaccacaggcgcccgccatcatgcctggctaatttattttgtatttttagtagagacgggatttcaccgtgttagccaggatagtctggatctcctgacctcgtgatctgcccgcctcggcctcccaaagtgttgggattacaggtgtgagccaccgcgcccggcctcaaagacttttaatagttactgtggtagattcttggaccagtgctgacagttactttattgatgtatctattatagagagaaaaattcacaagcctcaaaagtgtttattacatctgacctatgtgggcaaatttcctgtgcttttcagtggagtcccagctccagttatggtaggtgtatgtatttcccattgtttctgtataaataactcagcattgctttttctttttcttttctttccttttttttggcttaagtagttttatttagaaataatttacatgtcataaaattaacatgttttaactgtacaattaaatgatttttagtaaattacagtgttatacaaccatcaccatgacccaattttacaagatttatatcaccataaaaagatttccttgtgcttgtttgtagtcagtcttgttcccatttccagcctcaggcaaccatgctaggcttctgcctttatagatgagtttttctggacatttatatatatataatgtatgtacacacagtgtagctttttgtgtttagctttcacttagcgtgatgtttttaggatccaccgttttgtaacatgtatcattatttcatacctattgctatgtaatagtccattgtatagatctaccaccatgttttgtttatctgttcatcagctgatggacttttggtttatttccacctcttgactgctgagaattaggacagtatgaacatttgaacaaaggtcttgagcaaaaatgtggacatatgtgattttatttttcttgagtaaatgcctaggattgggtcattgggttgaatggtaaattcatatttaactttttaagaaatcaccaaactgttttccaaatagcctgtatcattttatattcccaccagcaaaatatgaaggttaatgtctctttatccttgacaggattggatatcatcacactctttgattgtagctattttccagtggttgtgaaatggctttaatttgcttttctctaatgcattctgatgttgatcatctcatgaagttattagccattcatttatcttcttaggtaaaatatctattcagatcttttgcccatttatttaccttcatattttgaaatacgatagatcacaggaagttacaaaatagtaaacaagtcctgtgtaccttgcattctttttccctcacaggtaacctcttgtacaactataatacattatcataaccaggagatagatgatgtacacactttatttcaaatttcatcaatttgacatgtactcatttatgtgtatgtatggttctatgcagttttttcacatatgtagatgtgtgtaaataccaccacaatcaagatacaaaacatctttatctgtcttacgttaactccttatagtcacatacaccattacccactgatcctggtaaccactaattctccatcttgataatttggcatttgtgaatgttttataaatgggctcatacagtatgtaaacttttgagattgtctttttctgttcagcataatacttttaatacccatacaggttgttgcatgtatcaagtttctttttattttattatttagctgtgtaaagtttcaagagagtaatgataaaacccagctcatctttgtttcagtgaccaacataccagcgaaggatgcagcaccagtggaggtaatgtaggcacatttgagaagttgacaattacgcttcatcagatttttcagtcaaaaaatctattaatttgctcaaatcgggaaataaatttttagtctttttttttttttttaaagaaaatagacaccatgctggtcttggaaggcagtggaaacctggtgctatacacaggagtggttcgggtaagcaataagtagcacttcatgcctttagtaggacttcaggctgcctgcatgaatatttgtaaagttactttagattgatattttaaatttgttatgttcctgtctgcacaatttggcagaagaattttgttaataattctcagtgaagcttcccatttaggtgggtcctaatttggagggctatggctcactgctattaaatgcattggtactctaaacctgtcacagatgggaaaccttcaatgagtataggtagatttttttttttttttaaagttaaactagttttgaaattgaagcatgggtacctttgaaattgaagcatgggtacctttggtaagtactaaagttttggtaaagtttcactatattaaatgtggtgtatgttagctgtattttttttttttttgagatggagtctcgctctgttgcccagggtgatctcggctcactgcaagctccgcctcccgggttcacactattctcctgcctcagcctcccgggtagctgggactacaggcgcccgccaccaagcctggctaattttttgtatttttagtagagatggggtttcaccgtgttagccagggtggtctcgatctcctgacctcgtgatccacccgcctcggcctcccaaagtgctgggattacaggcgtgagccaccgcgcccagctgttagctgtatttttttaacatttgtgaaatgtacatagagaatatacattttacaaatttaaattatgaaatttaaatacatacaatttgaataataataatgaagtgaatattcatctacccagtactctggttaagaaatagaatattgccagtatccttatttttattacattcttttctgattgcatcctatcttcccctgccctcgagatagacagaatcctgattttgtgataaatcagttgtttgtattactagtttttacagttatgtatgtatcactaaagaatgcattatttagttttccttgtttttgaatttttatataaaaaataccatgtactcgcctctgatgtacttattttgctcaacattatatttgttttagatttgtctgtgttgatgcgtactgttgtttactcattcagtgtgatgtatatattcaatagtattccatcgtacctcattttgtgctttgctttattgtacttcacagatactgcatttttttttttacagattgaaggtttgtggcaactttgtgttgagcaagtctgttggtgccatttttccagcagcatgtgctcattttgtgtcactgtttcaaatattgataattcttgcagtatttcaaacctttttgttattagtttatctgttatggtgacctgtgatcagtggtctttgatgttactattagaattcttttggggcaccacgaactgtacccatataagatgaggaacttaattgataaatgttttgtgtggtctgcctgatcatttgacccctttcctgtctctctctctcctcctgcctcactatatcctgagacaaaacaatattgaaattagaccaattagtaaccctgtaatggcctctaagttttcaaatgaagggcagaatcacaagtttctcactttacatcaaaaactagaaatgattaagcttcgtgaggaaggcgtgttgaaagctgagataggtcgagagccagaccacctgtgcacaagagccaacttgcgcatgcagaggaaaagctctcgaaggaaattaaaagtgctatttcagtgaacatggcaactgataaagcgaaacagccttatcgctgatatgaagaaagttttagtgtctggacagaagatcaaaccagccataacattcccttatgctgaagtcgaatccacagcaaggccctaactctcttcaattctgtgacggccaagaaaggtgaagaagctgcagacgaaaagttgtaagcaaacagaggttgattcttgaggtttaaggaaaaaagccctccccataacacaaaagtggaaggtgaagcagcatgtgctgatgtagaagctgctaagataattgatgcaggtggctacactaaacagattttcagtgtggatgaaacagctttctgttggaagaagatgccatctaggactttcataacctgagaggagaagtcagtgcctggcttcaaaggacagtctgaccctcttgttaggggctaatgcagctggtgacttaaagttgaagccagtgctcatttaccattccaaaagtcttagggcccttaagaattatgccaagtctgctctgcctgggctctataaatggagcgacaaagactggatggcagcacacctgtttatagcatggtttactgaatgtgttaagcccactgttgagacgtattgctcggaaaaaagattcctttcaaaatattaccgctcattgacagtgcacctggtcatctaagagctctgagggagatgtacaggagatgaatgttgttttcatgcctgctgacacatctgttctgcagcctgtgaaggagtaattttgactttcaagtcttactatgaaatacattacttaactagagctgccatagatagtgattcctctaagagatctggcaaagtccattgaaaaccttctgggccgggtgtggcagctcacacctgtaatcctagcactttgggaggccgaggcaggtggatcacgaggtcaggagatcgagaccatcctggctaacacagtgaaaccctgtgtctactaaaagtacaaaaaattagccgggtgtggtggcgggtgcctgtagttccagctactcgggaggctgaggcaggagactggtgtgaacccaggaggcagagcttgcagtgagccaagattgcgccactgcactccagcctgggcgacagagggagactccatctcaaaaaaaaaaaaaaaccttctggaaaggattcacctttctagatgccattaagaatattcatgattcatgggaggaggacaaaatatcaacataaacaggaatttggaagaagttgattccaaccctcatgggtgactttgaggggctcaaaacttcagtggaggaagtcactgcagatgtggtggaaatagcaagagaattagaattagaagtagagcctgaagatgtgactaaattgccaagatcttatgattaaacctgaacagaattgccaaacttgaacagaattgccaaaatcttatgatcaaacttgaagagttgcttcttctggatgagcaaagaaagtgggaacatacagaaaacaaacattaaatggcagatttaaatcccactaggccactaattaaatacaatggtctaacacaaataacagagactagcagaagagattagaaaatacagcccaactatatatgttggttataagaagtgttcttcaaatataatgacataggtaagttaaaggatggaaagaagatatattatgcaaacagtaatcaaaagatagctggagtcgctataaagtgggaaaaaaaaaatgaccaggaacaaagagagactttaaagggccaaatcaccaagaaggcacccttgagtattttgtaaatgtcagttcattccatttggttgataatgttgttcatgtcctctccaaccttggcaatttcttttcttctttttcgatacagtatctcgttctgttactcaggctggagtgcagtggtgggatcacagctcactgcacccatgacctcctgactcaagcgatcctcccacctcagcctcccaaagtgctgggatattacagacatgagccaccacatccagcctggcaaactttttatgtaggagttcagacaagtatcttagcctctatgggccgcatgcagtctctgttacatatttgtcttctgtttttttttttccttaaccatttaagtacataaaacctattcttagctcacagactgtacaaaaatgggatacaagccagatttggtcatggaacatggtttgctgaccaaggatctaaatagatgcagagaaatcatttgataaaatcaaatatccgtgatgaaaaaaaatcctcagcatcgagaaatagaaggggacttcctcaaatagacgagggacattcaaaattttcactgtgcctcctgatgaggaggaagggacggccatgacttttttcttggtgtttgcaaaaagtagggcagatatagtgaaaagtttctgtcctggtcggtcattcttttcccaacactttggctggaaagagtaagattttcttagggcgtgttttgtctgtgaacgttggcatgtctgtgttataggcactttgaaagcctgaggcctggttatgtaaggagtcaaaaaaaccagaaacctaggaaattcatcattaggtcattcctgggtctcaggttactagccagtttgtcttcttttcttcactttttcagaatcctctgttagttgcattataaattttattcagttttttttctttctggtgattaatgagggaatagcatggtatgtgcttattccatcttttcgtaaattaggggtttgagatagcttttaaaaaattatgcataattagttctcactgttattttgttttttaagcctaaggattttattggggcaacttctgttattttgttagctgttgagtagtgtgttaacatgaatatgtacgttgttaagatctcattttagttctgagcatctcctttttagtcttatcaagttttcagcctgtacagatgtgaatttctgtttttgctaagtaccctacagatagccaaaataaggagtggttagcacggattgtcaactcattcttttttttttttttgagacagagtttcattcttgttgcccgggctggagtgcagtggcgcgatctcggctcactgcaagttccgcctgctgggttcacaccattctcctgcctcagcctcagagtagctgggactacaggtgcctgccaccatgcccggctaattttttttttttaatttttagtagagatggggtttcactgtgttaggcaggatgctcttgaactcctgaccttgtgatccgcctgcctcggcttcccaaagtgttaggattacaggcgtgggccaccgcgcctggccgctgttcttactgtctttatgaccaataaggtagaagagtacatagtgtacagatttttatataatgtgttgactatattaacattcctctccttgccttccaaaaaagtcttcagtaatgaagagaaggaatccaaccaagagaaattataccaaggtatgagaggtctaggtgggcagatggcttcagcccagaagttcaagaccagcctggataacatggtgaaaccctgtctctaccaaaaaatacaaaattaaccaggcatagtggcatgtgcctgtagttccagctactcaggaggctgaagtgggaggatcacttgagcctggtaggttgaggctgcagtgagctgagatcatgccactgtactccagccacagggaaagagtgagatcttatctcaaaaaaaaaaaaagaaattataccaacatatttgcagttggatagtggaattcaatagattattgacatttgaattgtttctttgctgtgtttggtgagaataaacttagaaatatcaaaagaaatatatgtttatattccttaacattttatttaaggatgtgatgcattaaaggcagtattttttttttccacatgtttttattgcttaaaggtgggaaaggtttttattcctggactgccagctccctctctgacgatgtccaacacaatgcctcagcccagtactccacttgatggcgttagtgctccaaagcctcttagtaaactccttggatcattggacgaggtaagaaaaggactaggtgctgccaaaaagttaacattttttaaagaagtttggttaaatattagttctttccatggttaacttaattttagtttctacttgcagaataaatgttttcaaacagaagtgattcagttaacatacgctgacctcccttgtgatgtatgtgatactttttgaaggtgctggagagatggaaatgatacattcttttccatctagggatctcacaatcgtgtggagttgatgtactgtctgcataagaaattagaatttaagaaagactcatgactcagtaatgtggaaaagagagtaccatcgttgattgactgatgggaagataacatccaatgggaggacatggcaaaatcaaagcctcatctctgagagacatgtcagtcttcgtttggaccttggggatgagtaggatatctgtaggtagaaaggagcattcagggcaaggagaaaccacacaggcacaggcaggaaggccagataatgcggaacattttttaatggatatttgtatcttcatctcctagtcataaggactgaataaatctgtagaataaatacttataaaagtacaagtagtctgtagggtgaggcaggatagggtttggataacaataataaccttttttgagcattttctatgtgctaggcattgttctcagtgctttattggtaataattatttccttagaacagctttattgagaagatagtactatgattcttttttttacaaatgagatagaggttacaaatgaaataaacctactaagtggtagaactgggatttacactcttactaatgtgctcttaaagggagaaaggatgaaaaggtggttttcttctgaatgcaattgacagggcattacaggattttgagaaaggagttacgaggttttggatctgtgttgtaaataggtgtattttgggattcaagataaggagaccagttagcctccaagtgaggttgtctgtgtcagtttaagaagtatgaagagggtctgagctagggcagtatatgtgtggaaaggagggattaatatgagaggccttgagaggtggaaatgagtttgtcagctgattggttttgtgctgctgggctggggaaaggtgatgtggaaggaggctctgaattctctgaacgacctgggaaggtacctggatttaccaagttaggaagcctggagaaaagtggtttgtatttaaaggacatgtgagtgtggatgtttagggacggttcaaagggaaggttagtgctatctgttgtatttgataatgtctatgtcttcattatatttttaaacatgtgccacattgaattttttttccttcaaaccagcacatttgcagaacattcaaagggggaactggagaagtgtcagagtgttttgtgtgatttggaagaatttcttttataatggaaaatggtttccaacttttttagaattctataagcctggtaatagtgcctttttgataggtgtaaggtcatggaaatgatagtctgacacattggctgatggcttttccacttctctggaagattttgctagtagacttagagccaggaccagtggagctgaatttttcctggtgacttttagagtagaatctggaatagaataaatacatcttagtcttgattgtcagtgttgacaagatattcacttagagatatataaattgaattaaaggaatcaaaaaaggatcagtggtcatgactagagattaagattggaagcatctgcatgtagatagtaactaagaccatttaaattttttgtttgcatatctgcagttaagcaaataaatgctgttcctgtatttttgaataaataattgcctataggggaaataccactaaatcctggtctcatttgttggctttttcattactgtcctttcttcctgggctcttagttcctcagctgcctcaaatcacagtttagtcttttgttttttgttttttgtttttttttgagatggagtcttgccctgtcatccaggctggagtacagtggggcaatctcaccgtactgcaacctccacctcctgggttcaagcgattctcctgcctcagcctcccaaatagctgggactacaggcacctgccaccgcacctggctaatttttgtatttttagtagagatggggtttcaccatgttggccaggctggtcttgaactcttgacctcaagtgatccgcccacctcagcctcccaaagtgctgggattataggcatgagccaccacgtgccccggctcacagtttagtctttagccctgtaaggttgctaacagtgctgctggcttctctccctcttagctatgactttccttgcatattgtcagcctttccatatgttcctcttaccaccaaaatttgcagatggccagagcagaaaaagcaaggttctccaagaacgttggcccctttccctgcagttgccttctctcctagatcttggtccctcaagtccaggttgcttccacagcttttccacagccaccaatcagatgttttccttttacctaccttttctagctgtttcctgtgaggaccttggtttgctggtacttcattgtatctggaacaaaatgttttaaacagcctgggtcttgccgtgtcatccaggctggagggcagagactattcacaggctcactacagcctcaaattcctaggcttaagtgattctcctgtctcagtcttctgagtagctgggactatacaggtgtgcaccaccatgcttggcttggagcagaatgtttttgaatcattacatattattgtttgttagaccatatgcaaaaaagaaatagttaaatttccttgtccttaatttctcagaaaacaattcatttgtgttgtatttacgactttttacaggttctcctgttgtccccagttccagaactgagggattcttcaaaacttcatgattctctctataatgaggattgtactttccaacagcttggaacttacattgattctatcagagatcctgtccataacagagtcaccctagtaagtataaacatttggtagctttccaagaagtgggctggcatttcaaatttgacagaatacagaattttgtctgaaaaatgacaacaaacatttctcatgatttaaaaaaatctattgtgtcattttttggcactattttactttttactatacagtaattctgcttgttttctacagtttctgtattattaaaaacttagtgaaaacaaaagcttgttgagtcagttgaattgtaaattgatgtgattttttgtcgtctcattaaaagtaaatgtccttttgatgatggtgactcactgtataaagattagacactttttattaaaacaagcattttggaaaacattttgcaaataattacatttaaagtttctgaaatttggaagtgttcatttctgtttgaaaattgtttttcatttattttattgctttgatgggcaaagtcttgtaccagctatttttaagacattcaaagacttagaatgcacagattttatttactttctcatttgtttccatctaggaactgagtaatggctccatggttaggatcactgttcctgaaattgccacctctgagttaggtacgattgagaagtttcatttataagacatgaagtaattgtgatttacattaataattggggttttaaacattattttgccatttttgaagccactggatcaagttcttagctttgtagaggagccttaaagagctagggagtgctttgtgatgtccactctatgtgtgctctaaggctggagtacaggtgaaggatgtgctatttctgttctctgaggttcttctgttggggaatattgtgcagtataataatatatggacatgcctgctgggcatggtggctcactcctgtaatcccaacattttgtgagactgaggcaggtggatcgcttgaggtcggtagttcgagaccagcccggccaacgtggtgaaaccctttctctactaaaaatacaaaaatcagcggggtgtggtggtgcacttctgtaatctcagctacttgggagtctgaggcaagagaatcgcttgaacccagaatgcggaggttgcagtgagccgagatcgtgccactgcgctccagcctaggtgatagagtgagactcagtctcaaaaaaaaaaaaaatatatatatatatatatatatgtatatatatatatgtatatgtatatatatatgtatatatatatatgtatatgtatatatatatatgtatatgtatatatatggacatgcctcttgcaagaacatctgggaaactggaagcctaagcgactaagataattcttggcatatttaatgtttttttctgtaatgtattaatgatgtttttaattttaaaatgaatatctcaattttcagataaattgtgaaagtaacctaattgccttaattgaataaaacttaatattattgtcaaaatacaatcagaattatcttaataaatattggattctgcttgaattattcctgagatgcaatttcaaaaatgctagaggagaatatttctgaacatagcatagtaaacaaaatgttagaattgaagggatttgccaacaaacgtaggttaagaaaagaatgcctgtatgatataaggaagttcatgacatatcttggtttccaatctaactgccaaagcaagacattggcagattgtagacaagaataactttttcattttaggaattttcactgctggtaaatggtattccaagttgctatagagattccttgccttctaaaaggtatttcgtaatcacaaggccaggtacctagaagtatgataagcctaagcaaaatatataaaaacaaataataatggaagaaattaaataaataaaaacaaaaaatcttacccctttatagccaaatagaagccccatagtttatgcacataagtttatgtactttacctgcaaagggttctcacacactcatgcagcattgggtttacacttattttggattcagctatgacatacttggttatatggtattttaatattatttgcttccaacctgtgctgtgtgagtttgcatattgcaaactgacgggatagaggatatgctgatgagggtgggcccagtggcatgacagtggaaagggaaaaaagaatcctggaagagaggatatgtgagtacacaaacattgcagtttgggattatttactactaaaagcagatttgggtctcttcacagtggtagccctggccactctgaggggatcattgtatgacagtgtagtgctataattgatgtggagccactgagaatggtataaggccaggtgtggtgggctcgtgcttgtaatcccctccctttggaaggctgaggtgaggggattgcttgaggccaggagtttgagaccagcttggacaacatagtgagactcggtctctacagaaagaaaaataaaatcagccaggcatgctggcatgcatctgtagtccttgctacttgggaagcttgagctggtggaccacttgagcccaggagctggaggtgacagtgagctataattgcaccactgcactccagcctggggacagaggaagaccctgtttccacttaccaaaaaaagaatggtgtaaattatgtggtatcaactcttaacccttttaaggcagagagcatgtgaaacattttagaaactgaacgacatcagaaataaagttataaagctttggttaataggcatgttaagtcatttagaacatcatgtaatgctagctaagcattgctattcgtggatgcatatattgaatattatatatttactgaagtatgtaggcagtattttatataaatgtataaacatagaagttgtatgtttttcatagtgacttttttttttttgagacagttttgctgtagtcatccaggctggagtgcaatggcgtgatcttggctcactgcaacctctgcctcccgggttcaggcgattctcctgcctcagcctcctgagtagctgggattacaggtgcctgccacaatgcccaactaatttttgtatttttagtagaaatggggtttcaccatgttggtcaggctggtttcgaactcctgacctcaggtgatccacccgccttgacctcgcaaagtgcttagattacaggcgtgagtcaccatgcctggcccatagtgacttttaatttgtcacccgagctagaacatctttaagagtgaaggggagcagttagtaattgctaggcaatggatgtaaatcaggactgtctctggcaaactgggctatttggttactttatttctgatgcaaaattaatgatcaaaaagctgtccttggccgggcacagtggctcacacctgtaatcccagtgctttgggaggccaaggcaggtggatcatgaggtcaggagtttgagaccagcctggccaacatggtgaaacatggtctctactaaaaatacaaaaattagcctggggcagtggcagacgcctgtaatcccggctacttggtggctgaggcaggagaatctcttgaactcaggaggcagaagttgcagtgtgccaagactgcgccacagcactccagcctgggcaacagagcgagacaccctctcaaaaaaaaaaaaaaaaaaaagctgtcttcagacccctttcaagccctgttgaattcagtagttggttttagtttcagatgatgggttaggtaatgtttgcatctcattggctctttaatgacagttttcttttcataataattggcctttacatagtagaagttaaagaaacttggttattgaaaggggaaaagaaatgcatgcagagtaagaatactaaaattaatctttgcttttaatagtacaaacgtgtttgcaaacaattaagtttatcctgccaaaagaaatagcagttcagatgcttgtcaagtggtacaatgtccacagtgctccaggaggacccagttatcactcagagtggaatttatttgtgacttgtctcatgaacgtgatgggttttaacacagaccgcttagcatggactagaaatgtaagtaaatacaattgttttctttatgagttattctgttaatgtaatggttgcataattggtaatataacattgagactatataataggcgtaccatattcaaaataatagaataatattaaggtttattgtatctatatgttgtaaatcaaatctcacttaatatttaatgttaacattttactagtgattataattactgagctttagaatgttaaagcatatatgactatttctcatttcacctttgtaaaatgactgcaagttatgctaggattagtgatagtcttggttttattgatgaagaaactggatcacaaagaaatcacagatctgtgattttttaaaaactatgactagactgcatcttctgactccttgtttaacattgttttctgaagataagattgtctttttacacacatattgcttgggatgtgaagaggaaggtttgatttgagggagatttaaagtgctttagcctgagtatctactctgttaatggtagaaagccttacctctcaccctcttcccccagtaacatccttacaggcccttattagattatttacaaaatcagcagagtggtgtcttcagtattggtgatctccttctagctttggagatcactcccaggacaactttgcctgggtcactctgaaaaaaaatcactctagactataattaccccttttccaggtagctcagctgtaccattctatatgttttagccttgcacaccaaatccttttttttttttttttttttgagacagaatgtcgctctgtcgcccaggctggagtgcaatggcacaatctcagctcactacaggctctgcctcctgggttcatgccattttcctgcctcagcctcccgagtagccgggactacaggtgcccgccaccacgcccggctaattttttgtatttttagtagagatggggtttcaccatgttagccaggatggtctcgatctcctgacctcgtgatctgcccgtctcagcctcccaaagtgctgggattacaggtgtgagccaccgtgcctggccagcaaatccatttttaaaacttgttttttgtcttaattatgaaaggaaaatgtggaaaatggaggaattaagaaaataattatactactcagagataaccactctaaatatttttgatgttaccttctatataaaaataccaatgaaaatttcccgttatcattaaaaattttttctaaaatatctccatcatttcttcatagtgtagttttatcataattaaccaatagctaataattgtaccttgtgaatctgttgttttcgttattggaatttataaacatcctttttcacgactctttaaccacatctctagttacttcccaagaattgaatcttaaaagagaaactgtgaggtcaagtaatgtttggaaaggggttcccaggtgacattcttactagcatcatttaaaagcgcccatttcaccacagtgtttatttgtggtgtggtgaacctttgccagcttcctgagaaattttatcttatttctctataagtaaatgggaatggttttttcaaaatttcatcagttatttatagttcttattttttgattcgtatttcatgtcctttgtctatgttccagtctcttctcagaccagtggccaaagtaatcctgtttgataacgtcaggttgcgttcgtcacgcctctgcgtagaatcccccagtgacttcccatgtcactcagagtaaaggccataggcctataagatgccatgtgacctagcccttgctcaccttcctggtcttatttcttaatgctttgcacacatcatcccggccacattggcctcagctctgttccctgagcactgccagcatgtttctgcctctgagtgtttgcacttgccattacctctatggagaatgctttccctccgacaagacgtgcttaggtctttattcagatgtcacctcagtgctgcctgtcctgtctctctctatagaattacacctgcctccatacctttagtgccatttacctgtttttctttcttctcacttaattaaatataatatactatatgttttacttattttgttttgtatccctcctcccccaactggaatgtaaattctaggaaggcaaagatttttgcttagttttgtttactactctctctctccaggacctgtggtattgcctggcatagaaggatactcagtgaacatttgttgagtgaatgccgttttccatctgagtgaggtactgtttttaagagtttgtgtctatttcagcacatgaaggaattgctgtctgcaatttcctttagaaaaatcttatgggaaaatagggacaattttcttttcttttctttccttttttaagacggggtttcactctgtcgtctagggtggaatgcagtggcgctatcctggctcactacagcctctgcctcctaagttgaagcgattcttgtgcctcagcctcctgagtagctgggattacaggcatgcacctccacgcctggctaatttctgtatttttagtagagacagggttttgccacgtgggctatgctggtttcaaactcctgagctcaagtgatcctcccaccttggcctcccaaagtgctaggattaccttcttttcttattttaaacaattgtatccaagtgacattatccccaatttttctgttctttattacatgtgaaaagattaagcctcatagaaactggatttctacattatgaaaaagcatgtcagctttctgtagttttgtgtatcattgtccttggaacttgttgatgagtacagattgttgtgtcctagtctctggcagagaacctatgccccctcgcgtttccatgttttggggaggactgagcacctacccattttttcctttgcaaagaaggacatggctctttgacttacttattgcatgataattataaaggaaggaataaggaaatcaattcttgaggccaagttgctttgccatttatttataggactgcgtggttaaacccttgctatcttttgtcctcatagtcaaagcttaggatgaaatggtcctcattggcaaatggttttcattttgctttgttcagatttattctttttgttttcacatatataatgtggtggagtacagaatttctgccaatgactcgttacacaatttttggcatttctttgtgctttctttaatttgctgatgtgttacatgagtgcactggactgtacattgtaggaacagttgcatttggggttaactttttgtggcttttgggctgctctttttttcattagataaatattgaatccctgctgtgggccaggcatgatgccaggtttctcacatataccccagacaaaacagattgttcctctggaattgactgtcttgagggaaacaaataaataatatttgatacatgtgttatgatagatgaagggtaagggtccataggagcatataacagggttggctaacctgagacacattgaaagagtgaagattaaacagatccatgtatggcacaaagagccatccttatcaggcagtttctactttctcataactccaggccttatgaatctgataattatagcagggacattctttttgactgtgggactttgtgtgtgttacattttggttgaagttttaggttagatagttactgttatatttgttgctttgatttcactgttactaccaggttttttataatatatatgagttgggctgttttttatttgaatgcttcacaagcaaatcttctctctcaataacattcggttttaaaaatcactttattgctacctatgtttagtttttatatagaaatcaactctgtttaggtgagtgagttgataaatatgtaagtttttcagcataggaaaatagccattgccatttatagagttacagtttattagttgatggtcaatgtccatgtgaagtagctggggcagcaaagattatgccaggggaaattgaagaagagcaacttgcagaaaactgctttgatgtagttgtactagttaaaagataggctcactattgtaatagaaaggcctcaaaagatacaatggctcaaacacaataaaaatgtctgtcttgtttacataacagggcttagcagataaacaggccacacagttattcaggaacccaggttgatggaggatcttttgtcttcggttcaaagcttgccgttggttgactgcattccagtcaggtggaaggggcaaagagcctggaggagcaggggtaggactggactggtcctggaagtgatgacagtgacttccatttataattaactctgtcaaagggtcacacctaacttcaaaggaggcagacgtatgtatgtagtctggctgtgggttcagtagaaagaggagaaaaaagattttccagagtagctacttgtctctgccatagaattgttagatagtttactgtaggtggactgtaaataaatgtttgcttagttctaacatttgactgatattgggttgatcctttgagacttggtatattgtggatatgcctaaagtttctttttctaccaaagatgtgatgtaatctatgtcgttacagaagtaggagagggaaggaaactaccattaaaatcagtccttaggagcccaggcactgttctagatgtttgcatatattaatatgatttcatttcatctttacagtaacctggaagaaagatatttaaataatgactttccagatcaaaaaatgagttttgatggcttttctcagttttcataattggcagaactgatttccgaatcctttaagttgatcagttgacaggaatgcatttatgatttttatcttttcttttggggttacttttcagtttgactttgaaggatcactttcccctgtcattgcacccaaaaaagcaaggccttctgagactggatctgatgatgtaagcattattatttcttgctaatataaattaatttatggatattcatactattcttccacttctgtggtattcctatcaattcctctatctttccaacacctttcactttatttattttaatactgaatagcaattattttgaagagtaggatctgttacattttctagggtctttaatgattatccaaaaattaatgtatgtattactgcatgatttcagtttgggtttgtagacattttattatcaactgatcacctgaaatgacagcatttaccttttttatgcagtgttttttaaattaaggttctcaatcgtatcaggttccatggtatattcctttttttttttttttttttttttgagacggagtatcgctcttgttgcccgggatggagtgcagtggcacgatctgagctcactgcaatctccgcctcccaggttcaagcagttctcctgtctcagcctcctgaatagctgggattacaggcgcccgccaccatgcccggctaatttttgtagttttggtagagacagggtttcaccatgttggccaggctggtctccaactcatgacctcaggtgatccgcccgcctccgcctcccaaagtgttgggattacaggcgtgagccacggcgcccggcgggcaagacaccctcagagcacagggtgctgccaagagcccggccgagtgcagctggagcgccgacgtcgccaaggatacacagtgctgacgcagtacacaagtgcgtcacagtggtcctccgccggctacgtcagtggctttcaggcgctttcctgttggaattggcgactgctgcggggctgagcgctggtttcacgcgtctcgggagccaggttggcggtgcgatgaggcgcagcaaggcctacggggagcggtacctcgcctcggtgcagggctccgccccgtcgcctggaaaggtgagtggatctcgaagagaccgacggcctcgacctggcggggcggtggcctcgacctggccgggcggcggcggcggcctcggcctcggcctggccgggcggcggcggcggcggcggcggcggcggcggcggcggcctcggcctcggccccggcctggccgggcggcggcggcggcggcggcggcggcggcctcggccccggcctggccgggcggcggcggcggcggcggcggcggcggcctcggcctcggcctggccggacggcggcggcggcctcggcctggccgggcggcggcggcggcctcggcctggccgggcggcggcggcggcggcggcctcggcctcggccttggcctcggccgggcggcggcggcggcggcggcggcggcggcggcggcctcggcctggccgggcggcggcggcggcggcggcggcggcggcggcctcgacctggccgggcggcggcggcggcggcggcggcggcctcgacctggccgggcggcggcggcggcggcggcggcggcggcggcggcggcggcggcggcggcggcggcctcggcctcggcctggccgggctgcggcggcggcggcggcggcggcggcggcggcctcggcctggccgggcggcggcggcggcggcggcggcggcggcctcggcctcggcctcggccttggcctcgacctggccgggcggcggcggcggcggcggcctcgacctggccgggcggcggcggcggcggcggcggcctcgacctggccgggcggcggcggcggcggcggcggcggcctcgacctggccgggcggcggcggcggcggcggcggcggcggcggcctcgacctggccgggcggcggcggcggcggcctccacctggacgggcggcggcggcggcggcggcggcggcggcggcggcctcgacctggccgggcggcggcggcggcggcggcggcggcggcggcggcggcctcgacctggccgggcggcggcggaggcggcggcctcgacctggccgggcggcggcggcggcggcggcctggcctaaggtacttctgttggggaatattgtgcagtataataatatatggacatgcctgctgggcatggtggctcacacctgtaatcccaacattttgtgagactgaggcaggtggatcgcttgaggtcggtcgttcgagaccagcctggccaacgtggtgaaaccctttctctactgaaaatacaaaaatcagcggggtgtggtggtgcacttctgtaatctcagctacttgggagtctgaggcaggagaattgcttgaacccagaatgcggaggttgcggtgagccaagatcgtgccactgcactccagcctaggtgatagagttagggttagggttagggttaggcaagacattggcagattgtagacaagaataactttttcattttaggaattttcactgctggtaaatggtattccaagttgctatagagattccttgccttctaaaaggtatttcgtaatcacaaggccaggtacctagaagtatgataagcctaagcaaaatatataaaaacaaataataatggaagaaattaaataaataaaaacaaaaaatcttacccctttatagccaaatagaagccccatagtttatgcacataagtttatgtactttacctgcaaagggttctcacacactcatgcagcattgggtttacacttattttggattcagctatgacatacttggttatatggtattttaatattatttgcttccaacctgtgctgtgtgagtttgcatattgcaaactgacgggatagaggatatgctgatgagggtgggcccagtggcatgacagtggaaagggaaaaaagaatcctggaagagaggatatgtgagtacacaaacattgcagtttgggattatttactactaaaagcagatttgggtctcttcacagtggtagccctggccactctgaggggatcattgtatgacagtgtagtgctataattgatgtggagccactgagaatggtataaggccaggtgtggtgggctcgtgcttgtaatcccctccctttggaaggctgaggtgaggggattgcttgaggccaggagtttgagaccagcttggacaacatagtgagactcggtctctacagaaagaaaaataaaatcagccaggcatgctggcatgcatctgtagtccttgctacttgggaagcttgagctggtggaccacttgagcccaggagctggaggtgacagtgagctataattgcaccactgcactccagcctggggacagaggaagaccctgtttccgcttaccaaaaaaagaatggtgtaaattatgtggtatcaactcttaacccttttaaggcagagagcatgtgaaacattttagaaactgaacgacatcagaaataaagttataaagctttggttaataggcatgttaagtcatttagaacatcatgtaatgctagctaagcattgctattcgtggatgcatatattgaatattatatatttactgaagtatgtaggcagtattttatataaatgtataaacatagaagttgtatgtttttcatagtgacttttttttttttgagacagttttgctgtagtcatccaggctggagtgcaatggcgtgatcttggctcactgcaacctctgcctcccgggttcaggcgattctcctgcctcagcctcctgagtagctgggattacaggtgcctgccacaatgcccaactaatttttgtatttttagtagaaatggggtttcaccatgttggtcaggctggtttcgaactcctgacctcaggtgatccacccgccttgacctcgcaaagtgcttagattacaggcgtgagtcaccatgcctggcccatagtgacttttaatttgtcacccgagctagaacatctttaagagtgaaggggagcagttagtaattgctaggcaatggatgtaaatcaggactgtctctggcaaactgggctatttggttactttatttctgatgcaaaattaatgatcaaaaagctgtccttggccgggcacagtggctcacacctgtaatcccagtgctttgggaggccaaggcaggtggatcatgaggtcaggagtttgagaccagcctggccaacatggtgaaacatggtctctactaaaaatacaaaaattagcctggggcagtggcagacgcctgtaatcccggctacttggtggctgaggcaggagaatctcttgaactcaggaggcagaagttgcagtgtgccaagactgcgccacagcactccagcctgggcaacagagcgagacaccctctcaaaaaaaaaaaaaaaaaaaagctgtcttcagacccctttcaagccctgttgaattcagtagttggttttagtttcagatgatgggttaggtaatgtttgcatctcattggctctttaatgacagttttcttttcataataattggcctttacatagtagaagttaaagaaacttggttattgaaaggggaaaagaaatgcatgcagagtaagaatactaaaattaatctttgcttttaatagtacaaacgtgtttgcaaacaattaagtttatcctgccaaaagaaatagcagttcagatgcttgtcaagtggtacaatgtccacagtgctccaggaggacccagttatcactcagagtggaatttatttgtgacttgtctcatgaacgtgatgggttttaacacagaccgcttagcatggactagaaatgtaagtaaatacaattgttttctttatgagttattctgttaatgtaatggttgcataattggtaatataacattgagactatataataggcgtaccatattcaaaataatagaataatattaaggtttattgtatctatatgttgtaaatcaaatctcacttaatatttaatgttaacattttactagtgattataattactgagctttagaatgttaaagcatatatgactatttctcatttcacctttgtaaaatgactgcaagttatgctaggattagtgatagtcttggttttattgatgaagaaactggatcacaaagaaatcacagatctgtgattttttaaaaactatgactagactgcatcttctgactccttgtttaacattgttttctgaagataagattgtctttttacacacatattgcttaggatgtgaagaggaaggtttgatttgagggagatttaaagtactttagccgagtactataccatctactctgtacttataccatctactctgttaatggtataaggccttacctctcaccctcttcccccagtaacatccttacaggcccttattagattatttacaaaatcagcagagtggtgtcttcagtattggtgatctccttctagctttggagatcactcccaggacaactttgcctgggtcactctgaaaaaaaatcactctagactataattaccccttttccaggtagctcagctgtaccattctatatgttttagccttgcacaccaaatcttttttttttttttttttttttttgagacagaatgttgctctgtcacctaggctggagtgcaatggcgcaatctcagctcactacaggctctgcctcctgggttcatgccattttcctgcctcagcctcccgagtagccgggactacaggcgcccgccaccacgcccggctaattttttgtgtttttagtagagatggggtttcaccatgttagccaggatggtctcgatctcctgacctcgtgatctgcccgtctcagcctcccaaagtgctgggattacaggtgtgagccaccgtgcctggccagcaaatccatttttaaaacttgttttttgtcttaattatgaaaggaaaatgtggaaaatggaggaattaagaaaataattatactactcagagataaccactctaaatatttttgatgttaccttctatataaaaataccaatgaaaatttcccgttatcattaaaaattttttctaaaatatctccatcatttcttcatagtgtagttttatcataattaaccaatagctaataattgtaccttgtgaatctgttgttttcgttattggaatttataaacatcctttttcacgactctttaaccacatctctagttacttcccaagaattgaatcttaaaagagaaactgtgaggtcaagtaatgtttggaaaggggttcccaggtgacattcttactagcatcatttaaaagcgcccatttcaccacagtgtttatttgtggtgtggtgaacctttgccagcttcctgagaaattttatcttatttctctataagtaaatgggaatggttttttcaaaatttcatcagttatttatagttcttattttttgattcgtatttcatgtcctttgtctatgttccagtctcttctcagaccagtggccaaagtaatcctgtttgataacgtcaggtagcgttcgtcacgcctctgcgtagaatcccccagtgacttcccatgtcactcagagtaaaggccataggcttataaggtgccatgtgacctagcccttgctcaccttcctggtcttatttcttaatgctttgcacacatcatcccggccacattggcctcagctctgttccctgagcactgccagcatgtttctgcctctgagtgtttgcacttgccattacctctatggagaatgctttccctccgacaagacgtgcttaggtctttattcagatgtcacctcagtgctgcctgtcctgtctctctctatagaattacacctgcctccatacctttagtgccatttacctgtttttctttcttctcacttaattaaatataatatactgtatgttttacttattttgttttgtgtccctcctcccccaactggaatgtaaattctaggaaggcaaagatttttgcttagttttgtttactactctctctctccaggacctgtggtattgcctggcatagaaggatactcagtgaacatttgttgagtgaatgccattttccatctgagtgagatactgtttttaagagtttgtgtctatttcagcacatgaaggaattgctgtctgcaatttccttgagaaaaatcttatgggaaaatagggacaattttcttttcttttctttccttttttaagacggggttttgctctgtcgtctaggctggaatgcagtggcgttatcctggctcattacaacctctgcctcctaagttgaagcgattcttgtgcctcagcctcctgagtagctgggattacaggcatgcacctccacgcctggctaatttctgtatttttagtagagacggggttttgccatgtgggctatgctggtttcaaactcctgagctcaagtgatcctcccaccttggcctcccaaagtgctaggattacaggtgtgaaccatggctcctggccttcttttctaattttaaacaattgtatccaagtgacattatcctcaatttttctgttctttattacatgtgaaaagattaagcctcatagaaactggatttctacattatgaaaaagcatgtcagctttctgtagttttgtgtatcattgtccttggaacttgttgatgagtacagattgttgtgtcctagtctctggcagagaacctatgccccctcgcgtttccatgttttggggaggactgagcacctacccattttttcctttgcaaagaaggacatggctctttgacttacttattgcatgataattataaaggaaggaataaggaaatcaattcttgaggccaagttgctttgccatttatttataggactgcgtggttaaacccttgctatcttttgtcctcatagtcaaagcttaggatgaaatggtcctcattggcaaatggttttcattttgctttgttcagatttattctttttgttttcacatatataatgtggtggagtacagaatttctgccaatgactcgttacacaatttttggcatttctttgtgctttctttaatttgctgatgtgttacatgagtgcactggactgtacattgtaggaacagttgcatttggggttaactttttgtggcttttgggctgctctttttttcattagataaatattgaatccctgctgtgggccaggcatgatgccaggtttctcacatataccccagacaaaacagattgttcctctggaattgactgtcttgagggaaacaaataaataatatttgatacatgtgttatgatagatgaagggtaagggtccataggagcatataacagggttggctaacctgagacacattgaaagagtgaagattaaacagatccatgtatggcacaaagagccatccttatcaggcagtttctactttctcataactccaggccttatgaatctgataattatagcagggacattctttttgactgtgggactttgtgtgtgttacattttggttgaagttttaggttagatagttactgttatatttgttgctttgatttcactgttactaccaggttttttataatatatatgagttgggctgttttttatttgaatgcttcacaagcaaatcttctctctcaataacattcggttttaaaaatcactttattgctacctatgtttagtttttatatagaaatcaactctgtttaggtgagtgagttgataaatatgtaagtttttcagcataggaaaatagccattgccatttatagagttacagtttattagttgatggtcaatgtccatgtgaagtagctggggcagcaaagattatgccaggggaaattgaagaagagcaacttgcagaaaactgctttgatgtagttgtactagttaaaagataggctcactattgtaatagaaaggcctcaaaagatacaatggctcaaacacaataaaaatgtctgtcttgtttacataacagggcttagcagataaacaggccacacagttattcaggaacccaggttgatggaggatcttttgtcttcggttcaaagcttgccgttggttgactgcattccagtcaggtggaaggggcaaagagcctggaggagcaggggtaggactggactggtcctggaagtgatgacagtgacttccatttataattaactctgtcaaagggtcacacctaacttcaaaggaggcagacgtatgtatgtagtctggctgtgggttcagtagaaagaggagaaaaaagattttccagagtagctacttgtctctgccatagaattgttagatagtttactgtaggtggactgtaaataaatgtttgcttagttctaacatttgactgatattgggttgatcctttgagacttggtatattgtggatatgcctaaagtttctttttctaccaaagatgtgatgtaatctatgtcgttacagaagtaggagagggaaggaaactaccattaaaatcagtccttaggagcccaggcactgttctagatgtttgcatatattaatatgatttcatttcatctttacagtaacctggaagaaagatatttaaataatgactttccagatcaaaaaatgagttttgatggcttttctcagttttcataattggcagaactgatttccgaatcctttaagttgatcagttgacaggaatgcatttatgatttttatcttttcttttggggttacttttcagtttgactttgaaggatcactttcccctgtcattgcacccaaaaaagcaaggccttctgagactggatctgatgatgtaagcattattatttcttgctaatataaattaatttatggatattcatactattcttccacttctgtggtattcctatcaattcctctatctttccaacacctttcactttatttattttaatactgaatagcaattattttgaagagtaggatctgttacattttctatggtctttaatgattatccaaaaattaatgtatgtattactgcatgatttcagtttgggtttgtagacattttattatcaactgatcacctgaaatgacagcatttaccttttttatgcagtgttttttaaattaaggttctcaatcgtatcaggttccatggtatattccttttttttttttttttttttttgagacggagtatcgttcttgttgcccgggatggagtgcagtggcacgatctgagctcactgcaatctccgcctcccaggttcaagcagttctcctgtctcagcctcctgaatagctgggattacaggcgcccgccaccatgcccggctaatttttgtagttttggtagagacagggtttcaccatgttggccaggctggtctccaactcatgacctcaagtgaccttcctgaccttggtgtcccaaagtgctgggattacaggcatgagccactgcacctggcctccatggtgttattcttaagtggtccaaatatgtttttttaaattgtggtgtaatttacaaaaatgaaatacatcttgagtttacagtttgatcagttttaatatatgcacactcatgtaacctacactcctatatagacacagaatatttttataactccataaaatttccttgtgcggttttttttttttgagacggagtctcgccttatcgcctaggctggagtgcagtggcacgatgttggctcaccacctcctgggttgaagctattctcctgcctcaacctcctgaatagctgggattataggcatgcgccaccacgcctggccaatttttgtatttttagtagagatagggtttcaccatgttggtcaggctggtcttgaactcctgacctcgtgatctgcccacctcggcctcccaaagttctgggattacaggcatgagccactgggcctggcccctcttgctgtttttaatcagctttattctcttcttctagcaatcactgatctgaattctgtcaccatatcttagttatgcctgttctagaacttgatgtaaataaaataatatagtatgtaatctttggtataagatttattcagcataatgcttttgagattcattcatattgttacagatacccgtagtttgtgcttttttattgctgagtagtatgaatataccatagtttgtttatccatccttcttctgctggtagatatctaggctatttccattttttttttttaagtcatgaataaagcaagctactgccaaaattcactggcaagtctttgtggatatatattttctttttttgggggagggggacagagtcttgctgtgtcatccaggctggagtgcagtggcacgatctcggctcactgcaacctctgactcccaagttcaggcagttctcatgcctcagcctccccagtagctagaattacaggtatgcgccaccatgcctggctaatttttgtatttttagtagagactggattttgccatgttggccagcctggtctcaaactcctggcctcaataatccgcccatgttgacctcccaaagtgctgagattacaggtgtgagccaccatgcccggcccgtggacatacattttcatttcttttttaagagacggggtgtcactttttgcctacgccggactgcagtgatgctatcgtagttggctgtaatctcgaactcataggctcaagccatcctcctacctcagcctccaagtggctaggactaccggtatgctccatcatgcctggctaatttttaaatttttttggcagagacaaggtcttactataatatgttgcccaggctggtctcaaactcctgggctcaagcagtcctcctgcccctatctcccaaagtgctgcgattacaggcatgaattttaatttcttttaatttaatttaatttcttttaaattaaaattcacatctgtaattttaatttcttttaatttaatttcttttaaatgaaaattcacgcctgtaatcacagcactttgaggggtaggggcaggaggactgcttcagcccaggagaccagcctgggcaacatattatatagtaagaccagttgtctaccaaaaaaatttgaaaattagccaggcatgatggcgcataacctgtagtcctagctacttggaggctgaggttggaggatgttaaacactctttcatgtgctcattagctgcttatgtatctttttgtgaagtttctgttcaaatctttatcaacttgtaaattagattttaaaaaatttgtaagctggtgaagttcttacatgttctagacatgagttcttgaccatattttcccttagaatgtggctttaacagtgtctttgatgagcagaattttttattttagttatccaatgtatcagttttttattttattttattttatttttgagatggagtcttgctctgttgcccaggctgtagtgcagtggcatgatctcagctcactgcaagctccacctcccaggttcacaccattctcctgcctcagcctcccgagtagctgggattacaggcacccgccaccacacctggctaattttttgtatttttagtagagaccacgtttcaccatgttggacaggctggtcttgaactcctaacctcaagtgatccaccagccttggcctcccaaagttttgggattacaggcatgagccactgtgcccagccaaggatattctttttataacattttcaaaaattaaggcatattgtatatacaggaaaaaaaatgaagcctatgatttatatttacaattgctttgatttaatacaaattaaaatattactgtttatgagaatgagattctaaatgtaaatggaattcacagaatgcataatttttttctcgtttaaagaaatagagtctcgctgtatgcctaggctggtctcgaactcctgggctccagccatcctcccatttcagcctcccagagtgttgggattacaggcgtgagccaccacgcctggccttgtacatgttatatagtgaccattttgcacaagattgtttgccaaatgaataattaaaaaaatccatttagtgtactttcctttaaatattttcacacctggagttaaaacattgtattttataaaatgttattaatataaaaatacttgtaaataaacttgtggctatgtagaatgtagtagaggacttttgcataagcccagagcctagtttctaaaggtctttagaaatatataatagacatagaggggaaagagttgggggaaatcagagggaggtataattctggtctctcgtcgttcagttctttttcattcagttctctcaggcacgactccagccacttagttttatatttcaactggatgttgacccaattaaaacaattcacagctcctgaagatgaaatactatgagtccctgctttggacacatctgtagtagagtaggaaaagataaatataacccaagtaattgttacagaatcttctgaaatatacaaatggtaaaaggttttgtagggcgtgtactggggaaaaagataatttttcaacatgaaccttttaagagcttgtgagtctcaaagagtctttaattgataggtgatatggataatactcccctttgggaggaggtttataatacataaacaacctccccacccttccctcacagctttctgtcctgtactacaagaacaacaaaactccaactagtcagaattgcaagtggtttatggccccccatatagattgaaaacttgctaagagactgcactggagaacctgaaaggatgaggatggaaaagatgattatacttttcatttgcaacagggctttcatttgattctcacattaatcccatgtggtagttaattaaggtagtattacaaggttcagtgaattgtctgagatctcacaaatacaacctagataagaacccaggtattattattttcagtcttgcaatattattttcctacttgcaatattatcttcactcttcattaagtttgcacagcaaagtaatggaataagttctgggctttaatccttgagtagtttggaactgtaatgtgttacatttgagagagagcccttcattttgaataaaaccttggtactgttcctgatcttctaacttgggttaatgctcttcccattttcatgatttttttcatttgtgaaatgaagtagttgcactagatcattttcaattttccttcccacttaaatcagttttaattaaaaaaattgcagatgccttttctcagattggagtacactttttgctccacacaatatctggtgtgtaaattggtatgttccgtggagtaaatacctttcctgactagccattaacttacttctgattcctgaatccactaatttaactattgttgaaattactaaaggaaatttttctttagcaaatgtaaaaactcatatcaggtctcaggtttgatgttgtaaagcactctgactcttaggaagactctttttttcccccaacctctcataaacaaattatttcattcattataaaatttcattcattacattttcattcttcagacttgcagtgtttcctctctgctaagtatagtgttaaacactggcaaaagaactctggacacaacatcatgaacttgctctctgggatcttataatctagttgcagaagcagattggtaaatacatagtatagcacaagtactataatggaggcctgaactgagtgctgtgggggtacacagatgaaggcttctgggagacatcatggcataactagacctggaggatgaataaaactttggccaagtaaatacagagatacatgaaaagcatggataaatggcacaagtaggttcagggatgataaaagtgttagtatgtggagagtgtacaactattttggggaatggggaaacagattaaatttggggccagaccccgaaggatgtggggatcccatcaaagtcttttaagcaggagaatgatcagatgcattttttggtatactacctgggggataggaggaagtggactacagaaggggagatcagtagaaggaagacaagttaggaagcttttcagtcattttcattaaacatgaagcttaatacatattgttctaagatcaggaatacagcaataaagaaaaaaacttgctgtaatgaaacttacattttcttgggagagacagaaaataaacatgaaaaacagatgtgttcaatggtgataaagcagaaagggagatggggagtcaagtgcatgtggggagggtgtttagggaagcacttatgaaagagtaacatttgagcaaagagccctgatacaagacaacaatccagacccaagacatttgaggaaagagcatccatataaagggagtgggaggtagagaaaacctggaccaggaatgagcctggtatgattgaggaaaacacaagggatgtggccagagaataataagagaataaattagaggggtaataggcaattgtatagggccttgtgagccattgtgtggaccttggatttcactcttgagtgacctgggagctaatgggggattaaacagaggagggacaggatcctctatggtatatggtaaatgagtagtatggtaaatgaggtaaatgaatagtaaaaggaactgctgtggtaatttaggtaacagatgatgatggtttaggtgaaagtggttggattgtggatatggtttgattggtgttagaaccaataggatttagtggtggctggatgtggacaatgggagaatagaatgaaccaaagctattgtaaacgtctagaaatcagatgaggacttgacgaaaggcattggcaatgagaaagtagacaggcaccattcatgaggtatttcttagcattgatagagttggatataaatatctggaattcttagctgattgaaatgttagttgaaatgaatgataccactcaaggtatgtgtgtcaagaggtatggagaagagcacagaagtttttggaaaccaagggaggagaaaagaagggatagtcacagagcagtaaagaaaaataaaggttaaaaataggtcacaggatgtacattatcctaagttaaaatattttaaggtttgaatgaaagggtgctgcagggtttgcaaactggtgggcttcaggcctaaaatctgcctatactgttgtttttgcctgacagaatatcttaaaatatctgtatttgaaagcatttaaggcttgacttgtgctctacgctccacagtcttatcgttcatagtttcttggcaaactcaccactcaagctgtgcctcacttatttaggagatctgcctcactagggtagacattttaggtttatgactcttaagttttcacctggacagattggctaacaaaaagaacctcacaggtgggtgaccttgaattcaccaggtcatgccatcagttcagagcggccggagaactctgttctcttgtgcattgatgcccccggagttgtgaaacacagtggccctgcttcagttttttagatttagaaactggtcagtgtcagagcgatcagacacagaaatgttaattcatgttcaaaaataataaccaggctagcatttgtttagcacttgctatgtgacaagtactgttttaagtgctttacatgaattgtttaatcctcacaacaaccctgggaaataggtcctattattaggcgccctttctacagatgaggaaacagacaacagattggtaaatttcccaagatcacaaagtaagtcagtaggagctcaaagtaacctgactccagagcccacactctttttttttttttttttttttttttttagctggttcacgtctctttaatgagatcaaaggctcctgtgtatgtcttgcgggggtaaagctagcacagtcccccaatactgcccctctcctcagggctccagccctttcaggcagattctaggtaggcagggaggggccaaaaggaacgcaaggagttgggactagggctgtttctggtgggcaagtaacccatccaccctctcaaaactacttatgggatgtccccttcactggaagacagccccatgggaaagacctgcggtacagaatctgggggcagtgcacacggggagtagtcctccagatctggcagggtggcactaaccctcacctccttgactggctcagcctcaccggaggcaggacaagggcagagcttaataccggagtcgccagttaaacggcgatagcggcaggaggggggtgtgggggcaggggtcacccctgccccagactcaccctcctgatgagggagggcactctggtgggaggaaacaccttccacatttgttccttcaaaatgggcagggcagctggatgaggaggaacagcaggtttgttcactggaagcagtcaaggggcggcctggggcgacagtataaggcgcggaggcggggggcggggggtggtgcctgggcggtgaaccacatcctcgtaggctgggggcttgaaggtgctgaggaggcgaaggtcaagcagtgaaccggtagggaaaggaccagccccatggcatgccccatgataagccaacaagttgatttcacgctgccgctgctgttgttgcagcctgagtttagctcgtcggtggcggaaggcccaacagcagctaaagaggatgaggacagtccagagcagccagaaccaccagagctcatagtagtaggtgcagcagccagtctccccgcagcagtgaacactctcacagaggtagggctggttgttcactcctgggcacagctctcgaagctgctgttgcggcgcccgaagtgccccccaggcctcctcgctgccgttcccgctgctggcccgagccatacctccacctacagccccctgaggaccacagcctcctctaccgccagccgccccgcccctgccacctctgctgccactgccatggtccctgcccggcccatcttcgctgaggccaccatcactccgcggccggagcttccatccccagagcccacattcttatctgagcatatacatccccatcacaagagaacgccagtttattcaagtaaaataaggactagaaatttacatcagggaatgtattctttcactgtagaatgctgaatggaaaaccaaatttcaatagttgcctactgaacaagatcatgagataacaacaagggagttgattataaatgactagaagttttaaatggcatcgactctgataaagtgataatctcagctccatgatatactcgtcaagcagttacttacatcaatctgccttataggatatcctttctcctggttaatgcttatgtgatagtgttttgtacctttcctttttcactgctttcattactgaccaaactactcacccccatatttctggtagatatatttcttttcattgcatgttagtatcttaaatttagtcctatcttttacttgatcctccgtgcttgacttcctaatctatgttctggtttatgttttagttttacagttgagctttctgaggacattcttattcccagtatctttttttgggtggttgggttctgggaggtggtatttgactgctgctgatgtgtaccaaccaagacagtagtcattaagtgactaacaataatgatttcagcagattattactcttggcaaagagcaagctttctctattataaatgattttatatttgttttgtttttctttatttgtaatttgagttctagcttaacattattacttcagataactgttaatacattttcataaatcatacattcttgaatggcaaataaataaataatcaagttccaagtagtttctaaagagagtaaacattaaaagtaaacataaaactacataaaaatcgatcacagtctattcataaagttggtatgaaaataaagatcctagatttggaaccctcatgatactcaatattttacatatatcagagtttgtaatttccataacttcatttggtagttagacatatagacagagaagataataatatattcattatatatatatttatgtattatattcattatatatatatttatatataatattcatattatatatatatgtctataacatatagacagagaagataataatatattcattttatagtttaggaaacagacttggaagggcaaataacttgtctaagatgactaagcagctgagtgagaaccacagcctatctgtggcattcagtttcagccatctttcccttgcttcataaggatagttactctggtatcagttgctggattgggattttgggcatttataaatgtttttattttggatattactgaatcacagacaatttcatcttagttaattaaaaattcatcttacgtgacacttgtctaaatcttaaaatattaaaattttaatgtataaggatgttaataatctttatattttaagagactatgaagtcaagtctagctaacttagatctgtaagtttttagctatggaaagcaattctattgtgtacaagtttcagcctgtgaagggaattcattgaaaatgtatagagatcagaagaactaacacctttcttgcatggatttttcttgattattggcagttaacaataaaatgttattagatcactggtgcttctgtgtggggttgagttttttatgatatcttctgttagacccataagggaggctgtgagttgttttctacatccttggaatatataagatcctcttttaaaattatattttatataagcacatgaaaatggaatgaaataatgaattgacataggaattacctacatattttggctgtacatttagtgcacaaaatatcccttttttgaatgccaaatggccaagtgtgaaaaccaatatttgttaaagctggagcagaagtcggtatcatcatcatagagtaaacttctggcatatgtgaagatatgaaatgttatccctgaagttattataatttattctcagaaatattagtaatcttattttaagagtaggacattatagtgcagtaatgataattttctcagtgctgcctgttgctagattgttcctatgattgctgtcatgcacatacagacactaaattgagggtcactttccactgaagttagtggaatacaaaataggtggaggaactttcttcctctaacgtctttatatgtgtctgtgtttatatatacgtgtatgtatataaatatgtatacacatatataatatctggagcaaaaatgattatgttgtaagaacttttggaggttttcctcctcgtaaaattccgaagtggtagagttaacattctgcttttaatttatctacaaaaacatgtgaagaatccccaaataagattttctcatagaagattcatggattttgagtctcagaaaaaaaaggaagaaaaaaacttcatggtataaaacaactaaaaattaaatatagtctttagaaatgattttgtttagtataaataatactggtatgacaactgaatgcaattgaaattatgatataaaatttctattctgctttgtatttttcattaaagtttttataattgtcatctgaaaaaggatttaatattcttaaattcattagctaactctctcaatattattacactattatttgcctatttgaaaattgttactttctttcgtacataaatagcattcataatcattgtgacattttcttcttgcattaatgtacatttatacttcatctaattgagaaaattttaacatacaaagtgacacaaaaagattttcattccaagttttatgtaaaacacctaaaattggaaaatgaatattcagatactaagagtaaattttttttttttttttgagacggcatctaactctgtcacccaggctggagtgcagcggtgggatcttggctcactgtaacctctgcctcccgggttcaaattattcccctgcctcagcctcctgagtagctgggactacaggcccacaatgccatgcccggctaatttttgtattttttggtagagacggggtctcaccatgttggccaggctggtctcaaactcccaatctcaagggatctgctggcctcagtctcccaaagtgctggaattacaggcgtgagccactgcacctatatgacatacttgaaaaaatattcttgggccgggtgtggtggctcacgcctgtaatctcagcactgtggaaggtcgagggtggatcacctgaggtcagtagttcaagaccagcctggctaacatggtgaaaccccatctctactaaaaatacaaaaattagctgggtgtggtcgcatgcgcctgtaatcccagctacttggcaggctgaggcaggagaactgcttgaatccaggaggcgaaggctgcagtgagcagattgcaccactgcactccagcctgggagacagagcgagtctctgtctcaaaaaaaaaaaaaaaattctcactttctgttgttgttgtttgtttaatgattaatagacgatttatttaagcaagaatacatagtcatcattgccagacttaatatgacaggttaaatgttggacccaattttccttcccagataagtttttctttcctatccctgtcagttttgaaaacataataccagaagaagaggggcccaattccacacagagctcccaagagtgagtttttaggagtgggtctgaaattaggaaagacacttgctgatcttgcataggtccaaggaatcaaggcaggattttcgatgagccctcggcagttagggtaagcaggtttcagccaggctcttaatggtcaaccacttggcttgcgcctgctgggtttccgaagacatgtcctattcggctggtttgagggcatagtggccaggggtgaaggagtatactttgggaacgacatcttggcgacccagtgcacaactcacttttttttggaaacgaggttggctctgtcgtccagactggagtgcagtggcgcaatctcggcgcactgcaacctccgcctcccgagttcgggcgattgtcctgcctcagcctcccaagtagctgggactacgggcgcacaccaccacgcccggctaaattttgcatttttggtagagacggggttttgccatgttgcccaggctagttttgagctcctgggctcaagcgatctgcccgctttggccttccaaagtgctgggcttacaggcatgacactctgcctggccagatttttgttaccctgtttagatatgatggtaactgaatgatcatgcaatctctgaccatgtgacattcagggataccaaaaatgacttgagatgggccaaggcagaattggagaagcatactttggctgaatacttaggccaaagtataatttggaacatttcttttaaaaaatctactcccctatgcctcccagttgcagtaccttacaattacagttaatctagtagcagatacttgattgggatattaggtatttacagaccaaatgcccattgggatattactcggtaacaggcagtttcactctggttcattgtagattcatccagtaagcatttctagagaactgctatatgaaaatattgtggaaagtatcaactttttaaacttttgatgtcatgacacctagaagattattttctgatactcatattctaagggaattttattttctgagatttgtttctgtggaatttttagttccccagtctgcactgaaagcctaaatcaagaggataatttgaaaggtaatgaaagtaaatcaattctagcttagatacccaagagagtaaatgaaatataaaaataataacttttaaaatgtctcaaaaaaaagctatggtaagctaattctgtttggtttattcatgcaatagtctgtctctgcttatgacataaagtataatatattttaggaatagtgtggttttcttcatgatgtcaaacatacaagcttatggatatatttaaaaattcttaattttctagattaatgttcagcactacttcttccatcttgcattggatgggggcagataattaataattatcagatattttcttatcaaaaacaaatttgttggaaaaaaaattttttttttttgagatggagtctcgttctatcacccaggctggaggtgcagtggcgcaatctcggctcactgcaagctccacctcccgggttcacgctgttgtcctgcctcagcctcccacgtagctaggactacaggcgcatgccaccatgcccagctaatttttttgtatttttagtagagacggggtttcactgtgttagccaggatgctctagatctcctgacctcatgatctgcctgccttggcctcccaaagtgcggggattacaggcatgagccaccgcaccaggcctcaataaaatattttataaatacctttaaggaataatacaaacacaaccagagcttaaataaataaatgtaaatcaatctgcttgctggttaagtaatgagttcagtgtttccgcacagaaagtgggagagatagatgaagaagaaaataaagcttattacatgttgggaaggattctaggcactaagttcctttttttgagacagagtctcattctgtcgcccaggccggactgcagtggctccatcttagctcactgcaacctttgcctcccaggttcaagagattctcctgcctcagcctcccaagtagttgggactacaggcacctgccaccatgcctggctaatttttgtatttttagtagagatacgggttcaccattttgaccaggttggtctcgaactcctgacctgaagcgatctgcccaccttggcctccgaagtgctgcgattacaggcgtgagccactgtgcttggccagttctaggcattaagttataattggttcatttggggactcgaaattctccattttattttattttattttattttttctgcttttgtcacaaaagcacagacattgcttaacaaagaggtctgagacaggatatgaatgttaagctcagggacatagggtcaacacttttgagtgcacagactgggaacctggcagagttttaacaatcccctcccctattttcaccatcccttagtcctgtagaagtagagcagatgattacgtattcactgctgtatggcttattacctttgtaggaattctaactgaagggcttggcatttggcctgactgaatatcagaatccctttatttttcgttccattgcaaaataattttttgtgccatcagtgaaataacagctatgcagtggcatatacagctctggagaccaggcattagaagactgagacaagaataaccagaatgatgataaggagacactggaagtcactttagattgatgaccaaagatttccttattctgaccaggaggtcagatctcaagggtccttctgagtccacttttgattagccaaattgtcttttctttcagtttgactataggttagtcaaccttccctccacattcatcagggactgttagcaatatgtcatatttttttcttggtgtaccattaagcaatctaaagctatgctgttacctgtaaccacttggattaattattttagattagttggttatacttctagggctttatggctttatcttttcagtcagcattattaaccaagttttgatagctttttcaacttttgtaacccccatccagggagatcagtgtcctctcagacacttccaggtaagcatgatctcctggaagacatgagaagtctcttaaattgtctaattattacattggagctacataataactccaatatacctggagttattatgtgtatatgcaagttaggttctaatgaggcaaatataagtaaatatgttgttgattcaggaggtaaaaattaggagagccacgtgtagttttaaaaacaaaagaggaattacttgtaacagaagtaagtaagaaaggaattctcagttatctcttgggtagagataccttgcatagagttcagcaaaaattgcaaaggttgtcataggactatggaggccattaggctaattaaaatttataatattgcccatatatttgtactaagtctcattcctgaaggattttatatttgggttgaggctttgagaaattctaagactggcttgggcagtaaaacaaaccaagtaaaaattgccatggctgtaaatagtcaaaaaggggtaagctaagtttctgcaaactaaacaatttcagagggtgtaagaatgtattggataaaggatgaagataaaaagcactttggagactattgatactcatcagattttaccactgataatttttcaagaggaactgtttatgaaactataaagagaaaatggagatacaaaaagccatccaagatgtaaatgccgaaggccaagttttgagataaacagaaaatcacaaaaactcatgtcaggtggttcttccatggccccagtgtgagcagacagtattttccttgaggagaaatactagtttggtgggggtaaggtagggagttaaactttaaggattaatcaagagaactatacatatgctatttaggttgagggtaaagatcagagtaggcatgggcaacgcctagactcaatcaagttacctatcaagcaagctgacatattcagacaaagcaagactccatctcaaaaaaaaaaaaaaataaataaataaaaagaattccttcattattttgtcatgctttaaggcccaggacaggcctaggcaaaagttttgatggccttttgttacatcccagcctttgtataagggcactggcttttagtatttaacttcattcagtcattactgaaacagttgttatggaagtctgcattagtgagacctggcctgccacaggaggttgcagtgagctgagatcgtgccactgtactccagcctgggcggcagtgtgagactctctcaaaaaagaaaaatgatgcagaaagatttgtttgacacagagtgggcataaactttcaatttgtcaaaaacatagtatctgtgaagtacaataaaatgtagtgcaataaaatgaggtatgcttggatagcaaaacatcatgttgtacctagtaaaggtatacaatttttatttgtgaattatacctcagtaaagctggacaaatgaactgtatttgcaacatggtaggaatatatgacattggacattaatgcaaatggaattttcagtgccatggtgaaaatgttataccactgaacaaaaaaaaagtagtgtgaaatgaagtaaaatgtgaaaatccgtaataaatgcagaaatatgaactgcttatccaaaagagaaaagtcttttgagttcctcaagaagattctctctttggatgctgggcacggtggatgccgggcacctgtatccgagcactttgggaggctgaggaagatggatcactggaggccaggagttcaagaccagcctgtccaacatggtgaaaccccgtctctactaaaaatacaacaattagccgggtgtgatggcacgtacctgtaatcccagctactcgggaggctgaggcacaagaattgcttgaacctgggaggcagaggttgcaatgagccgagattgcgccactggagtccagcctggaccacagagtgaaactccgtctcaaaaaaaaaaaaaaagaaagaaagaaagaaaagaaggttctctctttgggcactccttttcaacatattcagcataaatgaattaatgataccatttttactaggtgagtgtgtttgggcaagttgcttcagtgctcattctcttggtttccttttttttttttttttttttttgagacagggtctttctctgtcacctaagctggagtgcagtggagtgaacatagctcactgcagcctccaacacctagcctcaagagatcctcctgcttcagtctcccaaatagctgggactactggcatgtaccaccatgcctggctagtttttaatttctctttttttgtaagcacagggtgttgctatgttgcccaggatggtcttgaactactgggctcaagtgatcctcccacctcagcctcccaaagttttggattacaggcatgagccatggtacctggctgtcttttgctttccttatctgtaaaaactgaggataataacagtacccttacaaagttggtggaagaatgatattagttaatacaaatgaagtgctaacaaaaagagctttggaacacagcaagtacttgttaggtatggctattgtcatcaacacacttttcaaggcaaacttgtggtttcacctatcacctgagatatatgacttctaagttcatcagatcttctcttttggtttttatttttaaattaattaaatattattattcttattatttgagacagagtctgctctgtcacccaggctggagtgcactggcacgatcccagctcactgcaacctccacctcccacgttcaagcaattctggtgcctcagccatccaaagaagctgggattacaggcgtgcaccaccatacccagttaatttttgcatttttagtagagatagggtttcaccatgttggccaggctggtcttgaactcctggcctcaagcaatccacccatctgggcctcccagtgtgctgggattacaggcgtgagccatcgtgcctggccctcttttcattttagagataggaatctcattctcttccagaggctggagtgcaaaggcatgaacataactcattgcagtctccaactcctgggctaaagggatgttcccccctctgcctttggagtagctgggcctcagaactgtgccacaactactggcttccatcaagatctctgtcctaccatttcatcttcctactaggctatccccacatggatagataaatggtacctcaagtgaaagaaatcaactacctaaaataggattttccactccaaactagattttctttacatgtcatttctgttaatgtgggccacacacactggtaagctcagaatcatctttttcttttcttttattcacatccaatatggttgaaataaaacaaaatgctgtttttccttttttagaaaggcaatacttgttcattatatcaaaatttagaaaatatggaaaaacaaaaaggataaaaaattatccacaaccaaaatagcccaaatttccagttaaaaatatcaacgcatttgatatttgtccacataattaagactgtaatgtttacacaaatgtgagcttttaaaatctaaaaggctctcactattaaaaatgttttgttaaattttgttttaaaagtaagattttaatatccaaattcccaaaatagacatttttgaagatttggaaaatacagacggctgaaaatctttacattattactgttaaattttggtatgttctgttattctgctagtgaaatatatatagatttggggggctattccttttccttttttttttttttgagacaagtgtctcactctggtgcccaggatggaatgcagtggcgctatcacagttcattgtaacctggaactcttgggatcctcccgcctcgacctcccaaagtgctggggctaccggcttgagccactgtgccaggcgaatggctgttcctatatacacagttgacccttgaataacatgggtttgaactgcctgggtccacttataagctgacagaaaatacagtattggaggggcctgcatatagagaggtctgacttttcctctaagtgttccacccgcaggactgactgcgggatttgagaatgcgctttgttttttttttttaggaagtcttactctcgcccaggcttgagtgcagtggcgcgatctcagctcactgcaaccctcgcctctcagtttcaagcgattctcgtgcctcagcctcccgagtagctgggattacaggggcccacctccacgcccgggtaattttttgtatttttagtagagatgggttttcgccatgttggccaggctggtctccaactcatgacctcaggtgatccgcccgcctcggcctcccaaagtgttgggattacaggcgtgagccacggcgcccggcgggcaagacaccctcagagcacagggtgctgccaagagcccggccgagtgcagctcgagcgccgacgtcgccaaggatacacagtgctgacgcagtacacaagtgcgtcacagtggtcctccgccggctacgtcagtggctttcaggcgctttcctgttggaattggcgactgctgcggggctgagcgctggtttcacgcgtctcgggagccaggttggcggtgcgatgaggcgcagcaaggcctacggggagcggtacgtcgcctcggtgcagggctccgccccgtcgcctggaaaggtgagtggatctcgaagagaccgacggcctcgacctggccgggcggcggcctcgacctggccgggcggcggcctcgacctggccgggcggcggcctcgatggctcaggcgtcatggctcccgacgggcgctgctccctggcgcgctctgttgaggcgccggcctcgacctggccgggcggcggcggcggcctcgacctggccgggcggcggcggcggcctcgacctggccgggcggcggcggcggcctcgacgtggcccggcggcggcctcgatggctcaggcgtcatggctcccgacgggcgctgctccctggcgcgctctgttgaggcgccggcctcgacctggccgggcggcggcggcggcctcgacctggccgggcggcggtggcctcgacgtggcccggcggcggcctcgatggctcaggcgtcatggctcctgacgggcgctgctccctggcgcgctctgttgaggcgccggccggctggcgcagtcctgtgggcggcgtggcgcttgcaagcgcaggaagagtcctggggggaccgcggtgggcgggatacctttggcgccggatcttcctctttctcccggtttgttcccgacggtgctcgctcgtgggcccgccctggcccgggctttctggccccatagtacccgcgcggcctagttctcgggggcttgggcacccgggtgctgtatcggcgggtttcttcccatgtcctggacatttactttatatgctgcggcggaggtcgtacctccttggcctggaggaacccagtggggactgacgcagctccgggtgagctttggcggctgtgtcgagtgacaacgtaggcatctcagcacggacatttgcagtggcccgacggcgcaaatgacaggggaagtccccttgttttgagtatgaggtgtttgtcgctgtccctttataagggtccaactccactcatactcacctccctcgccccccccccaccccgcccagaacactttggtagctgcctttgcttaaaaaaaaaaaaattctaaagttcttacaaatcgttagtatggcttacaatttttaaccttttccacaaatgtttttagggtatttttcctctttacaggtaaataatgtgatctattttggattcaataagactttagtaattggatctaaagagtgacggaagaagctattaaaggtggatgtgcacagaatcttgagtcagtttgctttggcttgaataatcacagcactgtcgtttataagctgggtatttggggccagttacacttttcatccatagatggagttgtaacattaatagaatttgataggatgatccattttaaacatttagggtattgcttgacacatagcactaagtgttagctacaagtcactgtttttattgttgatgttaaaaggatattggcggggcgcagtggctcacgcctgtaatcccaccactttgggaggccgaggagggcggattgcctgaggtcaggagttggagaccaacctggctaacatgtcgagacctcgtctctactaaaaatagaaaaaaagttagccgggcgtggtggtgcacacctgtagtcccagctacccgggaggctgaggcaggagagtcgcttgaacccgggaggtggaggttccagtgagccgaggtcgcgctactgcactccagcctgggcgacagagggagactccaaaaaaaaacaaaaaaaaaccaaaaaacggaaactcaacggatgaccatgattataatagtagcataattgtgtctcttatcataactaagcatacgttatcttattttgcgcttccagcaaccctgtggatattgagacctgtagagatttaagatacttgttcagggtgaaataggtagtgcagcagaattttggcagtgggtctgatttagtttctcttgggaacagtggagtaagttacagtctattcctccagagaagaaggatagatatctacttgtacattgtaatttcaaactgctagcatagtataaatatgaatgtgatgatagagtctaaaacagaccttaattgagggttcctgtaactcctgaaattaaagactttaatttttgtgttatttttttttttttaggtggggtctcactctgtcacccagctggatgcagtggcgctatctcgactcactgcaacttccgcctccccagctcaagcgatcctcccacctcagtctcccgagtagttgggaccacaggtgtacccaccacacctgctgttttgttctgttttgtttttatttttggtagagactgggtttcaccatgttgcccaggctgttcttgaactcctgggctcaagtgatttccccgcctccacttcccaaagtgttgggattataggcgtgagccactgcactggccattattttatttttgagacaaggtctctttctgtctcccaggctggagtgctgtggcaggatcgtggctcactgcagcgttgacgtcctgggctcaatccatcctcccaccttagcctcctgggtagctgagactacaggcatgccagctacaggcatgcgccaccatgcccggcttttttctttaatgtagagacggggtcttaccatgttacccaggctggtctccaactcctgggctcaagtgatcctctcgccttggccacaagtgctgagattacaggtgtgagccactctgctcagcctgatttttttttttttaaacaagcttaaaaaaaaaaaaagcatgtttagagcctttctgagattcttagtggggatcttggcttccaaaagattaaaaaccactggtctagacagaagttagaatgttctttcaactacataacgtctccattaaataaagtggagtggtagcaacattttgaggattggttattatgaccacctctcttacacttagagtcttttttttttcccccaaatttaaagtcatttacattagaacctggggatttcagcggaatatggattaactagtgagtaactttggaacatgtgaagctattctgtaaagttaggtttgagtgaaatgacaaaacagggtgctttggatagaaggtaaggaatggagggagaagaggcagtggctgtgaagaatataaagaggttaatattctcccccagtttggcagagactggccatctgtgaactgcccatgctttctagaatgtctgagttttggagtgtgatgatgcgtctgtatatcatatctttctagtcttccattgtgctttcatttgttagtcttctcttgttttgccatttttgtactccctcacatgtgcttttgcccttcttaaaaatattcttcgtctgtaatccaagcactttgggaggcagagagaccagcctgaccaacatggtgaaaatccgtctctattaaaaatacaaaaatgagccgggcgtggtggcagcgcctgtagtcccacctactcggtaggctgagacaggagaattgcttgaaccctggaggcagaggttgtggtgagcagagattgcgccactgcactccagcctgtgtgacagagcgagactctgtctccaaaaaataaaaaaataaaaaaatatataattctttctctagtttttctttttccagatggcttctgtttagtttttctatgttctgtcaagttggtttcttattctgcagctgattcctacttctcaaactctacttgacagctcttatttttatttatttgttttttagaatagggtcttgctgtgttgtccaggctgccatcaaatttttgggcataaatgatcctcctacctctgttgcctgagtacttaggactacaggcaggcacctttgacagctgttagttgttttttctgccctttacatctatacttcatgcttctgagtaacacacacatatacttttgttattttgaattccctttctcccattttagacattttgttttcttttttttttttgagacagagtctcgctctatggcctaggctggagtgcagtgtcgcgatctcggctcactgcaaactctgcctccggggttcacgccattctcctgccccagcctgtagctgggactacgggcacccgccacaacacccggctaattttttagtatttttagtagagacggggtttcaccgtgttagccaggatagtctcgatctcctgacctcatgatccgcccgcctcagcctcccaaagtgccgggattacaggcgtgagccaccgcgcccggccccactttagacattctgtactggctattatgctcctccaaaactgtcctcagacactttgctttgcccctcattgtttcagtactgttattggagtttttgtttaaatgaatatttaacatttatataaatataaggtaaatattttgcatttgaattgcccttgttgtgcagttttgtttttcctggactgaataattgctttattttttggtttgcttgtatgttgtgttactacttggttacttaaactcagcaacttaaaccctcaaatgtggtcaaactggtcacataatccgatcaatttcagcttaaaacattgattgattgattgattgattgattgtctgtctacctggaatacccttactaaccgacttctccaacccagattggtttttcttcctctttgctacacagctgtgctcttgggacttccctttatcaccagtttgagaattcccttcatcttttttctgagttagaccctttgtttcttgtatctcatgtcatcttcatttactttctttgttttggtgtagcatagttcacttgctttgaggaaaagtggatgagaggtttttttgtttgtttttgttttgggacagagtcttgctctgttgcccaggctggagtgcagtggcatggtctcagctcaccacaacctccgcctcccgggttcaagtgattctcctgcctcagcctcccgagtagcgggattacgggtgtgcgccaccatgcccggctaattttttctatttttagtagagatggaatttcaccatactgttcaggctggtctggaaactaatggtatgtctttaaaacatctttacttaatttagttgatcatttggttatcgaattctgagtttgaaataatttttttcgcaattttgaaagcattgctccattttccagaagttctgttgttaggagtctgatgagagtcttgttcttggtaacaaaggttttctggaagtgtcctttcaattgggaaactcatttctttcagttctgtagcgtttcttgtattatttctttgaccatttcttaccctttttttaatgatgtttacctgaaagctggagtttctctaatttttctcttattctcctcttttgtttgttctgccttttgagagatttccttacccttatgttccaggggaagaagattggggaattcatgtttcagtatctagacttttcctcattgtcctgtataatcacggccttcacccttgttgggactccacagatttggagctgatcagatcggtttgttgagaacagcagcttttttggaggattttagggggagggagattcatttgactgtgcaagatgggcgacagagcgagactccgtttgaattaaaaaaaaagagagagaaatttagaactgcataatgaaaaagtaggccacaaatgttaagttttggacaattacaattacatctctatcttactgtgcaagatagcgatgatgtggcatctcttagggtcttactgttcctgttttcagccctgcatcagttcttgatatttggcagcttaagtgaattcaggtatttgcttatagtgacatctgctgtcatgtaaagaagtactgcttgaatcagatattgtcctgtttacataacgtgggctgtgctccttcctagctgtatatctttaaacaaggcatttgcctgcttgagcttcagttcccttgtaaagtgaggttagaggcaaaagatcatacagaagaataatttgtaaagttgtttaattatcttaagattgtctactttaataacatagttggaagcaaagaaggtaatggaattatttttctattatgttttggcattgtaccttgaatctatttcttcattttgaaaagggggaactggccgggctcggtggctgaggcctgtaatcccagcaccttcggaggcggaggaagtcagattacaaggtcgagagaacgacaccatctggccaacatggtgaaaccccatctctactaaaaatacaaaaattagctgggcatggtggcgtgcgcctgtagtcccagcttgtacccgggacgcagaggttgcagtgagctgagatcgagccaccgcactccagcctggcgacagagcaagactccatctcaaaaaaaaaaaggaagcggggaacaagccttgttcctttatgtgctgtcctgactgttgtgtattatttttgttaagattgctatagttcttttttttttgagatggagtcttgctctgtcgccagtgctgggattgcaggtgttagcctggcattgagcaacgttttgtaatttaagcatacaagtctctcacctccttgtttacatttattcccaggcatttttttcatttagatgcgattgtaaatggaattgctttcttaatttccttttctgattgttcgttgctggtacagtagtcccttcttatccacagtattgccttacgtggttttacttacctgcgtcacccgtggtccaaaaatattgaatggaagattatataaataaacatttcatgagttttaaattgcaaacagttctgaataacatgataaaaatctcacagcctcctgctccgtcctacccaggacacgaatcatccctttgtccaatatattcatgctgtatgtgctccccacccgctagttacatactagccatctcagttatcagatcagttgttggagtattgcagtgcttgtgttcaagtaacccttattttatttaaaatggcaccaaagagcaagaatagcgatgctggcagttcacatatgccagagagaagccatatagtgcttcctttaagtgaagaggtgagtttttgacttaggaaagaaaaaagatcgtatactggggttgctaagatctacggtaagaacaaatcttttgtccatgaaattgtgaagaaggaaaaagaaatttgtgctagttttgttgtgacaccccaaactgcaaaagttacagccacagtgtgtgataagtgctttgttgagatggacaagacattaaatttgtgggtggaggacacaaacaggaaacatgtttcgattgatggcaacctggtttgatactgttcatcgttttggacattcactggggtcttggaatttcaaaaataagatgtttgagtggctgtatactctttatcacatggatggaacatactctggttgtatcagcttttttttttttttttttttttttttttgagatggaatcattctgttgcccaggctggagtgcagtggtgcggtcttggcccactgctgcctcccgggttcaggcgattctttgcctcagcctcccaagcagcggggattacaggcgtgtgccaccatgcccagctaatttttgtatttttagtagaaaggaggtttctgcatgttggccaggctggtctcgaactcttggcttcaagtgatccacccgcctcagtctccgaaagtgctgggattacaggtgtgagccaccgcacccagcctggtgtgcatcagcattttggactttggagtttacgtaaccaaggagccaggctgtggaccttgtttattacttgaagaattcaatatttatttctgcctttttgactccttgactgtaaaatactgatctgatctgtagagagaacagtacatgtactattaaggcacagggaatcctcagtgccttaatagatcgtaagtacttacttattctttcccatagaggcttacacatggtaggagaagagatttctggaatacctttcctccccaaagaaagctggtttcttttgtttgttaagtgagagagtggtaccacagggtttccaagatttccaaggctgatgaaaattcttaacttctgttgtctgcttgtcttgctttcttgaatttattttttgtatgttatgtatttattatttagagacaggatctccctgtgtcacccaggctggagtgcagtgtcacagtcataactcacggcagtgtcaacctcctgggctcaagtgattctccttccttggcctcctgagtagctaggaacacaggcatgctccactatgcctggctatttttttccccctggagacaggatcttgttgtgttgcacaggctggtttcaaactcttggcctcaaagctagcctcccaccttggtctctgaaagtgctagaattaaatagaattaaaggtgtgaccaactgcacccagcttatttatgatgacgatgatgatgatgtttgggagatggagtctctgtcgcccaggctggagtgcgatggcacgatctcagctgactgcaacctctggctcactgcaacctccacctcctgggttcaactgattctcgtgccttagcctcccgagtagctgggattacaggcacccgccatcatgcctggctaatttttctatttttgtagagacggagtttcaccatgttataacgccaggctggtctcaaactcctgacctcaggtgatccgcccacttcggcctcccaaagtgctgggattacaggcatgagccgctgcacccagctctattttttgttttgtgataggaaattataaaacatggaattatgcatttgtcaggctttaaaaaaaacttttaagtgaatgaaaatggcatatttgaacataaacttagggcagatttttactacttttgaaaaaatgttggagaatatttctgtatgaaacgtaaaacaacttttaattttttttagaagttgagaggattctattttgcaaagctgtattatgaagctaaagaatatgatcttgctaaaaagtaagtacaaactgtaacatgtattctttttttaaaatcaatgccttttctcattttcttctttgaaataggtaaaaatatgttcttagtagttcttcctaagtgtattctggaataagggatttatcactcagactgatgctaaggaccagcctagattccattgagattgaaaccgtaattagtgttttctgcatgctgctgctttataccaagggcaagaaattgtttggcttaaaacactttttctaaaaattgtcttctgttggagtaaaagaggaccatgcctatatcttcatttgtttttggttagatatctgataccttaatcagatggaaaatagcaatgaataaaaaactgtaattgtaaggcaggagaatagcttgtataaaagatctttaattgacacaatatgtgatgctctaaggctctatcctagggataagaagcttggtgattctgatttcctgactgggagtggattaaagcaggaaattaagagggaggcagggtttttttttttttttttttttttttaggcagtatctgtctctcttgctcaggctggagtgcagcagctggctccatctttgctcactgtaacctctgccttctgggctcaagagatcttcccacctcagcgccccaagtagctggggatacagatgagcaccaccacacctggctaaggtttgcattttttggtagagacaggtgtcactatgttgcccaggctagtcttgaacttctgagcacagcagtctgcctgcctcggcctcccatactgttgggactacaggtgtgtgttactgctcccagctgggaggcaggcttttaaaggcatccaaaggaagatggaaatgctggtaagaaaggaaaatggtggtacataaattatgtaactagcagcactgtgactgttaactcttgtacctttttactgtgagactttaatcccttagtttgggtctggcctaatttctctgatggtaatactgtcaaggaacctagaggatatttacttattttagttgttacttgatttgagaaatggaaatttcctgtatttggtactgtaattagtaatttgtcttctgttcgattttagctggatatagtactgttagaaattactttcttgcttaaagggtaggtgtatttccctttgttgtttgggaaattgttgctgtttagtattttgcattatgataactttaaaaatgtttactataatcacttctaatttatttgcaaaactgttagtgctttattaaaatgtgatcaggaagaaaaagcaatttatatgttcatttcttatgcgtggataacactggagaaaaatttggtaaatgtgacatttaatggtaaaacgagtatgtggtcaactctatgtacgtgtttttaagtattacccatttctttctatgaatacttctgagttatctgcataaatagtggtagttttgagtaacaatataaacgagtttagtggttgctttggtttaagatgtattcttcggttagcatttaaaagtacagttctaagtttaatttacttttgtattacttttgaaaaacagatacgtatgtacttaccttagtgtgcaagagagggatcccagagctcacagatttctgggtcttctttatgaattggaagaaaacacagagaaagccgttgaatgttacagggtaagttataggattcaaatatagcctttgcatagccaaacacatgatgcccagagaaatttatataagtaagtcaaatatattttatgaatatcataaaacaggcattggtatcatagtacaattatgtgacacagcttggaacagatttagaattgtttaacacctataaattgtaagtctaacatggtcagaaatggtgttcttttgtgttcttttgcattcaaatgacacaaatataatttttatttgattcatttccagaaaattccaagacacttttattttaacacctttgaagtaacatgttttctctagaagtagaattttttaagggttggagtgataatttttaacctttatatataagtatataagtatatatactcctacatacatacatacaatttatttactaatctttaatttcttttctgatattagcgttcactggaattaaacccaccacaaaaagatcttgtgttgaagattgcagaattgctttgtaaaaatgatgttactgatggaagagcaaaatactgggttgaaagggcagcgaaacttttcccaggaagtcctgcaatttataaactaaaggtaaacatacaaaacataaagggagaaaacttaagacataaccatttctaatatttggagtttaaattacttttcaatagcaaaccttaagcccaggtgtttgtgtttcctttaacatttttcttttaaaaagtgtattaaaacctttctgagcatctgctgtcttattaggcattgttatactttataagtgacatctcatttacccttctggaataattaatattttagggattttacagtttagtagctgtaaactaagtagagctaagatttacattaagttctgtctggtatacaatttttgcttcattaagtgaaaattacctacaggatgacaatttagggatattttaaagaagagttttctaataactatggtctgaaagtagaagggattgtattttgagatagtaaagttttcaaggaaaagataaaaggtggtttctctagtatataagatgtaattactaaaaatggtaggaagttcttgctagtgtattgactggtcctgatattctttatagagcaaaatatagtttactaagtaactgttctggagaaaatctacacaaatatgtttggcaaacatttaaaatgtatattgtaatattttatatattaatgtatactttattgtgtatgtacaatataaaattataaatgtatatttgcctttagcctcctcctacccccattgtatatgtttctgatagaaatttaaaaaattttaattttgaaataattatagatttttttgcacaggaagttgcaaagattgcacagaaagatcctatatgctacttcatttttccccaatgcttatacaggttgagcatttaaaatctgaaatcctaaatgctccaaaatctgaaattttttgagcactgacatgatgctcaaagaaatgctcattggaaaattttggatttcagattttcagatttgggatgctctgcctgctaagtatcctgcaaatattccaaagtctgaaaaaattcaaaatctgaaatacttctggtctcaagcattttggataggggatactcaacctgtttaacccgaccaaagcacaatatcaaaatcaggaattttgacattggtacaatgtgtatgtatagttttctttcattttatcatgtgtagattcataccaccactactgtcaagatacagagctactctattaccacagagatcttcctcatgctgccccttttgtagtcatgctatttacttctcttcactatgcctgacctctggcaaccattaatctgttctccatctttatactttggtgatttcaaaatgttatgtaaatgtcatcatgaaatgtgtgacttttttttttcttttttcgttgtttttgagacggagtctcgctctgttgcccaggttggagttcactggcgcaatctcggctcactgccacctgtgcctcccaggttcaagcaattctcctgcctcagccttccgggtagctgggactacaggcacatgttaccgtgtcccgcttatttttgtatttttgcagaaacggggtttcaccatgttggcctggctggtctcgaactcctgacctcatgtgatctgcccaccccagcctcccaaagtgctaggattacaggcgtgagccaccgcgcccagccaagcatgtgaccttttgaggttggcttgttcagtcagcataataccatttgtgatccatattaagttttgtatatccatagttggttcctttacttctgagtagcatttcatggtccacaatttaaccattcactttttttatttttatttttttgagacagagtcttgctctgtcgcccatgctggagtgcagtggtgctatctcggctcactgcaacttctgcctcccgggttctcaggtgatccacccactttggcctcccaaagtgctgggattacaggtgtgagccactgtgcccagccttaaccattcacttttgaggggcattttggttatttctaggttttggctgttgttcaactgctatgaacaatcatgtccagatttttgaagctgaaaaagcattgaagatgcttccaaagataaatattactgataagtttttctccccagtaataagcagctggattttaaatattagtctaaaacatgaggtctaattgtgcagatttctttactctcttaggtgttatgcctcaaacataactcccatattgggcgtggcaatccagttaatctggtgtcagtagtgttaaagaacatatgtaatggcaggagattgttttcttgcagtgtaacaagtaagatactttgaagcactctttaaagattttctttaataacttgaaggcactgttaacacctttcctgtatcagattttttttttttttggaattgaaatccatgagatttataattgtcatgcaaagtaattccatttctcctaaaatttaaggcttgctaaggtaaacagtttctgacatttgtttaatgaatgagagtattactgttgagaaggctttttctctcaagtatgagatagaactttttaaaagcactcatagtggttttttaaaaaatgtttaacatagagtcaaagactagggcttttgcaatagggagagaccagggtatcatccatctcatccagaagaggagaaattgataaaggagagaggggaatgaaatacagagtagtaatggacggcttggtcttgagagctggggaaagacgagtttaagtaggtaaggtaaaatggaatttatatgtgatagcatcaggtttctcagtgaaggatgaatctaggttataagttgaaagtgagggtcaaaggaaggtatggggaagttgaggaaataggaggaggtgtgaagtgtcagggagtggagaaagtgagtctgttagtactaaaatggcattttgttttaggcagcaccagtttgatggttgagataatgcaaatgaaatcagttagcttggggttatgatttcccaaatctaagcacacagaaaccagttgggagggttctgaggaaaagagggaattagttgaagggatctgtaagcaaacagtaattatggatataagggattatagcattttttgcctgacagaagaaagtgtgtgtatatgtgtttacaggtgcttaaaacttgatgatgttattgtcttgaagggaacttgtcatgtggtggagaagtatatttctgaaagtaagggtacgtaggccctcagtgaggtggaagaataagaaggatggtatggtcgtttcggtggtatgaccaaaatgcagattttgaagacctgtgtcagtggcaagtggatggttgaggttggagtagaggataacatgactggagatgaggtgattaaggaactgagtagtcagcctgggcaacacggcaagaccccatctctacagaacgttaaaaaaaaattagccgggcatggtggtgcatgcctatggtcctagcttcttgagaggctgatggaagagcatcgcaaatgagaagcgagtggccacaaaccctacttcctctccttgtatgtaagttcagagagaaaaagccatcatggtagtgggggttatcctgagatgatactgtcttcatttaagatcaggaggtgatgacagtgctttgagatgatgatgaaggtaacagaacagtgggaggagaggggatgtgggattgagtcagatttaaggagatacagagcagtttgagcataaggaccttgttgctgaggattgactggggaggtctaggcttctggtggtgactcagatggacagggatgtgtggcaatagtcctggtagtctctgaagagagtatgagctactgcagtaatcacagatgcttttcttcacatacagttcttgaggcttagtttctgggttgtaagcaactctcagaagggacgaataaggtatataggatggtgtttttggtggcatcatcataaaactagacatagtggaatggtgctttttgggagcatgacttgtttaaaattgcacaagtgttactctaataatttttctttttcccctctaaataggaacatcttctagattgtgaaggtgaagatggatggaataaactttttgactggattcagtcagaactttatgtaagacctgatgacgtccatatgaacatccggctagtggagttgtatcgctcaaataaaagattgaaggatgctgtggcccgctgccatgaggcagagaggaacatagctttgcgttcaagtttagagtggaattcgtgtgttgtacagacccttaaggtagataaaagctattgggtctttacatttctatgtaggcaattagcatacatctttttgtactaaagcagcagtgccccgcaggacttaaatttcttttatttaggtagaacagttataaaatgaaatttttaccaggatcagttaaatttataatgggaaagttggggagataactatgataaatgtatatatttttggtgttttcatttataaggttgatgtaaaaatcaatgtagtttcacaaacgtggttagagtgagaaaaggaatttgtaggcataaaatggttaatttcttaacacttgattaagttttgtaacttactattcattccacaaaataggaatatctggagtctttacagtgtttggagtctgataaaagtgactggcgagcaaccaatacagacttactgctggcctatgctaatcttatgcttcttacgctttccactagagatgtgcaggaaagtagagaattactggaaaggtgcgttgactttgaggagaatgctttagtataaattgtagtttttctttttgcagtaagttcattgctctaaatttctttactgcatcattatttctataatgtacctaggagttatagttaatacagtgaaccactaggaggcaatcttatttttcttcttttacggggaagttctaattggttttatatgactttcctttttagagaactcttatagttcaagcttgattaaaattagccttatggttaaatactcaggtttgtcatagtcaagcttaaaatgaatgttctaactgctatttcatattttattttttataatagtataatcttgagtgaaaattaaggttcatctgtcatcagatggctaggttcacatgtactagtataagcacttagcatcactggtatttcagaaaatactgttttagctaagaaacaaaataactcaactatgtgatttaccttttttcctaaattttgattttgaaaaccagtgtctccattttgaaaataaattccattgaacaaaaacatcacttggatttgtataaaaatgttagtttagagcaggggttggttagaacttgtgggccaaatatggcccctgcctaattttgttaatatttattggaatgcaacatgcctctgtttatgtattgtctgtggctgcttacatactacaaggttggaattgagtggttgcagcagagattgtatgcctgtaaagccagattagtaatctcctcctttttgtagaaaaagtttactgattgctagtttaggctgtccatttgtttggaagttaatttatttccccatctggtataaggaaagaagttcatttcactgagtgcagggagtaggtaattttcttgaaaaagtacatagtgtcctaaattggtagggtaagagcagtatctaaaagaactaacataactttaagattattttagaaaacatgtaggatgttttattttgtgttctttgtatactcaaattttttggtcacaagttccttttacatttttcttaaggacatcaaagatctttgtatgtgggttcctttttttctttctttctttcttttttgttttgtttttttttttttttttgagatggagtcttgctctgtcaccaggctggagtgcagtggcatgaccttgactcactgtaacctccgcctcccgggttcaggcgattctcctgcctcagcctcctgagtagctgggaccacaggcgcacaccaccacgcccagctaatttttgtatttttagtagagacggggttcaggatggtctcaatctctctttttttttttttgagactgagtcttgctctcgccaggttggcatgcagtggtgcagtctcggctcactgcaacctctgcctcctgggttcaagtgattctcttgtctctgcctcctgaataggtgggactacaggtgcccgacaccacacctggctaattttttttttttttgagacagagtctcgctctgtcacccagcctggagtagagtggcgcaatctcggctcactgcaagcttcacaatttcctctcaatgctctgaataagagcttatcctcctgcctcaggttgttccccaccaggaagccccaggagggccctgaggacagcccttggccctcagagggggaggctcaggaggggagatgaccatggggatggagtcactcaggggagaatccggaccatgagggggtgactgggggcctgaggggaggaccctgaggaagataaaaagctggtgccaccctaggcagtttcacagtgtggcttagggtggtgggtgacagatggtttgtcagatcagttaatcaggactcatgggccctttgttacccccccttgtgaacctcccaggttcacgccattcttctgcctcagcctcctgagtagctgggactacaggcgcccaccaccacgctcggctaatttttttgtatttttagtagagacggagtgtcaccctgttagccaggatggtctcgatctcctgacctcgtgatctgccctcctcggcctcccaaagtgttgggattacaggcgtgagccaccgcgctcagcccacacctggctaatttttgtatttttagtagaaacagggtttcatcatgttggccaggatggtctcgatctttttttttttttgagacggagtctcgctctgttgcccaggctggagtgcagtggtgccatctcggctcactgcaagctctgtctccagggttcatgccattctcctgcctcagcctcccgagtagctgggcctacaggtgcccgccaccacacccagctaattttttgtatttttagtagagatggggtttcactgtgttagccaggatggtcttgatatcctgaccttgtgatccgcctgcctcagcctcccagagtgctgggattacaggcatgagccaccgcgcccggctggtctcgatctcttgacctcttgatctgtctaccttggcctcccaaagtactggaaggtctcaatctcttgacgtcgtgatccgcctgccttggccttccaaagtgctgggattgcaggtctgagccactgcacctggccgtatgtgggttatttctgtcagtgtttattacattagaaattaaaacaaataaaaaatgtaatccattaaaaatgtaataagccctattgtgtgttaataataatagctttttttttttttttttttttttttatttgagacggagtttgctcttgttgcccaggctagagtgcaacagtgtgatctcggatcactgcaacctctgcttcccaggttcaagcgattctcctgcctcagcctcccaagtagctggaattacaggtgcccaccaccacgcctggctaattttttgtatttttagtagagatggggtttcaccatgttggctaggctggtcttgaactcctgacctcaggtgacccacccgcctcagcctcccaaagtgctggaattacatgtgtgagccaccgcgcagggccaataatagcattttttatgaaaaataattattttccaacagcaaaaaagtagtcagaaaagtgtcattgtttttgcatttttgtaaatctttttaatgtctcgcttaatagaacatagctagattctcatttacttcctctttcagtctgtaaaactattacatgtcatgaagcctctagaaaactcagctcagcgggtcgcggtggctcaggcctgtaatcccagcactttgggaggccgaggcgggtggatcacgaagtcaggagatcgagaccatcccagctaacaatggtgaaaccttgtctctactaaaaatacaaaaaattagccgggcatgttggtacgcgcctatattcccagctgctcgggaggctgaggcagaagaatcgcttgaacctgggagtcagaggttgcattaagccaagattgtgccactgcactccagccttgtgacagagtgagattctgtctccaaaaacaaaaacaaaaaaactcagctctacatacatgagaaaatgagtatgtaatatataaatttttttttggtattattgtaaaagtaattttaacttcatggatcccctgaaggggtttttgagcaccctcagagatctttagacctcatttgctctggttgcgttattgtaagccactttaaaatcatgcttcacgtttaagtgtttgctttttgcttttacttttcttccaaagtgaggatttggagaaacattaggatttagaagaactaatttagaatatagattacaaataataggccaggcatagtggctcatgcctgtaatcccagcacattggtaagctgaggcgggcggatcgtgaggtcaggagttcgagaccagcctggccaacatagtaaaaccctgtctctactaaaaatataaaaaaagtttagcggggcatggtggcaggtgcctgtaatcccagctactcaggaggctgagtcaggagaatcacttgaacctgggaggtggaggttgcagtgagcttagattgtgccattacactccagcccaggcgatagtgagagactctgtctcaaaaaaaaaaaaaaaaaaaaaaaaaagacaatttatttaacgctgtaatgatctatatagtaaaaagagcaattgctgtattgatactcaaatacctgtcagttatttacttataatttggaaatggtatgtctaatttgagaaattacaactgttaattaaataatgaaattatatgatcaggaagaaactacaaaatagtctcccaactttatcctggtttattttgaaatgtgcacctataatcactaatcttatatttatcctgtgattggagggctggaaataactgggaataagacatcatttgagaggttaagcatgaagtataggaagtatgcaggataaaaataagcattagatgattcataatttataacatggggaataagaattattagaagttgaatgtggaagatgaagcttgaaataaaatttttattttgttttgaattaaatgaaccatgattattcacagtgcagtaagtgtgtatcatctgtttgatattttcatattacagttttgatagtgctcttcagtctgcaaaatcttctttgggtggaaatgatgaactgtcagctactttcttagaaatgaaaggacatttctacatgcatgctggttctctgctcttgaagatgggtcagcatggtaataatgttcaatggcaagctctttctgagctggctgcattgtgctatgtcatagcatttcaggtaagtcttccacttgtaggagcaattgacatttcacggagtcttgatgtgttttaaatgaaggtgtgctctggtatgtaatgacaatatgtgaacaaactgtggaattaaaatgaaatagtcaatttgatacagtggaaaataactaagcatacacaatactggtgaggctggtgaaacagggatgttgagtgcactcttgtcgaaagcctgcattgccatgatttgtttgtagacaaatttgaagagtttgatctttttactctgccatttttgggaacatgataaagatgtaatctcgtattatgggtaaagcttgattcaaaaaggtgtgttacttggacaaaatcctaataagtagatgtagggcaatggctttatagcctatgatagaagaatatgattgcaatttaacatgttaattgaaacacatgtatataacatttatggctgtattgtgtatatgtaacagtatatctattaatctttgaaaacataaaaccttttcttattttttatttttttattttttttgagaccaagtctctctctgttgccaggctggagtgcagtggtgtgatctcggctcactgcagcctccacctcctgggttcaagtgattctcctgcctcagcctcccgagtagctgggactacaggcccgtgctaccaagcccagctaattttttgtatttttaatagagatggggtttcaccatgttggccaggatggtcgcaatctcttgacctcgtgatctacctgccttggtctcccaaagtgctgggattacaggcccgaggcactgtgcctggcgtgcctggcctttttttttttttgagacggagtctcgctctgtcgcccaggctggagtgcagtggcacgatctcggctcactgcaagctccacctcctgagttcacaccattttcctgcctcagcctcccgagtagctggaactacaagcgcccaccaccatgcctggctaatttttttgtatttttagtagagacggggtttcactgtgttagccaggatggtctcaatctcctgacctagtcatccacctgcctcggcctcccaaagtgctgggatttacaagcgtgagccaccattcccggacttttttttttaatgagcttgcataacttttgaaaggaaaagaaataagcagtcttccaaaaaaagcattaaaccaggcttagaaaaatgattaattttagagaaggattttttgcttggggagggaaaaaaaaggattcattacttttagagaaggcccctccttctaatataaatctttttttctttttgagacagagttttgctcttgttgcccaggctggagtgcaatggcgccatctggctcactgcaacctccgcctcccgggttcaagcgattgtcctgcttcagcctcccgagtagctgggattacaggcacacgctaccacgcccatctaattttgtattttcagtagagatgaggtttctccatgttggtcaggctggtcttgagctcctgaactcaggtgatctgcgtgtctcggcctctcaaagtgctgggattacaggcagtgagccagcatgccctgcctaatataaatctttttatttttatttgagacggagtctcgctctgtcaccaggctggagtgcagtggcgcaatctcagctcactgcaacctgtgtctcctgggttcaagtgattctcctgcttcagcctgtcacgtatctgggattacaggcacacaccaccatgcctggctaattttttgtattttttaatagagatggggtttcaccatgttagccaggatggtctcgatcttctgacctcgtgatccacccgactcggcctctcaaagtgctgggattacaggcatgagccattgagcctggcctgtaaatcttttaaaaacaccgttgatagacagttcacatgttaaatgctaatattggctcagtagaaacttctgtgttcataaggaatggattagtgaaaattaatggatttagtgaggttcactaggtaatacaaacattaaaaggttcttatagaaattctcaagtaactgatagttcttatttttatttattttatttttttttgagatggagtctcacactctgtcgcccaggctggagcacagtggcacgacctcggctcactgcaagctccgcctcctgggttcacgccattctcctgcctcagcctcccgagtagctgggactacaggcacccaccaccacgcctggctaatttttttgtattttcagtagagatggggtttcaccgtgttagccaggatggtctcgatctcctgacctcatgatccgcccaccttggcctcccaaagtgctggcattacaggtgtgagccaccgcgccctgccaatagttcttatttttaatggaaactttaaaatttatctgtctgtgtgtctattagagtcttgctgtgtcacccaggctggagtgcagttgcgtaatcgtagctcaccgtaacattgaactgggctcgagcttcccagagtgctgggattataggtgtcagctactgcgcacagcctaaaatttttcgatatgtagttttgggaggcagagtctcactcttgctctggctggagtgcagtggcatgatcatagctcactgcatcctcgaactcctgggctcaagtgatcctctcctgcttcagcctcagctcagtagctgggactacaggtgcctgccaccatgcctggctacattgttaaattttttgtaaagacaaggtcttgctatgtttcccaggctggttggtcttgaactcctggcttcaagtgatccttctgccttgccctcccaaagtgctgagattacaggtatgagccaccacacctgactgtgaacttttaatcataataagttagtttccctcttaatccattcactcaggtctcctttcctagatgacagctactgttaggagtttcttgggtgttcagaaatattttttgcatatgcaaatgtgcaatacattctttctctgcttttaaaaaatattgtgcctcaatgtgggtgtgctttacctattgccagatgccttgcttttctgaatgtttcttcattgttccacttcagcacagagatacctacctcagtctttattagctaccacatatttctgtagaatgaatatataatagaaacatcttagatgcttgtattttatttgatcagtttattttaaagcttaatgaacaaatgattataagcataaaatgtaggttatgtgctggcatttgggtatttaagaattggctaacttttatggcaagattttcagactcttaatcagaggaatactgtggttctagtaagtgcatctgcattgcagctaggtagttaacaaagtatcttgaaaccttttagttaagatgaggaaatagccaggcgtggtggctcacacctataatcttagcactttgggaggctgaggcgggcggatcgcttgaggtcaggagtttgagaccatcctgaccaacatggtcaaaccccatctctactaaaaatacaaaaattagccacgcatggtggcaggtgcctgtagtcccagctacttgagaggccgagacaggagaattgcttgaaaccaggaggcggagattgcagtgagccgagatcgtgccactgcagcactccagcctggcgacggagcgagactccatctcaaaaaaaaaagaggaaatagtgaattgagatgatttgattgagtggattcacaactaattaactggtcacagattcaactgttgaataattttgtaaaagaggccgggtttatgaattgaggtcagtttgaaaacaaaaagaatgatgtcaacattttgtttcttactttgtgtgctcttttcaacatatagatgacaaactttgacatgatgtttagaaaacttgtgagtaaaaggataggcgatatgaatatttctaaaattcaaaatcagaagcttttaggttcataaatcatatattttgaaaaatgagcatgtttggaaagaattatatatacatggtttaaaattctggcggctcttaagaatatgctatgaagactcctttctgttccctagttatttactttctccagccccaaagaaactaatgttattgctttcttgtgtgttcttcaggaaatgttttatgcatctccaagtaaacacacatatatcccctgtctttaaaagaaggaggaaaacatttgaacattgcatttactttatttccattaactgtatcttggagatgtttccatgtcagtatatataaagggcattctcattagtttggatgcttgcatattattccattgtatggatgtactgtagttttggagtttttaaaaccagggtcctaaaaccaggacattagcttgcttttacttttttttttaatgctacttcaagtaatttagcaatgattaacttgtgccatgaattcctgaaagaattgcagtatcaaagtatatctgtgcatttataatttttagagctgttgccaaatatctaaccctaaagaggttgtatcaaattacatttccaccaccaattaagaaagtggtgatagaattaaaagccgatgctctagtcacccatatagttacttttggcatgtttctagtaagtgggcattgcctgtgactggacgttttcagtgatgggcattcattacttttcaagatagcccagtgcatctttaggtggtttggctcttggtacttccttatatagaataaaaatattcttcaagccttctacctgttggtcttgtttcttcttttgatgatttcttttataaaataattttaatacctgaaggcagctgtcacgtcttcccttcgccattctattcatcatgctttttttttttccataggttattgcattaggatctctttaatttcctggttgtcccatttattctagtgctatcccctgttatccatactctgaaaatgtgttatctacaatgtggcatttccaagtgtcatttcacctgtactttttaaagtagggtgtcatatctactcaaataggacaacatctgctgttgtcctatttattcagggcagaaaagtaatataattaaattttccatttctctgaatgtaacacgaatgtgcttttagtagaaactaatttctcagagctgctctgtgtatgctttttttttttttttctttttttggagatagggtctcactctgtcacccaagctggagcacagtggcatgatcatggctcactgcagccttgacctcctggatttaagtgatcctcctgcctcagcctcctgagtagctgggaccacagttgtgtgccaccactcctggctaataaaaaaaactttttttagagatagggtctcaccgtgttgttcaggctggtcttgaactctgggctcaagtgatccccccacctcggcctcccaaagtgctgggattacaggtgtgagccaacatgtctggcccctctttttttttttttttgcgatggagtctcgctctttcacccaggctggagtgcaatggcgcagtctcggcgcgctacgacctctgcctcccaggttcaagctatccttgtgcctcagcctcccgtgtagccggaattaacaggtgtgtgccaccacgcctgcctctttgtttttttttttattatttttagtagagactgggtttcaccatgttggccaggctggtctcgaactcctgacctcaagtgatcagcccaccttggcctcccagagtgttgggattacaggtgtgagccaccacgcctgtacctggcctatctttcataggttatataaattccttggttcccagtttttgcagtcttttccaattcagtttaattaatggttaactgtttattcattatcaaaaaaagtacagtgtaatagacaagaccatgttactattagaagtatgggtatcatcaaattaagatttttgattctaaaattattaggttccaagaccaaagattaaattaataaaaggtgaagctggacaaaatctgctggaaatgatggcctgtgaccgactgagccaatcaggtaatagtaatattaaactaatttaatttaaaaagaaaaaggaatttctgttaaggcatatcttatgataaaatcttcatctgtccaggagataatttgtcaaaattatttctttttgccgtatcagttaagagcaataggtatggaagagatgcgaagaaatagcacattctttaaaaaaaatgaatatttgatattgtttgttcctatgtggagaggatttcttaactctttcttcatctggctgctagagcctctagcctgaatatttagtcacttcctgaactaagtataattattgatttgccaaccatttaacaccagctgattctaaaaacactgctgtggggatataaagatgaagaagatacggatctgtcttaaagagctgagagcatagtgaggaagatagaagatatatacttaccttatattaggctcttggaatttgtggatttttttcccccgtttttggcttgggatgaatcctaaaggtctgttgcatattacctgtgattttgctaagatacaaactttaaggtagttagatggccattgaatcaagcagtgaactgaagaaacataatgcttcctataaggagcagttttgatataaaattggatgaattttgtaaagagcaagatgtaatattaaatcaaagttattataagctttggtgtatagttaggctgttggccaaagctcacattgctcttttattccatagcccactttttttgtgggagctaggctttcagtccttaaagtgactttctacttttttccttttctcttttccttctacccttgcagggctctcataagtgcctttgcatggtgtcacagttagatgaaaattgcctgtattttttttttatgtctttgatctgggcatcccgagggtgcctctgtaagtgtgctgagacacaactgtgtagtggtaaccaaacctaattgcccagcagaattaactcaaaggagggtttttaaaaaaagttgaattgaaatataattcatgtaccatacgcttcacccatttaaagtgtacagttcagtggcttttactatgttcatagagtattaccactgtcaccacagtcagttttagaagattttcatcactccatgaggaatttcttacctattagcagttactccccattttacccaaacctctcagccttggcaaccgctaatctgtctctgtaggtttgcctcttctttttttttttttttgagacggagtctcgctctgtcgcccaggctggagtgcagtggcgggatctcggctcactgcaagctccgcctcccggattcacgccattctcctgcctcagcctcccaagtagctgggactacaggcgcccgccactacgcccggctaattttttgtatttttagtagagacggggtttcaccgttttagccgggatggtctcgatctcctgacctcgtgatctgcccgccttggcctcccaaagtgctgggattacaggcgtgagccaccgcgcccggccggtttgcctcttctgaacatttcacataaatggaatcatgtagtatgtggtcttttgtgactggcttctttcatttagcaaggttttcaaggttcatctgtgttatagcatgtatcagtattttatccgaggactatgattttttgattgcttactgtaaacctatggaataaaaatctctgggaacaaggcctggaaataattctttttttttttttcctgagacagtcttactctgtcgcccaggctggagtgcagtggcgtgatctcggctcactgcaagctccgcctcccgggttcacgccattctcctccctcagcctccccagtagctgggactacaggcgcccgccaccagggccggctaattttttttttttttttttttgtatttttagtagagacggagtttcactgtgttagccaggatggtcttgatctcctgacctcattatccacccagcttggcctcccaaagtgctgggattacaggcatgagccaccgtgcccagccggaaataattcttaaaagctgtttaaaggaggattctgatcagccaggttcagaaatcagtgtatcagatcagagaataagagcttgtccctgttctcctatggccacttaaatccagaccttttcatctaaaatgcaaatatgtttggcatttttcatacacattcctgtcttttttcccccttctgctgtcttatgtagatactgagaatattaaacctgtactcttttcatttgctacataagcacccgttttgttgtccagctgtattttttgggttggagggttaggtctgcaataatcatgttatttcccctttgggtatacaaatgagacaacgtgagcaaatacaatctgtatttttaaagtgatggaaataacttaaatttttttttcagggcatatgttgctaaacttaagtcgtggcaagcaagattttttaaaagaggttgttgaaacttttgccaacaaaagcgggcagtctgtgttatataatgctctgttttctagtcagtcatctaaggatacatcttttcttggtagcgatgatattggaaacattgatgtacaagaaccagagcttgaagatttggctagatacgatgttggtaagttatatgtttcagaggaaatggtctccgtcttaattattataaattgcccataatcttattacccagaaataacgacttaatattttcctgtattccttttgtgtgtgggttgggctggggggagtttgaatgtggtgctgtaggggtggcatgtattttttgttgttgttgttgtttttgagaccaagttttgctcttgtcgcccatgctggagtgcagtggtgcgatctcggctcactgtaacctctgcctcccgggttcaagtaattctactgcctcagtctcccaagtagcgggattacaaatgcccaccaccacgcccggctaattttttgtatttttagtagagacggggtttcatcatgttggtcaggctggtctcaaactcctgacctcaggtgatccacctgccttggcctcccaaagtgctgggattacaggagtgagccaccgcgaccagccttgttgtattttgagacagggtctcgctgtgtcacctgggctggagtgtagtggcgtgatcgtaggtcactgctgccttgaacttctgggctcaagggattctcttgcctcagcctcctgagtagctggtaccataggcacatgccactcggcccagataattttttttttaattggtagagacagggtctccctttgttgcccaggctagtctccaactcctaggctcaagtgatcctcctgcctaagccccgcaaagtgttgggattaggcctggcacagtggctcatatctgtaatcccagcactttgggaggccgaggcgggcagatcacctgagatcaggagttcgagaccatcctggccaacatggtgaaaccccatctctactaaaaatacaaaaattatccgggggtggtggcatgtgcctgtagtccctactcaggaggctgaggcaggagaatcgctccaacccgggaggtggaggttgcagtgagccaagatcacactgctgcactacagcctgggcgacagagcgagacttcgtctcaaaaacaaaagtgttggaattataggcatgagccactgcatctgaccatatttttcatctaaatggttgtttatgtatgatttatcttgcttccttcatgaattctctcccatagtctctgtattaaaactataaatatcacttttattggcaatataatcttttttatgaagtagtcataatttgcttgcaactttctgttattgggcatccaagttttctcaacttttccactgttaataatcatactctgataaaaacttcaacaaaaagtgtcttcattgcaagttatttccatagagatacctaaaaacagaattactgagacaaaggacatgaacatctttaagtcttgcaaattgccaaaatgacagaaagattatacctcttcatgcttccagaagcgcataaccttttcttttcttttcttttcttttttttgagacagagtctcgctccgtcacccaggctggagcgcagtggtgcaatctcggctcactgcaacttccgcctgccaggttcaagcaattgtcttgcctcagcctcccaagtagctgggactataggcatgtgacaccatgctcggctaattttttgtatttttagtagagacggagtttcaccatgctggccaggctggtctcgaactcctgactgcacataaccttttcaatattgactttcttgtagaaaaacagatttctttactgtaccgatggattaatatagtggtgttccattgctttaatgacttaaaggaaaacccattgttttggggtttcttattaggttaggtgttctttatttggcttttgtcagttgattttggtttattgagttctagtcagtgtcattttttaagatggacttaaacattcttcatcactactatttttattaaaatttctagaaataatcaagtgagaatgcatttaataagaacatgagattttgcctaacatagaattccctccagctttgatatagaaaagcagttatataattaagatatatataatgtgaattgtttatgttggcaaaactaatggcacaaagaaaaatttcaaacccttaagccaatttttttattttatttcaggtgctattcaagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtaagcaaagattttaacaaattaaatattctgaattttgtttaatttttttttctaacttaacttttccttaaataaaacaggtatttctccttggagtagtatataccagccacttacaattaaaggagaaatgtaattctcaccacagctcctatcagccgttatgcctgccccttcctgtgtgtaaacggctttgtacagagagacaaaaatcttggtgggatgcggtttgtactctgattcacagaaaagcagtgtaagtagtaaaacaaaaatattgctttcacttagtgcgtaggttttaccggggatttaatcctcatgtgaagatttaatttgtcatgtgacccattaacatatatgtatgtaagcgctgaactgtgtatttagaaaacaattttagtaaattgaagtattttttagacctggaaactcagcagaattgagacttgtagttcagcatgaaataaacactctaagagcccaggaaaaacatggccttcaacctgctctgcttgtacattgggcaaaatgccttcagaaaatggtgagttttaaagtataagcatttttaaagaacattaccttaattttttaaaatcatgcactttttattgaaagtttttttgttcagaaaacagcagcttggtcatattatgacagatgtgttttttattgctgcaaaatagttaatgtagttaaatataagcacttagaggagcaatgcctggcacacagtgaatgttacatattagctgagctgttactgttattccttaataattaagttctgataattattcagcctgaaaattaaaaaaaaaaattagcacaaggctttgtaggtaagaccattatagatctttctaaatatttaaggtttgttttgtgtcaccattaggtgaagatggtcagccttttgaacaaactgacactacagaagaggcaggtttcagctatctaaaaatggcaactgttaaaaagtagttgggattgctacattagggtggtatcattagaagtgtttaaaagttgagtgtagaggccgggtgcggtggctcacatctgtaatcccagcacgttaggaggccgaggcgggcagatcacaagatcaggagatcgagatcattcctggctaacacggtgaaaccccgtctctactaaaaatacaaaaaaaaactctactaaaactacaaaattagccagacatggtggcaggtgcctgtaatcccagctacttgggaagctgaggcaggagaattgcttgaacctgcacggcagaggttgcagtgagttcactggtattaaggtggtttagttattacagtatttggaagttgaacaaatgactattgaggtaccatttggttttgacttgaaattttagccagttcttacaacctgtaaatgaactttagatctaatcatgcgtgttccttaaagttgtgtgcttttaactttcttttttagggcaggggtcttaattcttcttatgatcaacaagaatacatagggagaagtgttcattattggaagaaagttttgccattgttgaagataataaagaagaacagtattcctgaacctattgatcctctgtttaaacattttcatagtgtagacattcaggtaacagagttcctttatgaatttattggagatgggaatttccagtttataaacaaagacgtggagctataaactgcttaaattaattgccttgttatttaacggtaatcttgttttctaaattcactagctctcacagataagatatgacagagaagagtaatgagatgtttgtctcttaagatcatataaaatctttggaaaatcatttgggttttatattctgagtataaacaatttgactaaaaactattctgtgtgtttaggcatcagaaattgttgagtatgaagaagatgcacacataacttttgctatattggatgcagtacatggaaatatagaagatgctgtgactgcttttgaatctataaaaagtgttgtttcttattggaatcttgcactggtaagtagatgcagtacttgagctaaaagttttatttatttatttattatttcttttaaaagacggggtttctctgttggccaggctagagtgcagtggcacaatcttggctcactgcaacctctgcttcccaggctcaagcgattcttgtgcctcagctcccgagtagctgggattacaggcatgagccaccatgcgtggccaagctgaaagttttttgttttaaaaagctaatgatttcataaaagcactatttgtatagatttttcacaggaaagcagaagacattgaaaatgatgccgtttttcctgaagaacaagaagaatgcaaaaattatctgagaaagaccagggactacctaataaagattatagatgacagtgattcaaatctttcagtggtcaagaaagtaagtagcaggttgttgtatgtacgttcttactgataacccactggtcagtgtttttgcgttggtcttatattttggtaatttcaaaaatactcagtaatatgttgttattaatgcacagaagggatgtgtgtgtctaaatgcttatatttgcttgctttgtcttaggtttggtgtgtctttttaaacttgggaatctaggtgttatcttagcagtgtaatcaaaacaaatattataacctcaggactaattcttaatgaactttgctgaaattgaaagttgttgctgacaacttaagagcatttcttctcatcctcatcagccattatgaacgcccttgttttcttgctgtcagctgtttgagattgtcatgatgatgttaaattatgttcagtcttctgagtgttttgttgattaatttgtgttactactcttttattaggatttatgttgtctggtgtattgtagcatctgtatttctgtcaccattgaaaatcagttagaaaacatcagtaacttattttgttcacttggaaaagctttccaagttaacattcctctacaattatcatggttaacagaagtaatagaaagagcatggactttagaatcagaagatgttagattgtacaacacttttctgtgttcatgaagaaaaaaatagaataaagacaaaaaaataaaaataataatacaaaacagcagaaaaacaaagaaaaaagataattaaaaaacactttcacgtgtattattatttaaagtgtaaagtgcttattaaaatgacaaaaatgtaaataagataaaatatatcattttagagtttttacttttggaattttttgcaaatgaaagcccttaattaatgtcttttatttttagttgcctgtgcccctggagtctgtaaaagagatgcttaagtcagtcatgcaggaactcgaagactatagtgaaggaggtcctctctataaaaatggttctttgcgaaatgcagattcagaaataaaacattctacaccatctcctaccaaatattcactatcaccaagtaaaagttacaaggtaaacaggaaagaatggaatcatttcattgtgaaattgtttctaagtgttttaaatgctcttttgttatttttatttttttttttagtattctcccaaaacaccacctcgatgggcagaagatcagaattctttacggaaaatgatttgccaagaagtaaaggccattacggtaagtcacttaatttctctagctgtactttttattccaagattccttccctggccactctctcactttttttctgaagctggtcagaatgtccccttgccatccaaatagtatggcaaggggacattttggtctttttttttttttttttttaaggcagggtcttgttgtgcaggctgcagtacagtggtatgatcacagcttactgtggcttcgacctcctagctcaagagagcctcttggcttagcctgccacgaagccaggactacagagagtcacacgccactaggcccagctaattgtattttttgtagagatgggatttttccatgttgcccagggtggccttgaactcctggctcaaacaatcctcctgcttcagcctcccaaagtgctgggattgcaggtgtgagccactgtgcccagcctacataccttggtcttgaccctttaccatattttgttttgttttgttttgagatggagtctcactctgttgcccagtctggagtgcaatggtgcgatcttggctcactgcaacctccacctcccaggttcaagcgactctcctgcctcagcctcctgagtagctgggattacaggcacccgccaccaggaccagctaatttttgtatttttagtagacacagagtttcaccatgttggccaggctggttttgaacttctgacctcaggcgatctgcccaccttggcctcccaaagtgctgggattacaggtgtaaaccaccacacccagccctttactatatttttgaaagtactttatgtgtctctctcctcatcttccacaaaatttgagaccttcaaaggtagaaactgttttatttaaaatataagagttcctgacacagagaaggttcccgagtgattgaactgctacagtgtactaatcatactctggtctatgagttcattctcagattagctgtggattacatgtgtttcaaatgtatagctaggaattgaaaagtggtctgagcttcaaaaagtcttgctatattttaatacttccatatgaatttgacttaattatgtaaggaaatagttatgtatatatatcttattttaacaatagggttcaaaggagcttgacttttttggaattggaaataaaagtaggttctttcatgtttatcaggcaagaactaaattatactgctaaagttacatcaaggatatgctgatgtgtggcgattattacagtgtgatcagcagtatttgcaaattgagagaatactatttggtggggaagacatttttgaatttgcacaaaaatcttgaatgttaattctgtgtagtcatggcctatgacaattacatacaattttgacttaacatacaggtttcaggctcccaacattgtattctgtggaagtatagtggagcactagtccatgagcttgaaaagcttggtactagtactgactctgccattaattaatgatcttgggccagtcacttccttcgtgactggcttcttatctttaaaatgagagaattattgaagccagttctcattacactgaatgttaaaaattacagttacagcagtgattgcaaattcaaagctctggtgcggataccaacagtgaccataaagttttctaggtgattccactagtttcttatttcttggatgtgtatgtgtagcatctggactaggcactgtagatggatgagtgggggaaattttatttagcttgaaaattgagatagttttggacctcatggttaggtctttctgggaaatttttatttgaaacacttgtagaaaaagaaagcagacatgctagatctgtccctgacctcacttgttagaactggtcggattcctgggctgatacagagaagtttgaaacttttcaaaatttacctgttttctgataccactacaatttctttggaaaaagaatttcctgttaagtgtctgttttgtaaggggacattttgtaggttctagggttgggtatggtgctgtcatttagttttcttcagcagagatcaggtagccacatagctacactagatggcattgtatctatctgccatcttgtcaaggcagcagagttgtgttaagagaacatttttggagtcagatgtggttcaaattccagctgttattccctgcatccctttctctcattttaagataggagctaatattgtttacctaacagtgtagatagtataaaaattaagagtttaagtgcattggacgtattattatatacataataaattatctgcagctactgcttttttccctttcctggtggagcatttgaacgtcacctggagaattagttgtattttgtttcagcatggggttaagtgaaaagctaatttggggaggtgatttggaatgtcaggtagtccagattgcagtatagaaagaacacactgaaaggatggtcagtgtaatgttagaggactgtgaaagttggggaaagaagtttagtttgtaggtacttgtttttttgagcagggaattgtcttggctggaggtgaatgtcagaaaggttaatgtaggcaagtgtagaatggaaatgaaggtgtgatcatttaggaggttatttgtttaggtgagagagttaatgaattaggttttgtattaacgaatgaaaatgggagcagataaatttttaacaaattaagaatcatattttaaaatcagcaccaggtacctagaactcattggcaaatagaaactttcaaaagatataatcaggtccgggcgtggtgggtcacacctataatcccagcactttgggaggctgaggtgttggatcacttgaggtcaggagttcaagactagcctggcaaacatggtgaaaccccatctctactattatacaaaaaattagccgggtgtgctggctgacgcctgtaatcccagctactcgggaggctgaggtgggagaattgcttgagcccaggaggtggaggttgcggtgagccaagattgtgccattgcactccagcctggatgacagatcgagacaccatctcaaaaaagaaaaaaagaaaaaatcagttatttaaatttaaaagagtaagtttccccagcactgtttctggcatgatataattaaatgattaaaattatttgatttttttttcttccaatagaaactaaatagcagtaagtcagcatcccgtcatcgttggcccacagagaattatggaccagactcggtgcctgatggatatcaggggtcacagacatttcatggggctccactaacaggtgagctggcaagtgcataatcgcatattttagtaaaactactttacttccctcttttaagtagataacgtgtgaaatcaccttgtttatatatgtttgttaatatacatgtcaacgtctgtttatatgtgacttcaaaagctgtatttggtgttacggagatttttataatcccaagcagaaaaaacgagccgtatgtgatcacgtgtatataaaggcttaaagaacacttaatccacacctcagatgagctgagatgagattattccttaaattgaaaaatgttattgaatagagttatgcactaagaaatgcttaattaagaacctacacctctggggaattattttgatgataatgatgagaggcaggacgttatataggaaatcttacttaatttgaaatattatggttatataaagaaagaaaaggagtttggacctgaatcatacagggtttttaagttctgctctatcacttactataatagctgtgtaagttaacctgtctgaaatgtggagataatacttgccttacataattactatgagcatttgtgtatgtgcaggtgggcgtgggtgtgtatcagacatttattagagtatacagtaaacagttaatgaactaaggttactaatagtgtttactgtgggttggctatgtgcaaaagtgctttgtgaatgtaatttgatttaattacagtaacttagaatggccggtaccattattaatcccttttttataaataaggaaatggataaagaaaggttaggtaacttactcattattatacagctagttattgatagagccgagattcacactccagtggtgtaactccaaagcacttgccagtataatacattgctcccaggcagccagaaataaaaaaattgttccttttacgtacgacagacttctgaaatggtagtagtagtgcccttttttttttctctttttagcccaggaaagatttagaataaaatctagtttagatgagcacatttgtgtgatggttcctatagttaaggcaaccccactagccttttgtgatagtatcttctcaacacaagcaaaataacagaaaatctttgtgaagtcaagcttattaaatgtcgtaagtcatagataagtatatgaaatgtctaacgttcaaaccttgttttcttaaaaccttacacatcatataggtccttgtaagaggataaacaaaccggctagcctttcctggggcttttttagtgacgtgtgcagtcagttatttggtgccttgtgggtcatgatttccatttcttctgtgtacaggcataaaaggtcttctgttcttatacaagcatgtaaatccaacattctcattgtctcattttattcttgcaatgaccctgtgaaatgtgtagaagcagcatatcctcattttacaattgagaaacatggagactccaaatggattatttacaggttcacaaaacagctttgtggcactgaaagggcgagagccaagatctcctgatttctgttcctgtgttcatagattctttttccttaataaaagtaaacatatatcaagatggtccttgtttttttaaaataagatgattaaaattaaagattaatgagctcataggagatactcagaagtactgaacagggtgaagaaaactaaaaactaaccaccttattaacatttcttatatttgagagcatttccttctggttctttctctatacatatagtattttttatgagattgttaccatgttactatgttgtgtgtagatgagctagcctgttttttaaatgttactttagttctgagcatttttaaacttaaatgttttttgaatattaatgagttcatggtgtcccatcacatggaagtactgtaaattctgttcctttatttatgttgtttctggtttatgccattacaaattctaggacactgtcctagttttgtagggtattcaaaatattcagtttatgctcttaccactagtatctgatagtgccattttcgcacttttgctaatgctgacttactagtttataaaatcctttgccaatttgtaggaacaaaagttatatcaatttttaagtttttttaatactagtcatgctcaacaattcatgcaaatggcagttggtagttttgccatcttcaacgtgggtaccttccagttgtttggtttcttggtaaaactcacacaaaacagatggagaagagtttttgtatatcaacatgaatgttaatgtgatttttttaaagccaacgaacacatttgtgttccttgtgagatcctgtgcatgaatttgtcaggtaatttttttgacttgaacattctcataatagcttcaatttgcacaatgcaaccttgtcattttgcagattttcaaggctcacttcaaaaacatgttccttgaggcctattaacatttctttcctaaattgtctattcatatggtgctttaaaaaattagattacttttagtatatttattagagcctcacagtttagagtcagtagtcaattaaagtccctacttaaacttcagactaagattttttttttatttaatattttattttttctttttgctttcatgcagacagacattttgcaagactttaagattcttgggccatttctgtcaggttgttctgtgttctgtgcctgcttcctccccatagtaatttcaaaatagttatcctcacctctgtaaggtttccaaaatcaaacttgggcttctggctagccttttctaggtcttgatttttcagtgctttccagaggcaattgtttggaacctcttcgcacagtttctgtttcttcttccatgtacaggcataaaaggtcttttggttgttttctggtaaaactatcataaaacagttcaagcaaatgactattggtagttttgtcattaacatgggtgccttctagtcgttttgtttcctggtaaaacagaccaaacagagggagcagacagtttgtacatctgtatgagtgttgatgtgctttttattttaagccagggaacacattttatgttatttatgacatcctttccatgaatttgtcaggtgatttttgagctgaacattctcagtaatagctttagtttacaaaatacaacctagtctttctgcagattttctaggcccacttcaaatgcattgaccatcagatggcatcttggttccttacgtcctttctgtgactgaatgtccataattccacatcatactgatctttcttagaaaaggcaacagttactttctcctttattccttttttaatgcttgtgaggtagttcttgttgatcacagcgatgctattctcttattcttcatgtcatatttagcaatttttttctagtttgtcatttgataatcttgattggtatattttgatgtacagaaatttaaaatttatgtagttaaatctttctttaatttctattgcttttgtatttatagctcttgcctagatagtcttaactgtagtatagactttaacagtgttttctttcttttcttttttttttttttagttgcaactactggcccttcagtatattatagtcagtcaccagcatataattcccagtatcttctcagaccagcagctaatgttactcccacaaaggtaacaaaggaataatttatacatttataattattttctttttaaattgtttagggttccttcaaataaattcaagagagcagttcactattaaaacttttatgtcccttaaaatgtagatattttaaatttatctccaaatacagaaattatccttcttagtcaccttatttttgtgttaataagtgtgaatatttagaatattttaaaaatgggagtggtggtggtggatccttcatcgttctgttttaacagaaatagaactgtaatgcccttgctgacccactatgtggtaagtactttcaggcctgatacagctatatatataacaattgattgaagactcaatattacagtggtagttgaatgtgacagctttgaggacagagtgttggggtgcatttagacccttgttcttctgcttattttgaccacaggcaagtttcttaacctctcaatgcatcagttgcctcatatgtgaaatgagggtaataataataccttaattcatagggtttttgaggatattaaaatgagataataatgtaaagtgcttagaacagtgcccagctgacacattaataaatgctcaataaatgttatcatcatcatcatcatcattattgttaacatcatttgataaattgtttaggaatgaagaaggtatttatttcatgactattttgggcatgtggatcaagaaaattcaccttcatttatgtttcagggttcttctaatacagaatttaagtcaaccaaagaaggattttccatcgctgtgtctgctgatggatttaaatttggcatttcggaaccaggaaatcaagaaaagaaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctgtaagactgaggacagcgatgacatccattttgaaccagtagttcaaatgcctgaaaaagtagaacttgtaacaggagaagaaggtgaaaaagttctgtattcacagggggtaaaactatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaagggtaggtactttgttgttaaagttaagcacaatttttctttcttttaatgtttagcttgatgcagactctttgtgggatactaatgttgggatataaacgatgctttgtgaacacccccaaaatatttgagcaattttttttctcccttaataagttcacggtgaggtttcaaagagcaagagaacttagttaaagacatttcagtaactggaagatacttctatcatgctagggcagagcaaaagaacttggtacagtgtatggactcatgcttgaatcatgcgcattaacgtgagtctttttttaaagtgttcattttcatttgttctgtttcttttgtcactcagaaaacatgatattgaggctgggcacggtggctcactcctagaatgccagcactttgggaggttgaggtgggcagatcacttgagctcaggagttcgagaccagcctggccaacgtggtgaaaccctgtttctactgaaaatacaaaaatgagccgggcgtggtggtgcgtgcctataattagcagctactcaggaggttgaggcaggtggatcgcttgagcacaggagatggaggtagcagtgagctgaagtcatgccactgcactccagcctgactgagtgagactttgtctccaaaaaaaaaaaaaaaaaacaaaaaaacaaaaaaaaccatgatattgagatgttctcattttatgtgttgtatgtcagtcttgctcatgtattaaatgagcaaagaatgaaactacagggataaatgaatatgtaagacagtcagattggtggtataaattgagggattctggctttttatgttttaaaagcatattcattttgtttcctaaaatgttaaaaaatgaaatattctttattttctaggatttaattttagcctttttaaatctaatcccatggccttttggactagcaccccttcctcacagcctgagagcaaaggtatagaactagcattctcagtatgagataacagcagtttttagcagctggtagcccttaggaaagtattaataactgtggctgtatgaaatgaagtacttaccactacaacatgaatgttaaagaatgccagtttaagcaaagtaccttttgactggtggcatgacacccttgttggtttgttttttaaaatgtactgggatgctgatttgtaatgtacttcattgctctgctatttcaggtctgctcagtgaagacctatgttttatctaatgtttatctttagccactaacgtctgccagtattcacatgtagtggcaacggcatgtatacagtatggaagagtgtccctgtagggctgttcttttgtgcatggtttagaaaaatgttgtatttgaaaatggaccccatttttaacagccagcattctacagcttgcatattatatatgttgcacagatcatttttagaagtgtggctactagagtggaacaagaagtgggatctgttgaaggccttcaagaacaggttagggaagtgaaacctcacccttagtgaccagtaacacatcttagccatgccaaacaagtacaatgataaaataacaatctctgatttttttttgagtataccagttttattaccagctaaggtagctcttaatcttttattttaaagatacggtctttgagaaatgtgaaaagtgttaacttaaaagtggatgtatacttgcgtacagtttctgtgagctctaggttaggaatccctgacctaagaacgaatgtgcctatacactactgtagaacatagagccttattctgttttgaatctgataatgtcattgtcccaagggaccttagaaatgaagactttagacatgagtaaactgaggccaagagaggctatctgatttacccaagaggtctttactgagtaatagcagaagtggaacaagaatctgtatcttacggtgtactgttatttctcctagctaggaaatgatactaggttttcgtttataatgaaggagagggacaaatttaacattgtaaaaggaagggcactggttctgcagagcagtgtcatccaatagaaataaaatataacctgtgtatgtaatttaaaattgtcatttggtgcaatggcttgtgcctataatcccagttacttgggaggctgaggcagagggatcacttgagcccacaagttccaggcttcagtgaactatgatcacatcactgcactccagctctgggtgacaaagcaagaccgcatctcaaataaatacataaataaataaattttctagtagccatattaaaaagaataaaaagaaacagttaaaaagggaaacagatgaaagtaactttatcgatagatttgatttaactcattatgtccaaaatatcattttaacttctaattaatataaaaattaatgatattttacattattgtttttcaccaagtcttcaaaatccagtgtgtgtgtttacacttactgttagcatgtcttgatttggactagccaccttgtgaggttttaatagaatgtggctaggctaccatattggacaccatagctctcagaatgtttccctgtcaccagttggtatacatggcatgcttcataactggcttactttattaaactcctttagccagaagttgttctttacattaatagatcagaacaggttgcatatagaagttttttctgtttctaattttttgccctttgcattgatggtggctggggatgggttgttttcagccatatgaatggtcttagattttatagtgttagctacccatagagtaacagtttttatttaattttatctagtatcatgcttgaacacaggcaaactagatgcaactctagtcaccttccattcttggcaattgttaactttccttacaggaactaatcacagttggctttggattagtttcatatgtatactaatacttgcttatgttttaagatttttttcaattgctgcaaatgcatggatattttggtaaactattgtatgctaagtatagttaggcaacactttaaaatttttaacctttttaaattctagaaatttgtagtaattcttttcaatgactattaagtaaacacaagatttttttgttttctttcgttttaaatagattctgtgttcacttagggtttttggtagaaaactaaatcaggatgctaattctaattcatgattatcgtacatctctgcatcaaagtatatgtgttttttatcagtatgctgttttaacctatagataggttccatggtttttattttcaggtagagtattaacgtcaatacttaataccttatctttgtcaatttttttgactggtgttacagcaaaagagaagaaaaaacctgaagattctccctcagatagtctcggtctcctgacctcgtgatccacccgcctcggcctcccaaagtgctgggattacaggcatgagccactgcgcctggctgacacatgtcttaattctggtattcaccagatttgtttcgtgttctccgttgttagtcatcaaatttgtctactttttaaatagaaacattagctagagcaaggaacttagaaacactcaagcagcactgaatgtgtagaattgcataaccaatatagcttctttgctttcatatttacaattagttggagttttagttcagccgtacccagtatcttccattctgcttccaggaagaaatggaaaaatgtcagccatgatgatgcagtattttagtagcaagttgatggtgttttggtttcccatgggaaatattgtcactggagcattagcagctatcggtcacttattagggtaaaaaagcaacttcagaagaatttaacatatgccaaagaatcaacaaaggaagtaatcagccagggcaaaggtcgcacaagagattgtaatctagcaatcagcagtggaataagcagtcagcttaccagaaacccaggaaaatgctttagaaagggcagtcaggactaaggcaatttaatgaaatgcaaaataaatgaaatctgaagtttaaaaatctagattacaattctggtttctaactcagttatgagaccttgggcaaagtcattaaatttctctgaacttcagatttttgggagtcaataaaccaatacatgtcaaagggcccgataaactttacagtttagaccaggcgtggtgtctcacccctgcaatctcagcactttgggaggccaaggcgggtggatcacatgaggccaggagtttgagaccagtctgaacaacatggtgaaatcccatctctattaaaagtacaaaaattatctgggcgggatggcatgcacctggaagtcccagctacttgtggggctgaggtgggaggatggcttgagcctgggaggcagaggttgctgtgagccaagatcgtgccactgcactccaacctgtgtgacagagtgagaccctgtttcagaaaaaatatagtttatcagcaaacaggaaagtcttgctaggcaacgtaattgattagttctgtgccctggattctgggctcttaactgtatgagcactgtaggtgtgagcagcaacaattaagaagctgcagaggtaaaggtataagggcagtgattgaggatgtctaccaagcagatttcggcaagtgtgtttcaagaagtatgccgcaatctgaaatacctaatcctgaaaaattgctagaatctagtcttttaattttggccagtatttagcagtagtttggccctctactctaaattaataaaaaataagtagtactatattatgagctgtgttatctaacagtttatcttagctagtagcaattaatttatagctgctattaaaatgactaacgtagttaaaagtttgatgactaagtttttttttgtttgtttgtttgtttttttgagctggagtctcgctctgtcgccaggctggagtgcagtggcatgatcttggctcactgcaacctccgcctcctggcttccagcaattctctgcctcagcctccccagcagctgggattacaggcacctgccaccgtgcctggctaatttttgtatttttagtagagatagggtttcaccatcttggccaggctggtcttgaacttgctgacctcgtgatccacccaccttagcctcccaaactgctaggattacagatttgagccaccacgcctggccttgatgactaaattttaggaaatgttttagcaattcttcatacacctttcacttatagttacttaattcctctactcttatcatttgatattttcattttattgtgtatctctgtaaggccgaatcaatagattttgaacaatctcacacttaacctttaaaaaaaatctaataggcccagtttcctctcagcaatctttgaagaaccttcgagaaaggagaaacacagacctcccgcttctagacatgcacactgtaacccgggaagagggagaaggcatggagacaactgattacggagtctgtgtcttccgccagcacatacacacagtctttagagcagctgcttaattctcccgaaactaaacttggtctgttactctgtctaaatatgttcttcttctttaatttcactgtcttatttaattactattacactaaggtacatatgcttttttgggctgctccaataaaatttctttcaatattccactacctgtttgtattagggttctctagagggacagagctaattggatggttggatggatggatgagatggatggatggatgcttattaagtattaccttacacgatcactaggccatctgcagactgaggagcaacgagagccagtccaagttccaaaactgaagaactaggagtctgatgttcaagggcaggaagcatccagcacaggagaaagatgtaggttgggaggctaggccagtctcgccttttcaggtttttctgcctgctttatattcgctggcagctgattagatggcacctaccaggttaagggtgggtctgccttccccagcccactgactcaaatgttaatctcctttggcaacaccctcacagacaacactcaggattaatactttgcatcctttaatccaatcaagttgacacccagtattaaccatcacactgtccaaatggaaaaattattaaacaaatcttttttaaaataaaatgctagctcttgccctaggcttgaaccataaataagtggtgggaagtttatagtcacaaataggtggtgggtattagaaagcaggataaactatcctctcacccttccaagaaactgacagtttcagtttattcctcttgatgaagtaatgctaaatttttgtagtgatgttttggtatattttattacctgtaattaatattactgttcaaaatttagggggaatctgtcatcttcctgaaacttcagaatcacctggagtaagggtcatttgtattcatggtcactgaccacatggggtagaaactgcaagtcatggttccttcaggcaaagttaatagtggtgacacggaggcatcatgatagagcagcagactccagaagccaatttgactttgtgatttctgaaaaaattacctgtcaactgtgagcctgtttcattgtctgtaaagtttgaataatgatacctaccccgcctgatagaagattcttatgagggaacatgatacgtgaccagtaaatgttaatgctttccttatacgtgaaatgacataaaatcttggaatattaatagatgggaagaagatgtgtaataaaactgtctataaacacaattctgacaaatttcagaactgggactcatagggcttgtattcagttagattacatgctttacaacagagatactgttttatttgtgtcacctacaacatataatctgttgattgaggtatgttgaatagatgaatggcaaagaaagcagacctataaaatatcacatagtaagatatttatatttagatttttcttatttagaatcttcatctgtaatgtatgattttgaaaattaattcttggaacaacatgttgcagagcctccattatggcatgctgaatttaccaaagaagaattggttcagaagctcagttccaccacaaaaagtgcagatcagttaaacggcctgcttcgggaaacagaggcaaccagtgcagtccttatggagcaaattaaggtgagatcagaaacctggccactgtgaaaaccgccagtttggttttctggaccctccatacacatgcacccaagtttaaaaattcacattgcagatgcatctataacgtcttgatctttatattagattattagattcctgatggtgagaaataaatattgccttttttttttttttttttttttttttttgagacagtcttgctctgtcacccaggctggagtgcagtggcacgatctcggctcactgcaagctccacctcccaggttcacgccattctcctgcctcagcctcccgagtagctgggactacaggtgcccgccaacatgcctggctaatttctttgtatttttagtagagacagggtttaccatgttagccaggatggtctcgatctcctgacctcgtgatccacctgccttggcctcccaaagtgtgggtattacaggcaagagccaccgcatccagccaaaatacttcttttacacctattacataaagattatttcttaattcctacttttcctaagaaaccgtaatagatttagaaactagagagatgttcacaaatcattgttcacatatgcttaaataaaaaatgggtgtgagtctttgaattctaaagataaccagtgaatttaaattattcaactgatatttatagtactgaactactaaacagttttcaggtggagatggcaaagtggcatgggaagtttttcctgtttaaagtagacaccagaaacatctaggaatgttgcagaacagttgaggattactcaaatgaggtatttccaccctggctcactgataaatcacccctcagaatatagtcatactgcttattgaggagttcttatgacccaggccctgggctctacatacattatttaatctcatcactggttgagagaaaaattgaagctggtaaatggtggaacaaaattcaaactcatagctgtctgaaaagtacatgcttttcccctgtactttgctgttcctagtagatctgtcctgccactgtgcaaggccactagctatccttgtcagattattttaaagccgaattcagttattttcagtaaattgtatatatcatgacattccaccattaaatacttcagtatgcatctctataaaatagcattttcccactaataaaaacattatcatagctaacaaatcactaactagcccagtaaacctaaatgacttatttaaatgttatattttcttttttttttttttttgagatagtcttgctctgtcaccaggtttggagtgcagtggtgcaatctcagctcactgcaatctccgcctcccaggttcaagcgattcccctgcctcagcctcccgagtagctgggactgcaggcacgcaccaccatgcccggctaattttttttattttactagagacacggtttcaccatgttggccaggacggtctgaatctcctgacctcatgatctgcctgcctcagcctcccaaagtgttgggattacaggcatgagccaccacgcctggccaaatgttatattttcataaatttatactctcttcatgatttctttgtcttctttattgtcacttttttaaatggtcctaggtttgaggacaaagttcgctaactttcttgcctaacctaaaatgaaaatatactaaaagctatggcttggtttcaacctggaaatcttcctcaaagacttgaacatgatactaccttttttatatcgttctttgcctcatttctctgatagtgttttacattgtcttatattcctgaattttcactgtgtctgaactttttaagtgccgttcactgtggacgtcttaactgcctgggacttcaggaacagcgtaggggcagggggttagtggaggctaccgatgttcccctcagcccattttcagagccccatgccatactggcttagtttctatcaaaagtagaaggcagagggaacatcttggtaccaacccatggctccagttagttgctcctcatggagacgttccatcagttccccagctttcaactccatttccatgataccctgtgcttctgagacaagaactccagtatttacacaggatgcatcctctcctcttgtcagtgatacttggtaagctgctggactgactcatttccacctcttcatctgtttctcgtgagaatgtcttgacgttatctcatctactttttctcctcttgtattagcttgttgcttttctacttcacccctcttccttccaaccccaaatagcttaggacaatggagtcatatagcccaacacttggttcatatgcagcaatccactttctaggcaaatgcagctttgaaactatctcatagttggagttccggttttcatgtcaaatggattttatacggtgatgtcataaactcctttgaaatgcttcacatgcagctgctgtagttaactgaattccttcctttattgccatatggagggaagggggaaatttggggggaagagaagaaaaatacatgagttcagtctgccatatttaatcagaagctcctaaagcccatttttaactcatttctctaacaccagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtgggtaaaaggagagtctcagaacttctgacttctaacttaaactaaacagcctggtggttgagaagttgtctgtatgtgtaacttttcaattttgctcatttgaattgggtctgtcatatgagtaggccgtgactagatttgaaaagctgactttttaacatcttgaggcaactgtagtacatttatataattttaacattcagcaaaatacaataagtgcttagcttgatcttctagctctttgaaaattggatttttatcctggtgttgagttctggtgttcagctgaacgtggttttgttttaaattctactttttaaaaaacatttattagcttgttccttttctacttcacccctcttccttcctccaaccccaaatagcctaagacaatggagtcatatagcccaacacttggtctatatacagcagtccactttctaggcaaatgcagttttaaaactgtgccataggccaggcactggtggttcatgcctataatcccaccactttgggaggccgaggcaggcggatcacaagatcaagatactgagactatcctggccaacatggtgaaatctcgtctctactaaaaatacaaaaattagctggacgtggtggcatgtgcctgtagtcccagctactcaggaggctgaggcaggagagtcgcttgaactcacgaggtggaggttgcagtgatctgtcacgccactgtactccagcctgacggcagagcgagactcccatctcaaaaaaaaaaaaaaaaaaaaaaaaaaaaaaaaaaaaaaaaaaaaaaaaaaaaactatgatgtagttagagttggtttccatgtcagatggatttaatactgtgatgtcattaacttctttgaaatgcttcatatacaactgctatagttaactgaattcaagctgcatcttaagaattatggtttcatttttgttttagttttaaattacttttatttttgacatttacaagcacaaggaagacgctataatctctcttgagttgtcacccatctctaacggttttcaactcatggacaatcttttggcgtaaataggggagagttagagacttaaatcccacacatcatttctttccccagtgaataattcaatgtttattggatttctctgtcacctatacctagtttatgttcattttgcctgtgttattgtgaatgtctttttatagtatcctaaatagggctcatatattgcatttggttgatgttccttaagctttattttgttgttgtgtttttgtttgtttgagacgtagtgttgctctgtcaccctggctggagtgcagtggtccgatcatggctcactgcaacctccgcctcccggattcaagcgattctcctgcgtcagcctcccaagtagctgggactacagatgcacgccagctaatttttctatttttagtagagacgaggtttcaccatgttggccaggatggtctcaatctcctgaccttgtcatctgcccgccttggcctcccaaagtgctgggattacaggtgtgagccaccacgcccggccattttgttttttttatctataacaattacatatataaatatatttttaatgtgccacttattaattgaagaaagtggtcatttatgctatagcagtcctatatttggtttttaatcattacagggtaacactgagcttgttctaattgcctataaataggaagatccaggtgcaattgggtgggatggtggacaaaaatacaccatagatggtattgtgtgctttctaagacatcaggaggcccagaatgtccagacatcttacttttgactgattgaccttatctagttggtgctctttaacatgttccccatcccctgtaaatcctaataactaaactgataagagtcatcctcaaaattgagcaggcatctgaatcatctggtatacttactaaaattccaattgctggtccccaatttctgacccaagattctgcatttttagcaattcgttgctgatacttctggtctggggcccataccttgagaatccctggtctagaggcctgataagattcaggcttaattttttttacagacatacttcataagtagtattgatagtttctttgaatctggtttttaataatctttctaatgatgaaggaggaatgttctcaatactgacagtaatctcagttcttcaaactataggataggtttctatagccacaatagtatttttgtcacaagggcccaaataagaatacatcatgtatatttttagtagttattcaaattacaggttcactgtctttaatttattctaacaaaagtaaacctaattttatagttataaaaaagaagaaatctacttctagtcacctaagagtaaaactgcccctataaaaaacaagacagaaatctcaaaattataactaattttatagttataaaattaaccaggactttaagaatgtttgcattttaaaattaaagttttcaatacaacaatgatattatctcaaaatactcagcatgtctaacaggtctcttttaaaagctcagcatgtttaatgtagacgttgctaacgtccaggtggctcctataagttaagggtccattgatttagaagttctaaaagagactaacctaagggataccaagaacagatatttttaaagaatttcatagaggagatacacattagaaacccagaactctaagatgtgcatttggtaagtcctgtaaacagacaggaaaacacatttaaattagtttgccctttaaagattatttcctacttgtctcttatcaatgtgagtacataaaagagaccttattacaattaaaaactgatggtttagcagcagatttagataccttacattttctctttaagagagagaatgtaaggcctggcacggtggctcacacctgtaatccagcactttgggaggctgaggagggtagatcacctgaggtcaggagttcgagaccagcctggccaacatggtgaaaccccgtctctactcagaatacaaaaattagctgggcgtggtggtgcatgcctgtaatcccagctacttgggaggctgaggtaggagaactgcttgaacccaggaggcagaggttgcagtgagccaagatggtgccattgcactccagcccgagcaacaagagcaaaactcttatctcaaaaaaaaaaaaaaaaaaaaaaaaatgtaaactacaagatagttcaaaagaaattacacagaattcagcatgggagaaacaaaaaacaagagtgggaaaagacatcaaacatgtttttactaatcgaagttctaaaaggagagacaagaatacagcacagataatatatgaagagaatggctggaaatctttcagaactgttgaaggatatctatccacagattcaaaaacccaataaaatctcaagcaatattaaaaaaaaaagaagaaatctacttctagtcacataagagtaaaactgcccctaaaaaagacagagagaaatctcaaaagcagccagagaaagaagacacattgcctcacaatagacttctcaacagcattggtgtaatactatctcatgtactaaaagaaataactgccaaccttttatattttccaagatctcttctggaaaacaaaaactttaagaatctgccttcactgaaaattcttaatgatgtacttcaagcaaaaagaaaatttcctaggtaaaagttctaagatgccagaaagaaagacatgcaaaggaaacttaccaccatattacagatatggactgtcagtctgactggtcacactaggggcatttggttaccaaggccttgaaaataataaccaacactgcatacatgagggatgccagaagaaaggtctgagagccactcttcctggcactgaaggaaacagggcccatcagagcaaacaagtaccttttacctctctccttggaagcaaatgtttataatctctggttttgtgtaaagtttataacagtatttttcattcaggttgctacctattagtggatggtgaaattaatttggtggatcacattcagaatatttttttaaaatcaaaagaatacaagctggggtcagtgactcacagctgtaagcccaaaagtttgggaagaccaggcaggaggattgcttgagaacaggagttcagaatcagcgtgggcaacatggcgagaccctatgtctacaaaaattttaaaatataccagatctggtggcatgtgcccatagtcctagctactcgggaggctaaggcagcaggattctttgttataaggagtttgaggctgcagtcaaacttctggtcgaaatcctggtcatgccactgcatttcagcctgggcaacagagtaaaaccccatctttaaaaaaaaaattaagaaataaaaataatatgtgaaacattagaatatgttgaatctagtaaggataagcaattatttcttgaaactctacatatatacatgagtgttggtaaatacctgactgtatcatcagctctagatataaaatgtttatgatgttggctgtgagttaatgaggaatagttttcctttctgtgggtttgggtgtatttgggaaacattagctaagggggtaaagtaggttacccaactctgaaaagcagcatcaaaatctttataataaacacatactaggggcccaacttaaatttcaagcagatgtcatgagctgctcagagtagcatgttacaactctgcgttataaggtaaaatgacacattgcctcacaatagcctgccagatctgagaacacagcaaaatttttattttgtcaaaaatctcatattcagcttacaccattcatttcaggtgaacatacaacagtgcatttcagtttagggaaatgtttacagtcatctggttctctttattcctgggaacaaggttacctcacttggaacacataaccagtgccaagttgtccatccctaagcaatattgcttccttctactttctagaagttcttcagattgtggaagagaaacttttcagagttctttgccctcattccctcctccagaaattcatgcctttgtataatctcttccccctgagagccagtaggctaacctaatgagttatttttaaccagtagaatacagcaaaaatgatagattacaagagattgtggcttctatcttgctagcggactctctctgtcttctctgcttgcacactttgttgaagcaagctaccatcccagaggcaaggaacacaggccatcagtttagcagccttgaggaactaaattcttccaactaccacataagtttggaagtagattcttctccagtccagccttcagatgagaccccagccatgccaacatcttgattgcagccctgtgagagaccttgaaatagaaccatttctgatctcctgacccacagaaactgtgaaataaatatgtgttaaggtactaagtttgtagtaatttgttacacagcagattgtaaataacacgtagataaaaccagacagaacagaaaaataaaatggctttaaacctagaaagtttccccatgtaaaattttgaaaatgctactctgcctaaggtcaaaccgtcatacatatatacgtatgaaaacacagaaaggtgtctggaagggtaataccaaattaaatctttatccaagaggaatgaaaaccagtattcacacaaaaacctatgcacaaaccttgtgaatatattaaaaaccagtgacttatgcactttaaaaaggtgaattatgtggtatatgaattatatctccaaaacatttaattaaaaacctgtacacaattattcatagaaactttctttaaaattgctaaaaacgaggaagatctcagttatccttcaactggcaaatgaataaacaaactggtacagccatgcaattgaatactgctcagcaataaaaaagaatgcactgccagtacagcaacatggataattctcaaatgcattatgccagttgacagaggtcagactcaaaatactatgtacagtgtgattctacttatatgacactgaaaaaagcagtactataaggacagaaaacaggttagtggttgccaaggagtgggagaagcagccagggagaactttgaggaggtaaaaatgtgccaggccttggtcggtggtggtacataactgtgcatttgtcaagactcagtgctatacgctgaaaagggcaggttttactataagttgtacctcaataaacatgatttttaaatgattaaaactttggtttttgtttgttttggttcagttttaaggtttaccataaatctattggttttagattctaagttgtatataagcttctgttttaaaagaacttttttaaaaatcctcttatcatcaacaatatttagttgtgctggaaattttattttggaattgtttaatagagaaagacaataaataatgttcaagaacagacattgattcataacatcaaagtatattgtgagaagatggtatttcagaatagaggaagaatttcttatgtgctggtaagattgtagataatcatttctgcataattttcatagctggattgctttaataaagccacttaaaggttaagttctagattgcttcatgttgcttatcaatgttttaaagctaaaatagaaaattagctgttaagttggctcaaccggaaattcagtatatcctttaaaaagagaaatttagtaagcagtgtgtctaaagaatgacatatggttgggtacagtggctcgtgactgtaatcccaacactgtgaggctgaagtgggaggatcacttaagcccaggaatttgagaccagcctggaaaacagcccagcccagcccatgcctggctaatttttttttttttttttggattttagtagagacaaggtttcaccatgttgcccagctggtcttgaactcctgagtgcaggcaatccacccacctcaccctcccaaagtgctaggattacaggtatttggttttttgtttggttttcaagcaacctttctcaattttgctatgctcactctttcttcacatgttggtactggctagatacagattttgctttcctattggagactcttttgagagctggctattccctcttgctccttttcttttttctcttccctactttcaagtttcttgctctttttcttaccccataagttaccagaaattcatacccccttgagagggctttttctttgaacttcagtctttagtttcatcaacttttctaaggaaattgatctgttaatgaaagttggcttgcttgacttcagaatatctgtattattcaatgatgtgtttttctggttgctttgtttgagcatagtgtaaatatcacccattgcatagctatggcagtgacataaatctagcagcgtaagatcgagaaaagctagaagtcccaccacagattgtatttcagtgaaagggattcattttaactgcttataaaactaaagaaaacttataaacatggaaaacaattattaaacccaccatatgctcatactgatattaaatggtgtgccagattctagaaagagttaccttttggtaagagcactgcttgttaactatggttggttgctttagatgtctagtgtgtacacaaaagcatgaattttattccttataaccaaagtagaaacctactctgagcaatttgacaaaaggtttacattatttattttagtgtagtttaagattacagtaagatgcaattcccaaagagtgaaatataaggctgggcatggtggatcacgcctgtaatcctaacactttgggaggctgaggcaggtgcatcacctgagatcaggagttcgagaccagcctggccaacatgacgaaaccccatctctactaaaaatacaacaattagccagatgtggtggtgcccacctgtaatcccagctactagggaggctgaggcaggagaatcccttgaacctgggggggtggaggctggagtgagctgagatcatgccattgcactccagcctgggcacactctcaaaaaaaaaaaaagtgcaatataacttttcacaaaatatggaactgtggtagtctagaacaatgtctcaatatacctcctacacgaagtataatagtaaatatctgtatttggtggcataatatgctcttagtataaaccaaaaacacatgctgagcattggacattgtccaatgtttaattcatatgattcattctgagtttctgactgagatcattctttcagactgtgtatttctcctgggatccataaaatatgcagccctaacatgatttcatttttgtttcctttcctggaaaaggagaaatcattcagatcagctttcatattgccttatagacgatgacttcaaaatagttttaaagggactcctttgttctagaactgctctaacacagtagccactagccacatgtggctattgaaagattgaaatgtggttattccaaatcaggatgtacagtaaatataaaatacacaccagatttcaaaggcttacatgaaaaaagtaatgtgaaatatctcactagtagtttttatagtgattacatgttgaaattttaacattgtgaacatattagtttaaataaaatgtattgtgaaaattaatttcatgtttctatttacttttgataaaagtactactagaggctgggtgtggtggctcactcctgtaatcccagcactttgggaggctgaggtgggaggatcacgaggtcaggagaccgagaccatcctggctaacacggtgaaaccccgtctctactaaaaacacaaaaaattagccaggcgtgttggcaggcgcctgtagtcccagctactagggaggctgaggcaggagaatggcgcgaacccgggaggcggagcttgcagtgagctgagatcgtgccactgcactccagcctgggcttcagagcgagactccgtctcagaaaaaaaaacactactagcacatttttaaattacttgtagtgatctcatttgtaacacattacatttcaatcgtatactgcttttctaaagagtcactgctaagccctgaaattaactccaaatacctccctgggatacagtgccaaggaaggggcttccttgaacttcaacctctaaaagtaagcaagaattgagaaatatcttctgctttgaaaaatattcactccccaacgctaatacatcaattacatattatttgggggctaactaagctcctattttaaaatgtaaactgaagaaatcaggccagagtcattcccatcttagtgccaatcatataatcagataattagattgctctttccctaaagcctgtttagtttttttgtttgctggttttgttgttgttgggttttttaatttgtttttgttgttgttgttgttgttgttgttttgagatggatactcactgtgtcacccaggctagagtgcagcggcatgatctctgctcagtgcaacctccaactcctgggttcaagcgattctcctgcctcagcctcctgagtagctgggactgtaggtgcatgccaccacgcccgtctaatttttttgttttttggtttttttgtttgttttgagacagtctcgctgtttcccaggctggagtgcagtggcacgatctcggctcactgcaacctccacttccgaggttcaagcgattctcctgcctcagcctcccaagtagctgggactacaggtgcatggcattatgcctggctaattttttgtatttttagcagagatggggtttcgccatgttggcaaaactggtctcaaacttctggcctcaggtgatccagccgtctcagatcaaagtgctgggattacaggcatgagccaccactcacagctcgctaaggccttttgccaagacaaattagctcttagagaaccacaggattccttttgtaatgtattacaaactaaagtcttacctactcttgaagagtagaaaacatggaaaagttctatgttagcccttagaataattaaaaattcataagctctgaaataaagacaggtaataaaatcattgcgtatgacaaaacaaaagtttaaattggcgtttgtaaactctgcatgaaagccaggtttctcactactagaaaaaaagttataaataaaccaaggagaattccagaatgaatcctgtggtgccaaatatatgttaactacaaggaataacagtgaccttacactggaaacaccttaaccatgggccaaggttaaagatataacagcattctcacaccccttgcatagctacccccaatgttaacataactgttaacaaattatcaaaactaagaaattcgtcttggtatagtatcactaactaaactccagacctcagtcaggttttcccagtctttccttcagtgtccttcctctgtttcaggattcaatccatgatccttgacacttggtactttgtcagatgtcccgctgtatgggtttgtttgatgttttcccatgattagggatagacactgcaagactcagagctactttacaaagaagcctctagggagctccccagagaagacaggggagacaacacaaggacactagaggaaattttagcctctgacatccatgactatatagcaaagagtaaacaaagcctaactcctagccagagaaacacaaaatctcatactaaagccttatttaactcagttcgtttcacccagtacatcatatacagcctcaaacaaaaaattacaaagcatactaaaagacaagaaaccccacagtttgaagagacagagcaagcatcagaaccagactcagatatgaaagaaatatcggaagtatccaaccaggaatttaaaataactaagattaacatgctaggggctctaatgtaaaaatggcataacatgcaagaacagatgggtaatgtaagcaaagagataaaaacactaagaagaaataaagatgaaatactagaaataaaaaacaccataacagaaatgaagaatgcctttgatgggttcatcaaaagaatggatatggccaatgaaagaatcagtgagctcaaagagatgtcaatagatacttcaaaagctgacacacaatgagagaaaagaatgaaaaagaaaaaacagaacaagagtcaagaactgtgagacaattacaaaaggtggaacatggagactttttggaaataccagaaagagaagaaaaagagaaagaaagccaggcatggtggcttacgcctataatgccagcaatttgggaggccgaggcgggcagatcgcaaggtcaggagatcgagaccatcctggctaacacggtgaaaccctgtctctactaaaaatacaaaaaattagcggggcgtggtggcaggcgcctgtagtcccagctactcgggagactgaggcaggagaatggcatgaacctgggaggaggagcttgcagtgagctgagatcgtgccactgcactccagcctgggcaacagagcaagactctgtctcaaaaaaaaaaaaaaaaaagagaaagaaacagaagaaacatttgaagcaacagtgactgaaaattcccccaaattcatgatagataaagctatggtctgaatgtttgtgtctcctcaaaagttatattgaaacttaatcctcaatgtgatagtactgaggtggggcttttgggagtcaatcaggttacgagggctctaccctcaggacagagattagtgcacttatgaaagaagccccagggaattagctagcccctgacaccatgtgaggacaaagccagaatgtgtcatctatgaggaagcagggcctcaccagacactgctagtgccttggtcttggacatcacagcccctagaacggtgagaaataaatttctgttgtttataaactctccagtttatgatatttttgtcacagcagcccaaatgaactaaggtagacataaaggaacagatccaggaagctcaaaatacatcatttcaataatgatctttaaaactttgtttgaaattatactgatcattccgctgactgctgaatgacctggcaccgtctcagggttttagtctggagtttttgtttatgctcatggcctcacggagaacaatattcacctgaagtgacggcgcttctctttttatgttgttgagaagcatgattggctctttttttgcaaaattattcacaaacttaaactttgattcagaattattgaagtaacatggtgaggcagagtaatatgtgacttaaattttatggagtactaaggaaaacgggcagacttaatataaaagtggtgcattggtggtgcttaagggcaaataccgataacatggtgtacaaataaaggatcccgatgattcaaacaggtggaagtgatgggagaactgagttgtcacacagtaccatatccacactgtcacacaaatctcacctttatttattcccttttgcactaacgtagccagaaatgtgaaacgatgacagttttttcagtaggtattttttttttttagtttttatcattgacctttgaggtgcactattaaattgctcagtccattaaaataacggattgctgatttaaaaactggttccttgcttagcttcagcaaaacagcaaagtctaccacattaaatgtatattgtttatttgatttttattgactttgttgtcttattttaactacttaattgcaaatctgtcttggggttaacactgtgtaagagttttaagcataagaagtctgtacttagagtttagatgtagttttatatttgtacatgttgatgtaacattttaataataataattcaggtctgctgggcatggtggctcatgcctgtaatcccagcactttgggaggctgaggcgggcggctcacctgaggtcgagagttcaagaccagcctgaccaacatggagaaaccctgtctctactaaaaatgtaaaattagccaggcatggtggcacatgcatgtaattccagctacttgggaggctgaggtaggagaatcgcttgaacccggaggcggaggttgtggtgagctgagatcgcaccattgcactctagcctgggcaatgagagcaaaattctgtctcagaaaaaaaaaaaaaatcaggttaattctgggatctgagcaaagttttgctcctttccgagaggtgaacacgttacgcaattattaataatatccctgtgggaaggggctttacaacaaattattttacaggtgaagggcagaaatgaaaacattttctagagccactcctgcccttcacactcaggaatgtcgcagtagtcatctctctgttctggatcagtagtatagcaccagggcccctgcgcatcgttgtctggattcctccagtccctctgaggggtgtgtagcaggtgagaatctggggaggatggaagagaagcacttagactatattctaaaaatcagcttgctattagcaaggcagaaggagatgctctcgattcccatctgagattgtcatccaaatgcatttcagctgggtgctgcagcatttgtgtggtcagattttcaatttctctattgataggctgcttctggcacagtagctaatattaccattgctactgtgacagccaagtcttagacagagagccaaaatatttttattgcacagtcaggagaaatataaaggcctcaaaagcctgccatggtcttaattcattccaaacacctgcttttgtcagttgcccttttctctgtaaaaattttcgtagttaacaccattttgtccatgtgaactatgtgccaggaattccactaacatctttccacacattctctcttttagtcctaataaaaaaaaccatttgaggaaggtgttattatccctgttttacagatgagaagactgagtggcaacgtaaaacaaaacaaaacaaaacttgcctaagcataaatagctatgaagaagcagatcaagaagtcaaagttgatctgtctgattccaaagtcctggttttctctgaaatgcagcttgaattattggggatggaggagggatttaaacttattttcagttctagagatgagttgctgtatagagacaaccatttagatgacaatcacaagacttacagtctagaaaggcaggttttatttctggttcttctgtgaacctatttgggtaacccccaccccccaagacctcagttccctcatgaagatgagcctagactacctcataaaaatggcccagagtgtctccatggcccccgatagtctctgacttcgccatttggttgaatcagttttcattaactcacggggaatatttgatctgctcatctcatagggatatagcaaaggcaatttgttgagtgttgggggaatggataaaggtgagtaacactaagttcctatttgataagtgtcattactgagaacttaaggccacctaacaccaaactgggaaaagcacaaaaaaatgcactaaaataaataataggcaagttgtgacatttgaatttcacgtatcttcattttcatttttatattttatttactattttgctccacaatttgagtcaaacatgtgatgagagttctaacttgatatgtttacttcagtcccaaacatagtcatctttggtcttttctcagatttggcctaaaactcgtagtttcattgatttttttttttaactaggcattcttctatgttctaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaagatgagagaaaataacaatatgacaataaaacataatacaaataaaaacaatacagtataacaacgattacatagcatttacattatattagggattgcacaagagaaggtatgtaggttatatgcaaatactgcaccattttacataagggacttgagaagcatggattttggtagccacaggggtcctggaaccaatccctcacagacacagacggacactttacagtagatgaacacaaagatgaaaggaaaagtctgacctaggtttgcggggagaagtggaactccatttttgacaggtgatgccattttttgttttggacatcgtccctctgtagttctttccattcccagtcttgcactctgaaagatacactgaaggaaagtccacacagtggtcaaagtctttcacaagacaccacgtgaaggtctgcacagcacagtcacattgagaaaaagatctcatgcaccagaccccctgtttctgctttctaaaagatcatcttttgcacctgcaaaaaggctgcagtaaactgggccattccatactttgattcatgtattcaaatgctacttatgagctctctgtgtattgagccccaccaggatgctggggacacacggggcacagtgcagccagaggcttggccatcatagagctcacattctagtggaatcagacaggggggttacaggaaatattcaagtaaacaatataaaatgagatcacttgatgatacatggatacatgttacatacatgatgagacagagtaagagaatggggaaagggtttttagatgggggaatggcaggcttttccgaggctgaaagagatccaacccacttctatttcttcaggctcccagtgatatgaaaaagtgccaaacaggactataaaattgtggtctactgtaaatggtttgcagtaaaagttctcaaccagcttccactcaaccaactcaccagttagacaatgggccctctcctgtgtttaaaacagtccggtgcccacctgggtccacatgcagctggcaggtgtttgctagtgtgcccacccatgtctgttccccccacgtgagttatgtgcttacaacgagtcgtttctttgcattttccaactttcttacatttatatttaattaaagatgatctaaactgagaaatgaatgtgaaaagaaacaaagctcttttttgtttggtttttaactaaattaaatgtttttaacaagttgaaacgtgaatcatttaaaaaattgctatcagatccacagagggcaatccactcatatagttgactataaagcttgaggaggaattcataaaaatctaaaggttttacacatgcagattgattaataaatgtcgagatatggtccacttcaaaaataaggaaagtaattattgtagatgttgcactagagcatagtttatgcaggaaatgcaccagagaccttctactggtgaccccatattcgaagaaaaaaagcctctgctctacatcaagaggtgtcaagtacacttgtgttttcaatgaaaatataaaatgtttaaggtatatttgcaccatcatttaaggttacccactttagccatttttaaattcactgatcaatcacatggggagtactcctaacgtacctacagcaaactaatgcttttaacccaatactacgtattatgattgccagtacatcttcattgggacatagtattacagtagacataagacactcatcaaagtgtaaactcaaggtactttgtgaaagggaggtctaggggtcaaggaagatttgcaaaggaggtgatgattgagctgacacctaggcgataagaaggagctggcacagcaggacaaaggtgaagagggtcccaggcaggagggcgtgtgcttggggtggtgaaggaacagaagtaaggccagaaactttgtagaaaagtttagcaagccaagcaaacagcagccgggggttacgtaaataatgccgggccctggcacatttgggaagtctttgggtcttattttaagggcactaggaagggctttaaacagggaagttatatttcttcgagatcaggtgtacagctacaagtagccccaaccagtggtgatagggtcttggactcggtgaaggcagtgtggctggtggcaagtggcagaagtaaacgtgatctaacactgactgttcctggcaaaaccctggcaggtaagttagcagcaggtcaatatcccacagcaactgtatgtacccaccggagtttatataaccttttgctcccttctgtcactttgaaaacaagcaaactaagccttcaaacttcacacttcaaactcaacctacagtcattcccatgttccttctggttaacaatttacaaatgacatatttaaatgttagcattttgtagagagaatcaggagaatcagggttttttgtttttgtttttaaatctggtacaattaggtcatcctatttagtttaccgtttgcttgctacttgtaagaactaataactttaccagataaagtttagatttcatctgtactttaatctcaagaattcgagataaatagtggtaaggaagaaagtacaatgcgtacagctaatgaaacccaggaagatgagtcaatgcatagaaataattccaacccaaataaatactatttaaaatgctacttggagttttgccgtgatactagacacaatatggcaaatcatcctcaagaatacaagaactaaggtgtttccagtcctctttaacacctgtgatgcaggatatttggagagctaaattgttattattaacagtcttaatacctggccaccaacacagtagaggaaacagtttttaaagtgtcatacatctcttcaaatattcatacgcttaatgaaacattcgcacatctaaaaaggcatgcaatttctattgaaatcctgtgtgcctcttattctaagcagtgggactattgacccacattttaaaataaactatagaaaaggaactgtaacttttacacatttttaaaagacaacatatcagaaatctgagaaaaatatagaccatgtcccccaaaatgtgaaaaatttaagagtaaaaaataagatttgtgtcccaatctaaatgtttctgaggattaaaacacctcagtatttctgttttacaaggcttcgtccagatgttagggcccaaggaccatggtcaccctgcagaataagaagccaagaccaaaaggaatgcttagacttcccatctccttgttaaatataaaataatattttaaaaatcttattttcagggtcatagaggtagaagtgattttgtaaatctaatcctttcattttttgaacaaaaaaaaattaaatctaggaggtgaagtaatatactcaagctgacatggttagttagtaatcaaatcctgtcctaactcagaattcaattttacaacaccatagcaccttcctcctctggtctcataaattaaagatagaatagagaaagaggaagagtgggaggatggggaggacagtaggaggaggaggaagaaaatgtactcactttacttttcaaataaaactgcatctctcatcctaatgattatggaggacttcctgttttcagccattatcacacattgttgctctttactgtgatattggaatgccctgcagaacgaagcaggaaatccaataagtatttttctttatttaaagaaaacaaatgtttattaataaatgagaaatgctaaagatcattgactatcttgagggaccagagagctcagaattgctgcctctttcagttatttgggcatggcattgatgaagtactgaacaaaatacaccaacgtggcagtaaatcttatctgcccttaccttccctccctcataattttctctttctttctgtttcaactgttttacttcttcttcactcatcttcttaatttttgtttttgggtcagaaagaagcaactctggttgctttgaacccattccccaagatagtccatctccatgacctcccaactctgatcagttcccctgaacctctgtcccacattccaccccaccctggcccctgacccctcccatctccatcccgtggtcctgctatgggtgctcagtctggcatccatagctactttcccaggctcatcacctacacaaagtctctgctttagtcaacttgatctcttaatggtccccctcagaaagtgcagggccgcatcttcccctgccttcctggtgcttttcaagagctctctcaactccaaacccagctcggttcccacctcctccctgagccttctctagctgcctcaaccttaggcactgttctttcttctggatctgggtagaacatgcattgattatgcctgtagctcacttaggctgtcttttttttttttaacattatatccagtcaccttaaatactgaagggcaggcactggatcttgtagctataagtcattgctcagatctatctaggacactttcattcatatgatcctcaacaaacatttactgatgatgatgttaaaaactggagctcagaacaataactgctaatgtttatgtccggtgtaaaaacaaataacttccttttagggtatttttctaatgaagactccagtaaaccttaacaagaagctgttagtatggcttcacatgctatgagcaaatatagttccaaactctggctccataaatttctctttcctcttaaatcgttaataaatttgtgagtaaattacttgccatctgaattacagatttctgggtaggtgcaacgacgatgaaaatacctgcaggtgaattctttgtcctcttcacattttgctgcacattcttctctgcttcctgcccccagctgcttcttagtgacactgaacagtgaaggcccctgggtattcacatagtcatccaggggctctccttgacctagaggtgggagatccaagtggaataaatggtcagtaaatcaatgccaatgtctaattgtcatgacttccttttaatctatttggttagcattaaccaaataaaacttgctgtttactggaagtagaatgggtagctatgaatcaaaatgtttagttaagaacacacagttgggcatgtggacataaataaagatggcaactaaagacactggggactaccagagaagggagagagggagcgaggcaagggctgaaaaactacctatttagtaggtatttagctcactacctgggtgatgggaatcatttgtaccccaaagctcagtgtcacgcaatttagtgatgtaacaaacctgcacatgtacccctgactctaaaagttgaaattataaaacaaagaaaaacagtttcattaacagattgcaagatagtaaaagattaactggattgataaacaggttagaactatggaaccactactatgttaccatattagtggatataaatccttaaacaagaacaaattttatgtttgctatcaattgtgccatgtcatgagagaagagtaaggcaccatcagtggcagttgtgttaccaagattgatgttgatttgttcatccctgggtagaaatggaacttggaggccattgtttgatttcctacaatatgcgctttggttctgacactgtcacttgaactggtgggaagcatcctctgaatggtccctccttgaggcacataaattttggtgcatagatgatggtggaaataaacaagaactgaactaaattatgttgccaccttggacaaaaattgggcaaaacactggagggtaagaagctccccaacaaagaaggccatttttgtactgggctgatgacagtcacacaacactactaactggggagaaatcagtttttccaaggtgttgacaggtatctggatttcggaggaaattgtaaaaaagcagaacctgggacaaatactggtcttggtttttctttgagatcaaatctgagacaacgaatctgtccgaaagctgctttctgcctggtcgtggcagagggtggccaagggggcctcagctgtgctcccaccacaaggctacagggtgttcccttgtcctgaggctcttccggacatctggctgagctttggtaggtctattccaagcctggagatgccagctccatccttcgcacagaatgctagtgattttcacaggggtaagaggccaaaagaggctaataaaatgaagatagccaagctccatggaattagacaacaggacaaccttgaccactttgaggggcgtggtgggggctgcaggcagagggagtgggttatagagtgacgaggagagcagtggaggcggcagcgggagacaagcctggctctgaagacagcgagccctccagggaagatgcggtcaggggaggttctgaaagatgacacactgcagagcacactggtttgtatgctgatgacaaatatccagtaggaaggcaaatgaacagattctcattctcagaaaggcccgtcctgacctcctgagggtacacagagcacagggaggaggatgcacgctcatcaattcatgcaaagtcctcggccaaagtccccctgctccccacctctgggacttcgtccttcctcaatttaagacattccgggctggaaaaatggattattgagcaggagttggctgatgcattctaaacctaatccactaaaaagcacttgagagatgtatcaaaagatcacaaagaaatagatgctttaggcccatatccatgtctttaccccgcactttctgccaacttgaactctcatttccaagaagagttgtgttttggttaattctatagctcgcagtgtgacttcaaaacacacaataaatccacaaagtgtgtcctacggtgagttcagttaaactttctgaagagtttttttgaagtatagcagagcaggctacaattgatattcaaaaaaagaaaacttccatttatttcccccttcaattaagttctctgtgtcatgttattatacttcatagcacatcgctgctgagatcccctccccagctcctgtccctaggaaatatcccaaaacagaatcaaactgttttctttttaatttgaaataattttcccccattttttttttctcttattcacctctaggactcatatggcaataggatttgatagggcttatttgctggcaaggaaacatcaaatcttttagtggaaaaatacatttatattataggcaaaatgcagatgtatattgctactgatgcaaatgtattttattaatggtgtgagaatttcttcctcactgtggtgtgtgaatgtgtatgcatatttgcatgtgtaaaagacttaatttgtgaaatggaagatgtttctccacttcccactaagcatggctgtaaaagaaactttttcctctccccgggcattgcagcacactggaaagatgatacatccacagaaagcctggctttccaaaagagcttatgagagaatgttccccccaggttggttaaaacattggtaatcctgtggcggagaagtttgttctagcctttgggtgtagcccactgaataagttcacagtgatctatgtcatagtttccatgcattgaaatataatattcacacccccaacatacaccaatttcttacaaaaatttctttaattttctcctgctctgtattttgtttgatagctccttgaatggcttccactaaattcaaatgtatttgactctaaagtgcaacttgtaaaattttatctggtaatttatagattgaatttcaagtatacattatttacaggaagaactactagcaaatcgtatgattccgttcgtatgaaatgttcaaaatggcaaagatataaatacagaaagtagattagtggttgccagaagctgcagatcgggggtaacagctaaggagagtggagtgcgtttttgggggtatgaatagttttaaaatttattctgatggtggctgcacaactctcaatatattgaaatccattggattgtatgcctaaatgggtgaattctatacattaattatatctcaataaagcttttttttaaaaaaagaaaaagaaaaagaactactaggacatgtttagaatattatttcaaaggcttaaacaaagctgaaaagtgagaagagccctagattccttctgggaaacctggcttaaatccagttttctttatttcccagatttgagaatttggtcactgagcaaataacatgattttcctaagtctagatttctttgtttataaaatgagggtgaatatgctaccctacctataccgcgagctaaataagctagtatttgtaaaggacacacactcacactcacattcacacacaggtatgtatgtatgtgtaaaaatgtagcgacctaacccaagcactaagtgagtatttgttgaatcactgtctgcacacagcatctggcaaatggatgcgtgtgatttttccggggattagaggcaaacgtatactgatggaaagccttcctcaggccataacaaagggagaaatgctgaatccctgacgctgccaccaccatgaactggtgagagaacagaatatattcaaagagaaatttcattgttttaacttgcaagtgaggggagcatgacaccgtaagagagattatataaattagtcaaactgagaaccaggcgaagagcttagccgtcctttgcatagttagctacattggctctttttcaattagactggccattatgtgggtgcactcatttagatttgaaaaaccacccattattttctctgcgcattcattccagcacgctgacaatcttcacaggaaaactaaacttatttcttgaagaattcctcaatcttatacaagattttcaactgggagtttcatgaatcaaaaattaaatgaattgcacataaagccatggcatatgtatttgtactgcattgtgggagaaaaaataattattataatttaaaaaaactatgtcttacctgatttcagaaataaaagaagtagaagaaccacttccttatgttccattttgggactggccagcagtgcccagaaagtgtgtcccaatcccaggatgttgttgacttacatgagagtaaacgcatccacagaccagatagtcaaattaagttaatgattctctcagacacccacgccactggctcagcagggttcaaacacgaccttgaataaagggtccttacaaaatgattgagggtggaatctgcaatagatgctgggaagtggtgaaagcaatctcccccctcagctgctccatgctgccttcatgtctccttactccttccctcacctttgtactttatctctcacaattagtcttatttcctcccctcttcttttattccctttcttttggagaaaatgaaatcagaaaagtatctcacatttgctggaaccttccatgacgagaccctctgccaagcgctgcacgtccatagcctccctcaagcttcccaacaggcagtgctgttctcattcctgctgtacgagggatggggctgaggccttccccaaggttgtgtcgctacccaggggtgcagctgatagacaaaaccctttcaggtcctggatgacaaacttaagttaggtgtaaatgttaatatctccacatcctacaccaaatgacatagaaattacgacataagtgaaagtatcttattatcttcaaaatttctttattcccagtgaactcacatgttttctgtaattataaattataagacatcaatctttcccccaaatgaacgtatggcatattattatattctcattctcatgaaataaagcaagactggtagcactaagtggaaagcgtctatctcaattttaaatgttgaatctgtacttttccctggcttaagtctagagcaaccaggtagtatatatgttgtaaaacttctattttagtgttcaaagatatttagcaataaatcaattgacctctctattttagatgtgaaataaggaccagaaagcattgttcctctttccaggcagtgaaattcctgcctattcattaactggcaaaagagtagaggtgggagcccaatggtcttgggtggaacgtcctgtggaattccctgggattgaggaatcatgcagaaccctcaagaagaaaccacactgggcaacaagagggtggccccatgtgaggaacagggggaccgaatcgcatttcctgatttcctattctagcctcactctcttctctcctcaaattcttaccactccctttatcctctctgactcacctcgtggcccagttcattaaaggggacagaaggtggaggcaaattgagaaaccagcagtgggcagacgttttatttttaatgtgaaatgtctcttagggggcttatgttgatgtgcttgagaaagtactttgggggaaaaaaaaactaactctactaatatataatgcttccagcatgtatttatttccacttaaaatattattgtagcagttcctcttggataaggcatcttgggaatgatgttatcagaaattctacatccacataattttcttttcctgtttttttggttttgacttgggtagtgttggtatagcttttgcccacctttcccctggtaggtgttagatgcattaaattctacaaatgcgattttataaattagttgccctcctaatggcctcctggctgtacattcttccctaccttcataatccatcagcatcgtgaaagcacagagggacattgagcagagttctgtgctggcgccaccgcactctgtagcctgtaagagagcagcaaagaggaatgagttgctcaggtatagacaggggtggatgcatagagacttccactgtggcacggcccttcatgtccagggtaggcatgaagcaatggactattccagattgtgcataggaaaccacactgcactcttagacggatttttgctctaaagacaactaattcaaaataaggtgctttctacctgaaataatggcatgaactgagaaaagagatatagagagagatctctgtgtactacgatcaggttgcacatattctgagatttatgtattcttatttagttcaattccttatttactgaccacttactgtgtacaatattgtattagattcttttaggattacagttgacccttgaacaacttgggggcttggcacactgaccgtacacagtagaaaatccaggtataattctgattcccccaaacttaactactgatagcctgctgttgaccagcaacagttaataacatgtattttgtatgctatatgtattatatactgtattcttacaataaagtaagctagagaaaaggaaacgtttctaaggagaaaatacatctatggtactgttatgtatttatccatacagtaagtttacaccgcctgtttacaagatgaatcatctgtctgaaatggaagcaaccccagctacagacctcagtctctgttacatatcaagcaaatcaagtttttcttgtaatgtcaaatgtcatgacttttctctgcttcttgggagcacttccagcatcactagtgccacttcatgtggatcccatggtgttattcaaggtttacagtacagcacgaaacaggacgaaaaatacatgtgaacagggagagggcactttttactgggatgcgcaattcactggggatgacctgctcatgatggaatgttgagtatcacagaacgttttaagtggatacttgcaacacctgagctcattgcaacagcaacaggaggaggctatgaacttattaccgtactgtggtatgcactacggttaaatttatgcagttacaatttaatactgcatcttgatgtttgtatacacttctctcaactgagaatagcaccatatacgatctgtgagtgtgtacataagttttactaaattttaacttttgcaatagttttgttatattttatggtagtaaataataaaatagactaggtatctacatacattttatgcattcatgacatacttaactttttctatttttgttgatatttctagctgcatggtttgtctttgagttttttcaaattgttgcaaaactccaaaacattttctaacacatttattgaaaaaaatctgtgtgtaacagttcagacgtgtgttgttcaatgatcaactatatgtctaaagagtacaaatcagtctgtaaccttccccagcctctccatgctaaaggaactacaggaaactttcgcactcaagatgtgtggagattctgctgctgcacttgtagcaggcataagaacgttcaaataggccgggcgcggtggctaatgcccgtaatcccagcattttgggaggccaagacgggtggatcacgaggtcaggagttcgagaccagcctggccagcatggtgaaaccccatctctactaaaaatacaaaaaattagccgggcatggtggcatgctcctgtagtcccagatactggggaggctgaggcaggagaattgcttgaacccagcaggcagaggttgcagtgagccgagatcgtgccattgcactccagcctgggtgagagagcaagactctgtctcaaaaaaaaaaaaaaaaaaaaagaacattcaaataagattggagacaaattgaatttccttagctctgcccagcataaggcctgcaatcaagatccactcaggtcctcttatgaaggaatagacgtctcttccagcattaaaatggtaaattccttgcaagtatttacaaagaaagttataaacaccaggaaacatcaacctcaccaggaggtgaggtagagttcacccttccatctcacctgaagtggaaaatgcagccaagtcacaacttcctaggtgatgcacgtccatgcaagctggactgcattgctggcctgacatttgcacctggcagctcctcgccaccccctctttccaccttccttgagcccaggctctgctgcccgggaactgccattctaggacagctcatttcatcaagatgaacttctctgaatagccctaagaggacagtatcatttccaactggaaatagcaagaacttaattaatctactaaggattcatataaagcatccctctgtcgtggtaagggtcctcggcaagtttatctgtgccctcgatgccaatgtgcaggttgtttttactgctgttttagtgtattagagcatatcagcgaggagacttctactaattaacctggaggtggctcttctttctttagttgctcttttccacatgttagcctttgttcatcagtccccaggaccatgcaatgaggtgcttatcagccctcatgtcccgtaaagagatagcaggctatctctcaagttagcacagtggttaaaacgtaatccactagggggcattttcctttcctttctttctttctttctttttttttttttggaaacagaggctggctctgtcacccaggctggagtgcggtggtacaaacacagctcactgtagccttaacctcctggattcaagcgattctcccacctcagactccagagtagctgggaccacaggtgcacgccaccatgcacagctatttttttttttttttttgtattttctgtagggacagggttttgccatgttacccaggctggtcttgaactcctgggctcatgagatcctcctatctcagtctccagaagtgctgggattacaaatatgaggcactttgcctggcactaggagacactttctcagtgagacctaactcatttggggctcagtgaggtgatattttcttaattgagttgtgcttgaaaaaatctagatatctattcatctttgaaaaaattaattttcattggctgtctcctcatcattaataagcatggctgtgttacatgcttaagacaaatattagcagagaagaagaaagtcagacccggataacttagcagcctgcactgaggtggcaccaggactccccagaggagagacgagggtccttctgctctgaggtccagactcaccatggataaaacagagttgcaccaaatcatccttcccatctctcacattgattgttctctaagctcattcagagaaaaaaaaaatcttatctcacagtatgtcagggagataagtcatgtagaaaaaccttaaaatattttcaggaaagcaaatgagtgcacaaaaaacctggtgaaatctgagcaaggtctgcagactagtttctgatattgtgccaatggcaactttccagttgtaatcatgaactatagttatgtaagatactgcctgagggaggcggggccataggcacaaggatctctcagtactatatttgtaacttgttgtgtttatacttatttcaaaacaaaaattatatgtatatatttatatatgtatacatgttatgtttgcaacacatgtgcctatatttggatacatgtgtctattttaggaggacctaggatgatgtaactgctttcatactagttaagagaattcccaaatttcagggaaagtctaaagttatagagttcctaactcagggtgcagaactcggactttggctgattctcgtgagctcctgggatgagtgggtgggacagagaggcttctccaccaccacactccttccctggctggagaccagatggttaaggactgatgggtgccagagagcagcagccctccatgtgggtccagaacccagaggctggagtagttcatgcctgctcctgcctcccaggtattcaagggaaacccaccatctccacacaccagcaaaacaccagcaaaacagaggccccaagtaatgacttctcctttctcatcttatcttgccacctgaccagctcctgggctcctcaatccaaagttggggaagagagaagggaatgtcagtggaaaccacttttgctataaactctcatccttcagatgttctttcagtgggtacagtgtttagtgctgtgctaggtgctggggaatcaagagtaaataagaggccatctttgccctcagggagtttttggtctcatgggtttggggcaatgcaggtctgtaaactggaattgtaaaagtgaagtggcccaggtcccatttgttgtagtggtgcacagagagacagtcttgagaggtgaggagacatttcccagaggaagtaacatccaagttgagacttagaagacagctggaaggatgagaaaggagaataattctgtggagtcctaattaggcaaaaggaatcaggctggtgacactgaggaaaaaagaaagagaaagcagataagctgtaagtttgcctttcttcatggtccaggaccatagccctcctgcacaaatagctcacaatcttcctgtgcccagctaccatcaggccctcagctgatggaaaaatgcaggttatcccactgcaaccttggtgttatcagtactgcacaaagctctcttcagcacgcagcaaaagcaacatcctataaaacccccagcaagcctttgtctcttggcattcagttcctctcttgctggcctgcctgttgctgccttgcaacatattttcatactttcttcaataaatctgcctttatctacaactgtcttggtaaattcttcttactgcccatggtatactggcctcagatagttgcttcacctgctacacattctttaagcagaagaaatatatgtgcagggtcccagaggcaggaggagcagacagatgagaggaatttggctaacatggggaaatggtccaattgcgcaggcttctcactctgtttcaagaagtttagacttcagccaaagaaaggcagggactactgttactgaaggcttttaaaatccaagggtggcttgatccctctgattgcagcacagtgaggaggtcataggaggtgagagatgagagggggtgaaagaaggcagtggagaaagagaaaaaagaatggattagggggatgttgagaaagtagaattgacatgattttgtgactcattgaatgtggggaatgaaatcaagtatgctgcctgaatttctggcttggacatctggtggacagtggatcattcattaagaaggaatgcataggagggaataagatgaaattggctggggacaatgttatgtttaggaacttgagaaaacccaagtggaaatttccagaagggagttgaatattctggtttagaacaggagttggcaaactatagcccatgaagcaggcttatttttataaatcaagttttattggaacatggccacacccattcttttactattttctgtggctatatttgcaccaccttagcagagttgagcagatgtgacagagacagtacaatgaccagcaagccgataaaatatttgttatcatcgctttacagaaaaagtttgccaattcctggtgtagagcctaggaaagaggtctgagctggagatgtggaatcagcagttgtcagcagataggtgggactgaagcaatgggggtggacaagcttgctcagagagaaaaaaataagccctaggataaagccctcaacaacacaaggacccagaagaagagaattctgtagagatgactgagaacagttagccagaggggaaaattgacagtgtgagtccagagaagccagcaaaagtgaaaattgtaaaaaggtgggagtggtcatgggtaccaaagacttgtgagaaatcaagtgagatgtatcctgtgtatgccagaaggtaagagcaaatgaggccaacataaccttaataataccaatctcaatggcccagactccagcaaagtctactctagctaccgctaccactaaacatatgtaaaactcagtaaaatagcaattttaattaaacaaattcctgacctatctctgtaatactcctttcccaacatttttgcctgcatattctttgattgcctcttcaataatgttgtaatatcatagtctatgagagaagagaataataaactattttggctctagtattttattattgatagatttaaatttttcttctggcttcatagctcaggatcgataatggaagataagttttcaggattcttggcacacttaggaaaatctttatcaaactatttttatgtatgaactgtaagatttggaataattcccagatgggatgagctacactcttttctagctttgtacatttctatttttcttattcaacttttattttaagttcagggataaaagtgcagggttgttacataggtaaacatgtgtcatgggggtttgttgtgcagattatttcatcacccaggtattaagcctagtactcattagttatttttcctgatgctgtctctcttcccatcctccaaccctgatgggccccagtgtgtgttgttcccctcgatgtgtccatgtgttctcatcatttagctcccacttataagtgagaacatgcgatatttggttttctgttcttgtgttagtttgctgagaataatggcctccagctccatccatgttcctgcaaatgcacatgtcatgtgacacaatcgtgatgtaatctatggtcttgcatatttacattacaccaccaggtaaatcagcacgagggaggtgaagactattctgaatctgttttacacagggacagctagcaataaaatacacagaaatgactccataccacataaataaatcccatggaacccaaactcaatgactcaattcttcttttgctggatcctcaaaatgcccacatccactccaccaccacccaacatgagggcagaaagagatcagaattttagccaattacagctaaaatgtctgcttttgtcaaaagcaaatgaccaaatggatacattgccagggcccctccagagcctcagaaagggcctgctgaagttgccttttgctatgggatgaatcaaaccaaaacacagtggcttaaaataagatgaattattttatttctgaattctgaaggtctgctgggcttggccaggtgattctcattcttgtggtctcttatgaggtcagtggtggctagggctgaaaccatctcaaagccttcctcactcacatctcatgggtgatcccagctgttgctggaacctcatctgggactatcggccaaaacactcagaacttctccatgtgtctgggcttcctagaagacactgttcaagtagagggcaagacaatcaagaatctcaagctctatttcaaaacatttcttcccactccactactgctctatatatttttcacaatactttataccttctaacgtaatagttattatagaggtacacgtatgtcttactataacataaactccatgagggaagatatttttagttttgctcaatgaaatatccccagtgccaaggaagcactgccctacacattcatccaaatagtaaaataataaatatctatttttaaacactttgttaattctgcacacatttactttttctaaagggagaaatgtggaacactgaaaagctccttgaatcttagaatttgtttttaattaatagacttaatacatggcataacatgttgtactcaacttactcttcatgcaacgtgtaagcataaatgccaaagatcttactttcaagcatcagcattaatatagcaagttaggaaggtagacggtttggtaattacaaaagctcttgaagtaggcaaaaaccattgttttacatggtagccaagatcacactaatgataagtatttctggcttaaccagtcctcacagcaatatgctaaattaatgaaaacaaacatgggcattgtttgggtgttactgacatcaactacaaaacagaaatgaacagaaattgaaaactatattgtcaaatacaattaaaatagccaaatacatttctaggtaaaatctttataacttcaaatactgccagttttctttcaaaaacttacagtacttgaaagaacgaaaatcagcttaatccagcacaggggaaagaaacacatgagataactgaattttacaaccaaggtcagagaggatatcacactatcaccgtgggaggaagggtgagtgggtagaaatacctgttattggtttttaagtagatcatagccaaagctagagtagcacctggacaagtcacatccacatttatggtatctccttcctattgaaagaagagtttatgcatgtaaaagagttctaaatttttataaaattcctctgataagtatgcttaaaattaacatatttaccaatgtcaggatgaacactagtattttccaattaacttcccagcttccagacttttgatctattactttgctgtgtacttactttgatttgataacttggtgatttatgtttctccctatgcattcctgtttgaaagcgcctatgtcctccaaccatgtactgatagagctgctcaggcacattgagatcagacatacctatcaaattgctgccgtgctggaaaagacaataacagacgagtgaaaagaaattttatggaggaagatccataacacatacccataacaaatataaaaatgaactaacttcaaagcaggttatttcgggttttgttttttttatttccaacttaaagcaaacattaatcatgagttaataaatattaataattctcataaaagttttaatacatgaatgttcaactttaagtactgtcttaaaatacataagagctttagagttagttacatttaacaataaagaaaaatattagttatataattgaaacctgaactgtaaatatctgaatactttcattattgtacttaagaacttttccaacaataactatgataataatagtaatttattaaatgcatgctctgtgtcaggcactattctgtgtgtttaacatgaatgaacagccatatcaaatagctactattaaaaccctattttataaataaggaaagtgtggcaaagagggattaagcccaaggttatacagctattatagtaagttgcagggctatatataaaacacggccatctggttcaacaatccatgaagctgattaagcaatagacaataatgtagttaaatgacttgactcactagttaggaccagaattcaagttgcaattccctgtgtgattcctttcttttttttttgagacggagtctcgccttcttgcccaggctggagtgcagtggcacgatctcgactctctgcaagctccgcctcctgggttcacaccattctcctgcctcagcctcccgagtagctggaactacaagcgcccaccaccatgcctggctaattttttttgtatttttagtagagacggggtttcaccgtgttagacaggatggtctggatctcctgacctcgtgatccgcccatctcggcctcccaaagtgctgggattacaggcatgagccaccacacccagctgattattttccattataccaccagcctctttagctcacgtgccaatgtgaattcaaggccctaatagatggtcaaccacgaggtggattttcagaacacacatgagaaaaaattccttccactacaacttttttttttaagatggagtctcactcttgttgcccaggctggagtgcaatggtgtgatcttgattcatcacaacctctgcctcctgggttcaagcgattgtcctgcctcagcctcccgagtagctgggattacaggcatgcgccaccacacctggctaattctgtatttttagtagagatggggtttctccatgttggtcaggttggtctcgaacccctgatctcaggtgatccgatcaccttgccttataactttctttatatcatttagtttgaccataagaatgtattggtggtttttcaaggggaaccacatttcaagtgaaacaatcatttaatgaaacatttctggtaattctgtacacatctcttggatggagttaaagatgggtcaatctgatactgcattttgtcacaaggaagatgctactgggacaacattctgggatacacagtgaacatcactatggcaaaagggggttagggtttgtttcaagcagctactatagactcttaaggctcctgatcatatacattttcactattctctgttttcagtcatagtgggctgtcacttattcattctatgtcttgaacactttaaaaaaaaaactttattccctttagtttgttcatgaacactgtaagctggaggaaaagaaatcttaaagtctcactcttgaccacagtttctctcaatttgcaaatctggtaccttgaaaaatatccaaaaagacaagagagctgggcagaagattaagtcgtagtaagggacaatattcaggtttaggtgtcaacgttatttgtctcaacatgtagatgtcctaactgaagcatgggaaggcataggctatgcttacccccaagcagaccatgcccagggccaagccagcagctaaggagtatgactttctgtcagtgcagtattccatttcaggaccaggaggccgtcctgtaaaaacaaaagcaacacagttcaaactagcttctcaaaatctcatctcataaaaatcttagagttaactttctagcaagttgcactggagatacgaatgggatataactattcagaaagttatgacactataataaatgatgtccacaactgtaggtttacctaccaaaaaaaaagggcccaaaatagttctttttaaattgccaatttaagtctttataagcaatgatattcaaatactgtgaaactttgagtcttatcaaaaaaattaccaagtagtagaaaaaaattttaaaggaaaaaaggtaagagtattcaaaaaaaagttttattattttttttaaaacatctcggccaggtgtgctggctcatgcctgtaatcccagcactttgggaggctgaggcaggtggatcacttgaggtcaggagttggagaccagatggccaacatggtgaaaccctgtctctactaaaaatacaaaaattagccagggtggcaggtgcctgtaatcccagctactcgggaggctgaggcaggagaatcgcttgaacctgggaggcggaggttgcagtgagccaaaatcaggtcactgcactccagcctgggcgacagagtgagacaccatctcagcaacaacaacaacaaaatatcttacattttgttttcattactttcaaatccacacatcacatgtggtgaaacatgttcgaatgatgataatgaataaggaggtcacttacttacgttgttaagctgttaaatactatgtttagacatttatttcgagtgtatataataatgagccctactatggtagaatttctgtgtactgatcctagaagtctgactggatacaaaattcacacttttaaaagcaccctataactctaacactaccttgttgaaaacgacaaaatgtactatgtattaaaacccttccctctgaaaaaatgttcacattcctgaaattttatccctataggaaaaaaatgcaatttaaaaaaaaagaaaaaaggctgggcgtggtggcccttgcctgtaatcccagcactttgggaggccaaggcaggtggatcacttgaggtcaacgagttcgagaccagcctgtctgacatggagaaatcccatctctactaaaactacaaaaattagccaggcatgctgacagacacctgtaatcccagctacttggtaggctgaggcaggagaattgcttgaacctgggaggcagaggctgcagtgaaccgagatcgcgccactccgctccagcctgggtgacagagcgagactctgtctctaaataaataaataaataataaaaattaaagaaaaaatcacacacaaaggtaatcagtgtaatgtttatacataacaacaaaggattattagaaacaatctaaaaggttctaaaagttaaaaaaaggcattttacagaccatcaactcaatgaatattatacaaaatgtgttttaaaacccatttataacaatgatctataaaaacaatttttaggctgggcacggtggctcacgcctgcaatcccagcactttgggaggctgagacaggcggatcacaaggtcaggagatccagactatcctggctaacaccatgaaaccctgtctctactaaaaatacacaataattagccaggcgtagtggcgggcgcctgtagtcccagctactcggaaggctgaggcaggagaatggcgtgaacccgggaggcggagcttgcaatgagccaagattgcaccactatactccaggctgggcaacagagcaagactctctcaaaaaaaaaaaaaattttttttaatgtacattctgacagtaattatataaaaaggcatatacatatgaattaaagatgaaatcttctatatacagtgtgaaagaggtatgccgcagctgtgagactgtgcaatgacaccattagacatcatcatgatatagccaaagaagggtagactactttgcagatgaacatgctttaacaaccagtgttgaatattttcagaataagcgtttttcagatctctgacttatgctaccatgtattgtgatagccaaaacatttcaactttgggaataatttcatttatcattatagtagactaaattatgggtcccaatcttcactggttctctcctaggtttctatcaacaccacgagagaaacacaccctccagcctgggtcccagaatgaggcaggtgaggcagaacggcagcagaacagccggctacacatctacagcctaaagcagagctgcctgggccaatgctatgcctgtatgtatgtagcatcactgtggcaatagctatctgatacaatgatactaaagaataatacatctttaacaatatattcacaaatccatatagaaaagatcttgaataggacatataagtatgtaactaaattgttgagcatattaataatgccaatagcatttccatttggcagaaaaagatgacaacacattaagatttccaaaaagtttggacccaataaaaaacagagacaatgttcactaaagtgagtgtgtggaccttaccatttccaggttcatcaccaacatacccaccagcatgtaaaggaggaaagcaggagtccattacttgacttctattggaagtgctgttatccaacacagtaaacactgtgatgtgtttagtttagtgtctctcagggaccaaaacaatctactctgagttttaagtgcaggccactgctagacactgctggtaaagccggataaacagcatactcatagctgattaaaaccacaggtacctcattaaatgtgaccactggaattcagtaatgagctagcaaataaacatggaggttaataacctgcagttacattagccttggataacattacttagagttttgttgttttttttaattagtactagatcattctttgctcacaaaagctaccattgtctttccttaatttttataattttactatttaattgggttaatgtggagtggagagtacatgcctatgaagattcagcactattaatcccatacctatctcagccaacaggacttctgcagtatgtctgtgagctgtcccttgatatacaaggccaatgccaaccactgcagccacttggacattgtgaggaacatccagctctgtggacgttgggggtaagagagcaggaatgcgaatgctaagaagccgagtaatagacatatccatggtgcctagttttgcagcagaaacaccaagtagcagtccaatgcttgtcatttcatggccctaagatagaaacaaaacaaatacatagtttaaaataaaatactgcctgccactttcaagaagtacttttatgttgacaggcaaggtgagaggcactgagaatacagcagtaaactaaacaaacatggtccttgctctcatggacctaatgacttaataggaaaaaaagtgttaaattaaaaaacataaacaaatatattattaaaaagtagtacaataagaaagtacaaagtattatgaaagagtattttaaaatagcttaatttagattgggagggactagaggattattagggatgaaatctctaaagattatacaaagaaatttatattaggacctgaaggatgaaaacaaattagccaggaacagtggcaggaaagaggacactcaagtttagaaggtgaggaagactgtttcaggtgataaaacagcatgtaaataaatggctctgaggcgattcagaaatgaaccctcacattaacatcaactgaccacaagggtgccaagacaattcaacaggtaaagggcagtcttcaaaaaacagtgctgggacaagtggaaggacacattcaaaagaatgaggctggactcaacacaatataacaagtgttggcaaaaatatggagagattggaactctcatgtattgctgatggggttgtataatggtgcagtcattatggaaaacagtttacagttcctcaaaaagtttaacagagttaccatataacccagcaattccactcctaagtatgtaccactacttaccattacttcattactcttgagtaatgaaaacatacatccgcacaaaaacatgtatacaaatgttcatagcagtattattcgtaatagctaaaaagtacaaataacccaaatgttcatcaacttatgaataaaatgtacattcataaaataaaacatttattcaacaataaaaaggaatgtattgctgatagatggtacaacatggatgaaccctaaaattatcaggctaagtgaaagaagcccatcctaaaataccatattttgtatgactccgttcatatgaaaggtccagaaaaggcaaacccatagacacggaaagtagattagtggttggcaggaagtgaagtgaaggtgggggggtgaggtagaggaatggggagtcaccactagtgggtacaaggttcctttatggggtgaaaagatgttctaaaattaacagtggtgatggatgcacaactctgtgaatgtactaaaaaccactgtaccacacactttaaacagtgaattgtatggtatgtgaattttatatatttatataaataaagattccttaaaaaaaaaataacgctgtgaagtgaaagagtttagtttgccagagagctaaaatagccaatctgtatggttagagtgtgggggagcaagaagagtggggctgggtgcagaggctcacgcctataatcccagcactttgggaggctgaagcgggcagatcacctgagatcaggagttcaagaccagcctggccaacatggtgaaaccctgtttccatcaaaaatacaaaaattacgcaggtgtggtagtgtgcacctgtaatcccagctactcagaaggctgaggcaggagaattgcttgaacctgggaggtagaggttgcagtgagacgagatcacaccactgcactccagcctaggtgacagggtgagactccacatcaaaaaaaaaaaaaaaaaaaaaaaaaaaacgaagaacagtggtaccacctagggctggagaagtgaacaggatcacaccagctcctagaatgtatattaagagcaatggtcgatccccctttgccctctggtgttgggaattttggccttgttctaaaccagtttcccttcacagaagttcagccatcgtgtgggatcagaataaggtcctggggcaactaaaggtatctggccaagggtacatccgaaggaccctacaccggcccccagtccccaacagcctgttcaggtgtcggacaaagacttccaatctttcctatcatgtttttcctactgctcttctgagaaatgttacttagttatgtgtctctttgagaaattgcttcttttcagggcaggatgctgggttatgcttgatgaagctaaataaactgccagccagatgagaattatagacaaataatatgcagggacccccccggattcatcttagtcttgagctcatatagaattcagagaaatcaaaggcagttgacaaggagggtcaaggctgagtgcaagtgaacgcaactactcctgctggcttgatccccccctggtcatgaatggtggctgcgcgcacatccacgaccaaggtaagcctgagagacgccttggactctagcacagcagagggaaagactaaggatgcctttttctcccctctctctttctaaatgggtagcctgcactcctctcaagtgcgagacattgggactcctttgatcctcagactctgaagaaaaaatacctggtatttatcagtagcaaggcttggcccagctagaagttggaagatggggagacctagtcagctggggaaaataacaactataatactatcctatagctagatctcttcaaccacagagaaggaaaatggtccaaaattccatatgtataggccttttttgccctgcagaataaccgcaagctctgtcagcaatgtataatagaccttgcacttatagcagtgatatccagccagacttaatccagacagaagggaaaaaacagtctgcctccttagaagaggagacagaggcccctgcaccagcccaggtcccagctcctcttggatcatctcgtcccccttatccaggcccccttttgaacctcatcctgttagaagagttcgacctggatgcgctccagcatcacttcttcctttacaggaaatgcatagtgaatatggtcctatcaaagtacaagtccccttttctttacaagatttgaggcagataaaaagaaatctaggacaattgtgtcgacctggataggtatattgaagcctttcagaaccttaatcaaatgtctgagctttcatggaagggtatcatgttacttctcaactagactcttagagcttcagagaagcaggcggctttacaggtcactgagacatttggagatgaaatgtttatcttattatggcacctaccaaaagggggaagaaattagggagccctttctgacagccaagcaggcagcatccaccaataatcctcaatgggactcagacactgctctaggaaagtggccgagaaaacatttttagggatgcacagtggaagatctgaaaactagaggcaaatctctcaattacattaagttatcaaccataaaccaagggtctgaagagaacccttctgttttcctggaaaaaactgagagaggctttaattaaacacacatctctctcctgactctataaaaggatagttaattttgaaagacaagtttataacccaagcagccccaaatattggaagaatgctgcaaaaagttagctattgcaccagacagtactctaaagaaaatcctgaaagtcaccaccttggtcttttataatcgggaccatgaggaagcccaagaaaaagggagaaaaggaacgagaaaaaggcagaggcactaatagctgccatacaggcatataaacctctcgatcccagggagcttctcattctatgaccgactgttatcagtgtgggagcactaaaagagagtctgcccccgaaatcagaagcagcccccacggccctgtccaatctgtaagggagactactggaagacaaactgcctccagaaacatacgtcccaaggttcagagccggcttctcaaatggtccagcaggactgatgggtcccagggctctcctccccagctctgacagcccaggctgcattaccatccaggagtcccgggtgagtctggaggtcaaaggactcagaggacagacttcctactcaacaccagagcagccattcctgttctcctctccattctgggcctcccctcctcccttagcacaactgtgaggggcgtctcaggaaagcctctgactcgatatttttctcaatcccttagctgtacctagggagacctttcgtttacctatgcctttttaatcatacctgaaagcccgactcctctgaggtagggatattttagctcacatgggaaccaccatccttatggctccaggacagactctttgcctccctctggtggagactgatattaatccaggtgtttgggcaattcaggaaaatactggctgagctacaacagtctcaccagtccaaatccatctcagggatctcatctccttccctaattaaagacaatatcccctaaaaccagaagctaggaaacaactagaagccatcattaataacctaaggatgcagggccttgttaaaccctgtgacagtccttgtaatatcctaatattggaagtacagaaagaaacccaacagggaatggagactggtccaggatctccacctccttaatgagtaactggtgtaattaaccaatttacccagtggttcccaatccctatactttgttaacttagatacctgaaggaactaaatggtttgcattcttggaattaaaagatgctttttttctgcataccattataccccaactcccaaaacttgtttgcattcagggatccctccaaccagactacccagctaacctggatggtgttaccacagggattccaagacagcccccacctgtttgggcaggcaatctcaaaaagatctctctgagttctttcaaactcaagttagtcttaatatgtagattacactctactctgtgccccaactgaggaaatttctcagaaaagcaataaggctcttcttaattttctaactgacagaggacataaagtttcaaagtccaaggctcaactccgtcagacttcagtgaagtacctatgcctggtcttgtcagaagggaccaggacactgggcgaggagagaattggatccattttctccttccttctccccaagaccctcagctaactaaagggattatcaggcattactggattctgcagcctatggatcagaaatctaattaaaagcattgcaatgcctaattataacatatctaataatctagggggacatgcccatgacaaccctattttgcaaaatcctggaatagaacagtccattttcagaggttttcttcctgtcctttctaggtgtccctaatatatgggcatggattttcccccttttagttcctctttgtgttctcattgtaatactcatatttggtccatgtgtacttaacctccttgtaaaatttgttttttctcgcctagaggccatcaaactccaagtggtcatgcaaatggaacctcggttgatggctctcttttaccaggggacacttagataggcctctaagagagacctgactgctgtttcccaaaacaacaccctctgtcagcatgaagcagaacagtcatcacccctatccgaacagcagttagatatacctcttcagagcggggattgatggcggtaggaggcaggtaaattctcagatgaaactcaaccttcaagccaaggacagtcgaaagcctgaaaaccaagctacaagttctggataaatccatggactagagagctctcattcctgtttggcatgctctctcctgattggtccttatccttcacctactttacatatacctgcccttccccagttggtcctctacactatcgtgcctatttctaaatggtgctttttcaagcatacccacagaccaatcagcatgcacttcccccatttcaagcccataaaaacctctagactcagcctcgtggctggcaacccaccttcgggtcccctctcgctgttgagagctttcttgtcactcattaaattctactctgccttactcagggaaaaaaaaaaaaaaaaaaagcaatgggagatcattaattaaatggctttgaccagggaagtgacatactctgatttatgctttagaaagattattccatgtactatgagacaaatggacttagaagtacaagaatgaagaaagaagagcaaatagagcaattaggagctactacaatagccagccaaggcacaaagccaggcactgggagcacaggtctcaccttggtcaagtagtcatggatattgagagtcgccagcttggtaaggtgcccattcaaacccagagccatgagaaagccagcatactcattggccaactcagcatgcttgggcttattgtaaacaatccaagctgagtcgatctgggaggcaggagctatcttcaggccagcagccacaccattatgaaagctggcccagcttgtcatgttgggaggcacatcgatgtttccactattaaggtctactgttgtgttccgaggaggggcacgccctatccagccaaacgaagaacattgagagaataaaaatccacaaaaccaagattgttaaatttagatctttgagactaagattacttacgttttctacattcaaaaccattaaccccataatgcctggaacgttaggtctctatgaccacttaaaacttttgtacatgtgagtcaaacttaatggaactggaaaaaccttcactgtctaaacagttcattgtcctttttgttaaaatgtatgaggctatataatgagataactgataccaatttaacattatacagagatgactgggataatcactcattttttctttcaaacagagagcttaaaaaccaaagtgaagactaacatcactgttaaactatacaagttataaatcccaacatctgatgacactgatgttaatttcaaatgttctatcctatattttcccctagacattaaggaaaaatgacatcttaagaaaagacaaaagccaggcctggtggtgcgtgcctgtcccagctacttgggaggctaaggcatgagaatcacttgaacctgggaggcagaggttgcagtgagccaagatcatgccattgcactcccacctgggcagcagacagagactgcatctcaaaaaagaaaaaaaaaaaggaaacaagaaccttaataaatctgctacaggtcttacctatatatgcccccttctctctctttttttctctctctctctatatatacatacagatatagatatctaattatatgctatcgtttaaaatgcttagagatagttttgtaaaaagcatccttttatagacttgagtcacccagggaacttcaaaagggcattcaccagattatacttttacggtccatttatttaagaacaatgtaaattatatgttcacaatgctatatgttccctacgaattttttcttgattcttttctttttgatctacattatacacagcaaacattgaatctttttaaatatattttgaatattgtcttaagtcatggataaaataattaacataaatattttaattactgcataaagttatccatttcactgcagctttaaaaataccatttttaaagagttctaagatgttatgtaaaataaattttaagtagatgcaaagtgtcttatttgtagcatgtacacatacacacacaaagcacaaagtaagacttatttgtctttactatatgctttttgtacctaaaagctaactcaactgctagtgttagcaccacaatgagtaataagttcataagttacacttgtactttctcaaaaaaggcagacatatcaatatgaaaaaactgagtgacctttctgaaacattcattcatcatatgcaagagacataatatttatacacgagagaaaataaaatgcaaagggtaaggtaaattttcttcaatgagaataacaacatacaaaagtacaacaggccacatcagtgtgggttaagcaactatttaagaaaatattctttcctaaattaagaggataacctttctttttggcctaccagaatgactaaaagaataaaatgttggattaatgtcataaacacattttaaatcatgcaaattcaattaaatgtattcagaaaaaaagatgcatgtatatattttttaaacccacccaagtatcacttgagtgctaaatcacccagattgaatacattttaacatttgccaattttgcattagattttctttttaatctgcacttagtatatgaaatctttcatataaacagttggaaagactactaaaatgaacatctatataccatgccttccatcaagaatcaataattgttaaaattttgccataggtgctttacctctgagacaatttaaatattaaaagccactctgctcactatgtccctcagtgagattagggctcagaataagcatggtatggagatgggaatgtgttctttcacttagtcaatctcatttcctgcatgctgctcaaagcacaagcttttcacaaatctgagtggaactctggattttttaaagtatgcaatttaaaatactgtataattatgtttgcatatattatgtactatttatcatatattaaattatacattatatgctaccacatatactatacactactacaacatacattatacatacattttgtataggtttcacaaaaccatatatactataatagagtttcagtgataatttcaactatgtaattgtcacctttagaacacattcaaatcagcattagggggacatgcactataaaattcattgtaatcaagattataactacagttatatatggcagaaataaaaacttgtgccagccagaaaggcaatttgacatgttccttaaaaccattcatcttgctgtcctaagagttctacttctaagcatttagcctaaatacacaggacgaatacgccccaacaatgtttataataccaaaaaactgtaatttccaacaataccaggctgcttctataaactatggtatatccgctgaatgaaatactctgaagcaaataaaaatgaatgtattgattaaaaacacgtgtatacaatacatacacataattataaacacatacatttatttgctagatataaaaggatgttcactgtaaatttttaaaaaaatctaaaatagatataaattttctgataattaaacaaatataaaattataaatatgtggaaataaacttagtaaacatatatactaaaatgttaaaaggagtgatgcagaagagtgggagtactgcaagtgaccattgtttctctttttgcttagtacatttcttgatttatacaatgatcatctgtttaaactatgacgtaagacattttaaaactaaatatttttacatattaaacttaagattatttaaaattcaagtctcatcgttatcaataatatctttctgaacttctccaagtgactttttagatcttgaaatcacctcattaaaaagcaaaaatgagtaatgaactatattctgcttctctcaaagtttagtttcacatggcatttgagctttgataaccactacagcagctattaggaaaattttaaatcactggggatagagggagcatttcttttgttttaactaatttaaagaactacacttaatgcatgtacttaatcattttcctttctcattgagcccagaatttaacataccagtcagattcaatttaggaataggcaatggctctgttggaacaggatggtacgaaaacaaggtaaacattcctcgtcctacaggaagagccatagttcgctgacacaattggagcaatctgtaattaaagtaaaaaccaacatgtgaaaatgtttaaagcaaagagcaattgaaatatcatctgtaagtatttcaaaagaaggtgtactgtataagatgaagttgtctcaaagtaaattcatacacagatgtgagtgaactacccaaacatgattattttcattttaatattcttgttcctattacactcttagggagagacatatttcctctgttttgtttcatatttacattgaatgaaaaccacctggcctataaaccaagccgactctctctaggcattcaaaaaaaaaaaagaaatttaaaattccactccgatggatgctaaccttctcaaaggaaaatacagtacttttggggtttttatcactgtgttaatttcagtctagctgtcctcagtacatgtgggatcctcctcccatcccttttgccaatacagcctcagaagtaccatttctgtggcctgtacacaagaaaagaaacaaggtccttgtgttagaggtgaatggatttcatggtgtctccaagggaaatacagattggtttcacttacatgatggctagatttataggactaataccattatgtatcaggtatgttcaaggttaaaatggtttctgttggctctactgtgaaattaatacaccactcttcaacttcttcctatgttaaaatagcttaacattccatatagccacttaaaaaaaactaacagaaattttggaagtagggcatttataactaagaaacgcctatacaagctatatctgaagacacagaaatatcccttcagaggctgacaactgacaaacattttctctgcagacaaagctattcataagcatacaccctccttaactggacacacataactgcttttctagctaactggaaagaaaaattttgctgtcttaaagattctctgggaacacaaccgcaacattaatttgggatcaggaaaattcaaagccaagagtctgttgcaacccatagaatttttttagaggaaatcttacacataattcacttcaactttgcacaagtaacaaaattataatgagaacaatattatatcccctgaatataagatgccactcataagatgtatcattatttcatgagaaactaagaaagaaaaagcactgccaattaaactatgacgcctgttcactgaaatacacaactgatttcagagatattaaaaagtgaaaaaacttgcatcttagaatcaatgaactctactactaataatggctgactgcactgagctttactatgtattgagcagtattctaagtgctatgtaaaaataattcacttgatacacagcaccatcccatgaagtatgcctacttttacaaatgaagaaactgaggcaacaagaggtaaagtaatttaaccaaagtcacccagcacagcatggccatgcctggctctagaggccatgctcataaatcctatgctctaaactcaacttctgtcactccatctttttattcacaggtgactaataactgggtacatgtggagaggaaacagttaatagggaaatcacaactaattcagatcttcagcagcctgtggctaagtgtgggtgatggttcccctcaaaacagtaccataaaaaaagtaaagagaactagaaaacagtggcagatgaatgatagatgatagagacaagcagataaaagaacaggagagaattttaaaacagaagtgtcccaagagaatagctctggaatgtcataggcatgtgagtcttataatgtatcaagggatgtatcctgtgcaggggagtggcagaagaaaggcttatctatttttatttggagtatcatctatcatatccaaaaaaaaaaaaatactcatataagtttaaactacactaaaaaccccactaacctcaaaatctattcctgatcaagacacagaaaaacaagtccagtgttttctttgtttgtaaattcttaaggtaactatcaggcaaaatagttttacattcaccttttctaaagagtaaagtgttatatgtatttcaagaggaggacgatatgaaatacaacaattacgtcctcaaaagccaaagacattttgctaacacacgtggtttgttgaagttggatgaaaacttaaaacacagggcatattttcacttgaaagtatcttttaaatctctttagggttttaagtgctaaaaacttgaaggaaaaacaaatatacacaagacacaaatgtaacaatgaaacatgacaagagatagtgcacgtgttttctttcacctgttttccttttcctcgatgaactcgtggtcactgagctctgggtactgcactacattgacacggacaggatgcgcactctgaagaagccttcgcacatcctgcacccttaaatcttcactccatattaatgacatgacctcgtgattcatgtcattcatgccgtcatcttcctcctcagtttctgttcctgaaggaacatctgatgagagcacctgagtaacagactttattgtaataataatttcaaaagcagttaacatgcacttgctgaacatgaggatatataggctgatgtgtcatgactatactagcacagagaaaatatgttttccaaagcaggcatgggttggagccgcaatgtatactgggactctaatctacaaatctttctaaaaagtactatattgctggccgggtgtggtggctcacactctgtaatcccagcactttgggaggccgaggtgggcggatcacccgaggccaggggttccagaccagcctggccaacatggtgaaacccggtctctactaaaaatacaaaaattagctagccagacacagtggcgcacgcctgtagtcccagctactggggaggctgaggctggagaatcacttgaacgcgggaggcaaaggttgcagtgagccgagatcgtgccactgtactccagcctgggtgacagagtgagattctgtctcaaacaaacaaacaaacaaaacaaacaaacaaacaaaagtactacattgcctacttggaaatatttggaaatgacggggagagtttaaatttaggacaacagtcaaggggctggatacaaacagagaaatattctgaataaactataaaaaaaaatctaactcatcctgatcattttaaaaaagaaattattgcaagtagaatatgaatactagtcactgctaataatgctaatttaaatattgtctgttcattaatagaaggagaaggaaaaaagcctgaaaggatatacaccaagggttgggggaagtcacacaatgaaatactttcttactttactacttttaatagacaggatcatggttggatttcattattaagtttttttttttttttgagacagggtcttactctgtcactcaggctggagtacagtggtgtgatcatggctccctgcaacctccacctcttggactcaagcgatctttcaaccttagcctcccgagtagctgggactacatatgtgcactggccacccagctaattttttttattttttgtagagacagagtcttgccctgttggccaggctggtcttgaactcatgacctcaaggagatccacccacctcagcctcccaaatagctaggactacaggcacataccaccacacctggctaaattttttaaaaaattgtttaagtagagatgaggtctcactatgttgcctaggctggtctcaaactcctgggctcaagcagtcctccgccttggccaccccaaagtgctgagattacaggcatgcgccaccacacccagccagttttcactattttttaaaaaatgtgtttccaataaaaatttcttagaaggaaaagtactgaactgcagcgaaacaagtaagagggtaaattccttgattgtcatcatgttctaagcccagcatgtgctttaatatggggcttcccagtccaaataattaaatctaactgcaacacagatgtgaattgcatggaatcatatcatattctctcaaaaacagtattatactcttttaacaaaagaataactccaagttgaaatgttaaagttttgcaacatttaatgtgaaaccaacaaggtcagcctgaaaaaaaagtagatacgaccaaataatcacttttagttcctaaaaattcatttttagttcctacaaaatatctaatttaaaaaaaaaactgtattctaatgggtgagttagctataaaacatagtctcaaacagtgacaaaataaatttagatgggattaattataaaatgtagcctcaaataactgaacaaactgtatttagacataattacttaaaatcacgttcaaatacagattaatgttttaatgctaatggtgctgaactgctctctctcacaggaaaatcattttataagcaaaaagatttgttttctgtttaaaacaggatgtaaatactaattcaacgaagagctgtgatagaggcgcagattaaaggagagagatgctgggatgaccctgctggagatcagatgcccatggaaactgactccggcatgggtacacattaggcaactctgaggttaggaataagttttgatataggctctgaagaagtagtaataagacctaaggtgactcgtagttacaatgtactgattattatgtattgattcaaaagctactaagaggcaaggccaaattcccactgtcttctcagggacatgaacataaaagagtcaccaggagtggaattattattcctgaatcctccttgatgagattctactgttcattttttaaagttacctagaattctagaataagttttaaaagtttcattttcaagttttgaggatgatttaaaaagataattggagagtaatgaaataatttaactttctacttgcaggattcctagaactcatttaaaaaaaaaaacagacttgatgactgatgaaagacagtatttcgggagggatagcttaagacatgtttttaaacaactctactgaaaaaaacacattttttccctggggctgcagttttatgtgattaaacaaatatgtttacacctatttaaaaggttaaattcaaaaaattcaacacatcaaaaaatatgcagtagaaaatacttatatataattactcatccaaattcaggatatatgtgctctcccttttcctatgtaataattacaaagtggttaattactaatatggtacaagtagggaaatagccatggtagtttccatgactaccctcaggacttgtcctgattcaaggcaaagaaagatccaggcacaagacagaacattcacaaaatctcctgctcctaatgctcatcttaacaattaataagacgcgtacaattacaaaccccgtctggcatataatataaaagacaagctaatatatatacttagaaaaagccttaaaggaaaatgaagaacatttctactttatgattttatttaaggctaaaattggaactctgaactttctatgttgatactcacagacttccctttgggtaagtttccttcgcaggcctgcttggaaagatcctgacgtccaatcaagagacagacagcttctggccagtctgaggcaggctgttcacgacagtgataaattgcatctctgatgggaagagcaattccaaagggaagagtttccaaatctcttaaagtgaatcctaatggttaaaggaagagagaaaaattttaatttagactcgccactgtcccaattatcctgactgaagttggcaacaatatctatcctgacaaataagttcattttattcatcttactaccagactaatgtcttgacatcaaggactagtataggaagtctctttgaaagaacttgtaaaaacctgaagaaaaaaagacaatctaatagaaaaatataaaggacaaaaagacatttcctagaaggggaaacataaatgggcaacatgcatatgaaaagatgctctacctaattagtgatcaggaaaatgcaaattaaagctactgagaaatataaatgtcaaagccaatcaatactaaatgttggcaactatgtagagcaataataattctttttattcttttttttttttttttttttgagatggagtctcgctctgtcgcccaggatggagtgcagtggcgcgatcttggctcactgcaagctcctcctcccgggttcacgccattctcctgcctcagcctcccgagtagctgggactacaggcgcccgccaccatgcccggctaattttttttgtaattttttttaagtagagacagggtttcaccgtattagccaggatggtctccatctcctgaccttgtgatccacaagagcagaagaagattctgatcatcatgacaggacaaaaaacataaactaggaaacagggacatacatggcatatatggtcaccctaccagctgcagaaagcataattggtgaattatttgcccaactgctccagatcctggtcagtagcccacacactagaattatagttgctgagcccatccccccttattccaagaatctctgattggctgccttggaagctttagctcttctcactgtcataccacctttggttctactgtccaaatgctgaccttctgttataactgcaggcagcctggtggtcaagcagatgtccccaagaacttcctggggttctctctgaactttgagccatttagaatcaccaggatgccttggtcactgtcaacatcaaaatgtgaatcttcttagacaccaccggtagttaccgtacctctagaggaactgagggttcttcacccacaaatgaagaccatctctaaagtgccccatcacattctagaaggatacagctgctggaagaaaataaagtgtcccaccaccactcccacagttcttaagctcatacacaccaacaaccactccaggaaccaactgaagacttcaaatatcatagtaccagagagggttgatgccaaacccacttctaaaactgtgttcactctcttggagttaccaaacaggcttcacaacctcaaagccatttcacaatctccccaaagtctcaatctccccacagtctccccagtcacaatctccccaaagtctgccttcccagactttgctggtgactgccatcactgacataacaacgtggctggaaccctgctgctgccaaaaccaccctccgactctctggccaagtcaaacccctcacaccactatgggagtagtgagaactctctgaaaggccactaacacttctgtaagccacaactaccaaaacaagtcctctgagcccatgccactcacagtcttgtcataccacacctaccagtgaacagtattgccttataagcatatagttctgactcaagcagcgtcaagcctagccttttcacaggataatttctaacagttgggtctacccatgagttacacgaaccactctccagattcaatgagcttctattacctctgttacaactatcactcttgtgagtacagactaagttaactcataagactgtttagaagatgcctttgctacaaagggcactcctcgaaagttcttcctaccctcccagacatttacgatgtgtgaagagaaatgccccaaccagtcacaatctccccaatgtttgaagtagtcagaggtatcacacagtaaccttgaactacttctcttaggtgccaataggactatgaactccatgaataaaatcagctggtactaaaaatggtaactgcttataagtcaaccaccaggtcaaagatggcttactcaaaaaatgtcacaagaaaaaaaacatcaaatcaaagtgaccagcctcactgcctagcaaccaacccactcactcattcacacagaaggcaaaattgaaaggtagctgggacgcccataggaagaaaacagttaggatgatgcaggggagactgatacaaggctgttattctaatcatcccataacagagacagagtcacagctagggaattattcaggaattaggaaaagttatttctggtaaacaaactcccacatactgggttaaaatttctttggaactttatttatcatgaccctaggagctctagtcatatatgcaaatggataaacaacaaagctataaaagcagagggttttaattttgcttttattttttaaataatagcaacaaggaactttagtaagaataacatagtaaaactagacctgtaaaagtcatcaaaagcaaacatgacaggaatagcataaagtaatttgtgaaagctagtattatcaaagcactgacagaagaaaaagaatgatgctaaaaaatacaaaacacttctttcaataccataccttatcaatggcttttccaacccgagaaacactgctgtggatgtctttgtggtcggaggccaatttttgaacagtatcctttattcttttacagcactgtgtcaaaacaagtcaaagtgtccctgataattcagcatcttggcctataaaaaaacaaaggaaggattggttactcacttaagcaaacccaaagatggcaagtttctaatgggccttttggaccatgaaagatggaagaaaagtgaagaaaaaccagtatctgctttgaagctgatggtcacattcatagatgtgatttttcaaatggatactcagaaagatataatttttttattttttggaaataagaaaattttactgtgaaaggaatcatttttatcattacaacaaccagcacaggctgtgaataatactgtcaaggcagtattatttttgagaaaatatgtctaagtgaataaactcacttattaaacccagttacactgttcaagtcattctcaaaacgttctggttgttactaaatttcctcaagagagatgatttagtgcaaatgcttcatattccatataaagaggtagaagaaaacaaacttccctgggtaccacgatgtgcagaaaggagttaacacagcaggtcatagactactacccttagaaagtcctgcttacaaagtcacctcttggctggcatatagaaacctgggagtttgggagtgttcccatcactccctaactcagtgttccccaacctttttggcactagggaccagtttcgtggaagacatttcttccacggacgagggctggggggaatggtttcaggatgaaactgttccacctcagatcaggcgttagttagattctcctaaggagcacgtgagccagatccctcgaatgtgcagttcacaacagggttcatgcccctatgagaatctaatgctgccgctgatctgacagtgggtggagctcaggcggcaatgctcgttcaccgctgcttgcctcctgctgtgcacggcctggttcctaacaggccacagaggggtactggtccatacccgggggtttggagacccctgccctagctgaaaagaatggctcattgtgcctaaactgttgtacagtgtgatttatggtgaacatctgctttccttctgggaatctagaatgttgatacatgctaggcagtgagtacctggctttctcctggcttggagaaagcttccaatagtcctctcccagtgaagtcacatggaatatgcttaattcctgcagccatggtttgtgagaagtgttaagtgttgcctaccagggaagctcattagaagctcagtgcccagggtttttattgggggctggtcaccagggcacccactgcctaactctggactgcctaactttggactttggacttctgccccatgagtcttttccctttggtgattttgctttacacccttttgctgtaataaattctagctaagagtatgattatatgctgaattgtgtgactccttttaatgaatcactggaacctaaaggtggttttgaagacccctgacacacatgagatcaaccaaaagttactacagtttacatcctttccctgagctacctccctccaaattttgttcctatagcaggaaaaaaaggaggagaagggagaaaaacagacagataaaacaaacccagttatggtatttgtcatttctctctctatctacgtattcccacctgtaagcaacaggcctggtttctgaaatcctaaccaacattatatagaagagcttcttgaattttaatttacatcagaatcacttaaagttaaaacaaagtagctggaccccatccccagagtttctcattcaataggtccgggatggaacctgagaatttaaacaaggagcccaagagtaaaacagccctaggatgcctgctcatttaaccaatatttattgagcactcactatatatgacaggtacagcagtgaaacaaaataaccaaaaatcccttcccaacaacttaacttctggcaagagacgtaacacacaaaataagcaaattatatactacgacaaaagatgatacatgctacctgggaaagaaaagcagggtaagagagatggggagtgtgtgtgggtggagcagccgcaacttcaaaacagtgctggcatggtaggcttcactgagtagatgacactggaggcaagacttgaaaaaagtgaaggaattaccatgtggctggctactttggggtaagcatgccaggctgcggggagaaaagccctactgcaaaaatacacctagactattcaaacaacaaagaggtcagcatgtcaaaagtggatttctggccaaggaaaatagaagaagaggtccaagagataatggtcctggtttggtaggatctctttggcattgtaaagacttatgcttttactttgactgaaagggaccactgcaaggttttgagcagagaaggcatgtaaactaattaaaaaaaaaacccacaaaaaacatttttttttttgagacagggtctcgctctgttgcccacactggagtgcagtggcacaatctgggctcactgcaacctctgcttcccgtgcttaagcaatcctcctacctcagcctcccaagtagcttggatgacaggcgcccaccaccacaccggataatttttgtattttttgcagagacagggcttcattatgttgcccaggctggtctcaaacttctgtgctgaagcaatcctcctgcctcggcctcccaaagtactcggattacaggcgtgagccaccatgcctggccgataaaacatttcaatatggtcagtctaactggcaacgggagtaccagaactgagcaggaaaataagaggctgtggcagcaatccagatgagaaatgacactggctcagtccaggatttcatgactggacatgagtgaagaaaaggactcacagatgtctccaagatttctagcctgggtcaactagaaagatggagttgtcttcagttaaaacaaaaacaatctcagcacttcaggaggccaaggcaggaggatcacttgagcacaggagtttgaaaccaaccttgggcaacagagtcagaccctgtctctacaaaacatacaaaaattagctgggcatggtggcacacgactgtggtcccagctacttgggaagctgaggtgcgaggatcacttcagcctgggacgtctcggctgcagggagctacagcactgcactccagcctgagtgacagagcgagacctcaactccccatcctgccaaaaaagaataaaggctaagcaggtatgaggggagaggagagagagaaagttcagtttggggcttgttaagtttgagacattgagtaggcaccgcagtgcataagtggaggagttggtgagatatacaaacctggagttcaacagcagtgttagtgctggagatacaaatttgtgagtcactgacattatatatatatatatatatatatatgatacttaatgcatgggactatatgaaatcaccaggggagtcagtacagacacagagaagtgataaaagaactgagtcttgagaactccaagtttatgaggctgggaagaaatagaactggaaaaggaggctaacaaagactactgaagcactaactgtgatggaggaggaaactcaagaaaagtataatgttggggaaaccaagagaagaaaatgtgtcaaggaaggaggagtaaccagctgtgttgatgtgctactaggtcaagtaagatggggactgagaattggccactggatttacaatgtggaagtaatcagtgacgatgacaagaatagtgtctctaaaattctatgaaaagaaatcctaaaaggttacagggaactgtgaagagggactatattaagtctggttcaatgacaactactgagataaatgaaaagataagaaaaaagctttccttatctctaaatacagttgcacaaagtttctatcaagtgtttccaacttccaataacacaattaggcttccaacttctaataacataatttaggctaaggcaagacttggtacttcaagaaaatttcaaaatctgtttaaaaggtgttccacagatttcttggaccaaaagcatctaattgcttcagcagctctgttctggccatttctgatctttctgtacctaaagcacacctaacctcaacagcctcatcttctctatgaacccatctgaccacagacttactccctcttctgaattcctggtaacttctgatctctcccctactcccccagcacttaattataacccattttaacaatttcatgtatatataccgtcatcagtctctactaaacataagcccccaagggaagaccaagtccttattataaattgtatactccagttttatattaatagtgcctgcaaatgtgcaagacatataagtatctgaattgatggtaaataaagtgaggaaaaaatagtttttgtttttgcttttgttagagccatattcaacaaatggtgctgagacaacaagatatccacatgcaaaagaatcacataatatataaaaactaattcaaatgagccaaatgcagtggctcaagcctgtaatacaagcactttgggagcccgaggtgggtggattgcttgagcccaggagtttgagactaacttgggcaacatggcagaactccatccctacaaagaatacaaaaattagcagggtgtggtggtgcacgcccacagtccaagcttctagggaggctgaggtgggaggactgcttgagcccagaaggtagaggctgcagtgaaccgtaagcatgtcactacactccagcctgggcaacagagtgagaccctgtctcaaaaaaataaaatcaaaaataaaaattaactcaaatggaataaagacctaaatgtaagagctgaaactatcaaattcttaaaagaaaacagatgcatttctgaccttgaattaggcaatggtttttcagctatgacaccacaagcacaagcaaccaaagaaaaaataattaaaatggacttcatcaaaattaaaaacttgtgttgcaaacactatcaataaagtgaaaagacaattcatagaaggggagcaaatatttgcaaatcacattctgataagggtttagtatccagaataatataaagaactcttaaagctcaacaataacaagacaaacaatgcaatttaaaaatgggcaaagcacaaggcacagttcacgcctgtaatcccagcactctgggaggccaaggcaggtgaaccacttgagcccaggagtttgagactagcctggacaacaaggcgagactctgtctctacaaaaaaaatacaaaaatgtggctgggcacagtggctcatgccagtagtcatagcaactagggaggccgaggcaagtggatcccttgagcccaggaggctgaggctgcagtgagctatgattgcgccactgcattccagcctggatgaaaaacaagaccctaactcaaaaaaaaaaggtcaaggatttgaatagacatttttcaaaagaagatatacaaatagccaacaggcacacaaaaagatgctcaatattattggtcattatgagatgaaaatcaaaactacaatgagatactacttcatgcccacaagattggctatcaggaaaacacaataataactgttggaaaggatgtggagaaattcaaagccttatccattgctagtggaatataaaatggtgcagacaccatagaaaacaatttggcagttcctcagaacgttaaacagttactatatgacccagaaattccactcctagttatatcctagttatatacccaaaagaacaacatgtccacacaaaaacctgaatcagaatgttcacagtagcattattcataagacaaaaactggtaagaaaccaaacctccaaagaatgaatggataaacaacggattatccagtcattaaaggaaatgaggtactgatacatactatgacatagatgaaccttgaaaatattacattaagtattcaataagccagacacaaaaggccacatattgtgtcatttcatttgcatggaaggtacagaatagacaaatctatagagacagacatagattaatggtatttggagtgggaggagacagggtgggaatggagagtgactgttaatgagtactggatttctttcagaaataaagaaaatgtttttaaaaagaagtcatacctcctatccatccagacacatttatttctacaaccagcagacaacaaggtaggaaaaacacaaaaaataaaaagggtgccaggtacgatggctcacgcctgtaattccagcactaaggaaggccgaggcaggcggatcacttgaggtcaggagtctgagaccagcctggccaatatggtgaaatcccatctctcctaaaaatacaaaaattagctgggcgtggtggtgagcacctgcaatcccagctactaaggaggctgaggcaagagaatagcttgaaccctggaggcagaggctgcagtaagccgagattgcgccactgcactgcagcctcggtgacagagcgagactcggtctcgaaaacaataataataaaaataaaaaaggatgaagccaagctggaggaaagaggtcacctagaatttaccactgaacttccacgcaccaaccttgaaatccaatgatattttcaaatcgtagtaacttacatatctggagtttggtgctatttgttacctccttttcttcctttaccatctacaaattcctctaatttttggttttcaattttatgaatgacagatacaagcagtttatggccaattaattaatactgagagttctcagaatgctccaaggaaaaataatttctgtaaggtatttggaaactcaagaaaagcagaatggaataatctgaaagagaaccctgggaaagccctgttaagagagaaagagttcactaatgcattttcaaatggactcagtggaaagcagccaaaggtttaaaacaggtttgaaaattgctataatgaccagactgacagtcaaccaaacttctataagtcctactgggagagttctaacgttcttttgatttctctgtatgaaaacacaacctgcttctaggagaacctttatgtgaaagaaactggattcagttcctagaagaaaagctggggaattactgtgacagccatctccaccataactacatccaggttggccactgcggtggtcacttgtcacccagaagaaagtcctgcactaactgtgtcttccaatgtagtaaacccagggaacccaggcccaatgcatgagcctgaaagaaacaactctgacgcaatgctcactcatcactggagggtcacaagtactttttaaagtcagttttatgattaaacaagtgtaagaattagcatgttcaatataagcaaagaacgaacatatgtagaccatctacgtgtgttgctttattaagttaaaattttcaataaaatagaacagcaccttttatcatataaacagattttaagcacgacactcaaaattttcaagttctgcccttgagcctcactgctttgccattttaggatgtatgcccactagtttcacagaaacaataaataagaaaaatgtttgtttccatagcatcctatacttccctatcagagtttcacactttgttgtaaatagttatttgtccattactcccacaaaattaactttagtaggaaatatgaccaatccccaacgtttagtatagtaactggcaaatactacacgttcagtaactagttaccaaaagaataaatatgaaaataattaattatgtattacataatctcaatttcaaacccagcattgaagactgtctggtactaccaacaccctctgaaattgccagcagtttcactcagcagttcactgacccctcactctctcacagaatgtttagcatctgctacacagtaacactgcagcctaagttctgcaaataccaagtaagttaggaaataatactgttcctgtctgtcaataacattattgcctaagtagaaaatcccaaagaatctacacacaaacacaatccaagaatagatgagagttcaacaaggtcacagtacccaagatcaacacaaacatacaaacacacatatgcacacatattttcaaataagacacattcacaaaagagtcccctggcatcagttataagttccttctctcttccaaataatgacctctcccaccaaccccaggaattaatgggcttgtgctctgactcaagtcacttttgagacagtttcttttttacaaaactatttccacatttgtcaaagatgcaatgaaacatctctaatatataatgtgaccctataaaagtatattctaagtcagatataggaaggtataacaaacgtacacattaaaagggtgactggtttgcacaaagctaaaaactataaaatccctactaataccttggttacaccttcaatacacttttagcattttgtacatacatttgttttactttcttccctactgatcacaagcctcaaaaaaaagcacgtctcgtgtccagctccgtgacaagatttacccactattttggctcaccttaatacaatctagacaaatatatcattaatattgacaagtacgtttctcatccctactcagtatctgcacttttaattttctgtctgccacttatttttatgatatggggggagggggttcaactctgcacaaacacactgttaaagatagcattgctaaaactaaacagctggttggtaggcagcacaccatgttgcagcctgaaatgtctgccatcaggagataataaaaagttctaatttggtctataaaaggcagtttaaaggtgtcaattacaccatgaaatacatgctgcccacgagtcaaacacatgagagatgagacccaccatacttgagagcactctataaaaaaatagggaggcacaatataaaaaagtattgttatggtgatgattttcaagaaggttgaaagtatcaccacctaagactggaatatttccacagaaataagattccgcagaaatcactaagacctggcttgacattttaatgaatatcctataggcagtaaaaatttaaaatatccaagtttataaatattacatgtatcgcatttgagctcttctgagttatgaaaagttaactccactttcataagatggacagagatcttaaatttagaattaagtggaaagcaaaatggaacacaagttttgatgcagataaatacaaagaaatccatttaggaaacaaacctaactgtacctaaatgaaaactcagacctcatagagatatactccagaattcattctagattagctatttaaataaaaacactaaaatcagaaagctaaaagagtattaggcatcactaagaaggctggtggggggggaaatctatgatataccactcttataaaagccttgatgccttaaaatacaaaatgaaaccaagaaaaaacagaaaaaaatgtaaaagggagaactatgacatttagagtcaattaacatttattgagtgctgaaggcctgtgtcagcaatgttcaagatacttttcccatgttaccaatttctacacagatttaagaaatttagaatgggaataaagtagataaaggataaaaagatctaagactgactctagaaaagtcactgacaaggtgaccatggatatccttgcgaagtactagaatagaaaaacttgaaacttgaaaaggtaaggttggaattttttaaaaataagggactatttcattttgtctgtagtaaaataaactgcggcccattgaaatttgggattcttgtgagctacttcagcacctaggacacagcggctgcttagaggaaagagaaaaggcacaaatagaacacattcatttttttctggaggaggtaaacactgaaaacaaaatttttccagtatattagtagctggtaaatctgcaaagtaaaagaaagtatggtatttggtgttcaactcctgacctttcagagaacagtagactgacagacacgtgttctgatccagagagattattaaagactgtgcatcaaattagaggcacagtgtgctgcaaaccaaacatgaggggaaaaaaacgaaataaagttaatatttagagtgaaattacatggtacagactaatagtgctcctggagcaaagaacagtatcaatgactatcatagagaagacaggaaaggcttcaaagtatatgaggcaagaattgcagagagaagaaaaaagatacaggcacaagattttaaacatatgtctgtgacagtcacattttagagaacctattcactcccttcaaattccaaatataaagacttaatctctaggcatctcatttatctctgaaatgaatggtggaaccacattaggtttcctgtagcattggaatctggatttcatatttaaaaatcaaactcaggccaggtgcagtggctcacgcctataatcccagcactctgggaggccgaggtgggtggatcatttgagttcaggagttcaagaccagcctggccaacatggtgaaaccccatctctactaaaactacaaaaattagccaggcggtagtggcgcatgcctgtaatcccagctattcaggaggctgaggcagaagaaacacttgaacccaggaggcagagattgtggtaagccgagacactgcaatccagtctgggcaacagaatgagaccccccctcccccaccccccaaaaaaacaaaaacaaaaacaaaaaaaaatcaaactcagatttccaccttcccctctcctaaacttcctattttctacctggttccataatgatctacccatcattcatgtttaaaaccttggattaacctttggtttttcctgcccttttctcctactctgccagactccatctgtgcaccaactcctggtcattccttccctcagaaatccctttcatgtgtccctttaaatttctaccaccagtacccaaagacaggtccctatttcatcaaatctaggttgacacttagccttagctaaccttcttgcctctagtcaaacctcactcccaactccaaaccaacctaaatactgctgacaactggtctctgatcgtgtccctgtcccctccctattcaaaatgtccccaccccaccccaaagtaattcaatatcttcccagtctactactttccctggtatccatggctttacaaaacctgattccaatttaattttaatgctcttatcgcctttcccctgcaatctggtccttcacctctcactcctctacacctttgttcttgccatcctcccctccaggcactccatatagctctttctgctatccatattcaatttctgctactaaaacttcccataggtaaaaagagtctctccttgtctcaaatcctacccctttttgtccacaccactcatgtagcatctagcctagatacataaccgtgcattacagggcactgcttttgtttgtgtgtttgttaaaaaatgccagtctcatctccctaactggacacaaagttcttagaggatgaaaatgcttgttctttgtaactcctagaagattttgcttagttctacctataaatggtgattaataactactgatgaggtgatctaaagttcagttgaaataatgcccatctactcccatgcagttctttctaagggctctctctcttcactggtgtctgtactaaccagaagcactgttacacactgtgtgccatggtcttgttttttccccctttcaaatatgagtctggtctctccaactaacttctaagttccttaaagactcttataccttttaagcattctttacaatgttaagcagaccactggacacagagtggtatttaacataaaccagtaataaagacacctaaatattacccaaaatgtctcaattaaacagtgcttgggcccggcgtggtggctcacgcctataatcccagcactttgggaggccaaggcaggcagattacgaggtcaagagatcgagaccatcctggccaacatggtaaaatctcgtctctactacaaaaaaaaaaaaaaaaaaagtcaggcctggtggcatgcgcctgtaatcgcagctactcggggggctgaggcaggggaatcgcttgaacttgggaggcagaggttgcagtgagccaagatcatgccactgcactccagcctgggtgacagagcgagactcagcctcaaaaaaaaaaaagcttaacaccacttaaggcacagactttataaataacacgtctaccctgttttacaaatttcaaagccagttcacgtctattatttatttcactctcataactctgtgatgtcagtttactgaaggaaaaactggctaagcaagattgtaggatcaggccgggcgtggtggctcatgcctgtaatcccagcactttgggaggctgagacgggtggattacttgagcccaggagttcaagatccccctagccaacatagtgaaactccgtcactactaaaaatacaaaaattagccatgcattgtgcacacctgtaatcccagttacttgggagcacaagaatcgcttgaaccctggaggcagaggttgcagtgagctgagatcacacaccactgcactccagcctaggtgacagagtgagactctgtctccaaaaaaaaaaaagattgtagaaccagtaaattggcagtgcaaggattcaaacccagacctcctgggcccagggtcaaaattttaggtactattccacaaatacagattcaacttctcaattagcctccaagttcctggaggaccagggccatgaataatttcttttaaaagattctctcctcaactcctcccaaatgtcttcatgtatcaataagatgaattaaacctatatgaattctgcagatacaacaaactcatcataaataacacacagcctgacactacattgtgcccccataacagacgaaatcaccatccaggcctccatcttaagtggagaaagacttggtaatataagcctatggcctctccaagcgacattcccaaacaaccattttgagctcagccacacaatcaccacacccatataaggtgaaagcatactgtatttctcaaaatcctcgagtcctgccagacagtctagtctttgttctctgaagggttgagttaacatctaatctaaagagaatggccagaagtgtctgctactctcagagctttcaaggaaacgtccagttagagagcatcatctcctggaagtaccacgggtctccaagtacacatagctcagagccagggccctccataattttctccctaaactgcatttttggatcatttttaaagactttggaagccttacagatgaagaagcagggccctaaataaaaataagttagttttaatattccaagtgaacagtttgctaaaacaccattttcatcatcctaaagactaagagactaagacatgaaaacaacagaaacttctctattagctctagtatgacagtatcacagaagtgttggcaagtttctccttaccaatgttattatccagagttagaaactactttagaaataaaataactttaggaaaattactttactatgtcaagcattaaagtaatttcaaaaaagttctagaggaacatgaaccaagttgtattctctagtctatagattaagtcatactaacaactcactacttgaattatatgagcattatagttaggaggccaggcaaaagctgagaaggcgaggctagtcaggaaaacatctcagagaatgttactgatataacatgtagctgttgcactgtaatagacatatattactctgtctgggtttaagtgttcctttctagaactgtctctttacctgatgaacagtgtattataaggccatatacctcctgagggggtgagcacagctcaaggtggccagaagacctcactccctggtcccagttactgattcagggaaaggatccataacggaataataaaggtactccctggagtatctccaacaaaatggccatgttcctgtcttttgagctccattggtcatctctaccccatgtgaagaaaactaccctgaaaatgaagccaacagttgacagaagagaacaagatcagtcctgatgacatgcctggtgcccctggagccagcctagccctaacctcagcctatttatacatcaacaaattccattttaatgaaaactattatgtcacctgccagtctaaatgaatatggtgccaaataaaaaagaattaattatctccagagtacgtctggaaaaagaatggctaacaaagttaaatctacttctaaacccaactggaaacaccaatatactgactttttattcttaccacctaaaatggcctaaataacttgagaaccagtccgttcttctcttagaatgtttgaacaatgtccacccaaacttttatttatgacctactgatatactattttccagactagatgttaaaaacagatatcaaattgtattcaaaacaaagtcactattctctcaagagtgtcttgttagtatttagcaaaagtctgggtaacaaatgggcaacctggctatgaggcctactccatgcacaccaaagaataaggctaaaaaggtaaacaagctacaagtctaccaagccccgatataatacatttactttcattcaaaacaatatattcaacactggtcggctctgaaaaagcacagatcattcatatatacaaataagcatacttttcaacacatgtgtttaatatacacaacccaaattctagattggaagattatacctaacatgcgaccctcaacctctggtttctgtgtactgatgcaatatcataccacagcaatgagttaaaaacgtgacctccacaagtttctttttttgtttttcatgttttacttgcctacttaccttctcatttgttaccttcacatttttaaaaagacagcagttctccaactggtaaccaaagtttcaacagtttctttgattcaccgaagagataagggtaggagttatggtttacatgagttttactactagaagtcacaacatacacacacaccaaaggagttttaggtgctaatacagtatatgttgatcactcccacagatgaagacatctttaccaacttgcaaagtgagataacactaagccttaatcatagtaaatggaaatacatatccgatgcgttaaagaaaaaaggaaaagtgacaaatcgtcatttcactggattcttttaaaattttttctggaggtcgggcgcagtggctcacgcctgtaatccctgcagtttgggaggccgaggcgtgtggactgcttgaggtcaggtgttcaagaccagcctgacccacatgttgaaaccccgtctctactaaaaatacaaaaattagccaggcgtggtggcaggtggtgcctgtaatcccagctactcaggaggctgaggcaggagaattgcctgaagccaggaggcggaggttgcagtgagctaagatcgcaccactgcactccagcctgggtgacagagggaggctgtctcaaaaaacaacaaaaaaattttttttctggagactggcatttatgtctgtgaagtgggcaaccaggtggtccaggaacaagagtagaaagatttttcaatgggtgtcttttttatcatttgagtttataccatttgaatgtactattcactgggttatctttttcattgtttgaatggataccatttgaatgtatgacttactaaaaattaataaataaattttaaatttagaaaattccttgaaagtcactttcagaaaccacattagaactccgttagtctaaaaataatcagaaaagaatactgcatgtcctttactcttacaaaaactgcaattttcccaagtatacttttaaatgtgtcctgaaaccattaccaactgtttctgcctaattttctttcacaaagtatgagtgcagaataccagcaaaacatgataaatagttcttttctgtttttcccttccaccacagaggtgctaatgggaaacaatataaatttgccaataggaaaaaaatgctaaaaggcatatactcacaaatcaaatcactaaaagttaaccatacagtagttaaccctgttaagccagggttatccaaagcaccgctcccataccactgatgcgaatggtaattttagctagtatgtaaactaatattttaattgttatgaatttattttaacatgtagtttattatacctaatacctacataccacatgtaggactacacaaatatcactgcctaagataaatctacttaagtaaaatcgtgaatccatctgaaaaataagagtgcacatgtgtatgagtgaagttttagaagcaccagtgcactatacaaattagatcgaggcacactgggaatgaccaccagcctacattaaccacaatgaacttagaccaaacttcgtgctcacagggaaactctcactgaaaggctggcacaactaaatgacagaagctgtgatctctattcctcttaccttggacacctcactgcaggctctggatcactccccaccctcctatctaccaccctaaggtttctaattccaaaggcatgaagagaagtctagagtcagtctccagggagaggaatgtcttggcctcggcagagctcttcagtattctccctggttcttattgcctcttcatatttctattacacctatgttgtccctgaaccaccaatattccctaactgtctatggcaccaagtcgaagcctgcacttccctctcagagccttatattccattattgttctctgctgcaggcctgataccagtccaaccccatttaaaagaaaaaaaaaaagatattcctgttgtcaggctgatggatttggccagaggtggattaaatggcagagcacaaaccaattcaccaggtatgagagaccagcccatactatcctcatttccccaagtgtatctgcattaacaaacttgcattttaaaaaagattaacgagagaaattttatgtaaaagaatttcaagctacttaaaggtgatttagaccacctgagaaattttagggctcactgcaggactatctcccagccagcaatcaggcagtatttacaatctggaataagggtgctgagactagaaaagggttgtcaatgggcttactaactaaactcttatttatgtatgatcagtttccatcacaaactatcctaacagctcatttagtatatagctgtctgctcacaacttcagagatgaaaaaaaaattttaacataaaacattcatcctcagaaactgaaccaatccctttaggttggctaaaggatgcttctgcaacagtcattcaccagtatgatgcaatgatgtgttctatatagtcctcaaaaattctgttttattcataccagattcttgcaagtattaccacaagtaatctcagagaatgaggtccaaagtcctgacagaggggtcccaattagagcctctcaggttatcagaatcatttgcccagacaggtatattcagaagcccaaaaatcttccctttaaacttgaaaatagagttccaaactcagttttcagtaaaatacctttgagaagggcatatttaagtttcaatgtaatatctaccacatcacctgccgagaactttaatttagaaatcatctgttttcaaaaataccatagcccagatgccaaagcatgatgtttacctttacacaaaaaaacaccaaaagaagaaagattttatttgggaaactagacctggcacttgtggtatttattttctttcatgttttataactacctttagtcacttaatcctattattgaagaattaaaggaaatcaaagagataccaatataagactagcaatttggtagacaagagggaaaaaattaggaggctgaaaaaggaacacacaaactcaccaactcagactgtttttaacagcatagcatactgtgtggccaatacccctcaaaccataaattctgagaaaagttccctagtacccagtggagagtcaaaaacaaattcctgcctcagcaatttctcaccatcattttatccatctgagcctggccctaaattttctaaaacaaagctcacaatcacatcccccttcaacttacatcctctctcatggaagaaaggtactttctgttccatcattttcctctcaaactctgcctatgacctggtccctaaaaacgaaatgttccttccacctctccaagtctaggcccttcattctcttcctccactggttccttggcagggccgggagcacagagggaatacctcccaccgctgtactggatttcccacaccgcggttcacatcgaatttttcttcttaacccccagtaatctggcttgtcttagcaattctatgaaactgcaagcacagagggttactgactcccaatagccaaataaaagctgaccaatctctccttttctaagtcctcgcccttttcgatttctgctggctctatctagccttggctctccactcgccaaggaaaattcaagactgtggttagactctagtctttcttctgtgcaatctaagtgatcccctccactgtcctcctagaaatgacatcagaaaacaatcttagacctatgcatctccagccaccagtaaataggaaagccctcgattctatcttcattaagcccttcaaccttacttcacatgtccaaaaccaaattcaaagtcttcccaggattcctgtcccattccaccttcacttccctgtatctaccaactatatcatcatcgccacgtcagtcaaatttcccttcacaggcagccaccaaggtctgctcgtttttccatactagtattgcaactcctatgagaattaatacggtttttccatattaaaatctcatccactatgactgcaggtttgcttccttcctggagttcaaaaatgactgcagtgtccagaatgagaagctgctgtaagactcctttcccatggaccagcacccatcctcaactgaaacgcagtctgggaaagtgtgaaaaaatgaaggagaaggagagagacactcagctaacgccactgccctcatctcacctgccacaaataatctgcatcttcccccagctaccaaaccgtccttcacataaatttctgttcagcccacaagctgaaaagcctcctcagcctcttattaaagacccactaaataagtcctttacttcttgatcaaaaggaatcatcgctgtgacttctaaactgtaagaaaaccaaacctttaaaagtacctgtcctcagggcttggggcagtaaaaaaaaaaaacaatctaggtgaaacgtcttctataggaaaatttattttttttgaacgaacttaaccaggcaaagcaagtaactagcaacatgtgcaccatttacttgggcaaatgtcgcccgttcctcctcggtgtcatcaaaaggtacactgggagaacagaagggttgaattgagctggtttccaaggaaccatgtcagagccgctgcggagttaagagctgcgtccacacagcagccaaatcatgaagttgcaggagcggctgttgttaacccacagctaagaataacgctcgactttccaaaataaaacgaagaaacgaagtcccctggccaatgattcggggcggcacagaggggaaacggagcttcctgcactgccctcatcactcagaacctggggtcccaggcgattcagtcaccgcccgcagaacagcgccgcgggcaccacgtgaaactcccggggccggctgggggcgggggacgaggggcgcccactcgggggtcggcagtttgcaggtgcgatgggcggccccctcacccacgtttatccggactggagcccgccgctcccggccgggtttccgggtggttcgcgctccttctgaattggcagcgaggtcgcggcaggttcgaggtaaatcggacgaagaggggaaaaagtctcaggggtctgggggcctccgcgcctcaggggaggcaagggccgggccagaggcgcgagggtgggtgagggattcccgccgcggggccgggaccggggctcgggcagtgggccctgccccgcgcgcccacgcgggccgccctaccgtggctctgcaggatctcgtgcttgagaccgccggtgtagtcgatgagctcctccaggccgcgctcgcacagctgcccgtagcccgagaacttgtgcagcaccttctccagctcgcgctccaccgtcacgcactgatccatgccggaggcggcggcgctcggctcctcggcgcccaggtgtccgcagccgttcggcccgggccccgccgaggccgcgtcctgctcctcgttccccaagcgggcggcgcgggaggctgaggcggccgaggcggcgggcgcactagccgcggcgccgggggagccccgcgcagccggagcccgcctgccccatggcgccctagccccctggcgagtcgccgctgctcccgttcgctcgctgcactcggccccgcgtccccaggccccgctcgcgacgttcgggtgcctgcgacggcgcggccgattgtttttgttttcacgggaaccgaccgatgacctggttctcccgggcggcaccaagtgccgccgactggggggagggggatggccacccgggcgaggaaaggaggcggagcgggccgtaccaagtacaccctcggggtggggggtgcgacccggcgagaacgggcggaggaacgcgacgggcgcccacacgcgccgccactctaatggtgtgcgccgtaccacacggaaggcgtgcgagggagagggcgagggtggagcgaggccccaattggcctgaggagctaaatagggaactttggagacagccccagcgctcggagagcgcaacaactacgcgctccataaacaaggaggcggaaaccggccctcaccactccgcccagaagcggggaatcccaaccaatgggcgcggggagtggtaagaagccaatccctggccgaggcgtaagccttcagccaatccgggctgaggggccaaaccaacgggctcgctgttggagggggtgacttggagagcgtaccgagaaacgagtagtttatggaaagccttgggggaaaactagacaaaaatacaaagggctgttttccataggacgtagccctgatcccaatttatttcgtctcctcatcgatcttaagggaaaggggtaccgtcattccgaacttttgggcgacggatccatctcccgggatgaaaaaccaagccaggccgcccgggggctggttctgcgtcggcggggggtccctaatgggaattaaaggcgggggtgattgggcccgggtgaggggagccgcttgctgctcgcgaaaggcccgcgccggctgtcagcgctgccccgggcttgcgacacccaggaggtcatgtccccatcccccgcggaccgtggccctttggccccttggcctggaacctctcctgacggtggcctcgccccagagccatgtgccgggcagcttagccgggtggaaagaacacgcgctggagagccgggcagcctggcccttgctccctaggaagccttatgctatcggatcggatcggctttaccccctcgggtaaatccttcccatcgcttgctatggcgtctgcagccttggcctagacctccttgatcagcatcggctgcactacctttgcatttcttcaggagcccagctagttcgtgcctcagggcctctgcacttgccctttccttggcccagaaaactcttcctcctacctttttcatcctgaagttcttctcagctcacttgtccccttacagagtcctcccctggctgaccacactaatgtacttcctccccaccgttaataccataacacattttattatttccacaccacttaaactctgaaatgatctgatgttttatttttctgtctgcaccacttacataaaaccatgacggcaggccccctgcttgtctaaattttttgcctagaacagcccctggcatgaggtggtaggcaattctttttcttaaattaacgtgataacgtttttgagccttaacttccgtataactgagaaataattggaattaatacttaactaaattgttagataaaggagaatatatgtaaatacccataataggctcatgataaccacatgataaaggtggtagtagtcattattagggcagccccaactggtattatttcagatctcccttctccccaccccatttttcttccctcttggcagatgtctctgattcttcactgagattaaaaaaaaaaaaaaaaatctagctccagcaacttctatcactcttttccaagtattgctgtgtaccacccattttgtgaacattctcatgtacccaaaggaccaggagtcccttctccctttccaagacagccgttggggcctgcgggctgcctctcacccctgtccagatcttccccctctttctctgcagtaggttcttcctttctactttcagcccaaatgggtttgacctacctgggggaggaaacttaatttaaccctcctcaagcactcatttctttcactgccaaactgcctagacaaatctatgtttattcctcccttttcttcaaggatctccttgataagctcagtcacccttttctcagtctttttttttcttctccttcaaagggttgttatagtatgaaatattccatttaaggcactcaacaaaatgcctggcacaaggtaagagccatgataatccactgatcacaaataatcaatgactcctcattacctacagcttcagatcctctctcaaggacatggtctgccctgtgtagcaacacagcacaaacccctatccaggcatgaagcactttctcaccctcagtgtgacttgagtacagcccattcatactttgccttcttctgggacacttttctttattctgtttttcgaatcctccctttcttcaagtaacacgacaagtcttactttaactagtgacaccttctagaacctaggcctgcactcttcaataccataatcaccagccacaagcaggttttttttttgtttgtgtttttttttttttgagatggagtcttactctgtcaccaaggctggagtgcagtggtgggatctcggctgactgcaacctctgcctcccgggttcaagtgattctcctacctcagcctcctgagcagctaggactacaggcacacaccaccacgcccagctaatttttgtatttttggtagagacagggtttcaccatattggcctggctggtctcaaactcctggcctcgtgatccacccgcctcagcctcccaaagtgctgggattataggcgtgagccaccgcacccgacccacgtgtagctatttaaattgaaatataagctagataatttaaaatttagttccccaattgtgctaaccacatatcaaataataaccacatgtagctggtggctactgtattaatcagcgcaaaataaatatttccatcactgtagaaaagttttgttggacagtgctgatctagaccatgaccacagtaaagttaccagccctacctttaactgctgtaagacctctgtgtaagtcatttcatgccttagtgcatactgcccccatatttttagttaacttttccaacatgtgcctttttgactcaactagactatcagttttcagatctgggctgacttctttttatctcccatgatttaatcagcatgaaaaaaagtgtttgttaaaggaaaaagaatacgcagattagaggagaagaggcttcagagttagctgggagagaaaaatagtacttgtaagggcagagatttatgttgcttcttcactttgtattggccctttctacacagtgcctaattgccttaagcctaaactgtgaattgtcaaagaagcacctctagaaacaacagggaaagaaatttagttttcagagcaactgcaaattagtttgtttttttttgttttttttttgagccagcctctcgatctgtcgcccaggctggagtgcagtggcgcgatctcggctcactgcaagctccgcctcctgggttcacgccattctcctgcctcagcctcccgagtagctgggactacaggcgcccgccaccacacccagctaatttttttttgtatttttactagagacggggtttcactgtgttagccaggatgatctcgatctcctgaccccgtgatccacgcgcctcggcctcccaaagtgctgggattacaggcgtgagccaccgcgcgccgcgcaaattagttttctataattgcattttcaccacacaataaggaagaacacacacacacacacacacacacaaaatcccactttagtatcaagtggactcctgcccccacatgctgttcagcctggagaagctttaattgatactcattctggactttgctcttgtcttcccctccactccagatttgactctgtaaaatgtaagtaaacatcaaaaaaagacgggaaaaagaaaaccttttgtctttcagccaaaatacatatttattgtaggaaaattagaaaatacaaacaagtaaacagaaataaaagtcccatgaaagcccaagacccagaaaaagaaaatcagttttaacattcggggtgaatttccacagatttttttcttttttgtgcatacacataaactcatatgcacatttttatgaaagaacgctctcattgtatttactattttgtaaacagcttttgttgtcctcttaacattcctccaacaacaaaaacagtttttagaactgcttttgacatctttttaaaatgcttaatagctgttacactagcttatagcttattcaacatatctcatacatattttcactttgaattattcttagaagactgaaaccagagagagacaagatagaaaaaggaaaaatttcatctcttaaatttgagaaattatatttttaaaaaccttctgcttttatgcaaaacacactttcagataagggtaagaaggactacatttataattctgttaataaaaatgaatcagcgaggttggcaaagaactaactaatttcctgactactctagctcacaactaatataaaagtaaaagtaaactgacaaaatgtgttattaaaagaaattctgaattgcaaaaaatagcatttcttctcatttaaacaaatcaatttttatcttgttttgttttgttttgtgttttaagagttagtgtctcgctgtgtcacccaggccagactgcagtggtgcaattatggctcactgtagtctcaaactcctgggctcaagcgattttcctgcttcagcctcccaagtagttgagattacaggcatgagttacccactgcgcctggcacatttttatcattttcaagtaaaatatatatatctatctgagacatttctgggaattgctgctatgaccagttgaagaaatgggtgaaagcacaactattagcaaaaagtcttaatctgaatattttctacatcttttatgtcacctgtgtggtttggggcccgtttgctggctggattaatgatacttgctcgccattatgactgactcttagggattggatatgcagtattgacagtattgcacttctgtgtccaccatctccgtctttcagctccactgtttgtagaagatagcctctgctcagcggcatagccctcctcactgtggccttcaccactcatgaagtccagggcagttctagtctggttgactaccagttaagttaccccctaatagacttccatgaggacctcattgacttccttgagtatagtttgtaggcactgccctcgtacctgggtgcttagcctatagggggttatttataacttttgaaacctgctctctcaggttttattgtctgagtcttttcctttctggaatctggatgtttttcttaggtttgtttcctgctcactgttggtgtgctttaccagctgtagcaggaagagtgctagcactgtaatcttgtaattcattcaacccctctcagcctcagatgctttatctataaaatgagaagcttggaatagatgacctttaagttccttccagttctaaaattacagagatgccagggcttattaagtaacatgtgaggtgcaacacaaccaaacaggaatagacagaggcatctttcctgttttcgaaagcttggagtctgaatcattacttcctcattatggaaacgtgatgaggtttgtttttttgttttggtttggatttttgatttttgattttggttttaataaatagctacaatttattgagtgcttataacacgctaggcattctgctttaaatgtgggattatctcagtcctcaaagcaaccttttaaagtaaataatgccgggtgtggtggctcatgcctgtaatctcagcactctgggaggccgaggctggcagatcacctgaggttgggagtttgagaccagcttgaccaacgtggagaaaccctgtctctactaaaaatacaaaattagccaggcatggtggcgcatgcctgtaatcccagctactcgggagcctggggcgggagaattgcttgaaccccggaggcagaggttgcggtgagccgaaatcgtgccatttcactctaggttggacaacgagagcaaaactctgtctcaaaataaataaataaataaataaataaataaataataaaatttaaaaataaatagtatttggattattatccctgtgttaacagatgaagaaattgaggcacagaggggattagtaatttatccaagattacacagctgataaagtggtagagctggaatttgaattcaaatctttctgactctataacttgtaagtcattgtacttcaaaaggcgaaattatgctccatgattacttgttaagcatgctatgtccagtagaataaaggaagctttaaccaaacttcattgttttgttttgttttgttttcaataacaaagtctactccacctaccttgcaacattgttgagagaatatatattaatgttgcaaggtaggtgaagtaaacattgttaaatatgtatttttaaattacacatatatttaaaaatatacacatatttttatatatatgatttttttaagtgctcataaaccatgaagccccacagaagtgcagggtgctattatttcctcttatgatttcactttctgtctttcatttcttagcatatgaattgtacttcttttttcaactttttttagtagttgccctaaagttgcaatatacatttacaactaatccaagtccactttcaaatagcactgtaccacttcatgggtagtgcaaatactttataataatgaaatatccctaattattccctccagtataactgctgtcattctttgcatttatatataaactataatcattcaatacatcattgctatcattttgaataaactatcatctgttagatcaacaagaaaaagttaagttttttactttattttcaactattctttctctattgctcttcctttctccatgtagatcagaatttctgacctacatcattttccttctctctgaagaacttcttttaacatttcttgcaaggcaggtctactggcaacaaattccctcaattttcatttgtctgagagagtgcttatttctccttcgtttttgaaggataattccacaggatacagaattctacgttggagggttttttctcaacagttgaaatacttcattctactcccttcttgcttgcatagtttctgagaagtcctgatataattcttacctttgttcttctataggtaaggtacttttctcctctggctcttccaagaattttttctttatcattgaatgctctggcatatttcaaaataactttttcctttctccttccagaagcatggattttttttctctgatattcactgtgagaacctaccaaagctctaagaggtaaaacccacacaagtgtgagaagcttccatgacagcctcgccccactgccccatcctagggtttttaactctcagacttgtccactgtgagtctcagcatttcttcaattacagtttaggttttcctcatgagtactgcttcactcagagatttctgtttctgagatgatgctccagcatgttgcaattctctgtatctgcttatctgaccccccagcttaggaggcagcagtttgccctgtgacctcacttctgtgaagaatctaagaatactggcctcagcaatatggtggaaaacacctctacaaaaaatgagccaggcaaggtgatgtgcgcctatagtcccagctatgcaggaggctgaggcaggaggataacttgagcccaggaggtcgaggctgtagtaagccatgattgtgcccccgcactcagcttaggcaaaaagacaccctgtctcaaaacaaaatctaagaagagtttgttcagtttttgcttgtggttagaatggagtgatgacttccaaactccttacataaactggaaactggaagtcttcctatgtatttgattcaacctgtttatatatcttatgcatctgtgcagggtaaggtttgggttgtaaattgataaagtacacgattcatggcttttgacaacctggaggagactctaggcggtaaactaaagcaagtgtttaaaaatggccttttgaggccaggcactgtggctcacacctgtaatcccagcagtttgggaggccaaggtgggcagattgcttgaaccgaggagttcaagaccagcctgggcaccacggcgaaacgccatctctacaaaaaatataaaaaattagcagggcatggtggcatgtgcctgtagtcccagctacttgggaggctgaggtagaaggatagcttgagcccaggaggtagaggttgcagtcagcctaaatcacaacactgcattccagcctaggcaacagagccacaccctgtttcaaaaaataaaataaaataaaaatggccttttgagacttctggttccaccaagatagagtagtcccatttttcctaggccctctcagaaaaacctggatataacacaaaaaacaagcataggaagactttgaaagttggaaagaagtcagactgcctagggatcccaagacttgaggaatgacatgtggtaaattccctagtttcctcatttcctcctaaatgtcggacaaggcactacagaattctgcagccctgcaccatgaataggcacagacaaaacaaagacccatggaaagcctgttttcctgagtcaaagaatagaaaaaagtgtggcccaacaatgaaaaacctcatcagcttcttccctagtccaaccaaacactgatggaacaactgcattccccaaacctcaacccccagcacagtttcagcagagccaaccaggaagttgatattccactctaccccttaacctatggaagtgggaggcagctctccagttccctgtgggtgactttggtaggtctgactgggagctgaccttttattccctaccttatagaagcagacaatgctccagttcccccagcagattgagcaaggagacaagcttacatccccaatcagaggcatcaaggtggtcgaagttggtgccacactttcactgggatgttgtcagtggagcaataggagagctgaacttccagcccaccatttgcaataagaccatgtgagtcagtacttcagttttgccaagttactgtcagtggggcccagagggaaactaaacatgcctgtgaagaagaagaaggaagaaggaagaagaagaagaagaattattaaataggatacaaatccaaactcttataatatgctatccaaaatatccaggatacaataaaaaatcattcatccaagaaccagaaaaatcacaacacggatgagaaaagcaatcaacggctgtcaaatgatgagataaatcaagtgttcaaattatctaacaatgatattaaaatagcatcataaaatgcttcaacaatcattcaaattctcttgaaacaaaaatttaaaacccagcaaaaaaaaagagaatttattaaagaattaaatgaaaattatagaacagaaaacaagtacaagtaaaattttaaaacttgctgtatgggctcgatagtagattgaagataccataggatagaatcagtgattgaggacagacagatagaacttacccaatctgaacaatagagataggggaaataatgaacagggtctcaaggatctgcatgatatttaaaaggaaaaaaaaattcaaagaatagctgaaaattccccttacttggcaaaagagatgaaacttcagattcaggaaactgaacaaatcccaagtaggataaactgaaagaaatctatgatgctaagacatgtgataattaagcttctgaaggttgaagataaagaaaaaatattgatactgaaaacagccagagagaaatggtgcattattgataggggagaaccaattcaagtgacagcagatttttaacctgaaaccatggagaccagagggaaatggcataacattcttcaagtactgaactaaaagaattgtctacctagaatccaatgtccagtgaaaatgtccttcagtaatgaaagggaaatggagacatctcagatgaaggaaaggtaagagaatttgtcaccagcagacctaccaaaaagaatggctaaagaaatttcctaaacagaaaggaaattataaaagaaggaaacttggaacacgaaggaaaaccacagcaaaaaaatatgggtatatacaataaactttcctcctcttgagtttttaaaatttctaaattgatagtggaagcaaaaattatagcattgtttgatgtagttctaaatgcatgtagagaaaatatttaagactattataaacagggtgataatgtaaagggaggtaaggtttctatatttaaactggtaaaaagatgacaccagtagactctgatgaatatatataatgtaaaacctagagcaaccactaaaaagatatacaaaggggtgcaataaaaacgttgtagataaaggggaaggggtgttattgtttaatgggtagagagtttctgtttggggtgatgaaaagattctggagatgaatagtggtgattgaacaaataacccacaggctcgcaggatacaggaaatcagataaatgaaaacaaagagaacacacagaaacaaaaaaatggcatacataagccctaacatgtaattacattaaatgtaaatgtacatttgcaaatataacaattaaaaatgagattggcagagtggattaaaagccaggtgctgtggtgcatacctgtaatcccagctactcaggaggctgaggcaggaggatcacttcagcccaggagtttgagaccagcctgggcagcatagcaagacccttactcaaaagaaaaagaaaaatgtcccaactctatgatgtctgcaataagttcatttcaaacataatgatacagacaggttaaatgtaaaaagatatacaaacataatcaaaagaaaacataaatggctatattaataccacctaaagaagacttcagagcaaagaaaattaccagtgacagaattggacattatatagtgataagagggtcaagaagacatggcaattcaaaatatataagcactagacaacagaacagcaagatatgtgaaataaaaaactgatagaactggaaggagaaatagatcaattcaaaataatagttggagacttcaacacccatctatcaatgattgatagaacaactagacaaaatcagcagggatttgaaaaaactcagcatcaccaccaacagacatgatttaatcaacattatagaatactccacccaataacaccaagaatacacattctttttcagtgcccatgaaacatataccaacatagatcatatcctgagccatagaacaaaactcaacaaattataaaaaattgaaatttgttcaatttgttcaattgaaattgaagttatgttctgtgagcacaatggaattgaaccagaaatacataatacaaaagtattatggggctcaggacagttcagaaggagaggagccctgggagaaggctgagctcagatggttggggcagttgggggaaagaagtgagctggctctggagggccaggctactccatatggcaccctgctgggcagaggcagctccatgccagggcacaggacttggtgaggggaacaggagctggacctcagtcccattggccccctggctgggtgccctcttacaggggcccaactgtacatggtgaccctggatgttggcctgggaacctgtgatcttctactacatctggggctgacagaggactcgggggctgagaaggagacatggtctcacgatttggagtagagagaaggcttgaccagaagggactggctgtgcagcaggatagctggaggcctattggctgggcatcctgtctactgggtcctgggccggtcttggcagcaaagtcagggcagatagcaccagcaagccacaaccgtcctgctccacagagcgctagaacagccactcatcagttacagcaggactataacgatgaccaagaagagaagacaaaacagaagagggtaggtagaccagaaagagtgttcagaaagaagcttgaaagaggagaggagagacactcctgagtagtagcaccaacctaccagctagatttgtaacctccaactactactttctggcctcagttttgtcacctgactaagagggttggaataaaacgaatttaagtctcttttacctttgactaggactgacccaggctggcctttcaccagctcctgtccccatttccaagggaagctgggtggggggtagagggtgtggatgacttagtgtggtccatcctcagaccaaaaacccagctaggggcccacacattactgtctgaaacaccatgctcaggtgtgaacaaagatgcttggttactgtggacttttagttccaaggagggctgtgtctttcttaactcaatggaagaatcaaattaggagcctggctgggcatggtgactcacacctgtaatccagcactttgggaggctgagacaagaggatcacttgaaatcaggagttcaagaccagcctgggcaacacagcgagaccccatctcttaaaaaaaaaataggagcccacatcttcagattcccagggctgagattctgggaaactcagccaaactccagagctgatgcaagtagcaaaggaccttttttttggtcactggagcctggaggacagacaagggcaagaggcagagaattccagcctttacaggtcacagagaaagtggaggaggaggaggtagctgatgcctccacacccaggagggagggggaaatgatgagcaagatttttcaccctttcagtaaaacaaaaaaaattatttctcctatttccttctctgagattaatgataaactgtctatcccctaaaagaaaatgataaagactctaattttacttggaggcttagaaatgccatttctacgcaaaacagggagcccataatcagacttgagcggggcagagctttgatagaaaatgttttcctctctccctctatttcttcccctccttccccttgcaaaccaagatgcccgacagctaagaacaatgctcaataaaatgaaataatattttagtcaaaataggccaagactgctcccagccaactgtaaattagcattttgagggcaaatatgcagacaatttgagataatgaagcctgattattcaatccaatgaatgttaactagggagcagaggctccactgccttatctcactcccttcgatttatttttttaatcgtttcacatttgaactctttatttgtttctgttttatgcgccccctcccttcctctgtcacacacacacacacacacacacacacacacacacacacacacacacacacacacagagtctccctcccttctctcctccattcctgcccaggctgcagaaggggaccgttgcaggggccatcagtctttccacccagcctggccttcgggatggggtcagcacgcctcatggagcccctactgtgtgcatggtcctttgtagagttgcagggatttgggggtcaatgtgcactaaacagatgacacacaccctgcttcttagaacaggcctgggtgcaggagctggagaatggcaggtttataaaggaacatgccaggtacatgtggggctcagggaagtgggggtggaaggacattgcctttcatgtccttcaatccaccctccatgaaaggtcaatgtggagcacgccctgtccccaggagtcatggaaaactttcttaaattatcctttgtcccaggcaggactcactgcataatttgcaggacccagtggaaaatgaaatgcaggggaacttgcccaaaaatcattgagaatttcaagatagtcatggcagagcattaggacaccaagcaggggaccttctgagctcggggcctgggcaactgcgcacgccacacacccatgcagctggcctgcctccagcagctaaggggcagcctcaggccagtgggaggtaacataatgaggccttctgaaggagggttgaagcccttctcaagtgaagagagaggtttctgagacgctggggagggtcccagctgactggggctagcccctggggttgcgggttgccataggcaggagccccaatgcctgaacagctgtcagcatggtggtttccccttggaggtacccatccttcagcctagagatgatgtttacttggtggcggaaagaacagctcccaactgggcgaggctccccgctgttacggtgctcacctggcctcaacctcctccttgggtcctggccctgctttttccctcacgagtgtggcctcccagtccctgccctgtccccatgagctcctgcctgggtccagcccctgcagctgcccttccctcggggcccccttaccactcctttcagtgtgtgtagcaggaagtccccgcctgagcatggcctcccaccttgtctgctctgctcctcagcttgccctctccccaccagacctcctgcttgtcgagtgccctgtccatcactctcatcttcccgctgcctctgctcatgctgggccctcacctggggggtcttcagcccccttccacctcctatctcctctccacccatttcttcacacccagccaaagaaggcagctctgccttttaccggatgtgctcttgagtgggtgatttcacctccttgagctttagtttccctgtgggtaaatgggattgtagtggggcctgtctcgtgaggtgagtgagaagaccaaccaagctggtgtaagtaaagccccgaccccgggctggcccacctgaatgtgcatacctgttagcttgcactctggggagcctctgggaagcttcagaatgctacagccagttggaacagctgccctcctagaacttccgtagcctttggaatcctggtcacgcagtgtagcctgcattcttacactgtttcctccacctgatagaagtttcccaagagtagtgtggtgagcacttaggacgtgctccctcagcctcctgtgccaccctccttttgtctggagaggctggaaaattaagagctgcatctcccagattcccttgcagctaggcttctggaagtgaattgggtgatactgatcagttagactcctgaaactcagaaggtggacatgagactctttcctgccctgggtttctaatggctatcaagatagtagaaacacaattgcctttttctgcaccagattcccattgtccatcctctagcttctgggtgtcaagagtcaaaaactgttgttttggtttcagtaatggcttgattctggtccttcctacccttccttccttctttccttccttccttccttctttcctccctctctccctccctttctttctctttctttcttcctttcctttctttctctctccctctttctctttctttctttccccttccttccttctttccttcctttccttcctgtcccttccttcccttcccttttcttccctcccctcccttccccttccttccttccttctttccttccttccttttccttccttccttccttttccttttcctttcttcttttcttttttctttcaagatagagtctcgctctgttgcccaggctggagtgcagtggtgcaatcatgactcactgcagcctcaacctcctgggttcaagcgatcctcccacctcagcttcctaagtagctgggactataggtgccaccacgcccagctaatttttacgttttttgtagagagggggtctcagccttctgcttcagattactagtataagccactgtgtccagctgattctgggtttcttgatctctgtattgcagctacagtggtttcaaactcaattcaaggggtggtctcagaggttgtagtgccactgggagttagttcagaattctggaattccttcctggatgttcaggttagaacctaccattctggcttttccaaaaattttgaaagtatctaattctctgttaagtctctctttggtgggtcagtgcagtggatcatgcctggaatcccagtattttgggaggctgaggtaggaggatcacttgagcccagaagtttgagaccagcctgggcaatataggaagacctcccatttctacaaaaaataagtttaaaaaattagctggggccaggcatggtggctcatgcctgtaatcccagcactttgggaggcccaggtgggcagattgccaggtcaagagattgagaccatcctggccaacatggtgaaaccccgtctctactaaaaatacaaaaattagctgggtatggtggcacctgcctgtagtcccagctactcgggaggccgaggcaggagaatcatttgagccctggaggcggaggttgcagtgagccaagatcgagccattgtattccagcctggtgacagagcgagactctgtctcaaaaaaaaaaaaaaaaaaaaaaaaattagctgggtgtggtggtgtgtgcctgtagtctcagcttcttgggaggctgaggtgggaggatagcttgagcccaggagattgaggctgcagtgagctatgattgtgccactgcactctagcctgtctcaaaaaaaaaaaaaaaaaaaacaaattagctgggtttggtggtgtgtgcctgtagtcccagcttcttgggaggctgaggtgggaggatggcttgagtgcaggagattgaggctgcagtgagctgtgatcatgccactgcactctagcctgtctcaaaaaaaaaaaaaatctctctttggttaaaaatgcccagatgggctttctacattaaatcctgacaggcacaagaataaactaagccatctctttctcctgcacccccactgcacagcacctagtgtaggtctccctcttcctaagaaagccgcatgtcccataccagctgacccggcaccatggctggcctctgagctgcccgagcacatgctggacatttgcctctttgtgcatcgttcatttcctgccgttgccctgctctgtcctgtaagcaggaagctgactcctgcaaattacatttcccttgtccacatgcacagtgccttgtccactggtttcttgttgggttcaaccaatgcaaagcactggtgagaaaccggagggtgagagacggggaaggccagagtatttcctgtcctctctctgcttccagtggcatctattttgtggagccagcttctgccaggcaacacctgcaccacggcctcccagctcccagccattggcccctccacagttaaagctctgccctggcaccccagctcctggagtcatgtaaatactatctccctgctctgactgtctagatctatgggtagtagcagcttcctgaaattgctaatcttcgagttgcctcaccctcccctgttttcagcttttccaacactgtcgtaactgggttctcaaatgaaatcacctctctagtgagctacctggtgagctgggttttcctgacagtgtggttcctcctatctgctacaagtggggttcggggccttgagccacgtcttccctccttgtggacacagtctgtctcccctgcggcctccctggccattttgtcctggcccagcctgaagaaacatctgggcaaaatccttcggggtccctttccccagctgaggagtgggggggcgcaggggaggagccagggcgaacggcagctttcgccaacacctcactgttctcttctcgacatgtttactcacaggctgtctgggaagtgagaatcctccctaatggatgtttcacccaattaaataattaactccaagtgttgctaagcatcctcgcctctcaccttccagtcctggaggcgtcctcatgccaggctgcggctgctgctgagacaaggagcctagtgggaggagccaggagtgggggacagtgcccctgatgcttctgtacaggatgagggagataaatgcacctgagagggaaggtaaggagggctgttcagataggaggctgaggggaggctgagactcacaggaagtggcattagaaccttctggagcctttctattgaatattaagtccttgaaggtttccctctcccccaattcttcccatacgccacagcagggtccttgttccttcaaagaaggggaaaggaagggacacaggcttcttcctaatgggtagtcttgcgttatgaggagttacagagctgagctgctctactaaccagacagtcacataaggaaccccgaggggagaggctaaatacattcatactgtggaatatcactcaaccgttaaaaagaacaagatacattttcctgtatagataggaaaagatctgtaagatactataaagtgaaaaaatgcagataccagtacatgcagtttaatttaagtaaaaataatgtgcacatgtatgcatatacttgtctacctgtggaaggaggactggaactagggacaccaaactattccgaggggtgatatatagaacaaagctcctttcatgaaaaattgaactcacatttctgcagtgtaatcacacattctatctggatttattgtttaattgttttctattgtcaaacatgtctaagttattgacattagaacagagaaactccaacagagaaagggagcacagctacattttttttcttaaagattatatactatttctttacatggatgtcttgattgatttagttattgattcatattacaatggaaggctgaatcaacttatacggctttgaattaattgtataccttctattgatgagtgaataaatagttttttaacattcaccacaaaacatataaacattaacaattttgtgatattttacataaaacgtgcaagaaattctaaatttgaaattagtatttattttatagaacatattatgaaatactttttaaattagtaatcagaaaaaagatgattaaatagtaaaaacaatcatttgtatttttaccagatatcatcacttttaaaagtttggtttatattcttccagatagaacaatatactaaaataatataaataggttattatgtcaacaaacatttatatatatttttacagctggttacccccatgcaaaaacgtgccatatgtaatttttctatctaatatatttgaaaatgtatgttatttaaaagttttcctattgtaaacaatactataatgaatattattaaagacagtcttaagttagcaaagactgaaaggacatgttctctagtttagagtgtatgacattcaatcaagacctagaagacttatgccatcccccaagaatgtactaaaaatcatctgggattatagaaggaattcagggaaccctatctgcaagattatttacatgccagatccagtaatttatgatcttcttggtgtctgtaaagtcataaaagtcacaggattacaccatagtcatttgcttgaaattgcattcaagatatctgcattccattccttagatgctttccaaaataataaaatacctggcaggattctgtgtggaatctcagtcttcctatgtgggatgatcacatgtagcatccttagtgccaaacctaataaaacaagcttattgtttttggttttggcttttttttttttttttttttttttggagcatggttgaaaaaacttatgatacccagaacaggtttaataaatttttctaaactggatattgattatcaaagccaattatatgcctctaatatattgatttggagaatttagaaaatcaaatatttcaaatatatcagaaatctacatactaataaatttaaatgaaaaaatttctattaactaatgtatgtcagcagcttttattgacaaactcattttatttttccaaaggcatacaaagtagtttctataataaacctggcaaaaatagatatctagctagcattagcccaataatacaaataaaatcaaatcttgaaagaaatggaactttttaccattccagatagtataataaatgtaatagtataataaattcgcatagctctataacgcagatttggctaaatatgactctataaaatgacatttaaaagaacagtgttgtatacagcatatggatgacatagtttcttacaattttatagtaaaataataattacctgaataaggtaacatcaatcacattcatttaaaatagttgatttataaactagcttgattttaaaacaaataaaagaaactatctactaaggtaacaatgagtatcaattagagtgtcacttcacaaactttaatgttcatacatatgatggcatcttgttaaaacagagcctctgtttcagtagttctgcaccgacctgagaagctatgcttctcacaaacttcaagatgagattgatgttgttcttctatgaactatactttgagtaacaccagattatgagattattaataattcaaaaaataagcttattttttaggaaaaagtataaaaaaatcaggcattcaaactccacaaaaatactttttaagccatattacaaatagaagctttaaaatacatttcttttctctgcatggtttatgaatcttcatttataggactggctaacattgacacaaagttcacagtgggtattatatccatatatctacataagatgttcagcttctctcattctcagcaggtatggtctcattaacacctgtgattttaaaagcctgagtttctcccagcaagatgtagttttattaatatgtgttatatttatatatctctcactttgctatgttataatgtggaaccaaacctatagctattgctctagtatctgtttacttcataaatattgactgctagaggtgtgaatcctactagggtcttttgcataattatatgagggtaagcagtaaacaaaaatgactgaagaataaatgaaaataataacttagcttaaatgtaaagtaagatgacaagaataccatgaaataagagtcacagaaagaatgtttgctgctgttatttaaatataaatgttattatttttgaagaaataaatgtgtatacatctatctctttcagaagaattgtgaattgtttacaaatatattttctgaaatatcttttttttcttagtactgaggtctgatggtaaatgtttagtaactagctttgtataataaaaagccagatttatggtgttttcagattttcatggtgtaaaaattcccagtggccaatttcaaactactgacatgagatctcggaacatagcattaggaaaagatgcagaaatgggcttttttagaagccagtgcataatacttccaacacaacagtgacttagcagactgagcgtcactttactttaatgattaatcacaataattgtcaactgacattttttatttaatgacttataacatggttccaattataaaatgtggaaaatataagtaaaataaagacaaaattaacaataaatctaacacccccaaaatgattgttacacatatgtatatatcctttgagagcttttattaaaatatttatacttgtatttgttacaaaattgaaaatgtgttttatttcactttggcattctacccaaactgacaatatactataattttctacaattattacttattcctttaaaagtacatacaaaactgaatgaaactctatgctcccaatatactaaaatcaaatgattttattctctatagtttatagtttatattctataaaatctatagaatgattttattctctaaatatacatatttagaatgttttgaaaattattggtcaatgaacattctgacgcagaaatccttgtaaatattacctctgcttctttagggtaaatacctaaaagaggaattattgagccaaaaagtgcaattactttgagggtttctgataagtgtccctaaattgcactcaggaaaatttgtgtaagtttaaactcttaagtggagttgctggagaccctctttcacctgattcataaaacaatcttaattagaaagaagaaacaatccaaatgtctttgaggttcaagtacaccacatactatcgcatttaatttttatagtctttaattttattagttcaatttttcatatttgaattgcctgttagcattctttttcttttaatttatgtaggactatttacataataatgccatcaatcatttttatatgtgtgtcaagtttatcttctattgaataatttatcttcataattttgttcataatatttattgaaattagaatgcataaatattaaacttaaaattatgttatatagtataccatgcatgattataaatattatgtcaaatgtataaagtggtttttgctgtcagtttctgatttctccacccgatataattattttatattacctctaatacaacagattcaattctggataatttggggaacaacataagaacagtagtaatcaaaactaaataaaataactacatgcagtttacaaaaaaagttcacatcctatgaatatatttaaattatacttcacttaaatgtatcatttcactatgcattttctattgatttcataatcatattcctttattccatttttccccctctgctggcagaaagtttctattttctgttggcatttagagtatcctaacatttacaacatgcattcatgatgtattaaactataacatgaattaatatttgcctcaatttacagcaaaatgaagaccttctaaaattgtaactccatttatttttcccttccaacttccatgctatttttataatacattttagtatatgctatgactcccaaaaacattgttattgctattattatgctacattgtaaatattcatttaaatttacccactggaatacaactttgtgtttcttattacttcctgaatctataaactaccacttaataccatttcatttttgtttcaaaggtaaccatgagtgtgggttctgtcttagtgaattacttcagttttcagtgatctaaaaaggtttttgtattatcttcacttgtgaagttttaactgtatatgggattgaagattagaaattattttctttaggccgggcgcggtggctcacgcctgtaatcccagcactttgggaggctgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggaaggagaatggcgtgaacccgggaggcggagcttgcagtgagccgagatcccgccactgcactccagcctgggtgatagagcgagactccgtctcaaaaaaaaaaaaaaaaaaaaaaaaaaaaaaaaaaaaaaagaaattattttctttcagtgcatagaggttataattctattgtcttttcacttacattgtttcatttagcaagttaagagtctaaaggtgttcttttaaaggaaacgtgtttttcccctgactgtccatgatatttttctcttttactctatgtttctgcaattcctctctgtgtcatcaggttttgaattgctttctgtgtttttctgctttggattcatgtttccctttcaattaatagtttaattcatttagaagcatatcttccttgttcttgctctactttcttgagcccgtaattatatgtaagacttttcattaacctttgcactctacaatattttctatccttttctttactatgtttgattctacatattttattctaacatacctgctagatcattaatttccttatcaactgctctcaaacctatcttttgtgttttttatattgtttccttttcacatctgaaatgccaattttaagcattccaattatttaataaaatgtttatattttgttttttatcttcagaataattctactacctgggataattctactagtgatgcacaatttttgttccttagctcagctagttcagattcttgtctcacaaccaggaagaattagacaagtggacatcaaagagtgagtggagtagaatttattaagtgaaaggaaagctctcaggaaaaaagagaggatgtgggggttggttctcctacccaaagacaggaaagttccccaatatggctgagcccagggttttttgtgggctgaatagggagtgtgtgctgattggtttgtgagtatgcagaaaaggttaaagcaaagacaccactcaaaggtgggcatgacaacatagaaaaccaattaggcggctgggtgcagtggctcatgcctgtaatcccagcattttgagaggccaaggatagtgggtcacctgaggtcaggagttcgaggccaccctggcaaacacggtgaaacttcatctctactaaaaatacaaaaaattagctaggcatgttggcacgtgcctgtaatcccagctactcggaaggctgaggcatgagaaacgcttgtacccgggaagtggaggttgcagtgagccgaggtcccaccaccgcactccaacctgggccacacagcgagtcactatctgaaaagaaaaaaaaaaaataggtaaaataggtgaaaaagggggatcaatcagaggaaagcacacaaaacaggaaggtgggtcctcaatccaatccaaagatttacccagcacagtttccagcttgaatgttggatttcacggggaactcatccctatctgccttgggatttgtctgcctcctgtctctatcaatcactagctggccttttctgttattttgctctttttccttgttttctttcattttgttttgcctccttctgtgctaggttatcttttattttatgctggatttatatttgaaaaatttattttgttcacttgcaatactcattacagatacaaagaatggcattgttttatatttttataatttatttaatgcctgacttaatataagacatgctgatttattagatctacttctgctttcggtatgttgtgatatcatacattatgtagtctctggaaaactctacttactttacacatgagagagaaagagagagagaatgaaaaaatcaaataagatcttaatattgttatattatctcaggacctcatccctttgcctcttgagagtgggatgttaatggcttcacattgctcctgattcactattttttgtttgtgccattaagtttgtcaaaactattgaaaacagtagagacctcacttatacagccattgacatttattcctctttttgtaacattatgaatgctaatctcaaaagcacaaagtttgaaaaatcgttgcttttatctttaaattacctgggtcttcaatctttcatccctttggacaagtggaaaattccatacttgtagtttttgctggtaaagtatctgaaactaccctgtggtaggcaccctctgagataaaccctaataattcccgcctcctagtattcacagccttaggtcatcccatctttaccttaagtgtgacgtagactggcttcaaaataattctgagaaactatttcactttcaaaattataggctatgaaaagactgtgatttacatcttgggtactctctctcagatggtctcttgaatggctcactctgtggatagccagctttcatgatgtgaggcagtctcagatggtctcttgaatggctcactctgcagatagccagctttcatgatgtgaggcagagtcttgtggagtaatccacagggtggtggtgttgaggtccaccaaaaagcacatgagtgagtttagaagaaggtccctccaccacctcctttgaaatgaatcttcagataagatcacaaccccaactggcaactgcacagcaaattcaggagagcctttgagccaaaggtgcccaaaagccatgcctgaattcctgatcctcagaaattgagataataaatgcttgtttctttaagatacaaagacttgtgctaataagctatgcagtagtagatagttaacacagtcttctctttcctggtttatcacatttgtgccaaatattctctttgctcaaactcaagcccctacttctaaaaatacaaaacattgcatctcttctctgaatctttcttgaggcaggttcttaaatttctatacctccatatgcacacaaaacacatattcctcctgacatctttctatctttcagaaccgttgctggtgaaaagagtgaaggtcctctgcgtacttttttcctgaattctcatggacctctctgccttttccaaataagggcaatctcctttccttgagtcattgttttcccacaaatcttctacttgactgaagtgttcagggcacataggatgacttcaatatgcctgaatttacaaaagacctttatcttgttttttatttttgattctattacagtatctgaggaaaggagtcaagagattgcctttctgtgttatatgaattgagagaaagttctgttacacacacataaattaataatttaatttttcacctcaaatcttttcttaaaaccaactaactataattttctaattacagaacaacttcttacatcagaaaatggctctacatttctactcagaactctctcagtttaggactaatcttactaactcattaaaagcttactaattcattattaaaatgctctggtttccctttttataagttgttcattacagtccatgtccaaatggaatggacctttctttgtaattctttacacactgtcttaggccagttgggctgctataacaaaaatggcatatactggatggtttataagaaacacatatttatttctcacagttctgaaggatgagaagtcaaagactgaggcactggcagattcagtgtctgggagcacccatttctcatagatgacatcttcttactgcacacttacatggtgaaagggtctagttaattctctgtgttctcttttataggggcactaatcacagtcatgaggatttgacccttatgacctaatatccacccaaagtcttcacctcctattatcatcacactgggggttcaaatttcagaatatgaatttggtggcgggggcacaaatgtgttatgggggacagaccataacacatatatctgtaattgttttattttttcagaaagtgatcgtattatttctgtgacatgttatgccagaaaataatactacctttacgcttgaatcacaatgtagctatcaaatataccttttcctataaaactccattacatagcatttaatatttaaaagtgatatttgaggcaaattattgcctcacagcttaatcctttcattccacattcaaagcatctcccatgattgtcctcatacaacaacaatctgtctgtgcacaagtggattaattcttatctattttatactttaaacacttacacttctaagtgttctctacatacttccgattagactgcaattacttctgcaccaacctaatacaaaataacttgtttttttttaattttgatcccacaggccttaatttgtatcaatcacttttaataaaagtgaggttaagtaatattttttgagtctctacaatttatttagtggcatatacactgcagatctcattctcttatctttcacattagtgatgcagttatatattagaacaggaccttattaagataataatgaagatatttttcactgctccagtggtcacgattggattttcatcattcagatacctaagaacagtggtccacagcctttttggcaccagggaccagctttgtggaagacaatttttccacagatggggcacggagtacagtttggggatgaaactgttccacctcagatcaacaggaattatattctcataaggagcacccaacctagatacctcacatgcatggttcacaatagggttcatgctcctgtgagactctgatgccaccactgatctaagaggagacagagctcaggcagtaatgcttgctccccactgctcacctccggctttgcggccccattcctaacaggccatggactggtacaggtccctggcccaggggttggggaccgctgcctaagaacataaatatggaaatatttttgctcaaatgcacctaaccttcagatggctaaaaaccttttagcacccggggtgtaggattgagagtggagattactggctgagagaaacagcaaaaaacattcctcccattgaaattaaatcactctacaattgggtttaattgctggacctacctggtaactaacaaaaatactaaacataattgattgcctcatcatttgaaaacaagaggtcactgaatcaaataaatggtaggaaaatttagaaccaataaaacaaaacattttggataaaagttatttctctcttagacctgttgccatgagagtcccataaatgaaccagatttatagttagcagactttctcagtcacttataaataatgaccactgacacataaaatgcattcacaagtagatgcttagattaccacaaaggccttaagacctaaaacatcaataatgtaatgagctttgttttttgctacagacaaacaaaaaatacaccctgcaattttataaaaaattcaggattaaagatttatgtacgcttatgactcaaatgtaaccattattgtaagaatgcatggtaagcatgacattgtttcactagtcttgctacatcttaaaattaattcgttcattcatctgtccatccagaaaggatgttactatgatatacagcttctaaatggcccccaaccaatccccaaatcttgtcattgtggaatcccttcctcttgagcatggactagaccatgtaactcacttcaaatgaatgcaatatgaaaaaagagatgttacttccaagactgattataaagggattgtgactttttctctactaggccctattttactctctctcttttttctttttctctccctttctctctttctgtctgtctctctctctgttcatctgtctctcactctttctctctgtcaaaaccctgattctaaggaaaacaggaaggtatgttttagtgaattctcataattttattttggcccagcatccattttgaatataaatctaactttctcatactagaagcaggactcagtcacacttgacagtttccagttctttaaccacatccaccctcagttcccaaatgtgattggtccacatatttgcctgatacaactgctccctggtgaccacttctacttccctatgggacagctagacatagcctacctgactgaccccactgaccctcagacctcacatggactgtacagatatgtcacagtgactacctgtcagtcacagcactacgtcctggaactctaaaacttatgtttgcttgctttaaacccaccacttagaactccctgtgggtaacctatttagataaggtcctggatccaataaaggcattggctgatagggttctctctctctctctctctctctctctctctctctctctctctctctctctctctctcctctctctctctctctctccctccctccctccacactccctgatctcttcgagtggcctccagcatgcagtgtaaatctcaagacctctaagtaataaaatttttattttcatcttgtgtcttgccaaatcgttgaaagaatactctctatcttaaggatcctaaattaaaatacatgctataaacagccctacagagagaggcacatgtgccaaaaagcttatctttctggctaactgccagtaacaaccggagggcagccaacagccaaacaagtgaccttataagagaattccacccccagtggagactttaaataatcacaaccctggcaaagaccttaactgtagctttatgagaattctgaatcacaggtgcacagctaaatagtgcctggattcttaattcagacaaattgtgatataacaaatgcttgttgaataagttcttaagattgggggttattttttatgaaacaatacataaataaagcagttaagtattaatacatagactctataatcaaatgacctgtgatgaatttctggctccataattcttagcttctttatcttagtcaatttatacattttttatatatcaatgtccttgtttataaagcaggtataataatagtacctctcacatcaagttctttcaagtttaaaacccaaatgtacatacagagatcttagagcagtgcctgattcacagtaggcacttaaattttagctactgaagctcatttatttgaacaataatattaagactataaaaagttactaatacactttgcgaaattgagcaggtgacataatcaccttgggtctcggtattctttcattcattcaaaaatatttaataagcaccaattctgcatcaacctgcgtatatatttataataagagggagagaaagcaacaggaataatagtgctgccactaagtgaaagaggaagactgcaggagaaacagatttcagggagaatatacggggcagtcaaataccaagagtgaagttgtatgagctgtcaatgcttgtgcagttaatatgttatcattatctaaggagcattatctaaggagcagtcattctcaaacatttatgagcatctgatatagggcccaagaagttgcatttcaacaaaatgacaaataatactacagctgctgctccaggaatcacactacagtccattaatgtggaatatgttaaaacaataaaaaaagtgagtttgattattattatcatttataataatcggggaaaaaatgcttgtccccctaaatgtaaaaccgttcttggtttaattgagaaataattgctatggttgctgtggaatttagtaaattttataagtataaaatataaccttccaatcaacacatttttcctacataaatttaataaacattgcattgcacgtggaaattaataagtggaaatcttagttacactgtcagttccaaaataaacagacttagcttaaacatttgtttcaggtttaagttactagcgacatagaagttatccctatctatttaatgttgtgcaatgttaattaaaattgtatttaaaaattttttttcaaaggtttattcctactatgtattgactttgtattggaggccgtattaaatttccatatttgctcttacatttttaatatctttcttaggattttctacataaatagtcatttgtaaacaaatgtgttacgctcctttatttccaatcagtatatttttaaacgttttttcttgcttaaatatattagctacggtctctagtagaatgttaattggaagtactgaaggcaaatgtattttcgttcttcaaaaattaggaaggaataatcaattttctaccattatgtatgatccttactgtggaatttttatagatagcctttataaagctatttatatttttctgaaaatatttataacgaataaatttttaattttgtcaaaagctttttctgcacttcttaagatgaccatagatttttttaaattatagcaatgtggagaaaataccttaattgattttgaatgctaaaccaatatttcattcctggaataaaatcttttttatgttgccagatttgatcgttaaacttctataaaaaaatctttgcattatgtttaaggggtactcctctgtatttttaaagttttgacataatatggtctacaatgatgaattcctaaaatgagttttaggtattttccactaattttttggaaaaattttgtgtaaaagtattattttttcttgaaatattttatataatttaccaatgaaggtaattagcccaggatttttcttttttggaagatttttatttattaatttaatttatttaacagacatggtgttattctggttttatgtttcttcagttatactgtagtttatattatttaaagcctttgcacatttcatcaagaatgtcaaatttgacaaagatttattgacactttttcctttttattgttgtaatacttgtagtagagggtagcaaacttttcttctgtaagaggccagattggaaatattttaggcttctcagttagtgtagtctctgacataactcttcaaatctgttgtaatgtgaaagtagccatagagaacacaaaaataaacggatgtggctatgttctagtacaattttttttttcacaaaaacaggctataggcaatacttggttttgagaacttaatatgctgattctaatttagagatatctagatgtataaataggatcaactacaatgtgccctgttgtattacagatattgtcaatttgtgttttttcttttttcctcatccgattgtctagtggcttttccttttcatttatctatccaaagagcaaaattttggtttgatacattttctctatctatttttttggatataactttcttttctaaaagtttgggtgaatatttaaggcatgcgttttaaaccttccttcttttctaatacaagcactcaagatttataatttttctaagcatatagaaggaatttgtaccccacacgttttaataagatatttaaaaatctttttcagtttgaaatattttctaaatatccttctgacttcctctttgattagttagttatgtaaaagtgtgtttcttatttttcaaattgttctgaaattttccagatatatttttgttattggtttctatttaaattcctggtaatgagaaaccaaactctatataacttcaaatctttgatatttcctgagacttttaaaagaatcactcaacatatgttccatctcattaaatgatccatgtatgcttgaaaaaaatgtttatctattgcaccaccataattcagcctggacgacagagcaaaattctgtctccaaaaaaaaaaaaaacaaacccttgatcttatcctttttgagtatagtttttataaatatctgttaggttataaagttgtttaaatcagttttgtctttatttttgtctattatatcaattactgagaaatagatgttaaaaatctctaaatatatttatgagtttctgcatcatggattctgaatatctttattggttttgtcttcattggcattgtcatatcttttaaacaaatttactatttttaaattatgaagcactactttaagacggtgagtggcagcactcaccgtcttaaagtgtattttgtcggatattaatgtgaagacattagctttctataagtggtgtttgcatagtgcatcttaaattttaattttaactataaagtgaatattttatgatcagcatataattgtcttatcatcctgataagctctcattttaattggattgtttggtatctttatattttgtgtgatttgttatatgttttctattatgcctaccatattgttatttgacttccactgttttctggttcataacttttctaaaaggaagtcagtaataattcataatgctgttttctttatttaatgtcatatttttctagctgcttatacgattttttcaacataccttaaatgttccattatattatatgtgcttgaggttctctaaacttattatgtctataaattaatatcttttagcatatttggaaatttttgcctttttaagtcttctaaaaaaaagtcatcaaatatgttgttattccacaaatatctcttctctttctctaggatatcaagtacactgctcttaaattgatatgataaacctcttaaacccttaaaatgatatgataaacttcttgatatagtcccacagatcacaaagattcatcatttttctccctaatggtccctctatgctcttaaatcagatatttctattaatttgtctttacatttgctgactcttgtttctatcatgtttattatgacaatcagttcattcagtatttgtttttaattttagaaattttgttttttaaatataatttgcttttggtttaaaaaatcttattttggctaaattatatattttcatttattatgaacatgttttcatttatgtcatttatcattactatagtagctactttataattttttctgttaagccaatatttaattcatctcaatgtatattgcagttgattgcccctattttttgcaatgtaggtctgctatggtctagatatttatgattcccaaaactcatatgttgcaattctaaccccagggtgatagtattaggaggtgggaccttggcatgtgattaggtcatgataatggagccctaaagaatgggattgctctgcctgtaaaggagacctcagggagatttcttgctccttcacccagtgaagtcgcagaaataaaatttagctctgaaccaaaagcaggccttctccagatactgattctgctggtatgatgacattggacttcctagcctttagatatgtgagaaagacatttcttttgtttataagctacccagttgatggtcttttgctatagcaacacaaatggactaagatagggttatatgtgtttttaaaatcacacatagcctaactatgaaagaatgaaaaaatatatattcagtaaacaaaaacagccagaatggccataatgatatcagacaaaaaagactttaagccaaaacatgtcacaagagacaagaagaacattatataatgataaatgggccaattcacaagaaagatataactattataaatatacatgcatccaacatcagagcacaaaaatatataaagcaaacattgataaaactaaaaaaagaaatagcaagacaacagtagtagcatatttcaatattccattcttaataatggataaaacaactagacagaaaaacaaaaaagtaacatttaacttgaacaaaactctagatcaaattaaccaaagacacatatagagaacatgccacccaacaacagcagaatacacattcttttcaaatgcacatagaacattatttagaatatatcacatttggcaacaaaatatgttttaacacatttaagaagatagtaatcataccaagtaaattttctaatacatatggaatgaaactagagattgatagcagaagaaagactggaagattcacaaatacgttgcaattgacaacacattcttgaacaaccagagtcaaaaataaatccaatgggaaattaaaaaacatcttgagaccaactaaaactgaaacacaattcaccaaaacttatgagatgcagcaaaagtagtagtaagagaaatgtttatggtaataaatctctatgttaaaaacgaagagagttatcaaaccagtaacctaactttacacctcaaggacccagaaaaacaaaataagtccaagacaaatgaagaaggaaatattaaagcttagtatagcaataaataaaatagagacaaataaaatgataaaaaaatgaaaattagttttttttaaaagaccaacaaaattgacaaacctttggctagactaaaaaaaatagataaggctcaaatgaataaaagcagagttgaaagagaagacataattgatgccacagaaataaaaaatgacagtaagagactgctatgaaaaattatatgccaacaaattgagtaaccgaaaaagaaaatggaataaaattctgaagcaaaaaacctaccatttgtaatagcattaaaacctgaaatataagaaaccagatttatcaaaatatgtgcaagatatttacattaaaaactacacaatattgctcatagatattaaagaagaccaaagtaaatagagaccatgctccttggttgaaacagaatattcttaatattccaattctccccaaaatgatctatagagctaaggcaatcccaatcaaaatctaagctggctttaaaatagaaactgaaaagccattaagaagttcttgtgagtgtggctggttggtctagggctatgattctcacttagggtgcaaaaggtcctgggttcaaatcccagaggagcccaacttttagttcaaaagttcttgtgaaaacaaaaataatctagccaaaaatattcttgaaagaggaagaaatttggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaagaaagaggaagaaatttgaagatatacacagtctgcagccagacacaaaaaaattacatattggatttttcctttttatgaaatgtccagaaaagagaaatatataaagaatacataggcctgtgatttcctggtctgggagtagaaaggatactgactgtaaataggcattaaggtatttgtttaaagtgaagaaagtactctaaaactggattgtagttatcattgtgtaacaaatatttgtgaaaacaattgagctgtttgcttataataggtgaattttatagtatttacattatacatttataaaactttttaaagtatttttaataaagctgtgtcattaaaaagaccaataatctgccattcctaacatgtttagtaaaaaaacatgaaacacgcagcataaggattttaaaaagatacttttttgccaggttaattattttattttaaaagcgaagactatttttttcaaattaagttagagaatcacccaacattataattctctgggaaaatgtgaagttgtgacttataagtaaaaaaacctgaagaccatgactccagaaaaagaaaatctaatgcaaagaaattctccttactccaaattttgagtcccacacattttaaagattttttttcaaatccttttatattaactaatttatgatacttaatgggtcccagattatataaaaattcttattctatttgattccaaaatctgatggagcacagaaaacaaccaccacaatatcgatgagaagaaaacacaacaagatgttatttaggaatatcgggggaaactttattacaaagctgggaaattgaattcattttatattaagaatttaataagctcttctgaagatgaattcatttcatgaacatttcagcttataaatataaatacaattattctgtgaatggtacagagtgaaaaatttaatgattgtcttgatagtgatttaaaaattatataaaagtatataaacatctctatatatacgtataccacacaagcgttgagttgattttactgtgaggcatccacattaacatttaaaattcaaaaaacaattttttcaggcatataaatggtttaacatttgtttccggaaattctaacaagtgaaacttgacaagaaaacaaaaataagtgttgtgattattgaaagaaaatcaacatatacttctatttgctggtgatatgattattctattgaaaagaactgttcacgtttaaatgaatagcattaatgtgatacgcacaaaatagtaagcttatggcacagaacttttttgagaggccaatgtagaaaacaaattgttattaccctgatgatatttttataagagaaaacccactaatgtgttgattgaacagaatttctatcaaaatctcaatatacattttgatttaataattcaaaaaatatttacaaatactcaattagaggagataaaaatagattattcactgaatgaatgactttgatgcaactttctaacgattcagggaaatttaaagttagattcctcccccacatttactgaaaactaaatttatttcatagcaagtatatatatatatgtggtaagagaattattacaaatatagaatattatatgtaaatatgtataaaagtttggctggagaagaactgcctagttgtgacactaaaagtggagacaatttaggaacctatttaaatatgtaacaattaatattaaaaagcaaataattttttaaaaattataataaatgcaaataaaaagcattactatttcataaagagctcttacaagtcaataaaaatttaaccggtagaaaaatggataaaagttcactgaaagtaatctctaaaataaataatttgaataattaataagcatctaaagaagcattgcacatcaatacattgtcaaattaatacattttttaaaatgacaagctgtcacatttttctgttcaataatcaaaactaaaaatatgttgcaatatccagcagtgactacaatgaactgatataggcactatcctacatatttttaagaaataaaaactcgcaaattttctggatgtctacttgctaacttttaaaaacatttagcaaatggaatgtgcatttgttttactaaactattcctttcaatgaattaatcctaaataaataataaaagtatgacacagttacagggatctttataagttatgtttataggagcaaaaattagaactatacaagatgctaaccctctattaaagagtcatatttcctccatacaatggagaactgtgagcccattaaaacctgataatgtcatgatctctaatacatagtcaagtgtaaaaataggtagcaaatcaaaattatcttctctcaatgtacatctgtgcaagtctgtatatgctcacatgtgtgtgcataaatcagtatttcatattaatataaaatatctaggtgaaccacatgttgaccgtggctttgcattgggtttatttttatttttgtgtgtgttgttacaatagaatttgtataacaagaaagaaaaaagtaaatatgttaaagttaaaatatctacaaagtacaagaaatatgaattaaggaaaagtagagaaatggaatcctgagtcttataaagaataacaagaataatatctattgtgacccaaacttaaaaatttccctcttttgaccaatttctcaccctgtgtgttattagtcttcttttgatatctacctctaatttatgttggattaactgaggtaaagacacagacacatttctctgtgtcatttgtattctggcacctctctctatttggctcaacattagactgtcattttcattttctcaggtaattagtgataaccgtgtaccaaatattaaatatataattcatgacaattacagaacaatttcctggggatacaaaatatctgaaatataatttaccctctctgagtgttgccagttgaataaaagagtttaaagttattatgttgccttggctatgtccttatttctgtcttgcaatgcaattcacttttggattcttgcctgtattcctccaacagatcaagcaacacctaactaatagcgtaagaatctggccctctaattcaattcttgtacattttctggaaattaaacttgagaaattgacttctattgtagacttgatcttagattactgtccatgatctctggagtttttactcttgccactgggatcctaaatttgtccccttcctagtctatcagaaaagtacacccagcacattggggaataataacaattaattaaagacagaggataaagcctattgagacataatacttcctctatattaatgacttgggaaatgtatttttatgtaatcaacagaagcattgagtctctattacctaaattatctttatttgattagagacattactaagaaccttaagctttgtaataattgaacccaatattttcaatatgtgaaaagtgactttagtccttgaatattatttatttttgttatggctacacaaatgtatgcccaaactgtattctaacagatattgtggtaattatttgataacaattacaaattgaatggttttcatttaggaattttaaagccagttggagtgaaaatgtcctcatcttctctgggacaggtaaggaagtaaccagtaagtttgaaaaatatttggaaagttacatttaatttcgtaatcagtgtattatttcctttatgtttagcaaaatttgttggttcttgtaataagtttggggtcttcccccaactgcataaagatacataaattgggatttttgctgactcaagaaaccttagccaaatttcattgatatttcttcaccattcctctattaacaaagtttaaaaaaagataagaaatatgaactcaaagtatacttttatgattactattttttaaaatcacctatttttgtgactgctttattgaaacactgaatcacttcatgtatctgcctagtgactcaaaaagtgttattacaattcactttaaatgaaagtgccactcacaatcttgataattaatgcaggtaaccggctgtgtgagaaagttaacatcagccttaacctcatgcactgaactgtttttcacatgtcagataggcatttcattttgaggaaagccatgtttttgttccttttgtggttggaatttataattaattatacaacatggagatgctgtattttaattataaaacattttaatgtggaacacatgagacctaggatacagaatgtagcaatcaagttgtacaacaaataatcaaacctctaattatgaaagctacagtggttcctgaaatctaaaagcaaaagtcacaggatggtttatttaacaatagaatttattatattttatatcttcttcaaagcttactttgtttttcctcttataggaaatcctttttacctacatagaaaagttacgttattggaatttacatccctcctccataagaaaaaagacatcttctcttccaaatgtccaccatgctaattttatctctttcttattatatttaactttaaaaatcttgatcattataattgctgtgggtcgtatattcactgtgaatattctgtgagagatgacagttttattcttaataacctgcatattaagaatcgccatgcctttttcatggttagtgttcaatccacatgttaaaagaatgaaaaatgcattactgaattatcttatattacccttttttgcagaatcattctttgtagtgttagtgaaatatgccgaatattaaaataggaaccaaactttttataaaatgctgcctctgctgtctcacaatgcctaatgctacctctaaacgatagttattattcttttctgtcatataaagaaacatagtcatgccaattggttttttgccactatatatccagtgggaatcacacagagaatcaattcattacaatgataaattacaccattaaatagtatattatgccagaataatctagaaggtcatgaaagaaagattaagagatgacaagagaatctacaatgtgtaagaaagtgcatgatacatgaaaaaataggttttggtttgatatctaccaaatatgttaaatgaatatataaccctgtaaaaattgaaaaattacatacttgtaaaatcagaataaaacttgagatactcatcttttgtataacttacatgaaattgtaccaagtgatgactttttaaatacagttctagttatttcatatttctactcaagtaatgtggtttgctccataggagttatttgaaaataaacctcttttcaaatgctcaaatctattattgttctgtcagttgtgcaactcataaatactctttcctattctcttcaaaacacagaagtaatattaaaatcagtgggaaatattcttagacaagtcattgatacaaaatattaaacatatataaaaagtaaactttaatattcaccatgtatgttattattttatattcaattttataatttgttaacacacaaaagtattatgtcctgaccatatcacactatcaccgcgggaggaagggtgagtgggtagaaatacctgttattggtttttaagtagatcatagccaaagctagagtagcacctggacaagtcacatccacatttatggtatctccttcctattgaaagaagagtttatgcatgtaaaagagttctaaattattataaaattcctctgaataataactatgcttaaaattaacacatttaccaatgtcagtatgaacactagtattttccaattaacttcccagcttccagacttttgatctattactttgctgtgtacttactttgatttgataacttggtgatttatgtttctccctatgcattcctgtttgaaagcgcctacgtcctccaaccatgtactgatagagctgctcaggcacattgagatcagacatacctatcaaattgctgccatgctggaaaagacaataacagacgagtgaaaagaaattttatgaaggaagatccacaacacatacccataacaaatataaaaatgaactaacttcaaagcaggttattttgggttttgttttttttatttccaatttaaagcaaacattaatcatgagttaataaatattaataattctcataaaagttttaatacatgaatgttcaactttaagtactgtcttaaaatacataagagctttagagttagtgacatttaacaataaagaaaaatattagttatataattgaaactggaactgtaaatacctgaatactgtcattattgtacttaagaacttttccaacaataactatgataataatagtaatttattaaatgcatgctctgtgtcaggcactattctgtgtgtttaacatgaatgaacagccatatcaaatagctactattaaaaccctattttataaataaggaaagtgtggcacagagggattaagcccaaggttatacagctattatagttaagttgcagggctatatataaaacacggccatctggctcaacaatccatgaagctgattaagcaatacacaataatgtagttaaatgacttgactcactagttaggaccagaattcaagttgcaattccctgtgtgattcttttcttttttttttttttttttgagacggagtctcgccttcttgcccaggctggagtgcagtggcacgatctcgactctctgcaagctccgcctcctgggttcacaccattctcctgcctcagcatcctgagtagctgggactacaagcacccaccaccatgcccagctaatttttttgtatttttagtagagacggggtttcaccgtgttagccaggatggtctggatctcctgacctcgtgatccgcccatctcagcctcccaaagtgctgggattacaggcatgagccaccacacccagctgattattttccattataccaccagcctctttagctcacgtgccaatgtgaattcaaggccctaacagatggtcaaccacaaggtggattttcagaacacacatgaaaaaaattccttccactataactttttttttttttaagatggagtctcactcttgttgcccaggctggagtgcaatggtgtgatctcgattcaccacaacctccgcctcctgggttcaagcgattgtcctgcctcagcctcccgagtagctgggattacaggcatgcgccaccacacctggctaattttgtatttttagtagagatggggtttctccatgttggtcaggttggtcttgaacccccaatctcaggtgatccgatcacctcggccttataactttctttatatcatttagtttgaccataagaatgtattggtggtttttcaaggggaaccacatttcaagtgaaacaatcatttaatgaaacatttctggtaattctgtacacatctcttggatggagttaaagatgggtcaatctgatactgcattttgtcacaaggaagatgctactgggacaacattctgggatacacagtgaacatcactatggcaaaagggggttagggtttgtttcaagcagctactatagactcttaaggctcccgatcatatacgttttcactattctctgttttcagtcatagtgggctgtcacttattcattctatgtcttgaacgctttaaaaaaaaaaaactttattcccttcagtttgttcatgaacactgcaagctggaggaaaagaaatcttaaagtcccactcttgaccacagtttctctcaatttgcaaatctggtactttgaaaaatatccaaaaagacaatagagctgggcagcagattaagtcatagtaagggacaatattcaggtttaggtgtcaacgttatttgtctcaacatgtagatgtcctaactgaagcatgggaaggcataggctatgcttacccccaagcagaccatgcccagggccaagccagcagctaaggagtatgactctctgtcagtgcagtattccatttcaggaccaggaggccgtcctgtaaaaacaaaagcaacacagttcaaactagcttctcaaaatctcatctcataaaaatcttagagttaactttctagcaagttgcactggagatacgaatgggatataactattcagaaagttatgacactataataaatggtgtccacaactgtaggtttacctaccaaaaaaaaagggcccaaaatagttctttttaaattgccaatttaagtctttataagcaatgatattcaaatactgtgaaactttgagtcttaccaaaaaaattaccaagtagtagaaaaaaattttaaagggaaaaaggtaagagtattcaaaaaaaaagttttatttttttgttaaaacatctgggccgggtgtgctggctcatgcctgtaatcccagcattttgggaggccgaggcaggtggatcacttgacgtcaggagttggagaccagatggccaacatggtgaaaccctgtctctactaaaaatacaaaaactagccagggtgccaggtgcctgtaatatcagctactggggaggctgaggcaggaaaatcgcttgaacctgggaggcagaggttgcagtgagccaaaatcaggtcgctgcactccagcctgggtgacagagtgagacaccatctcagcaacaacaacaacgaaatatcttacattttgttttcattactttcaaatccacacatcacatgtggtgaaacatgttcgaatgatgataatgaataaggaggtcacttacttatgttgttaagctgttaaatattatgtttagacatttatttcgagtgtatataataatgagccctactatggtagaatttctgtgtactgatcctagaagtctgactggatacaaaattcacacttttaaaagcaccctataactctaacactaccttgttgaaaacgataaaatgtactatgtattaaaacccttccctctgaaaaaatgttcacattcctgaaattttatccctataggaaaaaaatgcaatttaaaaaaaaagaaaaaaggctggacgtgctggcccttgcctgtaatcccagcactttgggaggccaaggcaggaggatcacttgaggtcaacgagttcgagaccagcctgtccgacatggagaaatcccatctctactaaaactacaaaaattagccaggcatgctgacagacacccgtaatcccagctacttggtaggctgaggcaggagaattgcttgaacctgggaggcagaggctgcagtgaaccgagatcgccccactccactccagcctgggtgacagagcgagactctgtctctaaataaataaataaataataaaaattaaagaaaaaaatcacacaaaggtaatcagtgtaatgtttatatataacaacaaaggattattagaaacaatctaaaaagttctaaaagttaaaaaaaggcattttacagaccatcgactcaatgaatattacacaaaatttgttttaaaacccatttataacaatgatctataaaaacaatttttaggcggggcacagtggttcatgcctgcaatcccagcactttgggaggctgagacaggcagatcacaaggtcaggagatccagactatcctggctaacaccatgaaaccctgtctctactaaaaatacacaataattagccaggcgtagtggcgggcgcctgtagtcccagctactcggaaggctgaggcaggagaatgacgtgaacccgggaggcggagcttgcaatgagccaagattgcaccactgtactccaggctgggcagcagagcaagactctctcaaaaaaaaaaaatttttttaatgtacattctgacagtaattatataaaaaggcatatacatatgaattaaagatgaaatcttctatatacagtgtgaaagaggtatgccgcagctgtgagactgtgcaatgacaccattagacatcatcatgatatagccaaagaagggtagactactttgcagatgaacatgctttaacaaccagtgttgaatattttcagaataagcgtttttcagatctctgacttatgctaccatgtattgtgatagccaaaacatttcaactttgggaataatttcatttatcattatagtagactaaattatgggtcccaatcttcactggttctctcctaggtttctatcaacaccacgagagaaacacaccctccagcctgggtcccagaatgaggcaggtgaggcagaacggcagcagaacagccggctacacatctacagcctaaagcagagctgcctgggccaatgctatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacaggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatcaacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaaagtccaacaatgatagactggattaagaaaatgtggcacatatacaccatggaatactatgcagccataaaaaatgatgagttcatgtcctttgtagggacatggatgaaattggaaaccatcattctcagtaaactatcgcaaggacaaaaaaccaaacaccgcatattctcactcataggtgggaattgaacaatgagatcgcatggacacaggaaggggaatatcacactctggggactgtggtggggaggggggaggggggagggatagcattgggagatatacctaatgctagatgacgagttagtgggtgcagcgcaccagcatggcacatgtatgcatatgtaactaacctgcacaatgtgcacatgtaccctaaaacttaaagtataattaaaaaaaaaaaatttcaaaaaaaaaaaattttgtctataaaacaggtaacaatttgaatgaagaaaacaaaaatttaatgaatggcataaaaataaatttcaagaaaatgaaaggtgtgtatgatgacttaattaaaagaatgtaaaggaaaaaaaaaaaaaaagattttccagagtagctacttgtctctgccatagaattgttagatagtttactgtaggtggactgtaaataaatgtttgcttagttctaacatttgactgatattgggttgatcctttgagacttggtatattgtggatatgcctaaagtttctttttctaccaaagatgtgttgtaatctatgtcattacagaagtaggagagggaaggaaactaccattaaaatcagtacttaggagcccaggcactgttctagatgtttgcatatattaatatgatttcatttcatctttacagtaacctagaagaaagatatttaaataatgactttccagatcaaaaaatgagttttgatggcttttctcagttttcataattggcagaactgatttccgaatcctttaagttgatcagttgacaggaatgcatttatgatttttatcttttcttttggggttacctttcagtttgactttgaaggatcactttcccctgtcattgcgcccaaaaaagcaaggccttctgagactggatctgatgatgtaagcattattatttcttgctaatataaattaatttatggatattcatactattcttccacttctgtggtattcctatcaattcctctatctttccaacacctttcactttatttattttaatactgaatagcaattattttgaagagtaggatctgttacattttctatggtctttaatgattatccaaaaattaatgtatgtattactgcatgatttcagtttgggtttgtagacattttattatcaactgatcacctgaaatgacagcatttaccttttttatgcagtgttttttaaattaaggttctcaatcgtatcaggttccatggtatattccttttttttttttttttttttgagacggagtatcgctcttgttgcccgggatggagtgcagtggcacgatctgagctcactgcaatctccgcctcccaggttcaagcagttctgtctcagcctcctgaatagctgggattacaggcgcccgccaccatgcctggctaatttttgtagttttggtagagacagggtttcaccatgttggccaggctggtctcgaactcctgacctcaagtgaccttcctgaccttggcgtcccaaagtgctgggattacaggcatgagccactgcacctggcctccatggtattattcttaagtggtccaaatatgtttttttaaattgtggtgtaatttacaaaaatgaaatacatcttgagtttacagtttgatcagttttaatatatgcacactcatgtaacctacactcctataaagacacagaatatttttataactccgtaaaatttccccgtgcggtttttttttttttttttgagacggagtcttgccttattgcccaggctggagtgcagtggcacgatgtcggctcttcacctcctgggttgaagctattctcctgcctcaacctcctgaatagctgggattataggcatgcgccaccacgcctggccaatttttgtatttttagtagagatagggtttcaccatgttggtcaggctggtcttgaactcctgacctcgtgatctgcccacctcggcctcccaaagttctgggattacaggcatgagccactgggcctggcccctcttgctgtttttaatcagctttattctcttcttctagcaatcactgatctgaattctgtcaccatatcttagttatgcctgttctagaacttgatgtaaataaaataatatagtatgtaatctttggtataagatttattcagcataatgcttttgagattcattcatgttgttacagatacccgtagtttgtgcttttttattgctgagtagtatgaatataccatagtttgtttatccatccttcttctgctggtagatatctaggctatttccattttttttttaagtcttatgaataaagcaagctactgccaaaattcactggcaagtctttgtggatatatattttctttttttggggggggggaggacagagtcttgctgtgtcatccaggctggaatgcagtggcacgatctcggctcactgcaacctctgactcctgagttcaggcagttctcatgcctcagcctccccagtagctagaattacaggtatgcgccaccatgcctggctaatttttgtattttcagtagagactggattttgccatgttggccagcctggtctcaaactcctggcctcaataatccacccatgttggcctcccaaagtgctgagattacaggtgtgagccaccatgcctggcccgtggacatacattttcatttctttttttttttttttttttaagagacagggtgtcactcttttgcctacgctggactgcagtgatgctatcgtggttgactgtaatctcgaactcctaggctcaagccatcctcctacctcagcctccaagtggctaggactaccggtatgctccatcatgcctggctaatttttaagtaagaccagttgtctaccaaaaaaatttgaaaattagccaggcatgatggcacataacctgtagtcctagctacttggaggctgagtttggaggatgttaaacactctttcatgtgctcattagctgcttatgtatctttttgtgaagtttctgttcaaatctttatcaacttgtaaattagattttaaaaaatatgtaagctggtgaagttcttacatgttctagacatgaattcttgaccatattttcccttagaatgtggctttaacagtgtctttgatgagcagaattttttattttagttatccaatatatcagttttttattttattttattttatttttgagatggagtctcgctctgttgcccaggctggagtgcagtggcatgatctcagctcactgcaagctccgcctcccaggttcatgccattctcctgcctaagcctccccaatagctgggactaacaggtgcccgccaccacacccagctaatttttttgtattttttttagaagagatggggttccaccgtgttagccaggatggtctcgatctcctgacctcgtgatccacccgcctcggcatcccaaagtgctgggattacaggcatgagccagtgcacccggcccagttttttcttttatggttagttctttctgtatctagtccaataatttttaatttagaataacacactgtattaagccttataaaaacaccagtaaattccaagatctggaaatagcataaaccacattctctgaaccaaatgcagtaaatcacaagtagaaccaaaatagactgaacatttggaaaatgtagtccaatcagtctgaatataaaaatcagttgattattagattatattagtagccctggcatcttatacatgtggaaagatgaatacaccagatgaatgcaggtggaccttccttcttaccaaaacacagttcagtgtagtggccactaacttgccatctacttttcctataaaacctagcctgagataatcttaaattttctctctcaatctctacctaaatagtataattcttctcccaatgtctttcctaaaagggcatgaaaagattttttttaatggtttttaaaggtggcttgccttaacgtttataactggcttgctattttatagttacttcattcttagcattgtcttttttttaacatactcttagatcaacttaatgtgaaaatgaaacttgaattgttttaagtgaattaattttcttatgatattataaggaggtattatttttaaaaattaatattctttttattcttctcaggactgggaatatttactaaattcagactaccaccagagtgttgagtctcatcttttgaacagatctttatgtctgagtccttcagaagcttcacagatgaaggatgaggatttttcacagaatctcagtctggattcttctacacttctctttactcacatacctgcaattttttttgttcttcaccttgtgtatgaggagcttaagttgaatactctaatgggagaaggaatttgttcactcgttgaacttctcgttcagttggcaaggtaaatttgtttgtaggttagaaactgccaggaagtcctgagatgactgtcttttccatgatatcatatagggaccttgtaaatacgtttctgaaatctgccttctcagaaaactaggacatctctgtaaaccacagagttgtttgaagatactggttttgtaagggcctgtgagccatgcagggatttttagtctttgtcctgagattagtggaaggtcacgaaaaaatggagatgacctgctcagattttcattttgacaggatgactgactgactatactgtggtgggagttctagaataacatctgctgttttgtaatatccacattcaaatagtgctttatagttgacaaaatcatagtttacatataaagtctcaaacaaggtaagtttcctattttagtgatgaggaaacttgcctaaatttgtttcctgggatatgagtgtttgatagttgtggactcattttgctatgctatccttgttgcagtctgaggttgtccctgtctttgaggcactcatagtagatccacaataagatagttctaataatacgtttcaacacctttcaagagctttgaagcaccttgtgtatggctcagaattctagggtcatacttgtgtgttgtttgacctttatgacctttggtgataaagaagttgaatttgaattgaaatgtcagcctctgagttaagacatagtacattttctaatttctgttgtcttttttgagatcttgaaattcaatcctgagacatggcagttttaatcaatggtaaatatctcttaggatgtcattactatcatcaaaattattttgtaattaaataatttccaaaccataatcatggctgtctgaaataagtaatgtgtatgatgttttacattttatcaggttttttttttttttacatattttatcttatttactctttaaaacttcagagtaagtgagctgatattgccccatttcctagaagaaaatactgaggtttatagacatgacttatggaagatcacacagctaatgaatagcagaggaggaactagatcatggtgcttttactgtagttttacttccacaaaatttagcaaaaagaggttgggttccatttgtcacactgggcactttaaagtccaaaaatacaatagagagactctagatttggttatctttctcataagtaagtttttaaatttaaagattcaactaattaatccttccaattctgttgggagaaagtgctgtaataccttcttttttgcatgcccttactgttttagggacttaaaattggggccttatgtagatcattactatagagactacccaacgcttgtcagaactactggacaagtgtgcacaattgatccaggtaagtagtcgtgcttttaaatattttctaaacagtgtagtgatatttccttgtatctttctcaatgaatagcagaggatgtatttcttaccattagcttctaagtcaggggcaatgcctttccaccaggcagattttagttcgtagtgcttgttttctgacacgtagtaagccataatatcttcagtgtatagggaaaattttacccatccctaaggttctgacttgcaaaagtcagagaaagagcttccagtgtcaaggatgctttttttttttgagacggagtcttgctctgtcacccaggctggggtgcagtggcgcgatctcggctcactgcaaactctgcctcctgggttcacgccattctcctgcctcagcctcctgagtagctgggactacaggtgcccgccaccacgcctggctaatttttctgtatttttattagagacgaggtttaatcgtgttacataggatggtcttgatctcctgacctcatgatccacccacctcggcctcccaaagtgctgggattacggcgtgagccactgcgccaggccaccaacttagacttgtagagtacagttagtaccactaaccatatgctacttaaattcaattaaaataaaacatatatttcctcagtgtactagccgcattttgagaactcagtagccacatggggctagtgctaccatattggacagtgcagatacagacacagaacatttccatcactactgtactgtcctagaccctgagctaaaggtactgaaatttggggcccagttgttggaacagagctgaatcctggatgtttcttttgtttttttcacctttagggttagggcaaaatttttggttagattcttcttcttctttttttttttttttttttttttttgagacagggtctcactctgtcacccagacgggagtgcagtggtacgatcttggctcactgcatcctctgccttccaggctcaagcgattctcctgcctcagcctcccaagtgcctgggattgcctggggttataggtgtgtgccaccacgcctggctaatttttgtatttttagtagtgatggggtttcaccatgttggccaggctggccttgaactcctgacctcaagtgatccacctgactcagcctcccaaggggctgggattacaggtgttagccaccacatccagcctttggttagattctttatatgccttgggaacaagaatttgctaaatttccatccagggtgggataaaatagaagtcatttaaattctacatttaataacatagttccttatgtgctgtggcagaaaacatgaagcattttggagaatatggaaaaacgttattccttttttttttttttttttttttttgagacagagtctcgctctgtctcttaggcatgatctgggctcactgcaacctccacctcccgggttcaagtgattcttctgcctcagtctcccaagtaggtgggactacgggtgcgcaccaccaggcccagctaatttttttcgtatttttagtagagacggggtttcaccatattggccaggctgttctttaactcctgacctcgtgatccacctgcttgggcctcccaaagtactggggttacaggcgtgagccactgcacccagctggaaaaatattattctagttgtttcaaaatgacaagtaactgttgatcatcttccgtttaaaataaaataatgttgtcttaatgtattttcgtgtctttttgaatatttatctaattttaaaggtcaaacaggatttatgcatcatccatcattttttacgtctgagccaccaagtatttatcagtgggtgagttcttgtctgaagggcgaaggaatgccgccttatccttacctccctggaatctgtgaaagaagcagacttgtagtcttggtatgtatgtggagtgttactacctatctcctttttcttttaaaatttagttttaaaaagtacacctaatattaagtttttctttctgtgtatagttctgtgaatttcagtacatgtatagattcatgtaattactacaatgaggatatagaacatttacatcaccctcaaaaatttctctcatgattttgagactcatccaagttgtttcctgtatcgacagttcattgcattctatggctaattagtagtttattgcatgaatgtgccatagttggtttttcattcaagataattgggttgatttcagttgttagcaattgtaaatatagatgctgtcagcattcatgcttagcgttttatgtgaacataagttttgctttctctaggacaggtacctaggagtaggattgatgggtcatacagttaagtttatattttgtttttaaagaaactgtcatctgttttccagagtggctcttccattttacatttttaccagcaatatttaagagatcatttacctgcattcttgttggtatttggtattgtcactcttttttatttttgtctttctgagagatgtgtagttatacctcattgtggttttaatttgcattttcctaatggctaatgatgttttcagcgttctaggtatgaggttttgtcagatatgtggtttgcagatattttcttgtggtttctaccttgtcttgtctcgtcattctctaaatacatcaaagaacaaaagtgtttaattttgatgaagctagtttatctgtatttttctttaatggatattgctttcagtgtcatgtctaataattctttgtttaacttcaggttttgaagattttctcctgggtttctttgcatgttttacatttagatctctaatccattttgttaatcttttataacatgtcaggttttaagtcaaggtttttattatttcatttggatatccagttctttcagcactgttttttgaaaagactatccttcctctattgcatttgcacttttgtcaaaagttaatttggccacattcttgtgtgtctgtttctggactttctattctgtttcattgatctttgtggctgtctacgctgtcattactgtagctttatagtaagtctttaaaattgattagcgttactcctcccttcattactcttcttgccttttcatattgattttatttttatttttatttttgagacagagtctcactctgttgcctaggctagagtgcagtggagtgatctcagctcactgcaacctccaccttctgggttcaggcgattctcctgcctcagcctcccaaatagctgggattacaggatcccaccaccacgcccggctaattttttgtatttttagtagagacgggatttcaccatattggccaggctggtcttgaactttcaacctcaagtgatccgcctggctcagcctcccaaagtgctgggattaccggtgtgagccaccgcgcccgtcccctactgattttataatccgcttgtctatagctacaaagaaaaatcttgctgaaatttttttcaaagaaacacttctttatttatttttattattttttatttacctctagctgcaaatctcatgatttatttatttttagaaattagtttgttattactggttaatacatgtccaagatcaaaccttcatatagaaccatagggctgtaacggtgaatgaggtaagtttcttggcatacctgttcctcagtccccccatcctggagcagcctgctcataggccccttgtgggccttttcaggtggggtcttcccaggcttgcaggagaaccatatgcttttgtcccttctctcaaatgttggcagactgcaaatgtcttttcctcctgcccttctttttctttactttacgttttgctccgcttcatggtgagaagtgcttcagagtccccccatggctccaaaacagacatacagaatgaagattctgtttaaaaaacacagatttttttaatgatagcaaaatatatataacataatatttgtcattgaaattgttattattattatttcttgagatggagtcactctgttgcccaggctggagtgcagtggcacgatctcggctcactgcaacctccgccacctaggttcaagcgattctcctgcctcagcctcccgagtagctgggattacaggcatgagtcaccaagtctggctaatttttgtatttttagtagagatggggttcaccatgttggccaggctggtcttgaactcctgacatcaagtgatctgcccaccttggcctcccaaagtgcaggggttacaggcgtgagccactgcgcccggcctgaagttatttttgagtgtacaatccagtggcattgaatacgttcacattgttatgttgccatcaccactgtccgtacccaagacttcttcatcatccccaacataaactctgtacctattagagtgactccccattccccttccttccaggccctggtaattccgttctctttcttatgaatttgtctcttgtaagtacctcatattatgggaatcaagcaatatttatctctgtgtctggcttatttcacttagcataatgtttccaatgttcacccatattgtagcatgtatcaaaattacattgttttaaaggcagtattctatatagtattccattgtatggatataccacaatttatcatttcacctgatgatggacatttgggttgtttccaccttttgactgtggaatagtgctgctgtgaaccatgggtatgcaaatatctgttcaagtctctgctttcagttctttttaatatatacctggtggtggaattgttgggtcatatggtaggtaattcgatgtttaactttttgagaaactgctaaactcattttcatagtggctataccattttacatccttatcagcaatgcaagaggaagggttccaatttctccacagtcttgccaacacatattattattttctatttgtttttttaaaaattatagccatcctagtatttatgaagtgatatctcattgttttgatttgcctccttaatgattagtgatattgagcatattttcatgtgtttattggccatttacgtatcttctttgaagaaatatctatgcagatcttttgtgtatttgaaaattggatttttatttttgagtttaggcatttttatgctctagatattaatgtgtcagatacatgatttgcaaatattttctcccattctataggtttttctgtgaatgtcttttcagtaaaactggcatgagtgctcagtttacctctctggcctttcatcttagttttatcctcttggtattcctttataacttgtcagctcagagatctatttataaaaatatgaatttatttttatttataaaaatattctgaaaaatatcaacagaagcccttattgataggtttttggtttcgtcattataagttttattggactttttttattttttattttttttatttgagacaaggtcttactctgtcacccaggctggtgtgcagtggtgcaatcatggctcactgcagcctcaacctcccggggctcaagcagtccttccacctcagcctcctgagtagctgggaccacaggtgcacaccatcacacccggctaatttttgtatttttagtagagatggggttttgccatgttgcccaggttggtcttgaactcctgaccgcaagtgataaattttttttatgtgatgttagctaatgagacatttgtagtaaccttctagcttatggtggctctttttctattgactcacttgtatatgcggagatggcattgtctgtgtaccatttgttgaaatgagggaaaggaaggaagtgagataacatttattgggagcctgttgtcttcaaggaacttcatgtatgttttctcatttaatacagagatcttatgtacttttgtgtttgtgttatatgttgaatattttaactcttttgagagactttttccttggtcttatctttttcttttcctcctcaaagcaaataccactacagctctgtactactagatacttcttagatagtgagagagcactattcgatacctgttggaatgactgaaaataacttttggtgaggatatggagcaaccgaaactctcatacattactggtgggactgcaaaagtggcacagcactttggaaaactgtttggcagtttcttgtgaagttaaacatacacttatataagacaaattccaactgcttggtatttacttaagagaaatgaaaacatatgcctacataaagacccgcatgtatgtgaatgtctttggggccaggcgcggtggcataatctcagcactttgggagaccgaggagggcggatcacgaggtcaggagatcgagaccaacctggccaacatggtgaaaccctgtctctactaaaaatacaaaaattagctgggcgtggtggcgcatgcctgtaatcccagccactctggaggctgaggtgggagaatcgcttgaacccaggaggtggaggttgcagtgagccaagattgtgccactgcactccagcctggcgacatagcgagactccgtctcaaaaaaaataaacaaataaaaaataaagcagctttggtcatagtgaccacaaactggaaccaaatgttcatcagtttttgagtaggtaaacaaagtttggtatgtctgtataatggaatactactcagcatgaaaaggaagaaactagtgatccttggagagacgtgaatgaatctcaaagacgtatgctaagttaaagaagtagcacgaaaaagactacatatcatatgattcattcacatgatattgtaggatagacaaaactgtagagcaagaaaacagatgaattgtttccagtgctgggtgtaggaggaaaggattgactacaaaaggaacgagggaactttttggtatgatgaaagtatactatatgtgagtgtggtagtggttatgtgatataacatttgtcgaaactcacagagctgtacacctaaaatggacgaattattctatgttataattattttctagttacacttcaattatgtagctaggtgtggtggctcatacctataatcccagcagtttgggaggctgaggcagaaggattgctcgaggtcatgagtttgagcccagcctgggcaacacagcgagactctgtctttacaaaaaataaaaataatataaaagaattagctgggcatggtggtgtgtgcttgtagtcctagctactctggagactgaagcaggaagattgcttgagccaaggagtttgaggctgcagtgagctgtgattgtgtcactgcactccatcctgggtgacaaagtgagatgctgtctctggaaagagaaaaataatgttaattttcttcttttgcagagtattgcactgtacatacttggtgatgagagctcggtttctgatgaatcctcacagtatttaaccagaataactgtaggtaagttggtgcaatgttgcctctggaaacaaatttttgtagatgtcagtatcagaattgaaaaaagaattgaatttttcttgtttgctttggcggccatgtcttacctttttagtactgttctggtctgttgcggtctgttgtccacaactaattttcaggtatcaggattacttaaaatctaataaatcttgtattttcagtgcgggtaaaaaggactattttagcctgaaggaaattattgtaccattgactcttgaacaacatgagtttgagttgtgtgggtccacttacaatgaaattcttttcagccaaatgcagatagaaaatgcagtattctctgatgtgaaatccatatgcaggttctgcagggccaattgcaggacttgagcatgcagggatttgggtacacatcgggtgtcctaaccaatcccctgagtattctgagggccttgactgtacttttcagcctgccacagtattgcttattttattatttttttagatgttgtttgctaatggattcttattttcaaatgtcttctacatgttacatgttttctttaccaggatgactatcaaaattaagtttcattttgttgccttttagccccccagaagttgcaagcagaacaagtggaaaacaggtgacttttatttagactgtgcttttatgtcagacacttaaaacaatattatttactgttctgcttaattactttatgttttattctcttataggtttagtttcaggcattctacgtctgtttctagtctagctgaaagattggttggctggatgactaatgtaggtgagagcttctttgttacctgctaactaggccgtgcttcctccagactagctagaagtggaaggcatgaggagagaggggctctggctttgtgaaaaggcctcacaagattgagattatggttcatcaagccatattcttttttctcgacaatctcacaactttcatataataatatgtgggataccagctttttatcttggtgcataaggaatctttatttgccattacattggaacatttgaggctatggctatgtaagctggtctctgagaatggagaactctaatcaccctacatatacacctgaaatcattgtgatactcagatatcagaaatgggtggttttggcaaagtctaaaagcaataatataaacatttcagggtatacttttgaaggataaatgcacttttgaagggatttcaggcaccaagatgaacattgaactgggaagaggaagaggaaggaaaagcgttctatattccctattccccaaacctatgctcctaggttttaaattaagtaaaataccaaagaaattttttttcacaaagaactgaaaaacaaaattaaaaattactgccacgaagacatgattttaaaaatgaggatattatatgggatgtatgttaaaaagtaaagttttaatgaatattaaaagatgtttttgaagtcttatctaaagtatgttctaaatgaagtttctgacaggtttttttttttttttttttgcattttaccttaaaaatgacaataactgttgcgtagtatacatacaggatacctatgctgaaaaatattggattagttctatccatttgtatattgcataatatttaataagtgttattctcatataaggaaacattttttgcctcaatagttaatcgactttttatattataaataatgcatagtattataaaatttagaaaatcatgataagaaaaacatgatttaattaacctgaggataaaaaaatttaaatatgaaatatggtatacttacaaaataatatgtcaaacgtatatgtttagtttagagaatggtactaaagtgagtattgatgtactggtcacccacccctagaaatagaacattacccgcatagtagaaggcccttacatatctgttcttggatggtcccctcctgtcacacaccccaatgttatagtgaaccactgccctacctacatttgtgttaccttactcttgtttttctttatagttttacatctttataaattgctaggttttatgtagttttgaaaatatatagatgtaaatatatgttcctttttcttcactcaactttgttttttaaagattcatccatgtcgactcacgtagcagtagcagtgggtcattcattttctctgatatagagattactttgtttgaacatatcacaatttaattacccattctgttaatgatagacaatcggacttacccctttctccatctctttttttttttccatagcaaaccagtattgctaatgaatatttttatacctgtgtcttggtgtacctgggtgtaagtttctatatggctgttgatggatcaaatgggtggactgacctatacataccaactgttttccaaagtggttgtaccagtttacactaccattggctatggataagaattattgttgctcgggccgggcacggtggctcatgcctgtaatcccagcactttgggaggccaaggcgggtggatcacgaggtcaggagatcaagaccatcctggctaacacggtgaaaccctgtctctactaaaaaaaaactacaaaaaaaattagccgggcatggtggtgggcgcctgtagtcccagctactcgggaagctgaggcaggagaatggcgtgaacccgggaggaggagcttgcagtgagccgagattacaccactgcagtccatcctgggtgacagagcaagactccatttcaaaaaaaaaaaaaaaagaataaaaagaattattatcgctctacatagttgccaacacttggtattgattggctttgacatttacatttctcagtggctttaatttgcattttcctgatcactaattaggtagagcatcttttcatatgcatattgcccatttatgtttccccttctaggaaatgtctttttgtcttttatatttttctattagattgtctttttttcttcaggtttttacaagttctttcaaagagacttcctatactagtccctgatgttaagacattagtctggtagtaagaggaataaaatgaatttatttgtcaggatagatattgttgccaacttcagctaggataattgggacagtggcaagtctaaattaaaatgtttctctcttcctttaaccattaggattcactttaagagatttggaaactcttccctttggaattgctcttcccatcagagatgcaatttatcactgtcgtgagcagcctgcctcagactggccagaagctgtctgtctcttgattggacgtcaggatctttccaagcaggcctgcgaaggaaacttacccaaagggaagtctgtgagtatcaacatagaaagttcagagttccaattttagccttaaataaaatcataaagtagaaatgttcttcattttcctttaaggctttttctaagtatatatattagcttgtcttttatattatatgccagacggggtttgtaattgtatgcgtcttattaattgttaagttgagcataggagcaggagattttgtgaatgttctgtcttgtgcctggatctttctttgccttgaatcaggacaagtcctgagtgtagtcatggaaactaccatggctatttccctacttgtaccatattagtaattaaccacttcgtaattattacataggaaaagggagagcacatatatcctgaatttggatgagtaattatatataaatattttctactgcatatttttcgatgtgttgaattttttgaatttaaccttttaaataggtgtaaacatatttatttaatcacataaaactgcagccccagggaaaaaatgtgtttttttagtagagttgtttaaaaagatgtcttaagctatccctcccgaaatactgtctttcatcaatcatcaagtctgtttttttttttaaatgagttctaggaatcctgcaagtagaaagtaaaattatttcattactctccaattatctttttatatcatcctctcttaaaacttgaaaatgaaacttttaaaacttattctagaattctaggtaactttaaaaaatgaacagtagaatctcatcaaggaggattcaggaataataattccactcctggtgactcttttatgttcatgtccctgagaagacagtgggaatttggtcttacctcttagtagcttttgaatcaatacataataatcagtgcattgtaactatgagtcaccttaggtcttattactacttcttcagagcctatatcaaaacttattcctaacctcagagttgcctaatgtgtacccatgccggagtcagtttccatgggcatctgatctccagcacggtcatcccagcacgtctctcctttaatctgcgcctcaatcacagctcttcgttgaattagtatttacatcctgttttaaacagaaaacaaatctttttgcttataaaatgattttcctgtgagagagagcagttcagcaccattagcattaaaatattaatctgtatttgaatgtcattttaagtaattatgtctaaatacagtttgttcagttgaggctacattttataactaatcccatctaaatttattttgtcactgtttgagactatgttttatagctaactcacccattagaatatagtttttttttttaaattagatattttataggagctaaaaatgaatttttaggaactaaaagtgattatttggtcgtatctacttttttttcaggctgaccttgttggtttcacattaaatgttgcaaaactttaacatttcaacttggagttattcttttgttaaaagagtataatactgtttttgagagaatatgatatgattccacgcaattcacatctgtgttgcagttagatttaattatttggactgggaagccccatattaaagcacatgctgggcttagaacatgatgacaatcaaggaatttaccctcttacttgttttgctgtagttcagtacttttccttctaagaaatttttattggaaacacattttttaaaaatagtgaaaactggctgggtgtggtggcacatgcctgtaatctcagcactttggggtggccaaggcggaggactgcttgagcccaggagtttgagaccagcctaggcaacatagtgagacctcatctctacttaaacaattttttaaaaaatttagccaggtgtggtggtatgtgcctgtagtcctagctatttgggaggctgaggtgggtggatctccttgaggtcaggagttcaagaccagcctggtcaacagggcaagactctgtctctacaaaaaataaaaaaaattatctgggtgggcggtgcacatatgtagtcccagctactcgggaggctaaggttgaaagcctgcttgagcccaagaggtggaggttgcagggagccaggatcacaccactgcactccagcctgagtgacagagtaagaccctgtctcaaaaaaaaaacaaaaaaaaacttactaatggaatccaaccatgatcctgtctatttaaagtagtaaagtaaaaggtatttcattgtgtgacttcccccaacccttggggtatatcctttcaggcttttttccttctccttctattaatgaacagacaatatttaaattagcattattagcagtgactagtattcatattctacttgcaataatttttttttaagaaatgatcaggatgtagttagatttttttttatagtttattcagaatatttctctgttcgtatccagccccttgactgttgccctaaatttaaactctccccgtcatttccaaatatttccaagtaggcaatgtagtacttttgtttgtttgtttgtttggtttgtttggttgtttgagacagaatctcactctgtcacccaggctggagtacagtggcacgatttcggctcactgcaacctctgcctcccgcattcaagtgattctccagcctcagcctccccagtagctgggactacaggtgtgcaccactgcgtctggctaggtaatttttgtatttttagtagagaccgggtttcaccatgttggccaggctggtctggaacccctggcctcgggtgatccacccacctcggcctcccaaagtgctgggattacagagtgtgagccaccacacccagccagcaatatagtactttttagaaagatttgtagattagagtcccagtatacattgcggccccaacccaggcctgctttggaaaacatattttctctgtgctagtatagtcatgacacatcagcctatatatcctcatgttcagcaaatgcacgttaactgcttttgaaattattattataataaatctgttactcaggtgctctcatcagatgttccttcaggtacagaaactgaggagaaagatgatggcatgaatgacatgaatcacgaggtcatgtcattaatatggagtgaagatttaagggtgcaggatgtgcgaaggcttcttcagagtgcgcatcctgtccgtgtcaacgtagtgcagtacccagagctcagtgaccacgagttcatcgaggaaaaggaaaacaggtgaaagaaaacacgtgtactatctcttgtcacgtttcattgttacatttgtgtcttgtttatatttgtttttccttcaagtttttagcatttaaaaccctaaagagatttaaaagatactttcaagtgaaaatatgccctgtgttttaagttttcatccaacttcaacaaaccacgtgtgttagcaaaatgtctttggcttttgaggacgtaattgttgtatttcataccgtcctcctcttgaaatacatataacagtttactctttagaaaaggtgaatgtaaaactattttgcctgatagttaccttaagaatttacaaacaaagaaaacactggacttgtttttctgtgtcttgatcaggaatagattttgaggttagtggggtttttagtgtagtttaaacttatatcagtattttttttttggatatgatagataatactccaaataaaaatagataagcctttcttctgccactcccctgcacaggatacatcccctgatacattgtaagactcacatgcctgtgacattccagagctattctcttgggacacttctattttaaaattctctcctgttcttttatctgcttgtctctatcatctatcattcatctgtcactgttttctagttctctttactttttttatggtactgttttgaggggaaccgtcacccacacttagccacaggctgctgaagatctgaattagttgtgatttccctattaactgtttcctctccacaagtacccagttattagtcacctgtgaataaaaagatggagtgacagaagttgagtttagagcataggatttatgagcatggcctctagagccaggcatggccatgctgtgctgggtgactggttaaattactttacctcttgttgcctcagttgcttcatctgtaaaaataggcatacttcatgggatggtgctgtgtatcaagtgaattatttttacatagcacttagaatactgctcaatacatagtaaagctcagtgcagtcagccattattagtagtagagttcattgattctaagatgcaagttttttcactttttaatatctctgaaatcagatgtgtatttcagtgaacaggtgtcatagtttaactggcagtgctttctctttcttagtttctcatgaaataatgatacatcttatgagtggcatcttatattcaggggatataatattgttctcattataattttgttacttgtgcaaagttgaagtgaattatgtgtaagatttcctctaaaaaaattctatgggttgcaacagactcttggctttgaattttcctgatcccaaattaatgtggcggtcatgttcccagagaatctttaagacagcaaaatttttctctccagttagctagaaaagcagttatgtgtgtccagttaaggagggagtatgcttatgaatagctttgtctgcagagaaaatgttcgtcagttgtcagcctctgaagggatatttctgtgtcttcagatataacttgtataagcgtttcttagttataaatgccttacttccaaaatttctgttagttttttttaagtggatatatggaatgttaagctattttaacagaggaacaagttgaagagtggtatattaatttcacagtagagccgacagaaaccattttaaccttgaacatacctgatacataatggtattagtcctataaacctagccatcatgtaagtgaaaccaatctgtatttcccttggagacaccatgaaatccattcacctctaacatagggaccttgtttcttttcttgtgtacaggccacagaaatggtacttctgaggctgtattggcaaaagggatgggaggaggatcccacatgtactgaggacagctagactgaaattaacacagtgataaaaaccccaaaagtactgtattttcctttgagaaggttagcatccatcggagtggaattttaaatttcttttgtttttttgaatgcctagagagagtcggcttggtttataggccaggtggttttcattcaatgtaaatatgaaacaaaacagaggaaatatgtctctccctaagagtgtaataggaacaagaatattaaaatgaaaataatcatgtttgggtagttcactcacatctgtgtatgaatttactttgagacaacttcatcttacacagtacaccttcttttgaaatacttacagatgatatttcaattgcgctttgctttaaacattttcacatgttggtttttactttaattacagattactccaattgtgtcagcaaactatggctcttcctgtaggacgaggaatgtttacctttttttcgtaccatcctgttccaacagagccattgcctattcctaaattgaatctgactggtatgttaaattctgggctcaatgagaaaggaaagtgattaagtacatgcattaagtgtagttctttaaattagttaaaacaaaagaaatgctccctctatccccagtgattttaaattttcctaatagctgctatagtggttatcaaagctcaaataccatgtcaaactaaaccttgagagaagcagaatatagttcgttactcatttttgctttttaatgaggtgatttcaagatatacaaagtcacttggagaagttcagaaagatataattgataatgatgagactattgaattttaaataatcttgagtataatatgtaaaaatatttagttttaaaatgtcttatgtcatagtttaaacagatgatcattgtataaatcaagaaatgtcctaagcaaaaagagaaaaaatggtcacttgcagtactcccactcttctgcatcactccttttaacattttaatatatatgtttactaagtttatttccacatatttataattttatatttgtttaattatcagaaaatttaaatctattttagatattttttaaaatttacagtgaacatccttttatatctagcaaataaatgtatgtgtttataattatgtgtatgtattgtatacacgtgtttttaatcgatacattcatttttatttgcttcagagtatttcattcagtggatataccatagtttatagaagcagcctggtattgttggaaattacagttttttggtattataaacattgttggggcgtattcgtcctatgtatttaggctaaatgcttagaagtagaactcttaggacagcaagatgaatggttttaaggaacatgtcaaattgcctttctggttggtgcaagtttttatttctgctatgtataactgtagttatagtcttgattacaatgagttttttagtgtatgtccgcctaatgctgatttgaatgtgttctaaaggtgacaattacatagttgaaattatcattgaaactctattatagtatatatggttttgtgaaacctatacaaaatgtatgtgtaatgtatgttgtagtagtgtatagtatatgtagtagtatataatgtataatttaatatatgataaatagtacataatatatgcaaacataattgtacagtattttaaattgcatactttaaaaaatccagagttccactcagatttgtgaacagcttgtgctttgagcagcatgcaggaaatgagattgactaagtgaagaacacattcccatctccatatcatgcttattctgagccctaatctcactgagggacatagtgagcagagttgcttttaatatttaaattgtctcagaggtaaagcacctatggcaaaattttaacaattattgattcttgatggaaggcatggtatatagatgttcattttagtagtctttccaactgtttatatgaaagatttcatataatgagtgcgggttaaaaaggaaatctaatgcaaaattggcaaatgttaaaatgtattcaatctgggtgatttagcactcaagcgatacttgggtgggtttaaaaaatatatacatgcatctttttttctgaatacatttaattgaatttgcatgatttaaaatgtgtttatgacattaatccaacattttattcttttagtcattctggtaggccaaaaagaaaggttatcctcttaatttaggaaagaatattttcttaaatagttgcttaacccacactgatgtggcctgttgtacttttgtatgttgttattctcattgaagaaaatttaccttaccctttgcattttattttctctcgtgtataaatattatgtcttttgcatatgatgaatgaaagtttcagaaagttcactcagttttttcatattgatatgtctgccttttttgagaaagtgcaagtgtaacttatgaacttattactcattgtggtgctaacactagcagttgagttagcttttaggtacaaaaagcatatagtaaagacaaataagtcttactttgtgctttgtgtgtgtatgtgtacatgctacaaataagacactctgcatctacttaaaatttattttacataacatcttagaactctttaaaaatggtacttttaaagctgcagtgaaatggataactttatgcagtaattaaaatatttatgttaattattttatctgtgacttaagacagtattcaaaatatatttaaaaagattcagtgtttgctgtgtataatgtagatcaaaaagaaaagaatcaagaaaaaattcgtagggaacatatagcattgtgaacatataatttacattgttcttaaatggaccataaaagtaaatctagtgaatgcccttttgaagttcactgggtgactcaagtctataaaaggatgctttttacaaaactatctctaagcattttaaacaatagcatataattagatatctatatctgtatgtatatagagagagagaaaaaaaagagagaagggggcatatataggtaagagctgtagcagatttattaaggttcttgtgtctttttttttttttttttttttgagatgcagtctctgtctgctgcccaggtgggagtgcagtggcatgatcttggctcactgcaacctctgcctcccaggttcaaatgattctcatgcctcagcctcccaagtagctgggataggcacgcaccaccaggcctggcttttgtcttttcttaagatgtcatttttccttaatgtccaggggaaaatataggatagaacatttgaaattaacatcaatgtcatcagatgttgggatttataacttgtatagtttaacagtgatgttagtcttcattttggtttctaagctctctactgtttgaaagaaagatttcaaagcagtgattatcccagtcatctctgtataatgttaaattggtatcagttatctcattatatagcctcatacattttagcaaaaaggacaatgaactgtttagacagtgatggtttttccagttccattaagtttgactcacatgtacaaaagttttaagtggtcatagagacctaacattccaggcattatggggttaatggttttgaatgtagaaaatgtaagtaatcttagtctcaaagatctaaatttaacaatcttggttttgtgaatttttattctctcagtgttcttcgtttggctggatagggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttagccaatgagtatgctggctttctcgtggctctgggtttgaatgggtaccttaccaagctggcgactttcaatatccatgactacttgaccaaggtgagacctgtgctcccagtgcctggctttgtgccttgcctggctattgtagtagctcctaattgctctatttgctcttctttcttcattcttgtacttctaagtccatttgtctcatagtacgtggaataatctttctaaagcataaatcagagtatgtcacttctctggtcaaagccatttaattaatgatctcccattgcttttttttttttgagtaaggcagggtagaatttaatgagtgacaggaaagctctcaacagcgagaggggacccgaaggtgggttgccagccacgaggctgagtctagaggtttttatgggcttgaaatgggggaagtgcatgctgattggtctgtgggtatgcttgaaaaagcaccatttagaaataggcacgatagtgtagaggaccaactggggaagggcaggtatatgtaaagtaggtgaaggataaggaccaatcaggagagagcatgccaaacaggaatgagagctctctagtccatggatttatccagaacttgtagcttggttttcaggctttcgactgtccttggcttgaaggttgagtttcatctgagaatttacctgcctcctaccgccatcaatccccgctctgaagaggtatatctaactgctgttcggataggggtgatgactgttctgcttcatgctgacagagggtgttgttttgggaaacagcagtcaggtctctcttagaggcctatctaagtgtcccctggtaaaagagagccatcaaccgaggttccatttgcatgaccacttggagtttgatggcctctaggcgagaaaaaacaaattttacaaggaggttaagtacacatggaccaaatatgagtattacaatgagaacacaaagaggaactaaaagggggaaaatccatgcccatatattagggacacctagaaaggacaggaagaaaacctctgaaaatggactgttctattccaggattttgcaaaatagggttgtcatgggcatgtccccctagattattagatatgttataattaggcattgcaatgcttttaattagatttctgatccataggctgcagaatccagtaatgcctgataatccctttagttagctgagggtcttggggagaaggaaggagaaaatggatccaattctctcctcgcccagtgtcctggtcccttctgacaagaccaggcataggtacttcactgaagtctgacggagttgagccttggactttgaaactttatgtcctctgtcagttagaaaattaagaagagccttattgcttttctgagaaatttcctcagttggggcacagagtagagtgtaatctacatattaagactaacttgagtttgaaagaactcagagagatctttttgagattgcctgcccaaacaggtgggggctgtcttggaatccctgtggtaacaccatccaggttagctgggtagtctggttggagggatccctgaatgcaaacaagttttgggagttggggtataatggtatgcagaaaaaaagcatcttttaattccaagaatgcaaaccatttagttccttcaggtatctaagttaacaaagtatagggattgggaaccactgggtaaattggttaattacaccagttactcattaaggaggtggagatcctggaccagtctccattccctgttgggtttctttctgtacttccaatattaggatattacaaggactgtcgcagggtttaacaaggccctgcatccttaggttattaatgatggcttctagttgtttcctagcttctggttttaggggatattgtctttaattagggaaggagatgagatccctgagatggatttggactggtgagactgttgtagctcagccagtattttcctgaattgcccaaacatctggattaatatcagtctccaccagagggaggcaaagagtctgtcctggagccataaggatggtggttcccatgtgagctaaaatatccctacctcagaggagtcgggctttcaggtatgattaaaaaggcataggtaaacgaaaggtctccctaggtacagctaagggattgagaaaaatatcgagtcagaggctttcctgagacgcccctcacagttgtgctaagggaggaggggaggcccagaatggagaggagaacaggaatggctgctctggtgttgagtaggaagtctgtcctctgagtcctttgacctccagactcacccgggactcctggatggtaatgcagcctgggctgtcagagctggggaggagagccctgggacccatcagtcctgctggaccatttgagaagccggctctgaaccttgggacgtatgtttctggaggcagtttgtcttccagtagtctcccttacagattggacagggccgtgggggctgcttctgatttcgggggcagactctcttttagtgctcccacactgataacagtcggtcatagaatgagaagctccctgggatcgagaggtttatatgcctgtatggcagctattagtgcctctgcctttttctcgttccttttctccctttttcttgggcttcctcatggtcccgattataaaagaccaaggtggtgactttcaggattttctttagagtactgtctggtgcaatagctaactttttgcagcattcttccaatatttggggctgcttgggttataaacttgtctttcaaaattaactatccttttatagagtcaggagagagatgtgtgtttaattaaagcctctctcagttttttccaggaaaacagaagggttctcttcagacccttggtttatggttgataacttaatgtaattgagagatttgcctctagttttcagatcttccactgtgcatccctaaaaatgttttctcggccactttcctagagcagtgtctgagtcccattgaggattattggtggatgctgcctgcttggctgtcagaaagggctccctaatttcttcccccttttggtaggtgccataataagataaacatttcatctccaaatgtctcagtgacctgtaaagccgcctgcttctctgaagctctaagagtctagttgagaagtaacatgatacccttccatgaaagctcagacatttgattaaggttctgaaaggcttcaatatacctatccaggtcgacacaattgtcctagatttctttttatctgcctcaaatcttgtaaagaaaaggggacttgtactttgataggaccatattcactatgcatttcctgtaaaggaagaagtgatgctggagcgcatccaggtcgaactcttctaacaggatgaggttcaaaagggggcctggataagggggacgagatgatccaagaggagctgggacctgggctggtgcaggggcctctgtctcctcttctaaggaggcagactgttttttcccttctgtctggattaagtctggctggatatcactgctataagtgcaaggtctattatacattgctgacagagcttgcggttattctgcagggcaaaaaaggcctatacatatggaattttggaccattttccttctctgtggttgaagagatctagctataggatagtattatagttgttattttccccagctgactaggtctccccatcttccaacttctagctgggccaagccttgctactgataaataccaggtattttttcttcagagtctgaggatcaaaggagtcccaatgtctcgcacttgagaggagtgcaggctacccatttagaaagagagaggggagaaaaaggcatccttagtctttccctctgctgtgctagagtccaaggcgtctctcaggcttgccttggtcgtggatgtgcgcgcagccaccattcatgaccagggggggatcaagccagcaggagtagttgcgttcacttgcactcagccttgaccctccttgtcaactgcctttgatttctctgaattctatatgagctcaagactaagatgaatccgggggggtccctgcatattatttgtctataattctcatctggctggcagtttatttagcttcatcaagcataacccagcatcctgccctgaaaagaagcaatttctcaaagagacacataactaagtaacatttctcagaagagcagtaggaaaaacatgataggaaagattggaagtctttgtccgacacctgaacaggctgttggggactgggggccggtgtagggtccttcggatgtacccttggccagatacctttagttgccccaggaccttattctgatcccacacgatggctgaacttctgtgaagggaaactggtttagaacaaggccaaaattcccaacaccagagggcaaagggggatcgaccattgctcttaatatacattctaggagctggtgtgatcctgttcacttctccagccctaggtggtaccactgttcttcgttttttttttttttttttttttttttttgatgtggagtctcaccctgtcacctaggctggagtgcagtggtgtgatctcgtctcactgcaacctctacctcccaggttcaagcaattctcctgcctcagccttctgagtagctgggattacaggtgcacactaccacacctgcgtaatttttgtatttttgatggaaacagggtttcaccatgttggccaggctggtcttgaactcctgatctcaggtgatctgcccgcttcagcctcccaaagtgctgggattataggcgtgagcctctgcacccagccccactcttcttgctcccccacactctaaccatacagattggctattttagctctctggcaaactaaactctttcacttcacagcgttattttttttttaaggaatctttatttatataaatatataaaattcacataccatacaattcactgtttaaagtgtgtggtacagtggtttttagtacattcacagagttgtgcatccatcaccactgttaattttagaacatcttttcaccccataaaggaaccttgtacccactagtggtgactccccattcctctacctcacccccccaccttcacttcacttcctgccaaccactaatctactttccgtgtctatgggtttgccttttctggacctttcatatgaacggagtcatacaaaatatggtattttaggatgggcttctttcacttagcctgataattttagggttcatccatgttgtaccatctatcagcaatacattcctttttattgttgaataaatgttttattttatgaatgtacattttattcataagttgatgaacatttgggttatttgtactttttagctattacgaataatactgctatgaacatttgtatacatgtttttgtgcggatgtatgttttcattactcaagagtaatgaagtaatggtaagtagtggtacatacttaggagtggaattgctgggttatatggtaactctgttaaactttttgaggaactgtaaactgttttccataatgactgcaccattatacaaccccatcagcaatacatgagagttccaatctctccatatttttgccaacacttgttatattgtgttgagtccagcctcattcttttgaatgtgtccttccacttgtcccagcactgttttttgaagactgccctttacctgttgaattgtcttggcacccttgtggtcagttgatgttaatgtgagggttcatttctgaatcgcctcagagccatttatttacatgctgttttatcacctgaaacagtcttcctcaccttctaaacttgagtgtcctctttcctgccactgttcctggctaatttgttttcatccttcaggtcctaatataaatttctttgtataatctttagagatttcatccctaataatcctctagtccctcccaatctaaattaagctattttaaaatactctttcataatactttgtactttcttattgtactactttttaataatatatttgtttatgttttttaatttaacactttttttcctattaagtcattaggtccatgagagcaaggaccatgtttgtttagtttactgctgtattctcagtgcctctcaccttgcctgtcaacataaaagtacttcttgaaagtggcaggcagtattttattttaaactatgtatttgttttgtttctatcttagggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttggctgagataggtatgggattaatagtgctgaatcttcataggcatgtactctccactccacattaacccaattaaatagtaaaattataaaaattaaggaaagacaatggtagcttttgtgagcaaagaatgatctagtactaattaaaaaaaacaacaaaactctaagtaatgttatccaaggctaatgtaactgcaggttattaacctccatgtttatttgctagctcattactgaattccagtggtcacatttaatgaggtacctgtggttttaatcagctatgagtatgctgtttatccggctttaccagcagtgtctagcagtggcctgcacttaaaactcagagtagattgttttggtccctgagagacactaaactaaacacatcacagtgtttactgtgttggataacagcacttccaatagaagtcaagtaatggactcctgctttcctcctttacatgctggtgggtatgttggtgatgaacctggaaatggtaaggtccacacactcactttagtgaacattgtctctgttttttattgggtccaaactttttggaaatcttaatgtgttgtcatctttttctgccaaatggaaatgctattggcattattaatatgctcaacaatttagttacatacttatatgtcctattcaagatcttttctatatggatttgtgaatatattgttaaagatgtattattctttagtatcattgtatcagatagctattgccacagtgatgctacatacatacaggcatagcattggcccaggcagctctgctttaggctgtagatgtgtagccggctgttctgctgccgttctgcctcacctgcctcattctgggacccaggctggagggtgtgtttctctcgtggtgttgatagaaacctaggagagaaccagtgaagattgggacccataatttagtctactataatgataaatgaaattattcccaaagttgaaatgttttggctatcacaatacatggtagcataagtcagagatctgaaaaacgcttattctgaaaatattcaacactggttgttaaagcatgttcatctgcaaagtagtctacccttctttggctatatcatgatgatgtctaatggtgtcattgcacagtctcacagctgcggcatacctctttcacactgtatatagaagatttcatctttaattcatatgtatatgcctttttatataattactgtcagaatgtacattaaaaaaattttttttttttgagagagtcttgctctgctgcccagcctggagtacagtggtgcaatcttggctcattgcaagctccgcctcccgggttcacgtcattctcctgcctcagccttccgagtagctgggactacaggcgcccgccactacgcctggctaattattgtgtatttttagtagagacagggtttcatggtgttagccaggatagtctggatctcctgaccttgtgatctgcctgtctcagcctcccaaagtgctgggattgcaggcatgaaccactgtgccccgcctaaaaattgtttttatagatcattgttataaatgggttttaaaacaaattttgtgtaatattcattgagtcgatggtctgtaaaatgcctttttttaacttttagaactttttagattgtttctaataatcctttgttgttatatataaacattacactgattacctttgtgtgatttttttctttaatttttattatttatttatttatttagagacagagtctcgctctgtcacccaggctggagtggagtggggcgatctcggttcactgcagcctctgcctcccaggttcaagcaattctcctgcctcagcctaccaagtagctgggattacgggtgtctgtcagcatgcctggctaatttttgtagttttagtagagatgggatttctccatgtcggacaggctggtctcgaactcgttgacctcaagtgatcctcctgccttggcctcccaaagtgctgggattacaggcaagggccagcacgtccagccttttttctttttttttaaattgcatttttttcctatagggataaaatttcaggaatgtgaacattttttcagagggaagggttttaatacatagtacattttatcgttttcaacaaggtagtgttagagttatagggtgcttttaaaagtatgaattttgtatccagtcagacttctaggatcagtacacagaaattctaccatagtagggctcattattatatacactcgaaataaatgtctaaacataatatttaacagcttaacaacataagtaagtgacctccttattcattatcatcattcgaacatgtttcaccacatgtgatgtgtggatttgaaagtaatgaaaacaaaatgtaagatatttcgttgttgttgttgctgagatggtgtctcactctgtcacccaggctggagtgcagcgacctgattttggctcactgcaacctctgcctcccaggttcaagcgattttcctgcctcagcctccccagtagctgatattacaggcacctggcaccctggctagtttttgtatttttagtagagacagggtttcaccatgttggccatctggtctccaactcctgacgtcaagtgatccacctgcctcggcctcccaaaatgctgggattacaggcatgagccagcacacccggcccagatgttttaacaaaaaaataaaactttttttttgaatactctttcctttttccctttaaaatttttttctactacttggtaatttttttggtaagactcaaagtttcacagtatttgaatatcattgcttataaagacttaaattggcaatttaaaaagaactattttgggccctttttttttggtaggtaaacctacagttgtggacaccatttattatagtgtcataactttctgaatggagttatattccattcgtatgtccagtgcaacttgctagaaagttaactctaagatttttatgagatgagattttgagaagctagtttgaactgtgttgcttttgtttttacaggacggcctcctggtcctgaaatggaatactgcactgacagagagtcatactccttagctgctggcttggccctgggcatggtctgcttgggggtaagcatagcctatgccttcccatgcttcagttaggacatctacatgttgagacaaataacgttgacacctaaacctgaatattgtcccttactatgacttaatctgctgcccagctctattgtctttttggatatttttcaaagtaccagatttgcaaattgagagaaactgtggtcaagagtgggactttaagatttcttttcctccagcttgcagtgttcatgaacaaactgaagggaataaagttttttttttttaaagcgttcaagacatagaatgaataagtgacagcccactatgactgaaaacagagaatagtgaaaacgtatatgatcgggagccttaagagtctatagtagctgcttgaaacaaaccctaacccccttttgccatagtgatgttcactgtgtatcccagaatgttgtcccagtagcatcttccttgtgacaaaatgcagtatcagattgacccatctttaactccatccaagagatgtgtacagaattaccagaaatgtttcattaaatgattgtttcacttgaaatgtggttccccttgaaaaaccaccaatacattcttatggtcaaactaaatgatataaagaaagttataaggccgaggtgatcggatcacctgagattgggggttcaagaccaacctgaccaacatggagaaaccccatctctactaaaaatacaaaattagccaggtgtggtggcgcatgcctgtaatcccagctactcgggaggctgaggcaggacaatcgcttgaacccaggaggcggaggttgtggtgaatcgagatcacaccattgcactccagcctgggcaacaagagtgagactccatcttaaaaaaaaaaaaagttatagtggaaggaatttttttcatgtgtgttctgaaaatccaccttgtggttgaccatctgttagggccttgaattcacattggcacgtgagctaaagaggctggtggtataatggaaaataatcagctgggtgtggtggctcatgcctgtaatcccagcactttgggaggctgagatgggcggatcacgaggtcaggagatccagaccatcctggctaacacggtgaaaccccgtctctactaaaaatacaaaaaaattagctgggcatggtggtgggtgcttgtagtcccagctactcaggatgctgaggcaggagaatggtgtgaacccaggaggcggagcttgcagagagtcgagatcgtgccactgcactccagcctgggcaagaaggcgagactccgtctcaaaaaaaaaaaaaaaaaaagaaaagaatcacacagggaattgcaacttgaattctggtcctaactagtgagtcaagtcatttaactacattattgtgtattgcttaatcagcttcatggattgttgagccagatggccgtgttttatatatagccctgcaacttaactataatagctgtataaccttgggcttaatccctctgtgccacactttccttatttataaaatagggttttaatagtagctatttgatatggctgttcattcatgttaaacacacagaatagtgcctgacacagagcatgcatttaataaattactattattatcatagttattgttggaaaagttcttaagtacaataatgacagtattcaggtatttacagttccagtttcaattatataactaatatttttctttattgttaaatgtcactaactctaaagctcttatgtattttaagacagtacttaaagttgaacattcatgtattaaaacttttatgagaattattaatatttattaactcatgattaatgtttgctttaaattggaaataaaaaaaacaaaacccaaaataacctgctttgaagttagttcatttttatatttgttatgggtatgtgttgtggatcttccttcataaaatttcttttcactcgtctgttattgtcttttccagcatggcagcaatttgataggtatgtctgatctcaatgtgcctgagcagctctatcagtacatggttggaggacgtaggcgctttcaaacaggaatgcatagggagaaacataaatcaccaagttatcaaatcaaagtaagtacacagcaaagtaatagatcaaaagtctggaagctgggaagttaattggaaaatactagtgttcatactgacattggtaaatgtgttaattttaagcatagttattattcagaggaattttataataatttagaactcttttacatgcataaactcttctttcaataggaaggagataccataaatgtggatgtgacttgtccaggtgctactctagctttggctatgatctacttaaaaaccaataacaggtatttctacccactcacccttcctcccgcggtgatagtgtgatatcctccctgaccttggttgtaaaattcagttatctcatgtgtttctttcccctgtgctggattaagctgattttttgttctttcaagtactgtaagtttttgaaagaaaacttgcagtatttgaagttataaagattttacctggaaataatgtatttggctattttaatggtatttgacaatatagttttcaatttctgttcatttctgttttgtagttgatgtcagtaacacccaaacaatgcccatgtttgttttcattaatttagcatattgctgtgaggactggttaagccagaaatacttatcatttagtgtgatcttggttaccatgtaaaacaatggtttttgcctacttcaggagcttttgtaattaccaaaccgtctaccttcctaacttgctatattaatgctgacgcttgaaagtaagatctttggcatttatgcttacactttgcatgaggaataagttgagtacaagacgttatgtcatgtcttaagtctattaattaaaaacaaattctaagattcaaggagttttcagtgttccacatttctccctttagaaaaagtaaatgtgtgcagaattaacaaagtgtttaaaaatagatatttattactttactatttggatgaatgtgtagggcagtgcttccttggcactggggatatttcattgagcaaaactaaaaatatcttccctcatggagtttatgttatagtaagacatacatgtacatctataataactattacattagaaggtgtgaagtattgtgaaaaatatgtagagctgtagtggagcgggaagaaatgttttgaaatagagcttgagattcttgattgtcttgccctctacttgaacagtgtgccttactgttttcctccaccaccagatctattgcagattggctccgagcccctgacaccatgtatttgttggactttgtgaagccagaatttctcttgcttagggtatgctttgtcttcatttgtgttaacatgagaagtctatttgtggttcttaaacttagcttgtaagccgggcacagtggctcacgcctgtaatcccagcacttcagaaggttgaggcaggaggattgcttgagtccaggagtttgagaccagcctgggcaacacaggctgttctccatgactgaatgaatggcaaacataaatgtctttacaagagagccttttatttttaatttgtcatgcatatctaattggcagtgttcatttgaaatttcacaaataggactttgggaatcccaagaaaggtaaccacgttgatatttaatacttggagtgacatttcactgtctcacattattattcaaaacttcctaaaaagcaacaagtgattaggacttttttactgctttgttttacatttttggattactatcagggatgtgataatactgttaaggttgaatctaaagaaagtaacaattcacttaattgtctaaaattttccctctaattcttttttttctgatgtttaaacgtagcatatagaagcttttaaattatgtgtagatagagctatgattctttcctttgtgatttttttcttttccagagtacattttaaaaagtacccgcacaagccctctaaactttggtgatattcaactcaattttagtttttctttgttaaaatttaaatctttattttaatgagtagtttaatgagtaagacggttcccaacttaggttttttaacttaaccatagtgtgaaagcggtactcattcagaagaaactacttccaattttaattttaatttttttcttgtactcctggcagtatgatgctctcatggtgttgggtaatggcagcaagctgcagctcccagtcagccatgcagtcatgagggtaaatgacccatactctacagtttactatgctgacagagaatttcactcaattataggctaatttgagtgttcggagcatgtttaaggtaggctaggccaagctgtgttgtttggcaggcaaggtgtattaaatgtattttctttttctttttttttttttatgagatggagtctcactctgttgcccaggctggagtgcagtgacaccatcttggctcactgcaacctttgcctcctgggttcaagctattcttgttcctcagcctcctgagtagctaggactacaggcgtgtgtcaccatgcctggctaatttttgtatttttagtagagatggggtttcaccatgttggccaggctggtctcaaactcctggccttcagtgatctgcccgccttggtctcccaaagtgctgggattatagacatgagccactgagcctggcctaagtgtattttcagcttaaggtattttcaacttacaataggtttatcagtacataaccttactgcatttgcatatacttatttttcaaaattctcaacagttgggaactgattcttaaattgttctgtttattattatcattgttataaaatgtatgaactttacttgctctaattaattttatctctgttgcatttttaagacacttgctcgatgcctgattttgtgggatgatattttaccaaattccaagtgggttgacagcaatgttcctcaagtaagtacatataataaatattatatctttagtagcataaaattatgatttcttatgggatttttcaaaattctgtaaaatattttttcttatgaaggcaatattgatcattaggatacctcttaaagacctaagaacttccattttaagattctgtgctgcacagaccaccgccttctcttttagcctcaggtccctagaaattgtagtttttaaaaattaaatatgaatatcggtgttgcgtgggagttaaaaaatgaaaggaaaaaactaaatatgtttgccagaatactctaaaaaagtgttgatatttttgtcataattaagtgcacatttctaagatgctattttacttcgtgacaattttagatctcctaataactcttttaattactttatatcatatttattcgataagccaagtatactagttaaaaatgaacagatttttttggtaaaaactgaaaaccgaatattgtaactagccactgcccttagacaactgtccatgtctagtggtctcagtttctttatgtagattgtttctttcagtattttcagaggaaaaatctcaaagattgaaagaagttaatatgaacacccacatcaccaatagactctataataatattttactgtataaacatgtttcatcacttatctatccacttatctattcctctatctaatccaacattttttgatgaatttcaatgttagttccaaacagtaatacactccatcccaaaattgtaccatatatattaactggaattggtatttacattttttccttttaagataaaatttatatatcgtgaaatgcacaaatgttaagtatcctattggataagatttgactaacacatagacctgtggaaaccagcctctatcccttgtgccccttccctctttgtgcattcacctgtacccccaggtaaccaatatgtattttgtttatctcccaaaatatgttaatttccagatgtagaactttatattaatgaagccacatatggcatatacccttttgtataagacttctttcagcgttttcaagatattgagtatattaatagttcatcctttttattattaggtggtacagattgagtatttcttatctgaaatgcttgggaccagaagcgtttttggattttggaatactcgaaattatacttactggttgagcatccctcatctgaaactctgacatctgaaatacttcaatgagcatttcctttgggcatcatgttaatgttcaaaaaggtttggattttgagcattttggattttggattttcggattagggatcctcaacttgtgtattccatttgcaatcctattaggtggggctggaattactgaggcatagggtagatggtatatttagttttattagaaatgataaatcttttcccaaagcggctgtaccatttgacacattgaccaacagtgtttgagagtgttggctgttgcccatctaaccgataattaatggtgttagttttttaagttttagtgctgctgatgaatacgtaatgatatctgactgttgtttaaatttgcatttctctgctgactgttaatgttgagaactttttcattggtttattggtcctccgtctatctttttttgtgaagtgtctgtgcatgtcttttgcttattttttaaaaaaatttgtatttttattactgcgttgctggagtttttttaatgcattctagaaacccgttctttgtcagatttctttttttttttttttgagatggagtcttgctctgtcgcccaggctggagtgcagtggtgtgatctcggctcactgcaagctccgcctcccaggttcacgccattctcctgcctcagcctcccgagtagctgggactacaggcacccgccaccatgccctgctaattttttgtatttttagtagagacggggtttcactgtgttagccaagatggtctcgatttcctgacctcgtgatctgcccgcctcggcctcccgaagtgctgggattacaggcgtgagccaccacgcctggcctgtcagatttcttttgcaaatatccctcccaatctgtggcttgcatattcattttcttagtaataattttaatgagcagaagatattagaatgttaaataatgtctgatttgtcagttttttcttatggttattctctattcctatgaaaaaaaccatttgtctaaccccatcatgaagataatcttttctgcttttctctaaaagcttccaaagttttagttttgtgtatacttacataattcatttcaaagtaattttgtatatgatatgaggtacatgttgaggttgtctaccagggaagctcatcagagactcagcacccaagtttttaattgggagctgacatgtaggtaaggtactctctgccttgtatgtacccaagttccagattctcaggagaatgtgtgttagcctaaaccacgctgtttgtagttcaagcacggtaaacacagatatatacattttgttttaaagcaaccggttaatttacttggaatcagattgtcattctttcttggttgctagctctaatcttggtgcacgtctttatcctgtgggctgttggagtctgccctgtgcacacatggttcatggatcaggcagacatttgcacagaatttatatacagagcttggggccctgtctctgtggctctctcctttgtcatattctgtcctcacctcccaatgggtgtggtattttcctgtatcctggttgttaaggccaagaaggttatgagcttttaattgtagcttttgccatctttcttggcgcagatagacctgctttcagagcagaaaccgcagaaaggaaaatgtatctagtggtgttcctctcttccatggatcgactctcccctctagaatctgcttgcgtttgtcctcactccagtgtcttgaggtcaggagttggtgaattaagcccacctgatttttagaaagaaaattttattggaatatggccatgcccatttgtttacttattgtctgtagctgttttttgttacaaatgcatagatcagtagttgctggtatttactatttgacccttttagaaatagtttaccgacccctgccatagatagtttggattttatattttgtctagggtttacacttggtgtatgagttgatctgataggaatttattcatctattatttgaggaagtagaactcctaggtttgtttttatttgtttagttcttccagttttgttaatcactgatatgaaagaggtgaggaagaattgttttaaatgactcgctcatttgttaccataattttaactctagcatattcagatgtcagagattttagtttttttgaaagtgctctttgaaatgtatattgtaggatgaaatactttttctttcactccttcattcagcacatactcatgaatcctctgtaaatgcaaggcacgtgctaaactctgtaatacattaaagatacatcagacatatagagtgttctcaaaaaactttagtttattaaatgcactaagttcagcttactgagattaaacatgtgtacaagtaactgtaattccaaagtggaaagtataaattcatgtcagagagtggtcttttttgcggcctggtgtggtgactcgtgcctgtaatcccagcactttgggaagccaaggtgggcacatcactcgaggtcagagttcgagaccagcctggccagtgtggtgaaaccctgtctctacaaaaaacaaacgaacaaacaaaaaaacacaaaaaacagtggtcgttttttgtttttatgaaaatatggtttttggacttttagtatagaataacatctctctcttttttacttcagactttataatgttatatttggtctttattacatcagggatactgcaaataggagagataacaatttcacagttctcctgattgatatttcctatcagcttccacttttctctgggttctcatctggagctacattgattctggagcagggttccttgtagtgagcaacctagcgttaaaaggaggatttttttttttaaaggtcactttgtaaactgcttgtctgtttgaacttagggcatatgtaaaataacaactagcatcttcatagtactttttctttcataaaaagctttacatacagggtgcggttactcacgcctataatcctagcgctttgggaggccaaggagggtggattgcttaagcccaggagttcaacaccagcctgggcatcatagtgagatcccatctctacagaaaaatacaaaaattagccaagcatggtggtgtgcacctgtagtcctagccacttgggaagctgagatgggaggattgcttgagtccgggaggtagggctgcaatgagccgtgatcgcaccactgcactccaacctgggtgacagagggagaccctgtctcaaggcaaaaaaaaagaagaaagatattttaagtctttgatttggtgatattcagtacataagaagactgtattataagtgccttctaatatttatttattttattttattttatttttgagactgagacagggttttgccctgttgcccaggctggagtgcagtggtgcgatcttggctcactgcaacctccacttagcaggctcaagtgattctcgtgcctcagcctcctgagtagctgggattacaggcccagctaattttttgtttttcagtagatacgggtttcaccatgttggccaggctggtctcgaactccaggcttcaagtgatccgcctgccttggcctcccaaagtgctgggattacaggcgtgtaagccactgtgttcggccaatatttattgttttattgaagaaaacatcctgaaatgttaagaaatcttctaagaaatcttctcagaagattaaaagaataaatcttaaatacattcatatgtttagcaaacattagctttatcttttttggcttttttcttttaggagaaaaggatcaaatgtcttcttggttgttacagctagatattctgtgtatgtttttcggtaaattgttcattacctatactaaaaggaaaaggatgtcttttctaaacaatagttgtaacatagctgataaacatattgacagtttagcttatcttagcctagtgaataacctcacctgtggtaggtatgttggattaatgctggaaacatcccgtaaagaagaagtctgattagagttgtctcctatttctcttttcccacttcttcccctcacccctgccccaattctaaagccatcatctttgtatttcagttgactggtatgcaatattatgaccctgttactgatttagaatatacttacgtcttcctgtttatatttgttcagccctatttaattattattattattattttttttttttgagatggagtctcactctatcacccaggctggagtgcagtggcgtgatcttggctcactgcatcctgcacctcccagattcaagtgattctactgcctcagcctcctaagtagctgggattacaggcgtgcgccaccacgcccagctaatttttgtacttttaatagagatggggtttcaccatgttggtcaggctggtctcgaactcctgacctcgtgatccacctgccttggccttccaaagtgctgggattacagtcgtgagccaccatgcctgcccttaattattattcttacttagcccatcttagatttgaaatttgattacattcaatgagattaaaatataggcttttgagtgaaacggtttggtaaagcttactttgtataaatatagccatgataagcagtatgttattcttcagattattaaatatttgtaatgagaacattgatatctaagtattcttgctttctatattgacagattataagagaaaatagtatctctctcagtgaaatcgaattgccgtgctcagaggatttgaatttggaaactttgtcgtaagtgatgtataatgcaaattagctatcctagcgtctatcagataattaaattgaaatataccatgtgggagtaatattgtccttgatttaagtaattatgaatcccacatgtttctaaccattatttatcagatgttcatgacgttggttaaagctctctgaagtacagagctcttgccctcaaaaagcaatattggagatttaacttgtatgtatttgttttttatcctttccattaaagaaattggcaacaattttaaaaattgtttttgctgcatatgaaactgtaggcaaggggcaaacttcatgagtaaggtgacccgatgcttctgctgaaaaaaaaaatacatagaaatctgctgactgagggcacttcatcattcccagaaagatataaactagcttagagaactggaatatttattgttacttatttcaagttaattttaaagtaaaataatgattattaaatttcttgtcacctgttttcagccaagcacatgtctacataattgcaggagcctgtttgtctctgggtttttgatttgctggctcagaaaacttaccagcatttaactgtttggtaagaagtattttagtttactgtgttctttttttttgtttgttttaacaaagctttaagatgcttcttataacttggaattttttcttttgtttttctagcataaatttgccaaagattttatgacttatttgtctgcacctaatgcttctgttgtaagtctttttatcattctccttgggaataaaattaaacttgaaaaaaatttactgatgatccagttacttatgtgttatcagatatctctgctgtttttttaaatgtagaatgagagatctgaagaaccattagctcatctttttatttttgttttgcgatattaacttaggtgagaatatgattaccctggaaggatgcacaggtatctagttcttgtgacaagagaataaaaaaggccataatattcacgggttgtcatacctcatgtaattctgtctcagtattaaatattgggaatttcctttttaaaaaatattagtacttagtaaggattcagttgcttttgaggcattgcttctctgatgacaagactgagagattttatttcctggtaaaagctacatggatttatgcaacactatttataatatggaaaagttagaaacatcaaaaaagtctaaaagtagttaattaaatttgattatggtttatttatatattcttacacagtggagctaccaaaatcacgttatacaagaattttttgtggctgggtgcagtggctcatgcctataatcctagcaactttgggagaccgaagcaggaggatcatttgagcccaggaggttgagatcagcctgggcaacatagggagaccccatctctacaaaaaataaaaaattagccaggtgtggtgacacacacatgtagtcccagcaacttgggaggctgaggtgggtggatcctttgaccccaggaggttgaggctgttgcatcactgcacttcagcctgggtgacagagtgagagaccctgtctccaaaaacaacaacaacaacaaaaaagaaacaacttttttttgtgagtgaagcttgcttgtaataggtcatttaaaaggttaaaaatattgtgtagagtaacatctccatttcatttggaaaaaatatgtgtaggtaaaggaaaaattcagagaaaaagccaaaacgttaacaccagttatctttgggtgtgacattccaagtgattgttatgtcttgatattcaatatttgaaattatttctgttgaacttatatttcataatcagggaaaatatttgtatttacagatttttttttttctctgagacagcgtctcgctctgtctcccaggctggagtgcagtggcgcgatctcggctcactgcgagctccgcaccccgggttcacgccattctcctgcctcagcctcccgagcagctgggaccacaggcgcccgccaccacgcccggctaactttttgtgttttttagtagagacggggtttcaccatgttagccgggatggtctcgatctcctgacctcgtgatccgcccgccttggcctcccaaagtgctgggattacaggcgtgagccacagtgcccagcccagatttttttttaagttacaaacttttgtagtcttctaatgatggctaagctagttctgataataaagaaatgtaacacaacagttatagtgatgtcatctcttcacctgacagacaggtcctcataacctagaaacttgtctgagcgtggtgctgctgtctctccccatggtcatggctggctcaggaaacctaaaggttttgcagctttgtcgcttcttacacatgaaaacgggtggtgaaatgaactatggttttcacttagcccaccacatggcccttggacttctatttttgggaggaggaaggtaagtgaatatgtatttttccaatgaaaagatctcattggtgagatctataagggtgacttacgttgatcttgaagataacatgaaaaatttaaattctgactagctcttagcttaactagcagcattattcgacttgatgggcttctttgtagtttaaccgtcaacttatggtctactcagtagaattaccatcctctctgacacactgagcatcactgtatttctcagaatagtctgtgctctgttcttcagtgcattactgcttgtgcccacctggttaaaaattttaccattctactaagctactttctcagaaaggtcacaaacaaaatcgtttaccagatcctgtgacattttcttagttttcagctttcttgatctttttccaacatgtgccattcctgactacatcctttataagactgccctggctttagatgaaccaaaaaccatgtacagaaaagtgtataaatcataggtgcacaggtcaaagagctatctaccacagaaaaatctctttgttatcatgtagatcaagattctgtatagcactttcaactcacagcacccgtctctgcttctgccatgcacccctctcaatcactattatcttcctttccccaaagatagccctatctagtcttctaacaccttacgttgattttgcctgtttttgacatttaaattgaattatacacgatgtatccttttgcactttacttttgctcaacattatgtttgtaagattcatgttgtatgtagcaatggattattcaagtttcagtgttgtattacactttcattgtatgactgtaccacattttattgatctcccccattgatggatatgcttcttgcttctagtttggggctgttatgaacagtgctgttagggaaagttgtacatgtcttcgattttgttgtatatagaactgtgtggaattgggtcataggttgtacgtgtgtattcactttcagtgaataataccatcagtgctgcagtgcacttgtaccattttacatactcatgggcaggatgtgaagttccagttgttccatatccttgtcaacccttgttattggtatagtctttttagtagtctttttagttttagccaactagtaggtatataacaggatctcattgtggctttaatttctgtatttctgaataatgttcttgagtaccattttacacttttaatagccaactgcaaaacctcttttgtgatgtccaaatctcttgctacccagtttttgtatttatctatgttaaaatttttatttgtggtaaaatacacataacgtaaaacttatcaatttttaggtatgcaattaagtagtgttaattatattcacactgccgtgcaaccaatctccagaaatttttcatcttgcaaaactgacattctatagccattgaacaactccctgtttgcccctcccaccagcctctggcagccgccattctactttctgttttgatgaggttgactgctccacattggtttagctttgtattgatttctgtggattctttaaactatgtcctaagcccttggtcagctttgtttgttgcagctatctttgccaccctagggcttgtttgccttttcactctctctcagtggtgtcttttgatgacacaattattaatgttcttcttttatagtttttacttctttgtgttgtttatgaaatattttcttacccagagaaaaggagatattctcctatcttatcttctagaagtttttagcttttccattcacatttgaatctaaaatctacctggcacggatttttctccatgtttttttcccgctgctattgaaaagtttctccttctccactactctgcagtaccacatctattatataagttaagtgcctatacacctgtgtttatttctgggctattaggttttgctggtctgtttttctgtacttgcaccaatactccattgtcttatgagtcttggtatccagttgagtaaatccttcaaactcggttttcttcttcaaaagtgtgtttttctcttggctccttgcattttcatataaatattggaatctgttccatactaaataatctgataaaatattgatcagaattgccttgattgtatgtgtctgtgttaaggagattagaatctgttacagtattgtcttccattctgtgaatatggtatacccctgtatatatttagctgtagtgtgtgtgaccttgatcaatggctacagtgtctgtgtaggctaattttcccctcttctttaaggctgagcttaccattggaactcaccttttcagaagtacaaaaagtaaagttgatcagaaaggtgtgtatttcctctcaacatgttttgtggaattgtctttctttaattgtttagaattaataatggtcaaagaaatattactatgaaaattcttatttattttattctatgatttttgaaaattttttcctttcaaaatgagcctctccgtgtctcttaatcccatctttcattgttccaaactgtatgactctcctcgctcttctttcatatcgaattgatttttctaccattctgctactgcttttctagtgatttttggtttttaaatggtcatgtatactctgtaacaacatttaaacttagcatagctacaccattatgtttctacccaaaatttctaacattagtatcttaatatttatctttgaattttggtttatcaaaagggtacaaagaaaatggcttattccatgcacatgccaaaatagatgtatctctttgcttaaattttgaaatctcttctttctaatccattaaatatataagcatatataatgaattataagtccttatttaatactccaattattttaaaagacagggaaagagatttgggtatatgtgtgtgcatgtttgtgtgtaagaaaagtatttatactcaatagttttagaagtggttttatgtgatgtcctacaccatctttatttcaaaatattttttagaaaaactctgggactttagattaatttgcctgtttgctatactaaatttgagcaacaataaagtaatttaaggaaaattttaatagaccctttaccaagagaatatttttaaagtctatgaaactttatcttaaaagtgtatcatattggtgaggaaagaatttatatttagaggaatagttgtttatacagtcattgtaactttttttttttttgagaaggagtctcgctctttcgcccaggctggagtgcagtggtgggatctcggctcactgcaagctccgcctcccgggttcacgccattctcctgcctcagccttccaagtagctgggactataggcgcccgccacggcgcccagctaattttttgtatttttagtagagatggggtttcaccgtgttagccaggatggtctcgatctcctgacctcgtgatccgcccgcctcggcctcccaaagtgctgggattacaggcgtgagccaccgcgcatggcctcgttgtaactttttaatgataacttttgccttttcatttagtcagtcattctaaaggaatcatcatgcttcacagaaacagaaaaaaactgtttaaataccaattacaacattctgtatttttaaaactcagatttataattgtatatttatatacataggcatatacataggcatatacattaataaaattggataagaaggtggcatacttggtacatgactcttcaatatttataatttctaggactgcattcatggtcttcactactctgctattttatgttaaaaccttgcttcaagggttgaaatttaacatttatgggatattactttggctttaaatagtgatgatcttgaaatggcccaaggactaaatgaaaagtggaatgttcacaccactgacactcttgtattatgagggcatcttatcagtatgccttactattataccccagtttcctgattctcaagaatgccttgaaagtatgtgcaatataatcaataacatctgtccccaccgaacttactttgcagttactctttgagcacatcaaattcttccattgccgctcttctctgtgccctttatccgcacttcccagctcacagcactgacaaccggtgagtctagtgattctgtcttcaatgtgatacttattaagttctctaaggggatcatttggttgtattttggtttcatggaattatttccaaattagcattgttttgttcttcaacttagttatattcctggctaaatcttttaagaaaattatctcacaaagtattagaccagaggataactttggacacctgatgactgaccagtcttccaccattctcagatctatagaactgctctaaacccaaaaggagatcaagtaaagttgtctttagggaaaaaatcatcaggtaaaggatagttgccaagggaagttcaggatactttttttgtgctctaattatttaattccaagagaaaagtttgtctgatttagtggcaatgtctgtatgagtttctttttttcctttcacatagatgccgagaaattgtgtataaatgacatagacgggacaagaaaagcaaaatacagcaaaaaaccagagacaatttagaagtggcagtgagcggtagaacttcaaaccatgtagaagcagttaaaagctctgtgttttagggtacgaggaaccaccaacacttaagtttccctagatatagtttgagacatagcagatctcttgcatatgggggcagagaagaaaatagcccctataagacacctgagccctgtgctcaactgaaggcatcccatgttgtctccccagagacaggtcaagagccctttattgtttatgggagaagggtcaggagcacttatcacagtaacctaagccatcattttaaactacactacaatgtataaccaacgacagaagaaagatagctgttttacaaaagtagcctaatctgaagaccacactctgatggtaggtgcagcacaagaatattgttaagttaatacacttctgacatgtggcctcatgcctgtcatttaggaaagattttttgagttgttaaagccaattattggctagggtacagtggagagccacactcacatactgctggtcatagctatttggcttagctattgtaaacgaagccattttccattggtgacaagaatctttttttttttttttcgagatagagtctcgctctgtcgcccaggctgaagtgcagtggcgtgatctcgggtcactgcaagctccgcctcccgggttcatgccattctcctgcctcagcctcccatgtagctgggactacaggcacctgccaccacgcccagctaactttttgtatattttagtagagacggggtttctccgtattagccaggatggtctccatctcctgaccttgtgatccgcctgcctcagcctcccaaagtgctgggattacaggcgtgagccactgcgcctggccggtgacaagaatctttatgtaatttgttagtgtcattttttctgatctttattgattttatttttaatagatttatagaaataaatgtatttgagtaagaagagggaagttactgtctataaagctttttaaaattgaagtctcattttatccttctttttttttttttgagacagagtctcactctgttgcccaggctggagtgtagtggtgcgatctcagctcactgcaagctccgcctcccaggttcacgccattctcctgtctcagcctcctgagtagctgggactacaggcgccagccactgcgcctggctaatttttttgtatttttagtagagacggggtttcaccgtgttagccaggatggtctcgatctcctgacctcgtgatccacccatcttggcctcccaaagtgctgggattacaggcgtgagccactgcgcctgggcgatttttttttgttttttcttctgagatggagtcttcctctgttgcccaggctgcagtgcagtggtgtgatctcagctcactgcaacctccatctcctgggttcaagtgattctcctccctcagcctcccgagtagctgggattccaggcatgtgccaccaggcctggctaacttttgtctttttagtagagatggggtttcatcatgttggccaggctcatctcgaactcctgacctcaggtgatccacctgccttggcctcccaaagtgctgggattacaggtgtgagccactgtgcccagcctatttttcttttatgagatcttaaaatatgaaaacttttttgtttttacattctaaaatagaaatcttaaagtttaaaaaactgtttgagaaccccaaagaaaaatattgccatacccacatagatgtttgatgtactgtgtttcaaggacgtgtgtatatgtatgtgcaagtatgtatgtgtagaagaactttgctgtctgagaagaattgacatcctgtcttcccccttcttccctatcaatccttaaggaaaaagaaaaaaaaatctgagaagataaaaacagatgcctatgttgagtagaaagggatttttgagagtgattgattttataagtggtcagtttgatagtaaatattttcatattatgatactttttacctccctgtaaaacctcttcactgtgaagactaaagtaaagaattattgggtcaaaggtcagttatataaaatttttaaaagataatttctccattactttttaatagaatcttatctgcctttaagatttctgttcatttgaagatattacttgagcttctgtcctgtcttagcttataggcaacagcagattgcagagctcatattgtcacagttgtttgttacccactctctgtcttttttgtgaacaggtatcatctccaggctctccggcacctctatgtgctggccgcggagcccaggcttctagtgcctgtggatgtggacacaaacacgccctgctatgccctcttagaagttacctacaaggtatctctccctatcatttacttgtaattttattaccactcatccgtctttgcaggtcataatatttcaaatgtgttgtccagtaaaaggtgataagtaatgaattgaactttcataaaaatggaagcttccaaagttattgtatatcctgccaggccattcatgctcatttatatgatctgggtatcactttttagggatcatcagctactcttttgtccttagagcttataatttgaaaatgtccctgttaactttatgtgactgacagtagtgttttgtataactgattgagttagacccattcttagatttgttagctgaaacttgaaaacccaaaattgtgtatttgatgacagctttcatttagatgcatagattacaagttttatatcctcctttcattcagcaaattattaagtaccttctgtgactcaaaaccgtgctaggctctggggtacaaaatgagatgacattgtcattttccttaaggaacttctatcccctggggagccaggcatggatacaatgggaatagagggtgataattggagatgtctgtggaatgcaggggaagcagagaagcaccctcgcttagctgttagttatggggttgaggctgtcaacagtggacagtgtttggactaggcctggcccactgagtggagctccttcccagcggagaaggcaatgtgcagaaacccagcagcattggagcacggcctttggtgctgctggcctgtgaggagcaaggcttgaagtgatgggaaggacacataccctgtgaggaatttagacatcagtcctttaagatttgagtaccagagaggattttatgccatttaaaggtctctgtatgaactgcggggatagggggaggtatagcgtggagatgtttcttctttgttgtttccactgactacctagtgaattgtggctggacttttacatttgtaaagggcactcagtggtatgaacaaaccaaagaagaattgatggctcctacccttcttccagaactccatcttttaaagcaggtaagctgggtgtgttcgggagttgggtccaaggggtcaattcaacagaatggcatagcgttaaagatagctaaataaaagcctctgctttcttcatgtattgtagcagataagaaagctgcagcaggaggaaaagtcagaaagaatagagcaagtcttttcttagagatctttattgatagcttaggtggcctcagaacatgatttacattcattttttgtctggaaatggagcttgttaccttccagatgcctctttctggctgttattgtttcctctgagaaacataggtttcagtttgtcagatgagcatatttttcagctttgggttgactatgtttacgtttatcttgacagattaaagtaaaaggcccaagatactgggaactgctcatagatttaagcaaaggaacacaacacttgaagtaagtacattaaatttctcaaatttaccttttaggaagtgaatagaagtatataagaaggtataaattatagattattatctggaatgtgactcatcaccctttaatctcattcaagactatatgtagggtatgtcttctgtaaaacagtctgtatctttgaaacaagacttgtgttagaaaatgaaagttttaatttcaaactccaaccctaaatatttatttattgagaaacttgcactgacttccttgtgacagtaatggacttatctcttggtatattaacataagatttagtttaagaaagtgtattagtccattttcacactgctataaagaactacctgagactgggtaatttctaaagaaaagggatttaattgactcacagttctgcctggctggggaggcctcaggaaacttacagtcatggcagaaggcaaaggggaagcaaggcatgtcttgtatggcagcaagagagagagagagaggtgcaacacttttaaaccatcagatctcatgagaactcactcactatcatgagaacagcatgagggaaatctgcccccatgatccaatcacccccaaccaggtccctctcctgacatgtggggattacagtttgacatgagatttgggtggggacacagagcctaaccatgtcagaaagtaaagctgatttgtacacgcacaaaagaactttattaatcagtgtttatcagaccacatcttttgttgcatctctttaccattcttttgctagaaagttctcctaaatttaagattattgtagataatatatactactcagccagtttattttgggtggaaataatcacgtgcagttattttagagtgttgatacatttatacctaaagtagcatgtcagttaagcctttaaatttcaaggaagtttaacaagcatgtaaaagtttttatagtttggtcccaatgtgaatttttccagactgtatattagctgttttctgtattgttctgtccttagatttgcagcattattttcttcttgctgcaaaccaattaatagatatttagtacctcatgtaccctaggcatagagctaggggatatagggaatacaaagaaatgttagacaaaatgttatcttcgaagctcataattgagccaatagtcaaagtgcctcctcatttaacaagttccatgaatctagacaccaaagaaaaacagaactttattctaggctttctcatagggactgatttaatcttagacacagtaaataatcatttaccttagtggaaaatggtaaaagcttcatctcctgtgaacatggtattgggaaaacactgtttccagccaagaactgccagtaataccttatattaaattcattctttttctttcaggtccatcctttccaaggatggggttttatatgttaaactccgggcgggtcagctctcctacaaagaagatccaatgggatggcaaagtttgttggctcagactgttgctaacaggaactctgaagcccgggctttcaaggtagtattattgattggtaaaaacggaaagaaataattctaaattgctggcttcctcgcccattgctataaacttcaaaggtggatctgcttcctttttcattgttgcagattgtaaagactgactgtggctctgtttgctttttatgtgataaaataaataataaaatataatgaatataaaatactgtatataataagtaatatatatataataaagtaaaatactgtaagttaatgtttacatttagcagcaaggacagtcacaccatatcttgacactgtaacaaatagtgattttattattgatcttcaaatcggtgaagatttacttaatttcatagcaaaaatagaaaacgagttttgcaagctagcaattattaactccatttaaaaaccaccatttgtttccttaatctcggtgaggataaactgatgacagattcagacttcttttattagtttgctttattatttgcacagtacttgactgccagtgcagtagtgtttgaaataaggaaatagttacgataaatgagggtaggaagcaatctcattcccttggcggggtcagcacatattttgctctatattcttgactcagataagtttccaacacaagaaatttgtcccataatcaggcattaagacttctgaatttaacttcagtttcctgtaattccatgagcaactgtgtccctgctggtgatacaaagtagagtagtctaaagtagttaggaccctaaggaataattagacggcaaaagtggggcaggcagactggatgagtggcagccagaggactgagttagcatcctttgttcttccaagtacggagacagcagtttattttaattcaactcatatttcattttagtcagttacttatgaccgagcctttataatggttcccaggattgaaatgtataaatagttcccagggttgacattggtgaattttgtttggcagtattcagtaagttgtttatgaaatacttttgaaagatttttggacacagtttaacttaaatttgtagtattgcttcttctaaaaattagagcatattccaaagactctaacccaatttgtgaagaaaatagataagtttagacttgagtttgaacgaagaaagtatataaaaattaaaagctatttctatttcctgcctactggagttcagaaataaaatataaacctcagtggaaaatagtaataccttcatatttcattttcaatcttgaaccttgagtgatactgtttttttcccaagtttaaaaagttgtggtaaaatgcacacaatttattgtcttaaccattgcaagttacagctcagtaatactaagtgcattcacattgttgcgcaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacccctcattctacttcccctagtccctggcaaccaccgttctattttatgtctctgtgattttgattatactaagtacctcatttatgtggtttcatacactgtttatctttttgtggctggcttgagtgatattcttttttccttaccttttcagtaacaattctagtttctggtaggctttttaattagtcagtgaaggagggaaaagccttttttggatgagttgtgtaaacaggaagacctgtttgttattggccttttgataaattagcagctcatgttaacttgtgcaaaagcttcttgtaacttcttagcagaacaggttgatgaggcaagtttgcatcatctgggattttttgggaatgttgggtgacaaaggggaggtagagttgttagaactgtgtgtattacagtttaagcgtaaggaaaataatcttttgttgtcttatactgttgtggttgtttgtttttttagccagaaacaatctcagcattcacttctgatccagcacttctgtcatttgctgaatatttctgcaagccaactgtgaacatgggtcaggtatatattctatggtttgccgagccccaggactagaatttgttattatttctatgcatgggtcacccaaaacatctctactatctatatctatctttgagattgatgacatgcgtcagtcacattggatgacttttgcttggcacgtatagatttgcatagcctaaaactattaaattcagcaactttctaccttgatagaagaaacaacttaaaatttataagacatcagttttgacagatgatagtttctgtcatctacaagaatgatacccatccatattctgctttatgttttcagtgtttaccacctttctcttatttttatgtaatttcattaactgtttcctctgtatattataacccttctttttattgttcatacacctgttaccttcaagattccaagggtgctgagcagatttttctttatttttttgttttttgctttttgagacagggtcggttttttctgttgcccaggctggagtgcagtgacgtgatcatggctcactgcatccttgacctcccggagtgaagccatccttccacctcagcctcctgagtagctgggactacaggcatgtagccaccatgcctggctacttttttaaaaaaattttttgtagagatggagtctcactatattgcccaggctggtcttgaacttctgggctcaaatgatcctcccaccttggactcccaaagtgctgggattataggcatgagccactgtgcctggcccagatctttgacttaatccaccatagagacaaggaaagattggatgcatatatggccttcagaaaatttctcaacctctccaaaatgtagtttcctcatttctaaaagtgattataatagaacctaccttacagtattgttttgaggattaagtgaaataaccttcccctctcttttttattgaatctttactatacatgggacactctgctaatacttaaatgtcatttaattatgaccctgagaataggtattttatcattctgggcttacagatgaggaaactgccactgagagatgtcacatgcccaagatctcacagctagtaagagctgggctgtgcactccaggtcacgggtctctaataaagcccatgcccacccttaaccccagctggacttgactctgccacctcccctaaacttgttctggtcagtgttttttttcttgcagctttgttactcggtttcctttctggatcctactcttcccagcccaacccaaggcatagctctgtgatgtcctatctactcattttgtcctagtttggtccattcctctcttctgtagcacttactatccttaactgtctcttgggacttaatttttttttttttattaatgtttaatgttacatgtgctgtggcttttttaaaagattgtagtgttacttttatgtcattcattataaaacttaagaatgggccatagtagtgctatacaatttgtttttgaattgattttggaatatactttgtgctacaaaacttctgattttctgcagaaacaggaaattctggatctcttttcttcagtactctatgaatgtgttacccaggagacctcagagatgttgcctgcatacatagcaatggatcaggtatggatccaaaaacctataccaattctggtgaaatttgtcctgtagttcaagtaactcactgaatagtgtggtaaggttcctagtgtccttccttttagtttcccatttgcttttggaaatttaagaaaggaaaccatataaaatttgaaagctctcaaaaatccaaaaagcttgggctttatgttgacaggagtgccccttggggggctgtcttcctttaagggttcccattcctcccttttgtctcccctgactaggagaggaggggagcactcccttcctctctcccatcttatttttgcctccctcctggcaatgcctctttgtagaagtctgcatgtgagccgttagtgaacagaaccctagcgatggcagtactgtgaaattagacctatgtgatgaagcttgcaagaggttacagagtccatatgcagttatctaggcattggagttcatttttaaatttctcttgttattgctattttaaaagagcctaaaggggtaatgcagaaaataatgcttaataatgttcttaaaggatcagaccaatttattcactttaggcaaattagtaatacatacaccttttcagtattatcatatctttcagacccagatttggagctaagccaagccagtagttttctaacctggcagaaatttgccttggtatcttaaaaatacagatcctttaattccatgtctcatctattgaatcagaatttctggggtgagatccagaatctagttttaaacagctctttaagtgaatatagtaagttcacagctgagcatctgagactcagtgtctaagagaaataacctttaatgataaaaataatttgctaaaaagctgaatggaaaaatatatttagccagaggataattcccccaaaccagaaaacacacagtgttaagtaacatcattaaaaaccaagttccaatataactaagtaggcccagaatgccattattgtctggaatccacccttttttggttggaaagtatggatatatggtatccacgctggcactgcttctcacagtgcctctttgtatagcagccaaataacaagttgtgttatttgctggatgagaatgttgctggctgagaatgtgtctttttactctctgaaccctcacacctttacagtcatgggtggcaggtctttatgcatgaatatcttctctggttgcagctgtagtgacttgcagatggatctcaagggcagtattattagtagtgttcttcttgccctctaccccctgggatctctgccatgtcattgtacccagcttgagtttcccagaggtgactggctatgaccttttgggtcttggttattcggagctgttgagccaagaatgagctcattcacctttgttacttttccctgcaagctcctcatgtagggccatattgaaggaggtgagccattcacctgtacccagtgacggcgcctctgtgggcagactgcatcaaaacacagaatggaccaccccccgaccctttataattcggagccacatttaaaaaatactcagtctacaactctgatgaagagacagagcactctttgattaaatagattgttgtcctctttcctcttcaaggctataagaagacttgggagaagagaaatgtctgagacttctgaactttggcagataaagttggtgttagagtttttcagctcccgaagccatcaggagcggctgcagaaccaccctaagcgggggctctttatgaactcggaattcctccctgttgtgaagtgcaccattgataataccctggaccagtggctacaaggtaatagtagcattgtagcatagcgctcttgtgcttttgagatacattcggttcaggcttttctgttgtaactttgttttttcattggtaagcaagataaatctgagtataagcaagaatggctatagatttaacgtttccagctagatgaattagactttgattatctactttagcttctttagtaaaatacatctgacccaggcagataatatttatagcattttaaataccacttggtgctcaggaccttgttctctcttccctagcatcagatcacatttcctttccagtgcctctgtctcctgtttcctaggggtgtggcctgttgccttcctgaggccagcagccatcctgtttttgtactggcaccacatgtacatgtagaagttgacgtgtgcttgctgagtgagcttgttgtaccaactcagttttgaaaacctgggaccgcacagctatgtgatgtcacagtggtggctttctatcagcaggatttgtgattgcaaggaaattgtagttactcgttaacagtgtagaagtgattctgacttacatgaggcaagcgatggggcctttagatttatggaaatgtgtctgtgtgttaaatacacctgaaactgattttcaggagtagactccttgatcttttcattctttttagttcattcaaatgctcccagtaaatatctgacagttgcttgctttgggttaatactaaccttagtaatagtagtagaaacaattcttgctttgattagtgaaaactattagtaatcaatagaccctaagcgtttgaatataattcagtttaaaactatccacctgtaacactaggaaataaatttctgaaaaaaattaaattgtaaaccaagttgtgagggatatacttggaaagcctgattgcagactctccatgtttatatttaaaagctgcattgtatttgtcatttcctgttcagattcaaagatcatataacttcataattttttggatagtcatttttatcctcatttttggggaaaaacatgttatttcaaaggttttcgtgtttcgtttttattcaatttaacatttgatcacctatggcagacctttgctattgataataaatacttccttaaatctttgcagattccctgatttgcacatttcatataatgtatggaactttggcagtgattagaacattctctaaaacagggccctgattgccttgttgctctttagcgcatttggtggtttccagcattgctgtcagcctccattgaatttgacttgccacacagatttatcaaaaatgtgtttattttttagtgaaaaactagaatttttttttaaaacaaaacctcttaaatatatagtctcctctcttacaagcactagcagttggcattggggtagagaacaataaattaactgaaaattggaaattgcattcatatttgtgtgtaaaaatcacagatgcatatgtggactttcaggatcactcactaacaactcattagatctgagataacccattgaatcactacactaatctgaaaatgcagccaatttatattatataaatgtcggttttgttttttctttttttgagacagagtctcgctctgtcaccagggtggagtgcagtggcgcgatctcagctcactgcaacctccacctcctgggttcaagcaagtgtcctgcctcagcctcctgagtagctgggattacaggtgcatgccaccacacccagctaatttttgtacttttagttgagacggggtttcaccatgttgttcagtctggtctcgaactcctgacctcatgatctacgtgccttggcctcccaaagtgctgggattacaggcgtgagccatggcgcctggcctatataaatgttttgtacagtatttatctcctcaaattataattttgggcaaagaaagcgggtttcaagtttaagaactttaaaaagttttattaactttttcatattttgttatggaaatttaaagaatatacaaagtaagtagactagtgtaataaaccacaacaccaattttaatagttgccagcattctcctatttttgcgtcatttgtaccttcacccattgccacactcaattttccaaattgtgccattttactttcccaccagcagtggattgcaatgcaatttttggcattgtcctttttttttttttttttttttaagacttgtcaagtgcagtaggaaagcaaagtaaacccaaagcaagcaaataaaagcagaaaccaatgaaaccaaaaacagataagcaatagagaaaatcagtgaaacaaaatgctggtagacatgagaaagtcattgaagagaggctgaaccaccatgctctccttcatgatgagctgttcaaagaagaatctcatctgttctcccttaacctttctccctctgctgcctcccccaaacctaaatgtttccacctcccagtagactgacatcctcacaactgtgttcagtggagtctacagttttcatctcactccatctctacaatggtgaggcttttagctacattttccttcttgaaatgagcctcccttgactttgtcatagcacactttcccaatttttaaaaaaaatcctctttaaaaattctcagtatttgtcaccatttcactgtcactcctttgttgacccttttggaagtcatccttgctcctttccctccttcccttctctgcgatagctgacccattgctgatgcctttcagtcctcatcatagatatttcttgaatttgtccacattttactatttctacctagaacagaatgatgattttgtgcctggaccactgttatagcctcctaaatagcctccttgctttttctcatctccattccaaccatctcaatttaactgacagaacagtcttttaaagaataaactgatgtaacactcctgcttaaagcttttcaatggctcctgattcagctgtgaaagaaatccctactgtgtggcaccaggacctgtgtgacctgcaaggcgcctgttttcctcaacaaagcctcttttataccacttgctccccacaccaccctggccccttccacttgctcaaaaacactgagctccttttcactgtggggccattgaatatgctgttttccctccctagaaccttttcctctcattcttcacctgcccaactcatatttatccatgcagcctcagttttaatggcatttcctcccaggccttccaagaccactctccctcaggcagctttcctgacatctttagcctgcccgctcatgctctctaccttttttctgtatcaaaatgcctttgtttgcaagtaacagaaggcctgacttaacctgcctttaaacagtaaggacacaagtatgcctatgttattagaggtctgcaggtaaggcacgtaaagggtcatctttttccagtgtcttcaactccatttctctgaggttccatcagctacattctgtgccatgactttatcctcagtgcatttttcagatggtaatcaaatggctgtaacatgttcacctctagctcagcatgatactcagaggaagaatagagttgcttctaggagttttgtgatgagaatgagggaatttctttccctggagcctccagcaagcttgtcattaagtacctcctcaggtttctggctcgagttgcatctcatgcacacctctcaatctatccctgtggcagagaatgtctcttattgaaaaaatggcctgggtttgcctgtctctgaactaacactgcatcaggagaatgggattgccttgatcacccaagatcagtgattctcaaagtgtggtttatggagcagcatgacctgggcacttgttagaaatggagtttttctggccccaccccagacctactgaataagaatctctgtgctctgtgcatggagtggggcccactcatctgtggtttaacaagccttccaggtgattctggcacatgttaaagtttgaggacccctggccaagactagtaaggatctagttctggagctgaagtcagtcccatcaaatataatatatggtggagggtagggtgcgacaaggggtatttcggggagacaaccacagtgaccactgcacctttatagcactcatcacaatttgtaattatgcatttgtttgtgtcattatttgtgtaatatctgtctcccccaacaacactctaaactctacaatgacagggactcagtctagcttgtcagagtagcctcaataccggctatagaacctgctttatatatgctgagcgttcaataagttcttgatgaaaaagtaatagaagatatttcttgtgcctctcagttctgtcatcagttggttccgttccatttgtttctctcacagtcgggggtgatatgtgtgtgcacgcctacctcagcgggcagcccttggaggaatcacagctgagcatgctggcctgcttcctcgtctaccactctgtgccagctccacagcacctgccacctataggactagaaggtaattgcatatctaagtcttatcttcagtacctctgttacctacccctttacgttctagtttctcagtagttactgcccctagtttgactttcctcttcattaatgttgcagtgtcattgttagggactgttttggagcaaaaaagaaaaaattatcaactttatatatgaataactttcatttttattcagaaaaggatggattcttcttcacagagccccaaacactgatctatactaataaactaaatattccatattattctttactaattgatttttttattaaagctatttttctttattttctaggttttcagttgggttttttagaatcacatataatcttaatttctaatattacaaagctttacaactaataaatacctaattttgtgtttgaatttttttataatagttttaaaaattaatagtattatcacctgattgtatttttcagaatacagaaacagataaaaaaaatttatccattaagctgaatactaagatatgatgaattctaagcacccaatttttctgagattctcaaaaaaaatattttctgataagggcaaagattgttccatttaatcatttaaacttgaagtttaattacattactagttttttgctgttttgcaagcctctgataaaagtttactatctagagacttctggttatggccatgatggaattgcttgtattggactcacttgccctcaaaaacaaatataaaagctaaaaaaaaaaaaaataagaaaagggaagtacaacagggagagctttatattcaccctagcttctcccccaaaggcatttgccagttcatagtacaagaagtagagtgccagcaaaaagcagcaatgctgcagggctgaggagccagaggttgggtttgtgattgcccaagagcctagaacttgaggaacacagtctcaggcaggagagaacgatagaaatcataactcagactctggatatacctttcccttgagttacttaatgatattttagccttcatatacatgggataagacttcaagagatctagcagaagccacaaggccaaaaatgtaagcaaaaatgtcagcagcagcataggactgaggagacaaagggtggaattcaacgcttgttaaagtgaagtggctctgatcagcatcccagctcctcaggtgaattaatacatggccaagccctaagcctgctctagcctaattttagatctggtctgcttcagtttcactccaagcagacttgacctacaattagcctagagcagaactaaggtgatctgtgtgctttctccccacctgacagaagaaaatgtaaccttcataggagaaagaaaacatacccagagcccccacaatttttagtctacaggattcagtgttgaatcaaaaattatgaaacataataataataaaaaaacagataatagaaacagacttatgtgtgattcagatattggagttatcatactggaacttaaaataactatgtctaatgtttccaggaaaatagaaggaatgatagggaatttcaccagaaacctggggtcaataaaaaagagttaaatggaaattctagaactgaaaaatatagtaactgaaatgaagatctcagtattggattatttgaagtgaactggaagacacttatctgctggaagacaagtagaaagtaaacaaactgaagcacagagggaagaatggttaggaaatacagagaagagtacaagagacatgtggaaaccgtgaaaaaaaaaataaacatgcatggggttggaataagagaataagaggagagaaaaaatgagttagaagcaatatttgaagagacagaagctaagaattttgaaaaatggtgttaaatattaacccacagtgaaccctaagcaggataaatacaaagaaaaccatacctagtcacattaatagtcaaactactaaaaggaaaaggaagacattttaaaagtatagacttcttttcaggccaggctggacaaacagggttgttcaatggtcaactgtattagaaccagtaaaataccacttagatagtatttgaaggtagacaggcacttttgcacattatatttaaagaatttatatatatatatatatatatatatataaaattaaacaatattagtagtttcacatgtagttataggtcactttctgaagtctagaatgggtaaattctatcaaatcatatacaggtttgagtatccttaatctgaaatctgaagtgtttgaaatcgaaaacgttttgagcaccaacatgatgctcagaggaaatgttcattacagcattttggatttgggatttttggattaagaatgctcagccgaggctgggcgcagtggctcatgcctgtaatcccagcactttgggaggccgaggccggcggatcacgaggtcaggagatcgagaccatcctggctaacacgttgaaaccccatctctactaaaaatacaaaaaaaattagctgggcgtggtggtgggcacctgtagtcccagctactcggggggctgaggcaggagaatgggtgaacccaggaggtggagtttgcagtgagccgagagagcgccactgcactccagccccggtggcaaagtgagacttcgtctccaaaaaaaaaaagaattctcagccagtaggtgtaatgcagatattccaaaatctaaaaaaatccagaatccaaaacacctctctcttcggaagcattttggaaaagggatactcaatttacattacagtgtattaaggaatttcataattttaaatattgtctttgcatagtcattttcaaagggaaaaatgcctgttttaaacatgattgtgtttctgaagcttccttgaaaggagaggtatggctgaatttatttagagatgtgaccttcccaccccatttccattttagggagcacaagctttgctgaactgctcttcaaatttaagcagctaaaaatgccagtgcgagctttgctgagattggctcctttgcttcttggaaatccacagccaatggtgatgtgaccgtgtctggcggtgaacctaccctgaaacgtgacttctgcacaaaaaacgtgaccaaacatcaaagctaaagcaatgtttataaagttttatggtataactagggggaaatgagctgcacaaacctcaatgtattttaaatctgttgctgtcatcattaacggtatatgacatataaaagcaagttaaaatttacttttgtaaataaagtttttggtttgtttccaaaactcttgatgattgctttagttttggacttagagaatagagcaggggttgctggagtgaatattgatttttaaagtctttgaactgtggtggtataggtgaagtgactaagcccaaaaatgccaagttttaaaagaagctatgtcataaagttttactttctgtggcaaaagagcgctttagcatttcctcagatgtcacagttgtcctgtctaaaataagtttgtacttctggtgacaatgccagacactcttatgatgtgatcaccttaaacaggagaaggagatttttgccctcagttgctcaacatgaagtactgtggactgaattgtgtcctcccagaattatatattgaggccctaatccctgtgtgactgtattaggcaatagggcatataggagattactaaggttaagtgaggtcatcataagggtggggccttaattcagtagaattggtggcctcctaagcagaggaagagagatttttctttctctctctgccatgtgaagacagtgaggagtcggccgtctgcaagccaagaagagcccttatcaggaacagacttggctagcaccttgatcgtggacctccagcctccaaaattgcgagaaaatacatttccgtcgttgaaaccacccagtctgtggtattttgttatggcagcccaggcagactaatacgtgaagcctgctctaaatagataaaataagaaattactacagagggctctttagaaattgtatttaaaaacaagacaatccatatttacctaagatttacagaacgtatgtctgtaaaaggagggatttctggactagatgatggtgaaaaatgttcatataaaggcacctccagcttcgagttgccaacacaggaggaagaatgctccctgctgttcagatgctgatatgtgtcctgtgcttcctggatggccagtgggatcataagctggtagaagcaagatcttcatccactgacttcatatttcttccacatcctgaactgtggtgtttgactttaaaaataaattaaagcaaatagaaatgtttccattgagattttggcaaaaacccacatgacatttgcgtctgcagagtagacttggaaggcatgcacctggaggccaagtggtattctctggactctctgtccttgcatttgcgtggctgccccgaggactcccttcttcctggatgtgaagcagaggcacggtggggctgactgagaggctgaaatgtgcttctcttcacagttacatagttttcttctaattaaaaataaattttaagtggtagattatgaaaattccatttgaatcaagattttaaaaattcaatatcaaaccagttgttactgtcttcactctccgttgtttacgattgtgtgcttttccctgaataaagaatgactggagagacattagttgtttgcacacatattaactcatacctaagggagaacagcttttagaacattgtcgatgaaagcaaatatcagctttaaaagagagaggacagaaagactgcagatggtctggaagcagcatttttaggccatctgattagctagcagggagcaaaggggaggctgggaagtcagcccttgagtaggcctgctggatcatcaaataaatcaattgcagctatttttggggcctcaaaaaatcctgagggtatggctctcaccatccagaacctgcagcctccttagagccatggctcaaagggaagtgctgcagaaaaacatttggctgttaagtgttttggcccaaaaatagcacacatcatttcctgttaaagcctgttggcccgaagtagtcacactgctctacctcatgtgcccaggactgggaggagaggcagacgctggtgaggatcttatgccagttacatcatggttcctaacttactaattccctgtgcccatcttttctacttagatagatagaaataggtatcatcgcttccatagacataattaaagaaaccatacaatttacacatacactcagagtggtggttctttccccagtagacgctgacatctgcgttcctcccttgcaggtcttctgaaggacctagcaggagactcaggttgaaaccctacagaacctcgccgtgtgccgccgagtcttccttgaataaggccattttctcaccctttgtctagtaactagctgactccacagctcatggtaaggggcatgtctcagctcagggggtctcctgacatcccagaggaagcaataaggtgggggtctttcatctctcagcctgatgatctgtgcacacccacttggtgggaggccagggtgcctgtgggcagatgggtcagagtgtgggccaggatttggagtagaagccagagcatgtgaaaatccaaaccaggaagacttcgttgcctcccgcatgcggggttgaaggcctctcttctgtggtctcccatcctcatgctgatcaaattgggggggaatgtctcactgtgtgaggatcaccccaattaagctgtgggggaggacacagaatctgatcccctctgtatccttagcgcatgctacctccagccaccaggggaaagaagcagaggtgaggtgggagaggtggccactctggacggtgtaactgggctggctgcctctcagcgcccacgagcaccccacagatatccacgctagtgtacaaaggttcccaagtggtggccttttcctgcttccaagggctgcccgggttcccccctctctgaaatagattggttgcttctcattacatcacaagctgcagaaaaaaaatttaaataaaaagcctctacagctgtgtccttaactcttacctgtggataaggatggacttgcctgcccaacatcctctatcttatgtctttgggtgaaagggaagctggaatgggcagtaggggctgcttggggcagtcaggaccttcaggcttcaggcaaggagacccactgatcagacacctgcatcaaatattggtgctgacagatcccttagatggcaccggtcctgcccctcctacagtgagatccctgtggctcagggagggaggttgactgccccaaagcacccatcacaaccctaatgaagctgactttcaaccacacttcctatactccaccctgaaccgggtccagtactgcctgcattcccagtccagcagactcttaggagaaagcagtgattaaatgtaagttaaaaggacttggcaccaggaagagtttatgaacacatttgagaagcagacatactaactcttctttacacctttggaaaagcaaaggctttgtgtaattggaatttgattaactgaattaatctatgtgttgctttcttggtcacattataacaaccaccttaatctacatttttttctcatagctaaaaagatttattcctatttcatatggtacattattatatgaaatcttaaaataagttattgattgattgaagcagagtctccctctgttgcccaggctggcatcagtgacatgaccatagctcactccagctcactgcaggctcaactttctgggttcaagcgatcctcctgcctcagcctcctgagtaaatgggactacaggtgcataccaccacacccagctaaatttttaaaatttttgtagagatgaagtattgctatggtgccgtctggtctcagactcctggcctcaggtgattctcctgccttggcctcccaaagtgctaggattacaggtatgagccactgcacccagcctaaaataaaatttttatactaaattcaataaaatatataaataactggaaagtcttaattctcagtgcttgccttgtctctgtagttaagggacctgtcacactcaggcactcttccttgtgatgctgtaggccatgtgctttaagaactcaggcacactagctcattaggggagcttaacataaggatggaggttggaagctagttggtgccactcgtgtttctttcatttgtcttacgttcgtttttgtgcatatcaagaatattttagaccaggcgtggtggctcacgcctgtaatcccagcactttggaaggccaaggtgggcggatcacctgaggtcaggagtttgggaccagcctggccaacatggcaaaaccccgtctctactaaaatatatatatatatatatatatatatatatatatatatataaattagccaggtgtggtggcacatgcctgtaatcccagctactcgggaggctaaggcaggagaatcacttgaaccagggaggcagagattgcagtgagccgagatcatgccattgcacttcagcctgggtgacagaggaagactccatctcaaaaaataagaatattgtaagtgctgcttactgtaccaattcagaaattagggcagtttcatcagctggaaatgtggataaatgtatgcaactctaaagttgaaggaagatgcgttagcaaatccatcatggttagcatccctagctgccatctgcctgccccgttggatctagagaagatgaggtcaaacctttctcactccatgttctatgcaaatttctgcaaatccacagagcagggtgtaggtgctgtctccaatgtcacttccctccaaactccctgctctgttgcactaattcatttgtggttcatctcactgtgccccatgcgtgggctgaatgtcagtcagcttggcatcttcactgcctccttttgtctctccttagcttccagctgttttccctatgtagtgtcagatgagagtcttccagtgggagatgcccatgcagggcctggaggatagaggaggaggtgaagcctttactctcctgcactggctacagcagacacagggcagatggcatactcctgactgcaggaagctaataccagctgtggcaggtgtcaccactcctgagtttctggaagtttacaggagcttctctgtcctctgcttccttcattttcctgtttggatctctgagcaaaatccatgaccccttgagggatgcaatgctcagatgtaaagtcgtccccatcctcgagtcccaccaaaaccacccactgccactcagggactaggctttgcttctagaatttctagccctctggttacctcctctgagctcccagtgctgttcacttttccattctcaaatcctcagttgttctctaaaatgccagaatttctttgcaatttcctaacccctgaacaaactcacctgggtggcaccaatctcaaagctgcagcagtgggtctcactatgctttcagtacaaccttacataagttcagagaaagcctggactgaggaaatgaaaacctgccctgctgctcatcaggctggtgattctttatccaatccactggtggtgagcccgtgggttgattccatgtctctgctattgtgaatagtgctgggatgaacacgtgagtgcacgtgtctttttgatagaacaatttattttctgttagatagatatactcagtaatgggattgctgggtcacatggcagttctcttttacgttctctgagaaatctccacactgctttccacagtggctgaactaattgacactctcaccagcagtgtgtaagtgatcccttttctctgcagccttcccagcatgtgtcattgttttacttttttaaaaaacaatagccattctaactggggtgagatggtctttcattgtggttttggtttgtatttctctgatgattagtgattagtgatattgagaatattttcgtgtttgttgactgcttgtatgtcttcttttagaagtgtctgtgcgtgtcctttgcccactttttaatggagttgttttttgcttgttgatttaagttcactgcttctttgttgtgggagggggaaggcggggatgggcgggagctacaagaaaagaggcatcccctcagacactgggttaaagaaggaagaggctctattcagctgggagcattggcagacttgcgtctcaagaaccgagctctctgaagaaagagttcctggcccttttaagggcttacaactctaaggggtccacgtgaaagggtcatgatagattaagatctatagatagcacatgtggttagagtgcggggttaatctttttcagcttttacttcctccttctcttcagagacaggagacagtaagagaaatggcctctctcctcattcccccctttgagaacctcactcactagtgggagttctcactttcatcttcactatccaggtcttcctgagagacagctgaggtcttttgatgaactaaggtggtaacggagcctcttagtgactggagaaatatgggtaatgtacaggggagtaacatgcaggttcctaatactattattattcctattataagagttttaaatcctcctagagctggaaaccattttccaaacaggaatccaggatcaagcctatgccaaacctgcacgggcacatgtgccagctttgtcatgtctctaactatcctcatgcttcggctatgcatggaccagtcagcttctgagtgtgactggagcagggcttgtcgtcttcttcagagtcactatgcaggtgttgtccgggcttggtctcgcctcccaagtctcagttggccgggagcgtccgcagacttgtgtctcaagaactgagctctcatcttttccttgaatgacctgagagactttgttaacatttgtggccttctgagctcccttctttaacccttccagaagggcttccctgtatgggtttagcctttgcataccctgtctttcatttgggtcccagtgggggtctgttcctggtaattggatcctcacatacttttgggggttttggtaatcagctggaacatgttcttccacccacttagttgctgcttggagcactctcctttcatctgtgttaaagaggtacatgagcaactggtggcaatcagctcaggtggggttgtgggtctggataatagtttggagcaaaccaattatagcttgaggcttttcagtataggatggggtattgtttttcagtataggatggggtattgtttttccaattgaggagatcgacagaggtgaagggtttgtacacaaaggcatgcctttccactatatgcccatcctcatctacccagtatactgttgctttctcatgggcatttgtatcccagttctaggcctcaaatgggctgccaagggaggggtttctcctgaggtctcacatcctgtcttttctaccctgggtggcctaggggtatgtaggccttgggaagctcaggcgcagtggcctcaggagtgggaggccttcattcttggtgaaacggggggccactggtgccatttcttgccatgaatcttctgatgttgggtcggacaggacttcaggagctgactcccctcagcgggtggagcaggattcttctttggctgtctgtccctttgctactagtactgctgctgcctgtcctcttaacgactgtggggggtctaaaaccagctgtaaccaagtgtctatgtacggaaactggtctgggtgtcctggcttaccagttaccttgtgccatacctttgaaacaaggggccagtctaggcttccttctgatggccaacctacttctaatgctggccagtctatctcacacaaagttctaagttttcctggtgtcatagtaactccatagtccccattaaatcctttcttgaaatttttcaacatagttcctagtggagtgggcttactttgcgttccacccatcttcctcctgagacaaaacaacactcacaccacaagaaggaaagtctgaaggggtcactcactcatcttgcctgtctcaaactcaagcactcattcactttcactttcctttttgcaaacaagttaagccaaatcaaaatcaatattgagatcaaagtgccaattgcaatcaagtcaagtcaaatcaaaatcaatactgagatcaaagtgctgataagggcacattgtgggtgatcaggcgacacttccactcaaatggagcgggcaaattcccaggactggtcctactgtattccagatgtccagactccaagtgccggttccttcccggtgttcagctgctgcattgatcctccatggggccctgccgtgcactgctgtgatgaggcattccaccagggcaaatgcctacccggcagtgctctcaggatctgcattgctcaagctggctggagtcccccacagggatgctccgcagggcaggccaaagctgcctaaggggctccctcaactgtccattaatcacctcacttctgggtcagggaaccaagaaatgtagcaggacaagccgcagacaaaacccctcagacaccgggttaaagaaggaagaggctttattcagccgggagcattggccgacttgtgtctcaagaactgagctctcatcttttccttgaatgacctcaaagactttgttaacatttgtggccgtctgagctcccttctttaaccaggtgtctgaggggttttgtctgcagctcgtcctgctacagtgacacttagcctcagtctcatttccagtagggtcaaactgatgacctgacatacttattttctgtgctctcagctgtgtctaaatatccctgtgaaccactataaattcatgggcaatcaagcgtggcccaaaaatatgaccagagtggcgcaaacctgcctacaatagcccttgaagctgattgaggcagtgcctagatgccctgcaagaaggctggtgacacctacccctgtctgaggcatcttcctcatgtctggtagatgctctcttcctgctcctcccccattgtccctggggctcctcaaggctctcgaggcagccactgatggccaggttctctgtgggagttggctctcctgtcagccctccttccttctctcttttgcccacattccctcctctcctgtcttcccccaaaattcaaaaactgtttttattcctgctgcatccccaatcattcatctggagactcacaggtggtcccttccccatcccctgagactccttgggagaagatagttcaggatccgagacttggtctagtacaggaatgagtgatagccaccctgagtgagtgccttcatggctctctggagttccaggcccttgaagcggagcttacacttacccagagtgcagcccatgacagtgtgaaagagcactggctgtagccaagcgttagggaccaaatgcttccaagattccagagcgttggtctagattcactgatgtcatcacatcattccacgaggaatggctctttggtttataaaaggcactcaaggaaaaggccatgagcctcacagggaagggggttagtgtcccagcccgaatgctggagtcacctgctcttaccccaacatgaccttcacgtggggcctcatcttgtgttcaatcaaatccattaatgatttcaaatgaaaatgttacattcacatagcagaaaattgagaatatgcaaaattaaaagttgattaacctctcatctatactacaaagttacaaatattgtttatttttattgccttatttgtgtttagtatcatattaaaatttaaaaatgtaagctttaatattttgagataatcatagattcacatgtgattgtaagaagtaacacagaggggctctagatacccctcatcaaaatttctccagtggtaacaacttgcataactatagttcaatatcacaataggaaattgagtttggtacaatccattgacattgttcagatttcatcagtcttatatacacttgctagtgtgtgtgcattttgttctatgcaattttatctcatgtatacacttgtgtgaccaccaccaagttacagaacagttgtattataagaatacttcctattactttttttagaacttcatcttccctaatccctggcaaccactaatctttacaaccttataattttgttatttgaacaatattgaccaggcatggtggctcacgcctctaatccgggcactttgggaggtcaaggtgggcggatcacttgagctcaggggtttgaaaccagcctgggcaacatgttgaaaccccatctctacagaaaatacaaaaattagccaggcgtggtggtgtgcacctgtagtccgagctacttgtagagccgagttgggagaatcacttgagcccaggaggtcaagcctgcaatgatctgtgtttgtactattactggtggtgaatccacgtgggtctgcagcaacctcagttcttgcctcctcagaagaaagaattcgactgaagagcataaggcagaagaagagactggggcaaattttagagcaggagtaaaagtttattaaaaagctttagagaaggaacaaaaggaaggaaagaacacttggaagaggcccaagtgggcgacttgaaggacaaaagtgcagggtttgttggggtttggtatgcaggcatacttctggggttttgtgttccttctcccctgattctttctttggggtgggctgtctgcatgcacagtggcctgctagcgcttgtgagaggagcatgtgcagtgtgctgactggagttgtatgcatgctcacctgaggcattcttcccttaccagctgaatgcccctaggaggtcatacaccagttaaactctgccatcttgcctcttagtctgcatgtgtgagcctacttgttcaactcctgagattttactgggaagctactgatcaccaggttcaggtgttttctatttatcaggaaactgcctttctctggcactggctgtaaccaattattattttagagagacagttaacaactgcttgaccatcacctggtggttgcctaacattcctggtttggggttgtgaggggctctctcctgccctgctcagacctgaccagctacctactataacagcaccactgcactccaccctgggtgacaaagcaatcctgtctcaaaacaaaaagaaaacaaaaatgaaaagcccccagtattacctaaatggaaccagccagtatataatctgggattggtgtttttcacttagcgtaattcctgatatccagccaagttgttgcatgaatcaatagttaattcatttttattgcctagtggtgctcccagtcatatgataagggcacattgactttgtaagaagctgccatactttgttctagagtggtcctgccattgtacatgcctgccagcagtgtctgagtgatccattttctccgcattgacagtgtttggtgttatcattattttctagtttaaccatataagactgtggttttaactgaagtatcttttcaataacatcacacagttggcaaataatgtttatcctttgcccatgtcttctcattattgagccataatttttaaagatattttattgggtaaacatatttacataacagtaaatgccttaattgtctttgtatattctaaatataatttctttatcatttatatggcttgcaaatattttctcccattctgtattttttttttttttttgagacggagtctcgctctgtcacccaggctggagtgcagtggtgagatctcggctcgctgtaacctctgcctccggtattcaagcaattctcctgcctcagcctcctgagtagctgggactacaggtgcatgccaccacacttggctaatttttgtattttcagtagagatggggtttcaccatgttggtcaggctggtctcaagttcctgatctcaagtgatctgcctgccttggtctcccagagtgctggtattacaggcgtgagccaccacgcctagccctgtctcttccttccttccttccttccttccttccttccttcctttcttcctttctctttctttctctttctttccttctttctccttccttcctttccttttctttctttcttcttcattctttctttctttctttctttctttctttctttctttctttctttctttctttctgtctctttctttctttgtctgtcttcttttctttctttccatctctctctccttccttccttcctttcctttcttccctccccttccctcccttcccctcctccctcccctcccctcccctctctcctcacttcccctcccctcttctcttctcttcttttttctttctctcactacattgcccaggctggagtgcaggaacctagattcaaagatacaattttagcactctgtaaccttgaactcctggcctcaagtgatcctcccacctcagcctcctgagtagctaggactataggcccatgccacaatgcccagctcaaggagtgatactttgtcttgtgcatcctctgtcttgcctttccacttagctatggcctggctagagttcttaatgagagaagtctgctataatcctttctcccaaagagcctcctttatacactacatggtcactttcttccatatacgagagaagagtaagcttgctctctcacatcatcattaccaaatctcagctgggcaattaaaggaaatacttggatatttacttatccaaatacttggacaatttccaaagtagaattatcacagttttggctttgagaaagaacttggtattattgcaggtattttgggaacacttatataatattttctattatacttcttgagaggggttggttatttagtgacatgaattaaggcattataatattaaagaatggggcatcaatttcattggtaagtttcctcttcagcagaaaagagataagaatgttcatttatgcataaaagaacttgtcaaatgctttttttttcccatcagttaatatgatcatgtaatttttcctccttagtctgttgatatggtgaattacactgattgcttttcaaattttgagtcagccttatatccctggaataacttagtcatggttaagaaaaaatatatattgctgaattttatttgttgacattttgttaaagatttttatatatatcttcatgacaaatattggtctgtaatttttaaaataccgtttttatctggttttggtatgaggttaatattagtttcataaaataaattaggaagtattccctgactttttttttgtaagagattttgtaaacttggtgtttaaacttttaaaaacatttgttagaattctcgagggaagttatctgaatctagagatttcttttatgtcagttttacaattacaaattcaatttcttaaattatctatttcatcttgagtgagttgtggcagtttgtaagtttcaaagaagtagttcatatatctaagttgacaaatttgtttgtagagttgtttatagtattcccttattatcatttaatgttttaaatatctatatcccctctttcattcatgatattgataatttgtctttgttttctttgttagatttgctagaggtttattttattaatcttttaaaataatcaactcgttgtttcattgattctctactgtgtttctggtttcaattatattagtttctgctctttactatttccttccttctttctgttttggttttcttatatttatttattttagagacaaggtttgctctgtcatccaggctggagtgcatgattatagctccctgtaaccttgaactactggactgaagcaatcctcccacctcatcctcctgagtagctaggactacaggtgcatgctgccacacctggctaatgttctttattttttgtagagatggagtcttgctatgttgcccagtctgatcccaaactcctggactcaagcagttgtcccagttctgcctcccaaatcactgggattctaggtgtgaggcaccttgcccggcctgttttggttttattttgatctttttctaatttttaaaggtggaaacttagattattgatttgagacttttcttttcttatgtaagtatttaatgctgtgaattttcctcttagcactgctttgggtacatttcacaaattttatgtgatagtttcattttcattcagttctatgtattttaaaaattttctgagaaattgagaactttctttttgacccatggattacttataattgtgttgtatagttttaaagtgtttgaagatttttcatatgtctttctgttattgatttctagtttgattccattatggtatgaaaatatactctgtatgatttcaattttaattttgttgagatttgttttatggccctggatatggtctatcttgataaatgttttgtgaacatttgaaaagataatgtgtgctgtctgatgtcactggggcaatgttctacaaatctcaattatattcttttcattgacactgtttttgtgttcttctaaatccttgctgattttctgcctagttgttcttttttattatcactttttatttctttatttggtggttttgcctagttgttctatcagttgttgagagagagtgttgaaattttcaactataatgtgatttctctctttctccttttggttctatcagtttttgctttacatattttgcagctctgttatttgatgcatgtacatttaagattgctatgtcttcctggtagattgactcttatcattatgtaatatccctttatgtctctgataatctttttgctctgaagtctgctttatctgatattaatagcaactcctgctttgttttgactgatggttacatggtaacatggtatatatttttctcatccgtgtatgttgaacttacttatattcttatatttgaagttaatttcatatggatagcatatagttgggtcatgatttttaatccactctgccagtttctgttttttaataggtctatttagacaatttacatttaatataagtatgagatattaaggctaagtctgccattttatctatctgtgcttatttgtgtgtttatctcttttttttctctgttttatcttccttgctttcctgtggattgcttgaaaatattttataattccattttgacttatagtgttttttaagtgtatttccttgtatcaattttttagtggttgctctaggtgctacatcctgtacatgtaactcaggaaagtctatttgagttgatgttttatcagttcgaataaagtgtagaaacttcatctccctttagataactttaccctatcacattgataatataattatcttaaatagtttctttctatatctcgagaagtatattagacaatgttataatttttgcatcaaccatcatagtttagaaaacttgagaagctaagtgtagcatatatttacccttattttttctctttttgtcctttcttactttctgctattagaagattctttctatcatcatttcctatccatctcaagaaatttccttagttattcttttagggtaggtctgttggcaataaatcctgtttgttttcctttatttgacaatatgttgattttccctgcattcctaaaggatatttgtgctagatatagaattaggggttgacaggtcttttctttcattacttgaaaaaaatctgtcacctctagtctctgttgtttctgatgagaaacacattgtcatttgaattgttttcctcttataggtaaaatgtcatttcaatgttttcaagatttcttcctttagtttcagaattgtgattataatgtgtcttagcacagattcttttgagtttgggatttggaatttgctcagctactcgaatctgtagctttttgtcaaatttgtcatttttcaaccattgtttctttgaatactttttaagccccatactctttctcctctttttcttggtttttgatcatgcaaatgctagaccttataaaaatagtcccatggatccctgaagctctttccccctgccttagtatatattctttttctggctcagattgggtaccttctatttttctatattcaagtccattgattcttttctctatcctcttgtttctgttcttcagccatattgctaaaatatttattttgtttattgtatttttttcaattctaaaatttctatgtggttcttttcaatatcttttttgctgagacgtttttattctttcatttgtttcaagcattttcataattgctcactgaagcttttctattttagcgagtgttctttgacattgtgttggcagaggggaaaagggcattgccttcttagtgccagatgggagtggaagtccaggttacccatttggcaccattgacacctatgctgggaaggggttccttgttactgctaggtagaggtcagagtctaagatttccatgtagctttcaccaacactactgagggggaagggcatgcttcattaatgccaggcatgaatgaaattcctggatctcatctggttttgtccaacaccattctggctggcgtgggatgggtagggtgctttgttgtagccaggagaggatgcaagtctagattctccactcagcctttgctaacaagtgtggggctggagtcacatttttttcatggtgtttggctgggggtgcttatgttgtagacagaagttttctgccttgttaggctgacttttttctggtcctttggctggggaagcttttcttggggccttttttttttttggctgtgcctgttggtatttctaggttgctgcttctctggcacccagtttgagacataagaagccaaaaagaggccaggcacaatggctcacacctgtaatcccagcactttgggaggccaaggtgggctgatcacttgaggtcaggagttcaagaccagcctggccaacatggtgaaaccccatctctactatagatacaaacattagccaggcatggtggcaggcacctgtaatctcagctatttgggaggctgaggcagaagaattgcttgaattcaggaggtggagattggagtgagctgagatcacaccactgctgtgctccagcctggatgacggagtgagtgagactctgtctaaaaaaaagaagccaatcagagaacttataaccatgtcattcatttcttatgtcctgggatccttattcagtttgtcttctttccatatttcaaagtctttcatgcttcatatataatgtccagtgtttttgcagcacttagaaggaggaatagagagaaatttatctactccatcttgtccataaccagaggttcaagagagtaattttattttgccattaaattttgagtgtctagaggccattactgttagcaaactttcttcaacagagggagtgtttaccctgaaagctgcatttatataaaaaataaggtaccaaaaaattaggaagaaaaatgcaacctgagagtatgtgataacttcatgtacacttcttttctcttttatttgttcactattatacctaaaagttatgagaatagagaataacattaataacgttctgacaatccttggaattctaagagaatataagacatccctctcttattttaagaaagcatggaatactgatcagcaaaaaaagaaacgacttgggtggatatcaagggaattattctgagtaaaaaaatctttgagggttatatgctgcatgattccatttatatagcattattgaagtgacaaatttatggaggtcgagaacagatttgtagctgccagtttagggaagagggtagggagagggatggctgtggctatgaaagaaatagcatgaggattccttgtactgtgttatctgtggtggtggtggtcatacaaatctacacataataaaactgcatagacacacacacatactggagtgcatgtaaaagtggtgaaatatcaatagacgaaaggattgtatcaatggcaattttgtggttgaggccagacactacccagagacttcagtgaccctcccctgctggtgatattgtactatatagtcctgcaagttttcaccattggggaaactgggtgaagggtgtatgggagtctctctagtgtttcttataactgtatgtgtcagtctacaatgaattcaaaagaaaaaagttttaaaaagcaaagcaaagcattttgctattttgtactttcttcctctgcagactgccctactcacttccctggtgcaaagaggaaatggacagtctaatgtggcttctgcttaatagtctcttgtgtgcatagagaacctgttttttcccaattgtgtaagagttggttgttcttttctccatgaactattgtttgggctttgagtgagtgaggggagatttggtcctattctggagttacaagagggagaatctgacttatgtaggcaccattggtttccactgctgtccttaatgcccttctgaataagccaggtgattttctctgcacagtcctgaggctacatccactgagactggctctgtacaaagatgctaaacgccagacactccccagatacctctgtgccccctcccctattgatggagagcagaagagatatgagtctttcacggaggctgacatcacatgcagactttggcctcaagtctttgtcacttgccaaggacagaagaaataccgtgaactagaaagcttttgtgagtataaggaggagaaaaaaattagccagagttgcaagatgctttatgttgtttcaagtttgttctcatctctaaaggtaaactataggacccacctgctggggcaggtagatgagataatcctgcattagtgaactgtagcatctgactttcatagagaatggttttcttagtagaaattggggcgcaaaaaaatgaatgcagttatgggaactttgcgatgagatgcaaaatatctgggtagaaagcagataaattaccctcatgtatgtattttagtataaagtggacatgattactaggtaaaatgcacagaatttctcagttttcattgatggtatgaaatgtctcacactcaaatgtcagtaagggccagaagaaaatgtaaatataaggagttagtggataaacaataatagaaagtatggggcattgtcaataaactggagatcttggattcaatatgaatgttttcaaattcaaatttttaaacattgtgatggctggataatcacatctgaccacagatggtcagcagctgcttcaatataagttgtgcttggcttttctacatcatgaacccggaaattaagcttttctgtatataacaaaagcacaaatatcaatggcgtaaacaagattaggtcacctgcttctcgttaggatgtagaaagacatgaaaactttcctcctgtggtgatgacaagaatgaaccacataagaatcgtacgttcatggggctttcaaagattggaagatgtaaggaagctctgatgaactgaattgtagagggcgcgccctctagatgagccgagaccctggagctctctggggcaagtgcctgaatgagttcaggtgggaaaagtagcagctgcctacaggcaggaggctttgcagggttaagaaggagcatcctgcgtcaggggcaacatgtggctctggaggagttccaaatgcaaatatccatctctcagcccaacaactctcttccttacctggaattttgctgggaaagtggcattggagaaggggttggtagcagggagaatacagacagccttacacatctctgtgaggcttgggttctggagccctgcagaaggtgaacctaaaggtgaatccaaactgtctgaaacagtagccactccccagcttccaaacatgaagaaaaggtaagaatcctttaattatagcaatgcaagaggctggggttgggctaccagagtttcttacattagatgtaaagtggtatgatatgaattcaagatagagattgccagactggataaaaaagcaagaccaaaccatacagtatttacaaagatacactttaaatatgacacagatacattgaaagtaaatggatggaaaaggaaaaacatggtaatgtccagactcaatgtgagagggaactcacacagaggtgtggctgattttggcattgggaggtgtgactcattggcattgggaggcatgggccattggcactgggaggtatggtccattggtactggaaggcatggcccattaggactgggagttattgaacattgggactgggaggtacggctcaatggcactgggaagcatggaccattggtgggaaccatggctcactgcactgggagatgtggaccattggctgggaggtgcagctcattgccctgggaggtgtggaccattgcacgaggaagcatggaccattgcactgggaggtgcagctcattgccctgggaggtgtggaccactgcactgggaggtgtggccactgcactgggaggtgtggactattgccctgggaggtgcggaccatagcactgggaggtgcaggttattgccctgggaggcatggatccttgaactgggatgcgtggaccattgcagtgggaggtgtgggctactgggggccatgtggcatttgagttatggcagaatgggtctgggaaagagaattctgggctaagagagtcttccgttctttcttgtttcctcctctggaaatggctacctcttcttcctcaaaggaagctgaggaatgtctgcagcaggcaggctgtgtggggacttctagaccacaaaggcctgtctctgtgacagcttaggcctggtggggtgttcatggctgtgaacaccccggagagaacatggctgtggtctttaccagccctccattcctcttcccctcatagatctgtgagagaaaaggaaaatggatgtgttccttcgttttaggtagaagggctttgaggactggagaacgcctagggagaaaggggtgatcaaaatataccgttgttccaggatgtaattataaaaaactgggctccaaatatgaattcaggaatacttggtccccgtgccaatgcagccaagcccctgcacggtgtgggagcaactcctggggttggtgggaggcctggctgatgcatgatgggtctgaaaaccgctcaggctttgccaggtatgtgtcaggcactgatggcggcgatcggaccggcctaggttggcttagcgcgccctctagtgggagaaggtctaaagagcaaaatgtgagcatccttgccacagggcagaaatgatgctgaacgtgcacgccacatcaaaggacatacgtgcttaagggacttgtgcttaacaattactgtgattagtccgttctcacgctgctctaaggacacacccgagactgggtaatttataaaggtgttttaatagactcacaattccacatggctggggagccctcacaatcatggctgaaggcgaagaagcaaaggcacgtcttatatggtgtgtgcaggggaactgccctttataaaaccatccgatctcgtgagacttattcactatcacgagaacagcacgggaaaaacccacccccatggttcaattacctcccactgggtccctcccatgacatgtggggattgtgagagcaacaattcaagatgagatttgggtggagatagagcaaaaccatatcagtcaccatcttaaattgttaatacattggaatttgtttatgtctgttgtaaaaaaggccagtcgcttagctatttcatggcggttttgaggaattaccaccataacttatgggagagtgttttggtaaatggttacataagtatgaggaattttaattttttcattagaaataatgtgtggaatttataggacaatttattaagaagcttaaatgtatgtatggtcgttgattaatctaggtccatttctctcctagagagctgtcaatagagattgagtgtgtggtaaggcttcctcctcggtgggccttttagtgataggatggtcaagtgaggaagggctgtgctcctgcggctcctaattctgaattacatttattgggccatgcagtctggtttagtgcctgagtttatgtatgggaaatgaattccatttctacatgctgggtccttatcagagcagaaaaaagaacccacgctatgcagatacataaatgtcacccacatgaacaaggcactgtcttcagtatggcatgaagggggcagtgatgaatgggcagctggagaggggagcgtgttcagatgagacaggctggtgcagacatctggggtcaaccacagcagacactaaaatgcagtggggccgtggtgagggggatggaggggatgtgggaggtgagtgggagctgagggaagaggagtggctcagaatgcagtggggggtctgcgagaggaccagagagggaggaagcctctccttgggaagagttgggggcaggtcaggagaggttccaggtagagtcagaggtggctgggctggggtggtgaaagccacccttatcctccctgtgactcttagggtcattgcactgcttttctgcttccagatgagatggagtagcagggacggcgtttatcctttcacctgacataattaacacaggacaaaatagatgaggaaaaaaacaacaaagcgaaactgttgccatcagacagcgcagagctgtggtccctgagagggagagacagacaagaggagtgctaggatttccccagagggtgtggcctggacactttccaagctgtggcccatggatgtggctgctgtcgtggtggggtccctccggggaaatcactttgtcagtgaacagcaacatccttttctgatttttctagtaccacgcattgttttctcccattgtccaacaaaggaggcaagaatgcagtgtgccgcattcctcctgcagcagcgctccggtggcgtaccttaacctcgcttttgttttttcatgtgttggctgagtcagtgagtgtgctgtggtggacctctgccatttgtagctcctcaaatcttcagcaccctcttcacagtttgatagttccccacagtgtacctcctgccttctaatgagtctccaaatattccatttcacagccatccttgtttttgaggtgcaaacatatgatttaggtccagggatcataggcacccactcaaggctttgatcccaaacagttcccatggctggggcagagtgcggtggaggggcaggggcaggggctgacagctgtggcagaggcttcctgattcagctgcctccagatggggccagagcggctgcccctcactgcattagatctatggtatggcactgggggtctctttcttcagcattcgatttggtatgttatcttttttttttctttgatcagcttttcattatctctattcacaagtcgttataatattgctatttatcagtttaatgtaacacatatgataaaaacagatgataaaaagtatcatattaacaatgagaacattattggctgggtgcagtggttcacgcctgtaatcccagcactttgggaggccgaggagggcggatcacctgaggtcaggagtttgagaccagcctgaccaacatggagaaaccctgtctctactaaaaatacaaaattagccaggtgtggtggcacatgcctgtaattccagctgctagggagggtgaaacaggagaatcgcttgaacctgggaggcggaggttgcggtgagctgagatcgcgccattgcactccagcctgggcaataagagtgaaactccgtctcaaaaaaaaaaaaaaaaaaaaagagaacattattttacacaacccatttactgaatatgcagcctcttgcaacaataacatagtggacccaactctaccctctgaatggaccacttttatgattctcctaaaaagttttgagttggatatagtttcttgttgcttctctctgtgatccgagacttaagaatgagtctctggaaacgcagcaattggaaccagacctccccaggatcaaagaggacaggagtgggagaaaggacgcaggacacgactcccaccgtctccagcgctgcgccgtatgcttgacctcagagcatgcaggcactcaatgtcaagtgtgcagccacgtctatatcctgcatctcaagtgctcacaactgtgacaattagcagatatgggagagaggaggcatatcatggaggaatgagtcagtcccaaaaattacatgaacatttctgaaatttcaataccaagggttaacttctaaagtactagtgtataaacagaagccatatagctagccatgaactgaaatgcatgtaccatacagtgaaggagctcctgtgcatacaaaaccacccacgtctcatttatctctaattttaaaataactcattcccttgctggatatgcaagtgagtggtggagaaagaggtctatctgcaaggctggcgggggttaaggatttcattgcttccaaaagacgtgagcaagagaactttattactcactgaaggggattcttccttctcagccaagatggtcccatttaaatcacttttgaatttcctttcaagcttcaattgtgcaaattctagttgtggttgaggatcgtccccaacagctttttgagttattccttggactcttcctttttctactatgttttcatgaataattctagaatccatatttatatccagcccaaggcttctttcctatagaggtgtcgttgagttgtgagcttcaaagatctgatcatactgtttaaaagcaataggcttgggagtccagatgtcagcttctcagatccattttcacagtctgatggtgtctgctagcaattatcagtgcctgacccagaagcggtctattgcacctcagcttggaggaaaaagtgaaggcacatgcagtctgggaaaaaaagagaaaggaaggaaaaggcaggcaggcaggcaggcaggcaggaaggaaggagagaaaaagaaaggtggtaggtttctatgtactgacttggatttgtgtactgtgttccccaggcaattctaatccggactgcattcccctcaatgtctctaaagctgtcacatttgtaaatgcttactgcagaattttcttttttttcttttctttctttttttttttttttttctgagacggagtctcactctgttgcccaggctggaatgcagtggtgtaatctcagctcactgcaacctccgcccgtgggttcaagtgattcttctgtctcagcctcccgagtagctgggattacaggtacctgccactgcacctggctaatttttgtatttttttaatagagacggggtttcaccatcttggccaggctggtcttgaactcatgacctcgtgatccacctgcctctgcctcctgaagtgttgggattataggcatgagccaccgcgcccggcctgaggaattttcttaaatgaatttttaagttgtttcatatcaaaaaggtcagcatcttcacctggtcctttactcatctgaaaagcatcccaaactttcttgtgctgatgaaattgagtataaactgtgtctcaaagggctgcgtcatagggatttgcatgcttctcacacagcagaaccaagtgctgaatgagagagtcctttctctgccggaaatttaaagtctgcagttgattttcagacaaaaaatcccaggctttaggattgttgtcatttccgtcatggggatcctctttctctcttttctttctttctttctttctttctttctttctttctttctttctttctttctttctttctttctttctttcctttctttctctctctctctcttttctttctctttctctctttatttctctctttctttcctttctctttctttctttctttctctctttcttttctttctctctttctctctttatttctctctctctctttctctctgtctctctctctttctgcctttcttgcctttcttgcctgcctgcctgcctgccagcttgcctgcttgcttgcttgcttgcttgcttgcttgcttgctttctttctttctttctttctttctttctttctttctttctttcttttcttttcttttcttttcttttcttttctttcgacagggtcttgttctgtcactcagcctggagtgcagtggtgtgtgatctcagctcactgcaacctcgaccttccgggctctatcgatcctctcacctcagcctcctgagtagttgggtctacagcatgtgccaccacgcctggctaattttattttttgtagagatggggtctcactatgttgcccagtctggccttgaactcctgggctcaaatgatcttcctgccttggcctcccaaagtgctgggattacaggagtgagccatcacacccagccatgaggatgtttgagatgatcctcttaataaactcaacaacagtctcatccatctctctgtcatggcccacgtcttcagctacctctctcctcctgcatgctatctttgtcctataataaatcgttcactcctgaaacctggtagaggggattctgttgtctataacccccaccagtgcatttctatctaacggttaggaaaacctccttggctgggcacagtagctctcacctataatctcagcactttggaaggccgaggcaggcagatcacctgaggccgggagttcgagacgagtctggccaacatggtgaaaccttgtctctactaaaaatacaaaaaaatttagttggctgtggtggtgtgtgtctgtagtcccagctacttgggaggctgaggcaggagaattgcttgaacctgggaggtggaggttgcagtgagccgagatcacaccattgcactccagcctgggtgacagagtgagactctgtctcaaaaaaaaaaaagaaaagaaaagaaaggaaagctcccaactaaacactcaatggcctgctcataacaggagacacaggggaggtagtccagggtgggcgagtcagccgttcagcagcatcgtgaagaagccagttccttccaccttctactcattgttgtgcggcttcttcccctttgcgatctggtgctgcattccatctctagtcttcgggcatcactacttttccctgtggtgctcaacaggccatacagggcagctctgatgttggccaagtggaactgatgtggtcaggagacacaaatccattgagaggaggcagcttctccttggaagcagaatctccctttttatatccatgagaaacagccaggagagcaggaagccaagggctttctccttttctgttgcatgccagcgccctctttggctatgagcagcaggtctctctcccttcaccactgcatttggatgagactcagaggctgcttttgctgtcatctgtttggcttacttggtaagtttctgtgatttgaggcttgtcaccacttgtagagtttttgcttgatcgtgtgttgtttgtccagctttggttaaggccgcttaaaaccctgacctttggagactttgtgtgcaggattcctatttcatcattgtcgtgttttgtcgcaaagtcaggtttgcatcttggagagctttctggtcccccttcctgagttttgtgcccagttttgtggatgagtccatcataaatcttgtggatgaaatcttccaggtgcttctggacttttctgttcttttgcttcgcctgtgtagtgagagggagaagtccaacattaaatgagccctatttttacccaacgtctctttctccctgaccactctgtgtaaaatgcaatcataactcctccttcctgaccagcacttctagtcctctttatcctattttttctttctccatagcgcttatcaccctttcctatgccatctctgcctccagatctggaatataaagtcctcagtaggaaatacctttatctcttttgttcaatgaggtattctaattgctcagaatggtacctgacacatattaggtgcccaataaatagtttgtgaataaatgagtgaataaatactcaggatttttaacaaaagccaccaaagaaaacatgcttaatttattcaggaggtggaaatcttgggtgggatgaattccttatgagacctgcgagaagcgcaggtgatagtttgtgtgtgtgttcgttgtgcatttttattgatataaaacagaagcactggaaagtgtgggaagtgcgcatgtcatgaggatgcaggcccttggctggcttgtttatttcaggggtggttaggcattgtcgccctgggtggaggggtcagcgacgagccctctgaggccatcctgtgacatcccctgggcacctcctagtgtttgtcattcccgacgccccagggccagtgtccttggccttggagatctcaggctctgctggtttccccacctccctggctgtccctttttagtcctttcccacctcctgaccagacactgaacatccttggggctggtctccttcatttcttgctatattctttttttttaaagacggaatctcgctctgtcacccaggctggagtgcagtggcatgatatcggctcactgcaacctccgcctcctgggttcaagtaagtctcctggctcagcctcccaagtaactgggactacaggcatgagccaccatgcccggcaaatttttgtattttttagtagagacagggtttcgccatattggccagggtggtctcgaactcctgatctcaagtgatcctcctggctcagcctcccaaagtgttgggattatagacgtgagccaccgcgcccggccactatattctctttctattcaatttcattcttccctgtgcctctgcttaccatggggcacccacttgcagaggatgcctgattccatgccctggctccctccttggtggcctcatgcatctcaaactcaatatacccaatgctgtgctcagaccttccagctcaaatgcgctctgtctcagacatgctgcaaccatcctcctgggagttgacacctccccaccgtatcccctcacatccagtccctcagcatgttcccttgatcctaacttctaaagtgtccttgaacctactcacttctacctcccatgtgcccaccagacccagccccaaccacttttcgctggggtaacctcagtagaatttacactggtctcccttcattctctcacgcacacgacaaaccattctgtaccctgaagctggtatggtttttgaaaagctcaaatttgattgtgtctttaatgagttcccattgctctgaggtcagtgtggcatctttcatggggaaggtcatggccagcccccttccccttctcttcctatgttccagccaccatgacctgctgtccagtggtcatgagctgagtccctcatacccaaggcttttccagatgctttttctctgctggaacactgttcttgccttgcgttgctagcaaagatccccatgttcattaagcgcctcttaaatgtgacctctccagggaagcctcctccactcccattgcccattgccctggctcagtcagaccactctgtgtcttccttgttggtgctctctcctcttgtcattaaatcgctccatgtttaatgtctgtatcctccacttgactgtatgctctacaagggcagggtctaggctggcttggatgttatgctgctgaatctacagggcgaagcataggaggtgctcaataaactgaatagattttgaatagatgttcactgagggtaatactgaggagtggggttgttctcaatccttactgtagactccaaatgccagtactgttgggcgttgcttcctctgaaacactccttgaagctctgagtctcctttggatggttttacccaactccactcgtgcctccatcccttgctgcctctccagacatttgccttccttgtcattttcaggccgtcagctacagtgactgggaatgtgtgccacttggctctcacactcgcctctcactgtcgtttttctctcacgggagtttatcatctattcttctcatttccttgcctttctctctgcagcaccgataaatcatcagtttcacctgaacttcagaaagaagccattccttaattttggcagaagcacgatggagtagaaagtgaccaagtagactgacttctgatcatgtctctattgtgacatgccttcatgagctcccattgttcttggggttaaggcctttaatatatgttacaaggttggaatcactctggggaaatggccgaaactccctgagctttgtttcctcaagaggaatgtgaggtggattggattaaattccacctacaaccatttccatctcttacatttccagaatttgtcccagaatcatagaagcaaaccttgttcagagaggccatatccagctttgcaaaataaaaaaaaaagtcactgtgctggtgagatgggcctcaatcctggtcacatttctctcttctctccagatatctatgcttcctccctctcctgcctccccagaatataaacagctccctgagggttgaggatgttccttcgtcccactcccaacctgtcacccccaacttccagatttctttaaaagtcaaagagaaaggaaattttcaggaaggagatcatgtctaagagctttttattagtctcatcttccaatttcctgtagactcaagcttctttctttctgtcgtgcggggtttaatatccagtggctgtttgacaacagcaccaggaaatggaatttccatcctgattctgcctggaaccttgggcaaagtgcccaaaccttctgcctcactctcctcctgggagtaacagtccccaccctacagccttctggggcaagcaacagagacctaatatgaaaatggaaccagagagttctgatggatgtaaagtcctcaataaatgcatgcaggtattatttgttaatttttgccataggcaggctgcagcccccaggcaaactctgagtagaaggagcctataaaaacaagcctcctgcttctctctctctctctcatttttttttttttaattttttttttagacggagtcttcctctgtcgcccaggctggagtgcagtggtgcgatctcggctcactgcaaactccgcctcccgggttcatgccattctcctgcctcagtctcctgagtagctgggactacaggcgcccgccaccatgcccgactaattttttgtatttttagtagagacggggtttcatcgtgttagccaggatggtctcgatctcctaacctcgtgatccgctctcctcagcctcccaaagtgctgggattacaggcatgagccaccacgcccagccgcctcctgcttctctcttgaagcctgggttctgctctggtgtctccccagctcattgccggttgacggcacattgggctccctgtcagtcaggttggccacgtgaggaggagtcaatgaggcactgcttcctgccaagctgaggctgcccttcttataataaggaggtgagcctgtctcagggaaggttcttttcctaaatttcaggtgggattctaaacaggacaccactgatttttttaaaaatgaacctatcaagacatgcattttcatgggtgtaatcctgtttgaagtggtcacatttggggtttttatgtacttgctcctattactggtgaaacttctgtgaatgggcttcagatcatgaacagcctcagtggtggcagagtctcatgatttcaagttaccttatagttgagaaatagccccgcagggtaggtgatggcgtactccccacttgccattctatctggaacccggaaggtggtcaatccatattcactgaaatgaaccaagaaatgagactgtggctataaggttgaggatgttcatttgcttgtgaagcttctaaacaagatcttccaaacagttaagagaacacttggatatctttatgatggtgtgtttgctttgaaaaataaacatgaaagagaaccattatgttatagctccgctttctagtgagtaccccgtcaaggcatcatatccctctgtgtagcaatggaaaggcatttaacccaatgattgaacctctctgtgcctcagtttcctcatctctaaaataataatagaacctagctcatataactgttaagggggatcaaaggaggtaaaatgttgtgacaaaagttgcataacacagtggagtgtatttcattcattcccaagtctgaacttatgtgtagaataatgccacaatctatggccctgtgtcctgaaatgcccttcctccaggcccttttggagcaagagctccaaggggctgttccctcagataataacctaggtgattggaaaccttgactagggagcacagacctggaggtcggttccagtgtgggacagttggtcatatttcccactcaccctctgccatgcaaagtgggtgaggcagtggctctggccagttcattggcaggtggcaaaaccttgtctagtctttggcattgggcatgtgataccatcgatggccagtaggtggcacaagttgtccatcactgccgccagctttgctccattgggtgctttctcagaaggggaagatctatttctaatccagtcctggctttatggcaatgcttaatcacatggaagggaacatgcaataactactggtatttctgtaaacatgcatgctaagaatcagctgccatttggaaatgaggatggagggaacactcagtgagaggtctcctgaggacaatctaaaaaaggaaaaccttgagggttttaaaattttagagccagttaacctttgtgactcatggagagaaacgtttagaacccagaaggacaatgagaatacatcctgtggattgtaacctggtccaaggtccaccttgccctctccaccttccttcagctgtgaagtttaggaaggagagacaagatccccttgcatggagtcagcttacccacttcatgacccccagcagggccgggctgcaccttctgggctgtttgcttaattttttattcttttgtcctggcaagttgcctgcttcttgggtttgtcgtttccctggaggaaagtttatttgaatctcattctacccttaataaaattggcaccagataaatacgaagcggatgaagagacacattgcagcaaaacaaaaagtggaacgtggtcaacaacagggcgatgaggactttaatacatgtgtacactttctaaataaaaaattttcattgtagtaaaatacacataacataaaatttaccatcttagccatttctaagtgtacagttcggtagtgtcaagtacgttcacactgttgggcagctaatctccaggactcttcatcttgtaaaacagaaactctctacccattacacaacagctccctgttcttctctcccccaacccctaacagccaccattctacttcctgtctctatgaacttgattactctagtgtcaaagaaaagaatcaaactctgtaagatatttgaagagatttattctgagccaaatatgagtgactgtggcccccgacacagccctcaggaggtcctgagaacatgtgcccaaggtggtcggggcgcagcttggttttatacattttagagaggcatgagacatcaatcaaatacatttaagaaatacagtggtttggttcagaaaggtgggacaactcaaaactgggtcggggggacttccagcttataggtaggttaaaaaatattctggtttacaattggctgagtttatctaaagacccgggaccaacggaaagaaatgtctgggttaagataaaggattatggagacccaagtttttattttgcagagaaagccttcaagtggtaggcttcagagggaacaggttttaaaatgtttcttatcagacttaaagtctgtgttgatgtcagtgctggagaggtatcatgaggcatgtctgacccctgctttccatcatggcctgaaacagtctctcaggttaaattttaaaagagccctggctgagaaggaagccctttcagatggttgcaggggcatggggggatgcttagaattttatttttggtttactctaggtacctcatataagtggaatcacactattttgtcttttagtgactgggatatttcagcataatgtccacaaagttcatccatgttgtagcatgtgtcagaatttccttcctgtttaagctgaataatattctattgcatgcgtgatggttaattttatgtgtcaacttgactaggttaaggggtgtccagatagctggtacaacattatctttgggtttgtccttgaggacgtttccagaagagatgagcatttgaattagtaggctgagtaaagaaggtccgccttcgccagtgggtgggcatcaacccatctgttgagggcccaagtagaataaaaaaggcagaggagggccgggcttggtggctcatgcctgtaatcccagcactttgggaggccaaggcaggcggatcacgaggtcaggagatcgagaccatcctggctaacacggtgaaaccctgtctctactaaaaatacaaaaaaaattatctgggcgtggtggcgggcgcctgtagtcccagctacttgagaggctgaggcaggagaatgacgtgaacccaggaggtggagcttgcagtgagctgagatcgcgtcactgtactccagcctgggcgacagagtaagactccgtctaaaaaaaaaaacgcagaggaggagcaaattctctctttctcttcttagctggagcatccatcttctcctgccctggggaattggagctcctggttctcgagctttctgacttggggactcatcacccttagccccgcaggttcccaggccttcagctgaacgttggtcactccaatggctcccctggttcccaggccttcagattcagcctgaacgacaccatggctttcctagttttccagcttgcagatggcatagggtgggcctctttggcccccttaattggatgagccaatgcctgtaataaatctcctcttatgtatctgtatatattctactggttttgtttttctggagaaccccgactaatagagtatgtacataccacattttgtttatccacccgttcaccaacagacactcaggctgctgccttctggccattgtgcataacactgccatgaacatggtgtaaaatgcctcttcaagaccctgcttccaactcctttgggtatatgcccagaagttgaattgcttgttcatgcagaatttatttttaattttttttgtgtggaacagccatactattttccatggtggttgcatcattttacatgtccatcaacagtgcacaagggttcccatttgtccacatccttgccaacatttgttattttctgtttttcttttttcttgatggtagccatcctaatgagtgtgagatggtgtgtggacacttcaagtttgctctttctagggctttttctggagtgggcaaggctccctgatcccttcctctgaaagtggtgttactgtaaaggtggcattttcctgctggtcatggtggcacgcgcctggaatcccagctactcgtgagactgaggtggaaggattgcttgagctgaggagtttgaggctgcagtgcactatgattgctcctggaaatagtcactgcactggagcctgggtgacatagtgagaccttgtctcaaaaccaaccaaccaaccaaccaacccacccagacatttccccttctgccctcccctcagagctctgcctagagagcctgctgagtgtgggtacttctgggttggtgtctccaccctaggaacccacttgagagtgactttatttggaacaatcttcagtcacaggaatcttctgggaagtcaccagaccattgctttgaagagtacacagcctcagaccctctggggacaggagcaaggcaggctgatttattaaccacgctgcgtcacccttttgccctagaggttagatggtcccaggagcccccctcgccaagacactcctcagagtgggggtaggagggtgggaagttctagatcctcagtctggccttcaaatattccattacattgccggggacatggcgcacccacatttatccaaaggacaggggtctccagaaatgtctgcccgcaatatcctttggttacctccaaaacattctcttgaagttgtttaactgccatacattgttgtgggccggccttttattcccagattcacttatttaaaaaaaaaaaaaaactctcgagcatctctgaagagagaggttatatggcagatgcaagtcagcagaaggcagagagctgagaatggtggggagagagacacagggctcacggtgtgacaagcttcttggtgagtggtcaagtgcgtaatggccaggtaggcggctggtgggatgtgctcaggcagaccagcgtctgagtcccaggctggtcactaatttgctctgcgtccttgggcaagctccttcctttctctgtgcctcagcttcctcatatactaaatgagggtagtgagagctagctcagagctgttgggaggtttaaatgagtggatgatgtaaatacaagtgtcaggaatagtgtaggtgctctttagtgttcacccactgctgtggtttgagtgtgtccaaagttcgtgtgttggaaacctaattcacaacaccaacagtgtttggatgggggaccttcaggaggtgattaggtcatgagggctctgccatcatcaatggattaatagtgttaccttaggagtgggttaatcattgagggagtggtttcttgattaatggataagttcagtcccctttctctattgctccctcctgctcttttgtccttctaccttcccccatgggatgacacagcaagaaagtccttgccagatgcagtctccttgaccttggacttcccagccttcagagctgtaagaaataattttttttgttttctttttaaaataaaccacctgtatgtggtattctgttacaggctaagatactttctttctccactagccacttgctcagtacaagttgagagaagagtgttgtgaagcccaagtttaggcagagaggagcaggttagggcaagtgagcaggcagggtttgtctctcacccacctgcatttagccaacagctaccagtggcagccactgggctggtggacatgttccctgccacggagagaggggagtggtccagctgcaaggctctagttctgggatctagtcttggtgacggaggatcctggaaccatctaacctctggggcaagagggtgacgccatgtggttaataaatcagcctgccttgctcctgtccccagagggtctgaggctgtctactcttcaaagcaatggtctggtgacatcccagaagattcctgtgactgaatattattccaaataaagtcactccctggcaaagggataagtccctacccaggagctgcccaaatttttttttgaaacggagtctcactctgtcacccaggctgcagtgcagtggtgcgatcttggctcactgcaacctctgcttcccaggttcaagtgattctcctgcttcagcctcccaagtagctgggactataggtgcccgccaccacacccagctaatttttgtatttttagtagagatggggtttccccatgttggccaggctggtctggaactcctgacctcaggtgatgtgcccacctcggcctcccaaagtcctgggattacaggcgtgagccactgtgcccgacctcctgcccagatttctattttattcttgcactcagctaacagcctggctgcccagaggcaggtacaacttattcaagagcaggagaattccaattttattatttaaaaaatcacataattaactgagtattacaagctttgagatgtttgttggttaataaagatgaatgggctatttgaggtaatggcttttaattaaatggaagctaataactttggtaagtttgtccgagtagtaatcttggctaacagtttgaagtttcgtacaataatcttggctaacaatttgtagcttgccttgcactgatttcatagcattcattgtttacaacacgcagaacacccactttacagatgggaaaacggaggctgaggctaagggcacaggaaggctgtggggggattgcagtccacagcagccccgggggtctcaagggcatattccttttaatcatggcttcccacacaacatgcatccctaattctgttcacctgacccctgactaaagctcagctttagggcaggagatttaaaatacaaactcattatatctgcaggtgtgggctgcagggagggcttggagatgtagaatcctcctttgctgccatgtagagagaggaaagactgcatgcaggcccagctctgctactcacggcctatacaaccctgcacactttatcccagagcttaaatcttttcccttcttgcagctcttcttctgttaagggacctagagcaggacataatcatctgttcttcttatggaggggctaaggaacaagaaaaatggtaaggagcaaaaaatggggccaggtcatttgacaaggaaccctgggaaatgcaaaagttgtatattctttgctgagttggagcattagtgacctttctctcttttcttgtgaatttacaggagttgcaaaggcccagcacctccctgtggcttttaaaaccaggtatgtgggcaatgctcagcagagactgaggaccatggccggggtgccctgcagccctttcatgccgggcagctgcagcctttaatttgggggctattgtggtattgttggtattattcagggtttgggcttcaagagaacctgtgatgatttctttgttatttcacagaaattggtctgaacggttggcatgtaatgcggtggcactggttctcctgtgtttgcccaaaaccttgccaggagaaccaggcagtggacgggtgtgtggtcagtgtggtgacctgcaaacaccactgtccacacctcatgctcttgctcaagaattttcccaggctccgtgcatgtgtaaatttgcaaaaataacaaagccaaccttcattgtttgttctctaaataagaagaagcttcgtggtttgtgttcgagtgaaacagcaagggagaattttgatcctgtggaatctggccagaccttacagggttgaggggtctctgcactcacatttgccgtgttcctgtccctctgcctctcacctttgaatgcctccctggggcagatgctcccggctcctactcctcggatcctttgtgtaatttctcacaaatttctagagctcacatggaccttcctttcatagtccaggaacacacagggttgatcctcgaggcctgtgcctctctccgggcacccgtaacaccctgctccatgtttgcttcaccttggagtaatcaccttgcactcaccccattgtctttgggggcttatgttttgtgggtgatagagtgcatcatctatgaggtaaaatcttttatgtgtgtttgcttattccgggatgcactggtggccaggctgtgctcattctggctcactgagggtgtgttatcatcctgccatggaccaccctcttctagaaggaacagaacatcagggtctccctcccagccccctgttccaggtaaccacagcgtactgcaggaacaaaggtgtagactgaaagtaagttaaaggacagggctgaggcctatagactgatttttcggagtaaggaggtgggcccttttgaaaatattgagatataatttatataagataaaatttacggctgggctaggtggctcacacctgtatttctagcactttgggaggtcgaggtgggtggatcacctgaggtcgggagtttgagaccagccccacacaaaaccctgtctctattaaaaatacaaaaattagccgggcgtggtggcacgtgcctgtaatcccagctacttgggaggctgaggcaggagaattgcttgaagccgggaggcagaggttgcagtgagccgagatagcgccattgcactccagcctgggtgacaagtgcgagcgaaactgcgtctccaaaaaaaaaaaaaaaaaaaaaaaaaagataaaatttacctattttaagtgcacacaatgaattttggtaactgtatgcatttgtataaccacccgacaatgagatacagaacacttcatcacccccaatagttccctcaagcctctttgcagtttctcccctccctttggcctcagcaaccagtctgtgagtctagttttgcctttctagtctttcatgttaatggaatcaagaagtgtgtactcttttatgtctggcttcttgcattcagcatattttggagccttgtccgtgtcactgtgtgatttctctttattactgagtagtaatgcattgtacagaggtagcacaatttggtttttcatttaccagttggtgaatattcgagttgtttccagttttgggcaattaggaataaagttgctataaacattaatgtacaggactttgtggggagttctattttcatttctctttggttcatattcaggagtgggtttgctaggtcacaggatagacatatgttaaaactttgtaagatactgcaaaactgttttccaaggtggctataccatttgtattcaaaatcaacacttttagcctagagcatataactggccttcctgaaatccatggatatctatctgtgcaatggttttagagacattttattgcctcccacatgtaattaagttacttggcttttaggcaaaagatgataccatgtctatggatgagatgactctagttttgaactctgggttttgcagaagagtttgcattatcctcctcctgaggaaagcagatacatccgccacgatgcatgtgagtcaggtcttctgcgtgtcctctgaatcaggttcgcatgtgtgcctctaatggcagtttcgagttcatcctgtgttgagataatgcctgaaggcgagaggaaaaaatatctgtggttgtcaaatcgggtggaaagtgattaatcatggagacatttacggcatgctgaactgtttcgtttcctgacctttgtcccacgtgcgttaggggcaggcggggtcaagtttaaatccaagatgacaagtgtctgaggctaaggaaggtttctgctgaatacttggcttagagtcaatggctccatgtttcacacctggtgaaaaccgactcgcaattgaaagaaacagcatgggagtgtcaaacacttgctgacttggccttgggctagagcttcttgcgagggttttagaactgacacaccctttggatgtgctgggggcatctggtttttggtgcctgagtcacaaatcctggaatacatttgcccacagtgtttccataccattggaagtgcattatggctgcttctcttagagtcctttaacctcttcctcaagagccagctttgtcaacttgatgtatctcatggcaggcatggactcatgcctgtgtgtcccattgtatccccagatcatgggatttgtgggattcagccagtgtcatttactaatcactaggtccagggccaagtttaggtgaggttcactccatctaagctgtgttttgggggagggagggtctctattttttcatttagagaagtgactagacactagaaaatgtcacagagtaaacgtatggactacagcttgttttctgaaaaggtttagggatcccgtgttagtattgaaagaccctttgaggcctcatcccctccacccagtgggcacacaggcctctgaccttcagcgccaagtctcccttgaggtcagcttctcttcatctttcacttcttttctcttcctttcacccctgctggttgcagcgacaaggtccctgccaactgcggtgtgcacactggcgggccttcacctcccttaaaatccagctctcgaaatgtctgcaagggagcagcctgcaatattacctaatttgtctttaatctggtattcctagaataatccagagaatagagtggcctactgtacacactggattactcaataaagaacatgatgggaaacggcagtatttttctgttttaaaataagtaggtttggagggagctgggaaactgcgggctttagttacaaaatgactataattgtgggagacgtattttctttgaatgttgaaacacattggacaggatatacaatttagaaataatttacagttagagaaaggccctttcatctgagagggggcacatcttctgattggaaaggatggtcccaggggatgagggatcgggccccaggtgagcttcatctttttctcttccaacttcagtgtggccaaacagagcggaaagtcatcacgtagaaggacaaagtctgtgtttttttgtttttgtttttgttttctctcatgagagaagcaggcaagtgctgcctgagaaggtgaaggctcacctgtggcaggcttgcttcaagctggctgcagactgaaggccacccagaggctttggtcaccaagggtggcatgatgggtggccttctccttgctcatgcagctctcaccagcaaatttctactgaatgcccactctgtgcagggtactgtgccaagcacgagggatgccaggacccggaagaaagaactctgttagagaaccacagctgatagctgccagtcagcagtaaaggttcaaagcttggcctggccaaggagctatcacggagggctctgtggaccagggtcttgtagtgggagtgtgtcagcagagtggaggggttggaggagtgagcccaggtatgcaggggtatggatgggccgagagccttgggcctggcctggctgaaggctgtcctgttgaggcactggcaagtgggcttgggaggcagacggatgaccagacacggccccacagagatcagcccaaagcgcttggacccagggcatctgggatggttcttgaggtgagcgcatgaagccttgttttagacacatacactagaggactccagcctccctgcaagccctcctcctctctctctcctcactgttgaggcgagtgctgtgtctgccttagattccttctgcaggcttctgtctgcctgccagcagatgcctctatgtctgtcagccctcagaatgtcaggcacatgcactacccactgtgtgtgtggggtgtgtgtgtgtgtgaacatgtcagatacccacacaggctctccactgttcagtgtgtctccagtctgggacctgggggtggaaatagtcaccgtctacatccatcttcttctgcttctctcttaggcatttccaattcaacatacaccagcctgaactctttatccacatccctttccagcatgctcttcctccagcccctactgaccccatcacaggaaaaagccattctgttcttccagttactcagggcgacagcctcggagtcatcatcgatgtctttttcctctcacacctgacacctgacctgtggccatcctgttgactctccccttgaaatacatccagaatccagccccttgtccccactccagcactcacagtcacattgcacctggtctggaccccagcaagtgctgccctgtgggactccctgcttctccccttgctccacactgtctattctctgtagcctttaagaacaactcaggtcatttcactgtcctgctcaaaaccatcaaatcgtttcccgtttccttcagaatgacattcacagtcctttccgtcacagctctgcgtggcctgtggtgcctctgtatcctcatctctgacttagtttactccaccccattctcctccttcaccagactcccaggcactccttcacgagcagcatgcacctgccccagagccttggcaccagctgctttccctacccagaacactctccttcccacatcttcacagccagctgtttcattccctccaagtcccttatcagagaggctttttcagtcactttgagtaaaacagaaacctaccttttcatcattcttgaccccttaactaaacttgcttgagtttttgttgttgttgtttgctcgttttttacttattaccacttgacatcacttttgtgggaatccccttgcttttatggaaatatgtaagagtaaagaacttcatcttattttccgattatccccaggtcctagaacagtgctggcatttggaagctgttcagtatttgctgaataaatgaaatgaattatgctgtgattcactgtgtgtttggaggtgtttggagggactggcatgggaggattggattctacggtggtaatagtgacatggcatgatgaaggcatggagtagaggggcggccacagaaatgcaaaggaaggatgactgagggagaggcctctagctcggttgttgcaggacagggatgcttgactggcagtgccttggatgactcgttataagagctgtactccagactcaggatatgctttaaccataggttttcagatttctcctggggtccagtcaactcccatgccagtcccttgttccatgatcccaggccctgctccaattccttaactcttattctgtaaccgtaacccaaatggctaagcctgaggttgcaggctgacctttagagaaaaagttgaactttctctttaaagctaagtgggaaaaaaacaatgacggataaaatgtaaagatgtacaaaggtaccagtttgtacctgggtgtttgaatttctttacattttgctgtcagttgtacatggccatttgaaatgagtaatttaatattctgctgatttttaaatacatagatcattttcatggcactacatagtaaatctgtgctttgcttgtctgctatctgtgtgtttaggttcacaccagttctggtcgtgaagctatagctcaggcattatcatggacttcctagaagctgccttgccagcaaggagcctaagaggtgttcagaaaaattatccaaaacttggaaataaggaaagaggatgactctatgtcctttaaagtccagatcagagcattgtctattagatccactcaaggattatttaaatctcaaggagaatgtaactttgcttcacatactgtttactagtaactggctgcctgtcaacttgtgggagataagctggatacaattttgtccagtacagatgcaaatgattcccttcccttcccttcccttcccttcccttcccttcccttcccttcccttcccttcccttcccttcccttcccttccctcccctcccctcccctcccctccccttcccctccctccctccctcattctctctttcttttcttttctctctttctttctttctttcttctttctttctttccttccttccttccttccttccttctttctttctttctttctttctttctttctttctttctttcttctttctttctttccttcctttctttctttctttctttctttctttctttctttctttctttctttctttctttcttctttccttccttccttccttccttccttctttctttctttctttctttctttctttctttctttctttctttctttctgtctttctttctgtctgtctgtctctctgtctctctctctctctctctcattctgtctctgtctcattctgtctctgtctctctctctctctcattctgtcacccaggctagagtgcagtggcatgatctcagctcattgcaacctctgccttccgggttcaagtgattctcctgcctcagcctcccaagtagctgggaccactggtgtgcaccaccacgcctggctaatttttgtatttttagtagaggtggggttctgttatgttgcccaggttggtcttgaattcctgagttcaagcaatccacccactttggcctcccaaagtgctgggattatagacatgagccaccgcatccagccagctcttttatgtttaaatcggccaagcgtgatcgatttccttcaggttcaaaagattacccaaacattacagttgtattgtgccatagaacattaaccagttttgtatgtaacttagcaaacttttttcagcattctttctgacatacgatacatctgtgttcctcaaatgctttgagaatcagcttttccatcctatgggttccctcagtaatgagttaaagaattgtgcttgctacctgtatgagggtatgagagccaagttcctaatattttgaaaatgatgttttgatggaggagataaaaagtctcctgtgttagctatataaacccaaacctacaaaatgatgtcaagtaccatagaatgtatacaaaagacataacctactcctcccaccaatttctattttattagcatgcatttctcaggaaagactgttcaaaaggtaaggagagaataccattctaccattctgccaattcaagttagaccagctatttctctttgcttattcacttcctgttttctcttaataaatttatttaaagacaatttattagagaaaaagttgtcttacaaatgcgaattgtaagttgtcttactgatgtgatccagcaatccgtcctggccggcaccctgccaggtctgtaattaagactgggggtttgctctgcaaggacacattctccacctttgtctggggggctctgtactcagtcttgcggtttgtctgtggagctgaggtgctggttgggaatcaggagacgtcagttccggtctcagcaaagctgctgcgaggtgcggggcagaggcctggtttacctggtataccacatgcccttgacttccctgtggtaggtgcccctgattccgctccagctcttgctttgcatgtaatttacactgaggttgcaaacaactgcttattcctgtgggacttagttttttccttagggccaatctgaaaaacttacctccttagttacatcctacggatttgcagacaaataggggaaagaaatggaagaaataagggaaaatgttatccaaagttggaaataatagaagattactctatgtgctttcgatgtcatactagaagaagccgctttaagtagcaccattattctgaatggagaaatctgtggttgctttagtcatggagactacatcacaactagggttttccttttatttttgagatgtgtgtgatgggggaggataggggtacagcattctagaaatggcctcattttgcatttccttaggtccaaagttaaaataactttctgttctaagaagctttaaaagtggttcatggaccaggcacggtggctcacgcctgtaatcccagcactttgggaggctgaggtgggcgtatcacctgaggtccagagattgagaccatcctggccaacatggtgaaaccccatctctactaaaaatacaaaaaaatttgctgggcatggtggcgtgtgcctgtagtccctgctacttgggaggctgaggcaggagaattgtttcaacccaggaggcagaggttgtagtgagccaagatcctgccacttcactccagcctggtgacagaactagactcagtctcaaaataaagtggttcatttctttctaaaatcattaattgaacattaaaaaacattggtaagaaaaattgaaccaagaaggttttgggttatactgtaggtcagtgagctttaagtttctgtgtctctgaagctacatggctggacgatagctgaagtcagtgccccgagtgaagcctgaagaggagctgatggatttttctggtggggaaggcctgtgactgcactcagagagagctgggccaggcggggtgaggcacggtcactctgagttcacagacccactctgatccttgaatgggtctgtcctgaaataatggggaatcctggaacatgctgctttgtgtagacgcctttctcctttgcaacttttaaaggtatttgtcccctgggtttcatttgaaatgcttttttcttcttcttcttttttttttttgccagatgctttcactaggagcagtatccagaaagctatgtttctaacctaccttgttgtttgcctcttgggcaaatgggtttgtttaccttattgactcagttcagtggaaaatattaccctgattgggatggagatggggctgctgttctgaaataactacgcaagtttacctgttcaggtgggacacagcttcttgtgttagtcacggatgaattttgaaaatttatacatagtgcaataaatgctggtttctttccccttcctcactccttcctggggcctatatgtgtgtatctctaacacacatacacacacacgcaggcacacacacactcatacacatgcacactcacacacaagaggatacgttgcatatacagctcaatgctacaaagaagcccttttaccagaagagcacacgggaactccgctgaagtttgacagggtgattgtcttgtggctactctaccctgaggccagagcacagtgagggcctccctcctgcccccagccacaccaaagagggggcaggggttcacagggagcaaaagaggagctttttgccatcaccatgagacggtgaccacaggggcctggctcgaaggtgagggtggggctggtgactggtgcctgtggattccagagtggttggcctacacagcctactgagaggtagagcacggtcctttgcgtccctgtggactccgagtgcctgccatggtttggaaggtccactgaaggctgagtgctcagcggcgttgccagccagctggatgcatgtaaacagcattgtgaatggagaacattctttcaccttattcttgcacattcttctcccctacttagcttcttatccttcctatctactcatctagctagcaatccctaaaattaaatcatttataaatgagtccgatgagggtctttttttgaaaactggatttagtgaataaggcagacccctgtttttggatagggctttgcctcttgttattaaggaggaataacttgttcccaacttggttggtgaccccagctgaggaggaacaagtggcagatgagtcccagggaagacccctagggggaatggctggaggtagctgtatcagggatgaaaagggtgggggtggtgatgaggggaacgcagcccttcatgcaaagaagtgggtgtttgaaatcagtgggtgactatttttttggcaatgtgggctccttaggtcatacacagtggccttagaaagccagccctgcctctcttccctcaactgatggtggatttgtgtaatgagatcaccgtcttcttgaaaaacacttccagggtagctcattacaaagcctcgcacagtgttcggagcagggcgagctgcaaggccccgggctttccattctgaaagagctgtgggtgtcggggtggctgccagctgtgagagctccgtgggtggggactctgtccctcaaagccacgcactcaggcttgcccattctagtgtctctgtgggagacaatcaatgtaatttactctattaatggaatgaaggattacaataataaaatctttttcaaggaatgcaaaaaagcatttatcaaaattcaatatccattcatggtaaaaactctcagcaaactaggaacagtaggaaacttccttaaaataataaaggcatttacaaaattcctgcaggttgcatcatgcttaatggtgaaagcctgaactatctcctaaacccatttactcctcctcagggaagacttccctgaccccatgtttaagtcaaacactcattatacattcccttaggaccagcctctcatccaaagaagtgatcataaatgcaatttaaaatgtatttgtggttgggcgcggtggctcatgcctgtaacccagcactttgggaggccgaggcaggtggatttcttgaggtcaggagttcaagaccagcctggacaacatggtgaaaccccatctctactaaaaatacaaaaatcagttgggtatagtggtgcgtgcctgtaatctcagctacctgggaggccaaggtggaaggatcacttgagtctgggaggtggaggctgcagttagccaagatcgtcccactgcactccagcctgggtgacagagtgagacttcgtctaaaaaaaaaaattatttctgccactatttgcttaatgtttgttttctggtgtaggcattcagctctgtgaataaaagcattctgctgatttctgctgccctgtatccagacggaaggaatgggtgagtgaatgacaggcacctgttctgtttacagtcagtaaagtaaacacaacactacacgtatgaactccaccggaaagatgaacacttatggtatatttggtgccactgtcccagggagagtagaagtacagggttttgttcttctgacttgagaaatttttgtgctagaagggccactgagggtcatccaggcctatcactgcccaccccaaatttataggtgaggtcactagggcctgagatctgaagcatgcatgacatcccgaatgaactacaaatcctaggtcagagttaacagtagtggtaactgcacaggatgagttggtgcagggtgacaagctcatgcgtggtagctattttgaatcaataccccgtaactaacctctgctgtttgaaacacctggcagagtgctgcaactcacccttgggcaaagccccactctctgaggctgtggtggggttcagggaatactaccccaaaatatggcagattggcattggagaaaacggcagaagcaggaaggcctctctcaccttctccttgcccttcttttcctgaagcaggccatgaaaccaagctgactttctcctggagcaaggcataaggtccttgtgtgagaggtgcccactctttacctggaggggaggaacatctttatctctgaagacacagggacgcagaagaaaagctgaacaaacaggccttgctgagttcccccttgtatataactaattagatcatactccctttgtccaatcacacttctccactactgtcgacttctccatcaaacttacaataaaaacacacaggtgtccctattccctatttctttatctttttctttctttctttctttctttttttttttttaagatggagtcttgttctgtcacccaggctggagtgcaatggcgtgatcttggctcgctgcaacctctgccttctgggctccagcaattctcccaccatagcctcccgagtagctgggattacaggtgcccgccatcatacccggctaatttttaaatttttgtagagacggtgtttcaccatgttggccaggctggtctcaaattcctgacctcacgtgatccacctgcctcagtctcctaaagtgctgggattgcatgcatgagccactgtgcccagcctctttggatcttttttcctgaggtgtcttatgttacataaaatttaaattaaataagtttgatgtttctcttgttaatctgtattttgccataggtgcctcagctatgaccctcgtaatgggtgaggaaaaaacacattttcttccctgcagctgcttggccacctgccttttgcttggattggcagaaatctggcttaatctggcttctccagtcctccatcacctggccaggaggtagcccttggtctaaccccttctcatgtttggaagcagactttccctttctttctaaggactggtaggcagctcctcatggatggagtgataactccagaatgtcttcgtgtgatggctgttggagtgggaagtgggctgggaggctgtgctggcatagactttgtgtaggattgagaagacaataactgccagtgtgaagatcaggcgggagttgggaagacagctgagagtggccaaggggaagccagagcctcttcaagtcatctctagatgggtgtgaaagggagagaagaggccaagaaaccatgagattaaaaggtggaggtgggggcatagagatcccagctgctctaggggaccctcccaggcaagtgctgtgtgtgtatgctcctccactgttccttctgcaatgcattccatctggctgctagatacggtaaagggaatgaaaggtgggaaaggcaaagggtgcatttaatccactcttcagctgtgaattctctagaggagagctagtccttgtgtttgttgatgcagctgcctctctcctgagacctgtaaaatgacttttttttttaaaggtaaaatcatgactcttacacaaatgtaaaatgaacacatgtcaaagattttatttagttcattaattaatgagggaaccagtaagatgctacaaccagcccaaaggagaattaaaaatgccacgcatagctaggacaataggaatgctgacatagaatttacaaatagatgcaaaattgatgatagccactggacagtctgtccacatgtccatggacaaggatagttggcattccatgggtcttttacaacttgcaaaccgaggaaagtttaggtcctcctttttccttgctgacctttcatgggtcagccctcatctggacatcaacactcctgagacatgtggtcactgcaataattgactgaaatcagtaaagacacaatttctccctctgctgctccgtgttcctgtctagagagttgttttcctctccaagtaaaagttgttaaagagcttaaagacaatgaagggcagagagagccaggatgtgaagacttttctgctgtactgtctttcacagatccatgttgcagctgggagcacggggaaacctggacacgcacttcaccaaaatgagacaactgtggcaggagacaggctaaggcgagtggggacaaatcaatgtgctggatgccctggtgtacctgtgacgaagaagcaggagctgggaagagagaggaaaaggaaatagacaagtgaataaataaataagagttcagaaaccccgtctccaccaaaaatacaagaaattaggtgggcatggtgctggcgcctgtagtcccagctattcgggaggctgaggcaggagaatgacgtgaacccaggaggtggagcttgcagtgagccgagattgtgccactgcactccagcctgggtgacagagcaagactccatctcaaaaaaaagagttcaaaggaagtgtagaagagttgagagaagaactctatttgcacattcactcttcagttcatttcctcattcattttctgaacagtgaatctggctctgtgctggatcctggagcataaagactaaattagctgcacaaagaccctgatcactaacatcctagtgggaaagacacactgtgtattaagctgagtaatcaccaccttcccaccatgtctgtatcctgatccctggaacatgtgaatattatcgtatatggcaaaatggactttgtagatgtgattaagttcaggatcttgagttggagagattactctgcattggcctaatgtaatcacaggggttttcataaggaggaggcaggtgatcagcataggagaaggcaatgtgattatggaagtaaatgtgggagtgatgcagctacaaactgaggaaagctggcagctctggaaactggaagaggcaagggacagattctctgctggagccttccaaaggagccaaccctctgacaccttgctttcagccttgaaagacacattttggacttctgaccaccaggactgtaagagaatagatttgtgttgtttgaagccactgagtttgtggtaattgctataggagtcataggaaactaacatatatgctgaacaattgcatggtcgcatgattgcaatgtagagtgttttgaggaaggaaattaaggcagctggggagctgatgacaggtgtcctggaggaggaggtttcctgtggagagctgagggctttgaaggaggccacccatggtggtggattggggacgtggcagtttcaaagcatacaccatgtgaaggaaggaccctgcagaagtcccaaatcaatgttttcttgcttatccctggtggatgatggaggctggtggcaggggcattaatgtgtggccatggtggtctgtgtgatacggtgaaaatgcaaaggagatgaactcccaagacttttgggagacatttataggaagatgggtgctaaataaatccaaggcagtcttttcagacagagggcttgataccactaattaggcagcttggatgagtggcaccatggaactggctggtggttttcttgtgaaaatagacacaaactcccttctctccatgttcttagaagatgtgaatttagaggtctccacattgcctgacaaagtctgttttaactgggtaaaataaaaaaaaaattaccattgtattgctcctgaaccttgcttaaaattccctttaaagatctacaaagggttttgctcatttgtacaatcttaaaggtcacaaaattagaagcttagcagccacatgccaactgcacacagcatttgaaatctttgacacagaccgttccagaagtcacaactggcaaagctgcacttcttgtgacactcagtagcctgcacacccatctcctggcttgtaagcatatgcctttttgtccagccagctgaggtacttggttcctgattgttttcttgtttgttttttaatgctcagatattctcatgtggtgaatatttgtgagccaaattacttggcaggagcgtttgatgccatggccaaatggggagcccagagtcagcatctttttaaagctaactcttacttgccagctcctctttctgcccacatactcgccccgtaccaggcccagtggctgttgcacagacaaacaccaagcagtcctgcaaaccccatttgcttccttctgggcttgatgctgcctgggagtgggcttctccctgggtggtatgtaggagttttccttacattttcatttcttatcagcttaccatttgcaactgatgcaggacaggcaagaccccaaactggggcttagcccaggaggattcttggctttgcccaggagagaattcaagcacaagtggtggtgttagacagcaacttttattgaggcagcagcagctgtactgctccctgtggagcagggctaccccacaggcagtgtgcccagagtagcagctcagggacagttcagcagtcatatttgtacccacttttaattacatgcaagttaaaaggcagttgatgcaggcatttctaggaaaaaggtggtaacttccgggtcattgggttactgccatagaaaggggtggtaactctcaggtgttgccacggcgatggtaaactgacatggcacactggtgggcatgtcttatggaaagctacttctgccctggccctgtttcagctagctctcaatttggtccagtgtctgagcccagcctctggagttgagtcccgccccctacctcactatcttggttctatttggagatgccctgaaaggctgtgtccagtcccacagtgagtgaggaatctatgctgaggttcctttggaggtgaattttgaatgacgtataacccagtacagaggaaaagtccagaactgagggatgcaggctaatattaaagactcatagttttgggggctgtctgtccaaaggctcatgcatgggcagaaagagttcacctgacctgtgctgtgggaagtttgctgtaaacattctgataaacatttaactttagtccctttcagtaccagtgccatgccctgcagtgttcactaagcgcccacaggcatctgctctctgtgacctgctcatatgacgagctaaagtcgagcatgcttcattcacagccaggcctcctccttctttgttggcctgagtgtgttgctgaccattcatgggtcagccccgacctggacatcaacactcctgagaaatgtggcaactgcaataattgactgaaatcagtctctccctgtttgctggtccatgttcttgtctagagagttgttttcttctccaagaataagaaggtggaatcgatttttccaccttttgttcccctcaccccagtgatgatgaggcaccaggagggaattttctgactttctgcaggcatttatgttctgcttcacatcatcatatttattcctttaatgtaggagaaccttaaatgaagcttgttggaaataggccatcctccataacctgggtttgttggagcccatgtatagaaatgatttcttggcaactctagttctcttgagcatgtgtgctatggttaaagaggcagaagggcacaagaattttagcaccctgaggactgaaaaccttccatagaaccagcatacatattgttttataaataaggagtattcttggggtatagttgtttgcaaagaaagggagctccttaagatttatgacccagctcacaataaccagatgacctgaatcaagggtgtatgtcaggaacaggatcctggaggggtcaatgacagtgtccatctgtggcctcaaagagcccgttcccaactctcctgccttttgacagaaggtctgtctggttatggctttaggaagatagatgacttctgtatagtcacaggaagagtctgcgtgcctggagctgtgggctggaaaggaggtgagagatgctggcctctccaaggcctcgtccacgtgccccatctccagacaggagcagccagggctccgttaggctgcaaacaatggaaaacctgaatagcagaggcttaaaaaacatgtggtttgcttgtctcacctgaaagaagtctgaaattgggaagtccagggctgggtcagaggttcagagatgctggggttgaggcctagatggctttttggccttttccccaggaaaaaacagaatcaatcagaaggtggctgatgtaggtcaggtgggctggggctggaggggatggtaggctgtgagtctggcgctccctcttgctggtgtggggatgggtaccaggagggcttctctcctccaccttgctctgttgctctgttgctctgttgcccaggcacccattgccaagaagccagactggaattcccaatgggatggggcagtcccaaggcacatggaatctttggtgggacttatacaccctgtactcctgtgagctcctcagtcactctggtcaaaaactctaatattgttccttttaacacagtcatcacccaaaaccctgttaaacacccaaatgcacctggggcaacccttgaccttatggagcccactttctttgcaaacaacacagatgttgagatgaagcaggaaggagtggttacataggaggatccagaatccccaaccccagggagttcgatatgggaaaaatgcctctgagtagggcggagggatgctcagagggctgcagggtcctgggaagtggctgtgtctcaaagtgtgctccatattcatacccgtctttccccactgcttttatttgcttcgcttttgaatctgtgattcaccttctttggtctcacctcttcctcgggccctttggttaagggcaggctgattactgcatatggctgtgccccagccctctgctttacccagcgattaaggagaagcccacaccaattcaacaaggcttgcattttaggagcagacaaaaatcttagacccagaagccaggtgtgcagaaaatgcatgttggcttccctttagcgttatctaatttcccaggctcaattctgtctgggtaaaggaacattattcttggttagctgaagtcccctgcttttcctgcagatgtgtctgatgctgggggctggcattgctccccttgggggctgggagatgctctcctttctggtctttggttgtcagagcctgctgttcactgctgttgtctcttgttctgactccaccccagctctgcttcaatcctactctctccaggccacagccacccactgggacctcccatgaagctcttgggagctctcacccatcctggagggagcccatgtaaatttgggcctggcttgttgattctgaatcaccaaataggcatttgcgcagcctgcctctccaagggaacttcagggttttgctgccactctggactttgtctgaggctatctttctgcacaaactgcacaaagtggggatgaagcccacttcatgggcacaggcccttcccaggacactgcagcctctccatacccctcccccctactcaggaggcctctgtgctgctgaggccaaagatttgctttgaaaggccaaatattcttcctgagccctggtcttaacccggggctgaagctttgctctcaaaggtaaaggtgaagacctccattttcctctgctctctgcaaattgcctttggctgaagcagggaacaggaaatgaatgaccaagttatgtggcctgggagagggagaagagcccagtcaacagctcaagaaatcccgccatgtctacttaaggggaagaagagagaaaggaggataaagagagattttttttccttttaatataatgcacattaaattttaggttgtttttttttttttctacatttaggtcccttatgtggcagaaaattccaaaatatattagtaaaaatgaacccaccttacatactcttggggtttcgttgaaatgttgagaagttaagaaactttgttagattattttacttaatttttaaaaaatagcctatcaaggagttttcaaaactttttaggtgtataaacaccctatttcggaaaccaccgtattttacactttcacttcccacctacaccagctcagtgacaagaaagtgtctgaaacaaggtgcaaaatcaaggttctcagaaacacgcttgggacgtcttgttccgcagcttggctgctctttccgcccggagtgtccttagcctgtgcccctttcgaactccggcactttgtctgcggagtagctccagcgcagtctcccagcgttacctggcagcctcctccttcctggagcaggagaagcggctctgtctcctgtgttccatcatcgattatggctgctctcacactgggttaggaaggtttggtcacctgagtgcctccctcctctgtgctgttggactctatggtttacatactcctagatgctattttttacatactcctaagttttcaacctgagaaatctgaaaccatcccctaaccttacctggttacctgttgaaaaatgtgttatcccagaggtagattctttgggtcctaggcatctggacttgcaagagtctcatgtcagtttcatgtgcttacaaaggtgataacagagagggacatagctgtgagtttttcccaacggccagtgagtgcttcgttccctgtatcatgttttatttatttatctatccccagggctagtgcagtttggacatagggtgctatgggttgaattacatacttgtcaaatccatatgttgaaatcttaacccctagtacctcagaatgtgacattatttggagagagggtatttatagaggtaattaggggaaaaggaggtctttagggtgggtcctaattcaatatgaccgatgtccttatatagagggaaaatctggacacagagctgtatacatccagggagaacgtcatctggagatgaaagcagagatcagagtgatgcagctccaagacatggaatgctgaagatggtgagcaacccaccagaagccaggagagaggtataaaaggtttctccctcacagcccttagaagccaccaaccctgctgatgccttgatctctgatcctcaaggatgtggagtagctgtgtgagaggctgtctgagggctcttcaaaaagttcataggaaatgcatattatgaaaaaactatgctggatttcaaattttttgcaccaaaattgatttgtactacctttttataacatgttcatgcacaatctagtttgaggcactaagaaggataatacatcagtttgaaaagagcctctatcagagcaatgtgaatttctgctaaaattgaagtaagaacaaacatcaaatttatagtgaagcttgaggggaagtatagtgaactcattgatgctttgtgaaaagcttatggagacaatacccccttcccccaaatcagcagtttacaaatagataacttcttttaagaagggagaagttgaggctgggcacagtggctaatgcctgtaatcccaacactttgggagcctggggcaggtgaatcacttgaggtcgggaattcaagaccagcctggttaacatgtgaaaccccatctctactaaaaatacaaaaaaaaaaaaaaaatagccaggtgtggtgacaggcacctgtaatcccagctactcgggaggctgaggcaggagaatcacttgaacccaggaggcagaggttgcagtgagccgagatcatgccactgcactgcagcctgggtgacagagcaagactctgtctcaaaaaaaaaaaaaaaaagggagaagttgatgttgaagatgaagcctgtggtggcagaccattcatgtcaatttgcaaggaaaaaattaaccatgccctaattgaaaagacctgatgattaacagacatttcagttggttcagtttatgcaattctgactgaaaaattaaagttaagttttccactcaatgggtgtcaaaaccattgcacccagatcagctgcagacaagaacagatctttcaatgaaaattaaacaagtaggatgaagatcctgaaggatttcttcaaataattgtaataggagacgaaacatagctttaccagtacaatcctgaagacaaagcacaatcaaagcaatggataccaagaggtggacattttccagtcaaagcagaagcagaccagtcaggagcacaggtcacagcaagagttttttgggatactccaggcattttgctgttgactgtctgtagagccaaagaatgataacatctgtttattatgagagtgttttgagaaagttagccaaagctttagcagaaaaatgccactgaagaattcagcagagagtccttctccaccctgacaatgcttctgctcattcctctcattaagtaagggcaattttgtgaatttcaatagaaaatcattgggtatccaacttgcagttctgattttgcttcttctgacttctttttgtttcctaattaaaacaaaataattaaaaggcatccattttcttcagttaataatgtaaaaagactgtattgatatggttaaattctcaggaccctcaatattttaagaatggactaaatgggtggtatcatcacttacaaaattgttttgaacttgatggagcttatattgagtaatacagtttataaagttgatatttttcatttttatcttttgattccattttccatgaacttcctaaagtcctcttgtatttctaggagggtcttggattaaaaaaaacaggaggaaggaacaagtgagaaattactctcatagtttatggcgtgtcttaacatcaagttacttttaagtcttttattcttttaggaagatattttctctttcagggaaaattaagaaacatcagggcctgagttatgttggaaaatctctcccctactctgactgtctggctttattctgagctcccaagctataacagtggcacttgggtgggatgagagtggggtggggctcacatctacatggctgaagaccaaggcagaatctcacacccaagtcttgattctttgtgctgcttagctgttgttcacaccacttttcctgcttgtgtccagatctgaatgaaactgatggctgttggagaggcctttgtcatctgactctatctgttcctctgtcaagtaataccatcaatgatgctattcatagaaacatttcatgtttgagaggtgttaggagttgaattgtcttctagaagctgttgaattcctaaccctttatatctgtgaatgtgactttatttggatataggtagggtctttgcagatgatcaaattaagatgaggtcagtagggtgggccttaatccgtattactactggtcattctaaaaagggaaaatgccgatacagacagatgcattcaggagaattctgtgtgaaaatgaaggtggagatcagtgtgatgcatctccacaccaaggaacactaaaggtcaccagcaaaccaccagaagtgagatgcgaggcattgaataggttttcctcgcagcttcggaaggaaccaaccctgttggcactttgttcctggacttccagcctgcaggtggttgtgtaagcatttctgtggtcgaagccacctggtttgcagtactttgttagggcagccctagcagactaacacaagaggtcattgaaagtgtcatatccagaacagtgtgccttttgggggaggaaagtccagttggccctttcacatacacgaacatctcacatttaaagacacaattccaggctgtctgtggacactcataggtgcccgtgaaagccgcctcagccataaacttcttggagtcacattgtgaagtatttatttttaattacagattttctttgatgatcctcttctcttctctttttgtttccttggcttgtcactcattcgttgtggtaaatagactgcctgctgtttacgatgagaagtagcctgtgctttggtctggtctcctgacgcccggttgccagcagtccttgctgtctctgggttggaagccgtgatgcctgctcatgggctcgctgtctcctcaggcatgaaagtggaggcatccttctggctctattttcaacttaccttggtgaggccacaagaccctattgacacatgaaggggaagcacagagggaaagggggttttacttttcctcttcaacagggctagccctcggggactgagcagagagagttgtgaatgctgggttttgaaactggccccaaacgattgtctcctggaatcagagaaggaacaaccgactgcacctaaaagaaacagagtgtttaccagtcttgctggatggctttaaaaacgcaaatacatacgcattctcattagcccatagcactcagccatcttcacccccattagagaaagccagtctgctgcctgcccccctcaagtcactgctgaactcatagcatgtgtcgggcttctggaacctcacagatgtattgccgcagacaccctttagatgagaggtgtaggttaggggcacaggcaagggagcggtcactcctagacctgaagcatctcttccatagacgtcacagtatatatcttcccagccagctcctccccagcccttcagggaaggtgaacacaattccacactagagtggcttttaaagaaaaataacatgtatgaactcttcccagaattctatgaaatgaatgagtttgcattactttttctagcttatgacctgagtcttttattttttcagatacatttagttgtgtctttcaaaatctatttttgcagaacctaccctttgttagcattgggctggaaccccggaaggataattatgtgtgggacttggtagctgcccttaggtgtacaatcccataaaggagagatgccatatgcagaatgatgaaatgcagcatgaggctaagtgtccagcatgggttatggagggtagatgagagagaggttggtgcccagaagacagccgtcctgcctcgggcctatatgtctgcagaggcccacaggagtggggcagtcctgttcagggagggctgaggggttctccgaatcttatcaggtaggacagggagactttagaaaggattgggcattcagtttgtgggtgtgttataagcaaagtctggagcagctgtgagttggatttcactgggtttcatggagcagatgtctcttgctggggaatgatgggatgtaagactagagacagacacagtcagaggcgatgtctgccttgaggcagacaaacagatttcaacttggtcttctgggcctaggcagtgagaagcctggaaggtgtctgagcttggagatgacctcatagagccaactttttggaagattggttgggtggcagagtacactgtatgaaggcacaggagagagaaaggacaaatgcacaaaggaaggatccagaattccagggcaggctggacatgtgggcctgaaggaaggggaggggtgaagggagacctgaccatggcttctgcctgcttgaccaagcttggcatgtacattagaatatacagagtttgaggcctgaggacccttgttctttttcaataagtaatggtattttaaaaaccatctctgggttttatcatgagcagaggcgaattccatgcacagtgaggactgttttatttatttatacttgttgaatagtaaacagcattgaagaatgtttttaaagaaacccaaacttccttttccatttctcagtattaactttctttttagcaactagggacacaattgaatgctattgtcttaaacctgcctgacagagcagaggtacacgctggggggcgtgggaacctctatttggcaaagggaacttctcctgttattcccatatggaaagagacataaatttggggagagcttgctccttccctacatttctgtgatccatggttaacagtctcctcaagtgaatttcaaattctctttccaataagctgcaaaagtacttaaatcatttatttgttctgctcctgaaatgagagttactcactaaagtcccaaagtgtcccgaaccatgaggtgtccacagtgaaatgacatgtttaaaagttgccataaatgctggtaactggacatgataataaatctgagtcatttcacatggccagttgggtcggtaataacaagacatgcacttaaaatatatatctttttgcctttcgggctataaagattaataaattgtgtaaatttccaagataaagtgtgagacattctgaattttatgtgaatgacttgcatggtgacagtaaccatgttctggcccttggaacaggaggtaatttactgttgatggtttcttggcataatatatatacgtatttggggggtaataatttaaaatcatccagcacatggtctctgataaggtgcataactcaggtactcagagttgttttataggaaaagagatacaggcacaccgtgcgactgcaatcccggcacgttctccttcctcaggaatgacaagggatggaaacctggctccccacggggaataataaagcatgcctgtgaaaaatgaatcctggacctgagctcagggccagagtgctccaaaatttggggctttcccaggacttagtccagatttgcttctgtccaggccagtgaccgcttgaagctgtagagggcaggggagggagggtccccttcctgaaagggaagtgctgtgagacgtggctgtcactgataccagtggggacctctctgcccccagcctctaatcatgcttgaaggtttactctctgagcatggcttgagaagacaagggaaagcaatggagattggccatcacagccaaattctgcctgatatggaggcctgagtccttttgtgcaggtggtgactcactgccctgttgaatgggaggaaggaacagtgatcagacccaaacactctggttttcttcccacctgtttctcagaagtaataagtgcagggctcatgctctgcctgtgtgtgtgtgtgtgtgtgtgtgtgtgtgtctctgtgtgtcctgtgtgtgtgtctctgtgtgtgtgtgtgcctgtgcgtgtatgtctctttgtgtgtctatgtgtgtgcgtgtgtgcctctgtgtgtctctgtgtgtgtctctctgtgtctctttctctgtgtgtgttgtctctgtgtgcacgtgcatacatgtatgtccctctgtgtgcctatgtgtgtgcatgtgtgcctctgtgtgtttctgtatgtgtgtgttgcagaggagctgctaatgtgttctcatgctggttgtactgccccgccttggaacaactttatccttgggtgcaggggctgggtgagcctggaagctgccagatgcagcacatgatggaggagaagggcctggaaacttttgcagttgtcactcaacaaacactcatgcagctcctcctgtgtgccaggccaggtgccaggagctggagggaatacagagagtgagcctgccgctttgggatctcatctcctggaggaggaataagttatctacttaggtattcaattttaactggtatttaattacagccatacaagtggttccattattagtcaagctgaactaagttttgctgcaataacaaattttcccagaatctcagtagcttaacggagcaaaggttggttgcttgtgaatgctgtctgtcctacaaggtggtgctctgctctgtacagtcactcaggattcaaggctgacaggctaccttcttctttaggctgtgcattctggaacatggggtttctttagcctctgtagtggggaagagagacaagagactcactcacaagcttctctatcatactaccttatgatggaggtggtgttattagcctttttacatctgaggaaactgaggcacagaggagttaagtaacatgtccaaagtttcacagcaagtgagtagcagaaccaggattgtgagctccagccatctggctccagaatccctgttcttgtcatgctctgccatctaattaaacagtttcttgggaagggaatgaagagatgtcagacaggccaggagctcaggggactagaaaaagaatttatcagaagaaggaaagtatgtcggggaatgacagggaaggataaatgagcaaggctagaatcccagaaaaatagagagacttcatcttggctggcagaatagcttttgcaaattcgggattagaagcctggtttcatgagtttgggacgaaagctacagaaaatgcagacacagggtggatcttacggattgtgaagtcagggaggtctgaaatgaaatagaaatggcccaaggaaacctttcatattcctttttgtttccacatacatctggccacaaaagctctttggtggtttatcccatctcactgcttccttagggctctttcaaactccttgcatctatgtaagcatggataaggagcacagcagacatgggacacacctgtgttgctttctgggcatgctgtaggatgccactttttggctgtgcacctggagcaagaggcagcagggcagcagcacccagccccctgcagttgaagctaaagactgcagctgcagcgcaggaattccccagtaggacaggaaagcaaacacaggcaagataaggtcagagacagccaactgtttacagcgtccaagctcttcctgggtttggtccaccctattaaaagataataacctcttaaaacatttcaaaggatgtgttggcagtgtttaagaggaaacataattgtcaccacagcctgggtagtgtgcaattgagtaggagaccatcttcaggataggatgggtgatgggcaagattgtgctgggagaggagttcgtttgaactgcagactccagaagctacagtggctgcccaacccatgaaaacacccacagatgctgtaactgctgggtatctgtcatctttggaataaaccactcatgctggggtctcactttctaagccattaccagctgcaagggttggctttgtgaaggcaaagggaagtttactttataacgatgtaggctatgtggagatatagaattataggagcacaaagtgcattactgactcactgttctgctgcccatagagcagctcatcctgctttgtgaggcattgctgtgagttgccttcaggcaacttgggaggaagagctgcctgaaaccctttcttgaatcttctttaaggttgctgatcaggacccatctaccatgggaggactgtggggattcctccatgacctcagtgctgagctgatctggctcattaagagatggttcttacgaccgggttcggtggctcacgcctgtaatcccagcactttgggaggctgaggtgggcagatcacctaaggctgggagtttgagaccagcctgaccaacatggagaaaccctgtctctaccaaaaaaatacaaaattagctgggcgtggtggcacatgcctgtaatcccagctactcgggaggctgaggcaggagaatcacttgaacctgggaagtggaggctgtggtgagccgagattgcgccattgcactccagcctgggcaacaagagcgaaactccatctcaaaaaaaaaaaaaaaaagaaaaaaaaaaaaagaaaaaaaaaagaaagaaagatgcttcttacaaagaactctttctttgcatctcatggataatctgaattgtacatctcactgaactaccttctttgccatggctgctggggtgcccagagcaagtgaccatggcatgcatgctgtcacctaagtggctttctcttatttttcttttccttctctgttatttattctgttgtattgtttatattttgataaactcacttaaattcattttgggacaagatgggatctaaaccaagaagtagataaatatgtgtgctttagagggtagttattgcagagtctatcctgggaagagtggctcctttgttcaggatgcctttctgggtatgaggggtgggttcaattccttccatccctttctagaagtatgtagtctttgatggattcattgagtcactgatttgttctgtggacacttattatgtgccaggccctgtgctaggcctgaggaaagtgacgatgacctcagagttatgttccagtggtgggagataggcaaagactatgtaagtgggcagagacactaattacatgtaagaaccactgccttgaagggagaatgaggatgagggtgtgtcttaggtgggctgccatagcaaaataccatctactgggaggctaaaacaacagacactgatttcacatgctcttggtggctggaggtcagagatcaaggtgtcagcaagttttattctgaagcctcttcttttagcttgtaggcagccacatctcactgtatgctcacatgacctcttctcagtgtttgagcagatagagagagagagagtgctttgatatctcttcttacaaggatgttaatcttattggaccccatccttatgacctcatttgaccttaattatctccacgaaggcttcatctccaaatcacatcacactgaggcttggggcttcaacatatgcattttggggtgggcacagacattcagtcatgacagagagggagaagatctacttcctatggggtgacgcaggaagcccactctgcagagggcaacatgcatgctggaatggaaaggataagaatgaggtggctgtgggagaggagggtggggaggcatgtgagggcgcgaggtggagagaacagccagggcagaggccctgaggctccctgagcagctggtgtggtcgcagcttactcaggagtggagagtagcacaggggaggatgtgagatgagtggggcacgagtgtgcagagccttgtaaaccagctatggtgagggttttgggtttcctactacatccagtgcaacgttactgaaagattgtaagcagagggatgtcatgatctggcttaggcttaaggagctgtgtggacagtgggctggagggattgggaatggaggcaggagactgcttgtcagttttggtaagaggctgggaccatggtgatggccacgttctagaagagagagtggaatctgttgatggaggaaatgtgagagacagggagagggagcacttaagggcaactcctaggctctaggcagaacatttaggtgcatggcgatgctgtttactgagctgaggggatgcggaagggagcagaggcaacgtgtatgtaatgggtaattgcatgtgtcaatttgactgggctaagggatgcccagatagctggtaaacattgctttggggtgtgtctgtgaaggcatttccagaagagactagcatgtgaatcagtagactgagtaaagaagattaccctcaccagtgtgggtgggcattatccaactgagggcctgaatagaacaaaacggcagagacagggcaaattcactctccctgcttgattgcacatcttctcctgccctcggacattggtgctcctggttctctggcctttgggctcagacaaggtgatatggtttggctgtgtccccacccaaatctcatcttgaattatggctcccaagatccccatgtgtcatgggagggacacagtggcaggtaattaaatcatgggggctggttttcccatgctgttctagtgatagtgagtaagtcccacgagatttgatagttttataaaaggcagttccgctgcacatgctctcttgcccgccactgtgtaagacatgcctttcctcctcctttgccttcctccatgactgtgaggcctcctcagccatgtggagctgtgagtccattaaacctctttttctttataagttacccagtctcaggtatttcttcatagcagtatgaaaatggactaacacaacagggcttatacatcacctcccctttagacttgaactgagttacatcagttcactgtctgcaagctggaggttttcctgggcctccagcttgcagacagaagattatggaacttctcagcctgggtaattgggtgaatgaagtcccataataaatctcttatatttctctacatgtcctgttgtttctgtttctctggagaaccctgactaatgtagtatgtaaggcacccagtcataagggcaggctatccttccattaatgacctcattccgggtgtatctgtagcctagaccactcttctaggaaaatcctattcccttcttgtctcttccatgtggaaatctcacagacattgcaacccaacccatccaaatcagatgggaaccaggggtttaatgttaacaggtgatatctgctgctgccggtctgccattgtcctaaagcattttatacacattttcttatcttagaaagtccctgtaagataggtgtgctaacaagaatcattttgcagctgaagaaatggaggtgctactggctcaaggaacctggattcatttagagagtgtgcccaggatgagacgtgtggagagcctggcctgaaccaacactaacagtctcctggacaggaggtgagtaaggaagaagcggcagggaaggagggacaccgggtgaaaggaggtgggtgtaggaggaaggagatcacaactgtgttgaaagtcctagcagcctgagaaagacgggggaagaaggccctgcaatgaaccctgtgaccttgggaaggacaagtcctcttgcccctggggcccactgtctgagtccctaggaagtatatatacaaagggtttcggaatgcagagtttgcagatgtgggctgcagctgcaccctgtgtgtgactggatggaattcacagctagaagtggttttgtccctggctgctgaatgtatcagctgttggtgccgctttagttttattgagtgggaaggatgtagaccctgagtctggagaatgggactgggctggccatggagcctggagaagagaatgagaccatgcaaaacctttattccttgttcttggtttcttgttaaacaggcccagtgccaccagattaaggaggtgagggggcggttgtaagaaagtaagagatcagtctgaagattataaatatgggccagtgcaacaaagggaaattcttgtgtcaatatttttctgagccagcacttgggagatcctgatttccttaacaaaatgataacaaacattttttcatgttaataatgtaagatgaacatttccttcatgtttaagccactgaatgtgcagtgaacaaaagacatttacatacaggcatatttgaggatatggaaggttcaattccacaccactgcaataaagcaaatatcaccatagagcaatttatacaatttctttggttttccagtgcatgtaaaagttatgtacattatactgtagtctattaagtgtgcaataaccactccttatctgtctaagaaacatacataccttaattaaaagataccttattgctaaaagatgctaaaggtcatctgagcctttagtgagtaataatctttttgcttgaaggagagtcctgcctccgtgttaatggctgctgactgaccacggtggcggttactgaagcttggggtggctgtggcaatttcttaaaatgagacaacaatgaagtttgacacatcagttgacttttactgtcaggaaagatttatttgtagcatgcaatgctgtttgggatagcattttacctacagtagaacttctctcaaaaaaatggaatcaagcctctcaaaccctgctgctgctttatcaactaaatttatggaatattctaaatccttttttgtcatttcaacgatgttcacagcatcttcaccaggaggaaattccatcttaagaaaccactttctttgctcactcataagaggctactcctcgtctgttcaagttttaatatgagattgcagcaattcagtcacatcttcaggctccacttctcattctagttctcttgctatttccaacacatctgcagttactacctccaccaaagtcacaaaccccgcaaagccacctatgaaggttggaatcgatttcttccaatcttatgttaatgttgatactttgacctcctcccatgaatcaatgtttttaatgacatatagcatggtgaatcctttccagaaggttttcaattgactttgcccacatccattagaggaatcactatttttggcgctataaccttacaaaatgtattttttaaataataaaactgggaagtcaaaattatgccttgattcatgggctgcagaatggatgttttattagcaggcataaaaacaacattcatctccttgtacatctccctcagagctgatgggtgaccaggcatattatcagtgatgagtgctattttgaaaggaatcttttcttctgagcaacaggtctcaacagtgggcttaaaatattccacaaaccatgctgtaaatagatgctatcatccaggctttgttattccatttttagaacacagccagagtatgtaactcatttatttatttatttaatttatttattttattatactttaagttttagggtacatgtgcacaatgtgcaggttagttacatatgtatacatgtgccatgttggtgtgctgcacccattaactgatcatttaacattaggtatatctcctaatgctatccctcccccctccccccaccccacaacaggccccggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcatccttttttatggctgcatagtattccatggtgtatatgtgccacattttcttaatcccgtctattattgttggacatttgggttggttccaagtctttgctattgtgaacagtgccacaataaacatacgtgtgcatgtatctttatagcagcatgatttataatcctttgggtatatacccagtaatgggatggctgggtcaaatggtatttctagttctagttccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcgtgtgtcttttggctgcataaatgtcttcttttgagaagtgtctgttcatatccttcgcccactttttgatggggttgtttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtcctttcccatgcctatgccctgaatggtattgcctaggttttcttctagggtttttatggtttcaggtctaacatttaagtctttaatccatcttgaattgatttttgtataaggtgtaaggaagggatccagtttcagctttctacatatggctagccagttttcccagcaccatttattaaatagggaatcgtttccccatttcttgttttgtcaggtttgtcaaagatcagatggttgtagatatgcagcattatttctgagggctctgttctgttccattggtctatatctctgttttggtaccagtaccatgctgttttggttactgtagccttgtagtataatgtgaagtcaggtagcgtgatgcctccggctttgttcttttggcttaggattgacttggcaatgtgggctcttttttggttccatatgaactttaaagtagttttttccaattctgtgaagaaagtcattggcagcttgatggggatggcattgaatctataaattaccttgggcagtatggccattttcatgatattgattcttcctacccatgagcatggagtgttcttccatttgtttgtatcctcttttatttcactgagcagtggtttgtagttctccttgaagaggtccttcatatcccttgtaagttggattcctaggtattttattctctttgaagcaattgtgaatgggagttcactcatgatttggctctctgtttgtataagaatgcttgtgatttttgcacattgattttgtatcctgagactttgctgaagttgcctatcagcttaaggagattttgggctgagacgatggggttttctagatatacaatcatgtcatctgcacacagggacaatttgacttccacttttcctaattgaataccctttatttccttgtcctgcctgatttccctggccagaacttccaacactatgttgaataggagtggtgagagagggcatccctgtcttgtgccagttttcaaaggaaatgcttccagtttttgcccattcagtacgatattggctgtgggtttgccatagatagctgttattattttgagatacgtcccatcaatacctaatttactgagagtttttagcatgaagggttgttgaattttgtcaaaggccttttctgcatctattgagataatcatgtggtttttgtcgttggttctgtttatatgctggattacatttattgatttgtgtatgttgaaccagccttgcatcccagggatgaagcccacttgatcatggtggataagctttttgatgtgccgctggatttagtttgtcagtattttattgaggaattttgcatcgatgttcatcagggatattggtctaaaattctctttttgttgtgtctctgccaggctttggtatgctggcctcatagaatgagttagggaggattccctctttttctgttgattggaatagtttcagaaggaatggtaccagctcctccttgtacctctggtagaattcggctgtgaatccatctggtcctggactttttttggttggtaagctattattgcctcaatttcagagcctgttattggtctattcagagattcaacttcttcctggtttagtcttgggagggtgtatgtgttgaggaatttatccatttcttccagattttctagtttatttgcatagaggtgtacagtgcaatcaaactagacctcaggattaagaaactcactcaaaaccgctcaactacacggaaacggaacaacctgctcctgaatgactactgggtacataacgaaatgaaggcagaagaaataaagatgttctttgaaaccaatgagaccaaagacacaacataccagaatctctgggacacattcaaagcagtgtgtagagggaaatttatagcactaaatgcccacaagagaaagcaggaaagatctaaaattgacaccctaacttcacaattaaaagaactagagaagcaagagcaaacacattcaaaagctagcagaaagcaagaaataactaagatcagagcagaactgaagtaaatagagacacaaaaatcccttcaaaaaatcaatgaatccaggagctggttttttgaaaagatcaacaaaattgatagactgctagcaaggctaataaagaagaacagagagaagaatcaaatagacacaataaaaaatgataaaggggatatcaccaccgatcccacagaaatacaaactaccatcagagaatacaataaacagagtatgtaattcttaaaagccctaggagttttggaatgagcgttggcttcaatttaaagtcaccaggtgcattcgccctaataaaagagtcagcttgtcctttggaaacaggcattgacttctcctctccagctatgaaagtcctagatggcatcttcttccaatagaaggctgttttgcttgcattgaaaatctgttgtttagtgtggtcaccttcatcaatgatcttagcaagatcttctggataacttgctgcagcttctatgtcatcacttgctgcttcaccttttttttaattttttttttgacgtttcactcttgttgcctaggctggagtgcaatgctgtgatctcagctcactgcaacctctgcctcccaggttcaagcaattctcctgtctcagccttctaagtagctgggatcataggcgtccaccactacttctggctaatttttggtattttcagtagagacggggtttcaccatgcctggtggccaggctggtttcaaactcctgacctcaggtgatctgcccgcctcggcctcccaaagcgctggaattacaggcatgagccaccacaccaggcccaccttgcatttttatgtgatggggacagctttttttccataagcctcatgaaccatcctctgctagcttcaaccttttcttctgcagcttcttcacctctttcagccttcattgtattgaagagagttagtgtcttgctctggattaggatttggcttaaggcagcatggctggtttgatcttctatccagaccacttacgctttctccatatcagcgataagcctatttcactttcctgttcatgtgttcactggaggagcacttttaactactttcaagaacttttcctttgcattcacaagttggctgtttggtgcaataggcctagctttcagcctgtcttggcttttgacatgccttctactaagcttgatcattttcagcttttgatttaaagtgacagatgtgtgactcctttcacttgaacacttagaggccattgtagggttattatggacctaattttaatattgttgtgtctcaaagaacagtgaggcttgagaagagggagagagatgggagaacagctggtcagtggagcagtcagaacatacgaaacctttatcaattaaatttgccatcttatatgggcatggtaccccaaacagttataatagtaacatcaaagatcaccgatcatatgtcatatgtcaccatacagacataacgatgaaaaagttgaaaatattgtgagaattaccaaaatttaacagagacaggaagcgagcacatgctcttgatacaattgcttgacacagggttatcacaaactttcaatttgtaaaaaatgcaatgtctgggaagtgcgataaaatgaggtatgcctttactgactttaattttagtaaatgacttcataaggaaaaggaaaaaatgtcattgtgagggcactgtgtttgttatagactagctaggtcatcaactgggtggttttgatactagcagagtcctccatgtgctaggacactgtttgaaattcttgttatagctttaaaagtcatggttttatcaactaactccctattagttactgtaattgaatttttatgttagcttccactagtagcaagtttttgagtcaagatggcccttgggttttattgccaaccctgacagcagaatcctagacagggtcgctttgctcttaaagcctctgatgtccagttgcaaagtgagtataattgcttctctctcagatctgtgttgaggagctcaagaaataacgaatgtggaagcactcagatcaattactttttttgtttgtttctaccttatctagtttcctaggtcaaaagtttgcttggctaatggaagaaaggagtcccaacctttccaagtgggacagattccctagctgtgctctgtatattgaatctgcttcttatcatttggctgtggtctgtgtgagtgctgaaaaggaggagataatttcacgcactagggaaatggaaaagactcctgcttggcaggcaccagggtggcaagagaatccaggatgtggccacgcacagcttaaagactacatttcccagctgcctttgcaggtgaatgccatcagtgagacctaattgagagtatagtctggggagtctgggaatgttgcctaagaaaggctgatttagttggtggtgcaactccctttttacctcccctctttctctctttctggaatgtggatatgatggcagaaccacagatgatcttgaatgaggaggtcacttgctgaggatggtgcaacagaaagatggaaggagctcaatccctgatgagcttgtggacctactgtatcagtcctggattactcactttctgtcttttatggagagaataaaccatcctctttttaagttgctcttccccctttgtttgtgatccctcttaccatagaccaaacttaattcctaatgaatagatctgccaaattgtttatatcagagatgacaacaggaacacatctgtttacattttcctttctcctgaagccccacctagtcccagagggtggtgtgtttcttcactgctattttgggcagaagctacccggctgtggtggttaaagtcagcactgctgttagcccttgtggggcctttgtgcaaattgaaaaaaggcattcatatcctaagacaccttcctgttctttgccagaaaaatgtctcaatgcaaattgacaatgtgtggacaggaatggaacatgcccttgagaagcagcccctgcacaggatgccactgctcagctttgggtcaatgtccaggccagtatctgacctcgaacttctctctaggtcttccacctttacttagcacaggcctcagaacagtccagccaggggtctaggagagaaagtggctgagactgtgtgagatggggatggggcagaggacggatagggtagagggtggattacagtgagtttctggctattgactgctttcacatgagcagctcatttctgtgccaaccatttgactagtaagttggcagaagccctgcctgttggtcacattctggcccatgctacaaggccacctggcaggctcaggctgcagcacggcaggctgtgtgcacacggctatctcccctagtctgtccccagagctgtctgtgcagtcctgagctcccatgtaagccaatgctacttttgtgtgaagaaggtggacgaaatcatcagcaactcttgcttatatagaatgtgacccaagcaatggaaagagaaaatccaggtcttggttttgtactggcttgcgagaagtccttcttttcctctctagcaatttccctacatccatccctgcctacccacattggattaaagggaagagagaaaaatgccctaagccccagagagaaaggtggcagaaccatgatattgctgctcttgactttgtaagatggccaacatcagcccagagaaatctgatctgaaatagaatgagctcacctgacttcgaaatttaccacatttgtcatgaggcagtcacttaacctaaaaagtaaacaggctcttactctgtcatagtttacatttgtgtgtgtgtgtccttttctgttttctttctttctttctctttctttctttcttttctttctttcttctttctttctttttagtagctttaacttgttctgcaaacaaagaatatgacagaacaatgtacgttcctttgaaatggcaccattaatcttgatagcaagtttctaattatgaaggatagagagctttggctgcttcatggaactgtgtcctggtgacttttttcagtccctttttcttgctttccctgtctccggtagcttccttgagagctgtggtttctcagtgttagatattcaaaagcacagcagcctacaggccatggctaaatcttctttacaaccagatgcatatgagatcttagcaggaagtaagaaaagtaaacgcattattaataaacacacttaaatgcatacaataaaatgaatgctgtttccttcaaagtaaccctcctttgcagatatagtctaaccaagcctctattgccctgcccagcatggatctgaaactctcctccgtaaattctctagaactctaggaccgccccttctaaatgcccaaaagaatcccaactgactgagggcaaagatgcaccttatttctggctccctttcgcttcaccacttgacttcaaatgacttcaggctgattccagaaagctaatacaccctcaaaggacaatgcaccttcatttagctcactcaggagagaggccacagtcttgaggggaggcactctccaaggcacagctcaaaaattgtttcaagcaatggaatcttcacgtgaatgggcacatggcctcccacagcaaggatgctcgttaatggggaagaatcactgaaaatccgaattcagatgtgtttcagaaagcagcttcaaagtgtgtgactgatcttcctagtcctgggaagagcagaattggcccttagaaccgttaagagtcagattgtgaaacagagagttcttgttccccatatgtttcactctaaatggaacatgaatcagagctgggagaggagcttccaacttctgtcaataataaaagccttcttatgagtcaagtgctttgtaaatactttgattggtagaggaaaaaggaattgcatattgaaagaactgtatttccattaaaatgcatgtgtgtaaagtaaagaagggcaggaaacattgagcccaagactttctgagtttgagtgaaccaacctgctggagtggtttctggccatcactttgtgctgccatgtctcagcctgtgctaagtccagaggatctggggttccgatatttgcaagaaaaagcaaggacaacaggtttgaagtcaagcaatgggagggtctcccagagacctggagcagggaggatgagtgccttagctgcttctgtctatccatcttccatctgtctggcaatcaggatattttctggggcccattcaatgcttctctgttggctgggggctcccatcagctgccaggggttccacctgttttcagtggtccatgtgcagtactcagagaaatgcctcctgagggaatgagtccagcgggtgagcgccttttaagaaatgcggtggctcacacctgtaatccagcactttgggaggccaaggcaggcagatcaccagaggtcaggagtttcaaaccagcctggtcaacatggtgaaaccccatctctactaaaaatacaaaaaatagctgggtgtggtggtgggcacctgtaatcccagctaatcaggaggctgaggtaggagaatcgcttgaacctgggaggcggaggctgcagtgacccaagattgtgccactgcacttcagcctgggcgacagagcgagactccatttcaaaaaacaaggagtatgaaaatgctttccagctctttgcagtagggcctgtctcatggggtgcagcctggaacttgcgcaggcccctacacagaaggacctgtgcttggcccaatgctctgctcctgctgtcttgtcatacttaatactttttttagcaagaggccctgaatgccatttgcattaggcaaattctatagctgatcctgatgaggctcttctgtatggggacctgcacaactgcaggactgcaccctatgacgcaggccctattgcaaatggctggaaagcgtttttgtatttcttaaagggtgttcactccctggattcagtcgcccccaaaataacgtcttgggtgtcttatttaggtggcacctgcttggtctgaaagagctcatgtgacttcaggaaatactgaatttgttctgagaaagcctcttgccctaaaaaaaagtgtatggggggagtgctcctagtctgtcatagttaaagttcaaaggttatttacagtgtgttgcatccactgtggtgactcctggcagatcctgaacttaagcagacgtgtgttacagatcttaatgagtgtgttgatgccgatgggagttgccctggatcacaccaagtgggtgatgggtgggtgagaggagagacattctttttgttaacccctcatttccacggtcagtctcagatggtcattacaaacctcttctaaatctggacctcaacaagcccccctcacaccagggacaaagtaagggtcatgcgatggcctctgagctgaccttcgagttcagagtggccgtgtgctggtgctgtgatcattaaactgactgctttgcaaggtcagcactcaaggctatagatttatatctctcttttattctaaaactagactatgccacaaccaggtgactgtggtgcctcactcaggtggtctgtcttctgcagttgaaggcaggtctttttcctccatccattcagattgaatccagggggtcctccctggaagacctgtgttccacagaagactcccctggagcttctcctctctgcacctcagctttcttgtgggtgcagcaggccacccaggcccagtccctgctcacgacaatgacttcagctttccagggtctttctcatgcattcccaaccattagactccccagtcctctctctattttttccccttatttagtaaatatttattgaagatccattacttgcacaaaagacagcaggccgcagggaaaggggtttatagtgggagatacgatgaaaagatgattaagattgcaagttctcaaaagtttagatgttgaagtattattttccaaagtgagttacacagggtattaatgggtaccgctcaaagaaagggttctagagtgaatatgaaacattggcttaaacaaagttaaacattttaaattactgcacagcttctcaaaagttttaatatgctaatgtgtcatctaacttcccaaaaggagaaacataatatattggacttcttaaaagtatttatgacattttttcttgcattgaactagtcccagatagaagacttagccttaaagggcaaaataaaaagatgagttctttttctttttaactgacaaataaaaattgtatacatttatggcttataatatgatgttttgcaatatgtatactttgtaggatggctaaactgagctactaacatgtgcatcacctcctatttttttgtgtggtgagaacacttaaaatctactctcagtgattctcaaaatacaatacattattaactatagtcagcatgttgtacaatagatctcttgaatttattcctcctgtctaactgaacttctgtatcctttcaccaatatctccccaaccttccccatacccctgactccagcgcctgctatcaccactctacgttctacttctgagtttgactttttataatagattccacatatgaatgagatcatgcagtatttgtcttccgtgcctggctcatttcacttagcataatgtcttcaaatgtcctcagggtctgcccctctttctgcctctgtgggggctccaagtgggaattcgtggttactgtaattggcagggggcggagatttggagctggaacctctagagtctgagctctaccatggaaaggccgtataatgctcagcaagtcatttaactctttggtgtctctgttttctcattgataaatgcaaagataatagtgcaccttcactgagcttcactgggttagccaggtaaaaagccttatggggcaatgcctggctctggcaggcttgaatgctggccgctggctctggttctcccatgtggaaacaaagcctacgtctcacacccagcagcaggagcagcggggtctcggcccagccagtgtgtcctgagtggcacagggtcagacataaccaggtccatgaacatttgtgtctttgtataaggtcagacttttattgatgcaatttcaatcataaaagccactagctgcatggagttcccaaggaggtgattttctttagtgctacctgtttacttggtagttaaagcctcaggcgcactttacaaatcagtcagtattgcaaacaagacatagtagtacacttaatcaatatacaattgctatagattaaaccttctacatcagtaaacattcataaagtaatatttaacattaagagaaagggggataggataaacgggttaatgaaccagtccaagagggtaacatgaacaaggagaatgtcctggtctgatctggatggacatcaacattttgtaagaaagagactatcgtggcagatgctgggtgctggtcatgagtaacagcaggatggggtctatgaagacggccatctggagctggtgaattcttcctctttttatagcccccgagtcctctggtgaggactgataaagtgaaccttatctgattgggtatagtcactgttgattagacaaacatctggctcctgttggcatgatgtcttttaaaaatgtaagatggagtctttttctaagatggagtcacttaggtcaaaggtcctgtgtccacaggggctgcccacatttcaccacaagttgccatgagactgcccaggaggacccgaatgcctggagtgctccagccatgctcatgccacggcttttgtccctctgcctgtctttggacacctctggtgtggagttggagatgaggaggagaggcttgcattcctatcagcagtgtggaatgagcagaggtgcgggtagactgaagctctgtgtttaacctctgtttacagaatatggacgctgagagagagtctggggtacttaaggaaaggcttgattggattgcagaaaacagtttctgaaacagactatttctgaagactcaaattttaattcttttgaatttatacagcaactcatctcacaaataattattaaatgataataacaataataatgatactcttcctcctcctattatcaccaaatagcatttactgggtgttggcaaaatgctgggcattggtcaggaatgctggacttgtatttccacttgacccttcaaaaatccttgtgatcaataaattactatgttatataattaaaatattaaaattattggaaattttatttaataatagcaataatatattagtgtaaatacttttctgaataatgaaatatacaataatatattatgcacaaacacaaatgtgttaagtaaacacatcagagcttgttgccagccatgatataatgtgtattatcatatgctataccgacatccccatttgacattggaggatatgagctctgggttgctaagtgacatttcccaggttacagctctctggaggaggcagctggactccaggaccccgtgtttcctgagacctccatagcctgcctcccgctttgctgtgctgcttctatgagaagataaagtaatttaatagcagctgtcgatatgcagggccacctctcaagtgcttgaaaatagttctcttaagcgggaaatactttttttttttcccaaaataatttattatgtttcaaaagtatttcctctaattgcagggaatccaaatcaagcgcttgcatttcttataaacaaacacctctgtatactttcccctgaccatggctgacttcaaaaccaggccggcctgcaccagagcctcagagccagagaccgccccaggcagaaccacagactatgcagggcacctctgttcacctctgcacccatctccctgaagtgccgggcttggcttcccggcaacatccttcatttcaacagctaaatacgcggtcaacaatgggttggtgaaaatgggggcgcccaggagccattccatgccttcagatggggtccgggctcactgtgcaatgcatcatttcacacaggttaaaaggaaaagcagttgccagtgcctgttgttcatttaaggagattaaaatgatagaaaaagaggattttgcatttagacagtgagcagtggaatttaaaaagcagtgccagaaatcatttagtatgtgttacattctattcttttttttttttttccagacagagtctcactctgtcatccaggctggagtgcagtggcatcatcttggctcactgcaacctctgcctccctcaagttcaagtgattctcctgcctaagcctcccgagtagctgggattacaggcacccgtcaccaagcccagctaatttttgtatttttactagagacgaggtttcgccgtttggccaggctggtcttgaactcctgacctcaggtgatccgcctgcctcggcctcccaaagtgctgggattataggcgtgagccactgtgcctggccttagtatgtgttacattaaaaaaatcactccataaagatgtacaattattatgtattaataaaaaatgaaaataaaaagaccgtgtaaactgccacgtattcccactggagagctggtgagtctctccgtggatcgtaccattaccacaagagtcctctggcccacgcacaccctgctctgcccatcagcagtgctccccctcctctccgccattggcttctcatatcctcctgggctgatgtgcccatgctgtgtactcaacactgcctctggctggtgcaagcctggaagggaggtagacggtatggatggctaagcaggcgagctgggctggctgtggcctcggctgtctatcacgctgctacccagcctcggattcaggtcgaacttgcctgcactttctgaacacctagaaagatgcagcccgggcccagacagttcacttctcactcagcaaatgggaaaaaaaaatggagaaggcgctgcgtcctttgaggctcctgccctccagccaccttatctactgtgtctctctgggctcaaatggcgctttcctccagggctctcttggcgtctcatccctctacctccacagggtgtggtaccttcctttgttcctgtggttcccactgcacagctggatctctgttctcactgcctgaaattaacattcctgttcccgtttctcttgccttcctgacttccaggaggtggtggcagttactcagctctgcttccacaccctcgccatgtcttcctcaatagactcaaccctttgtcctgctagttgctagtactcaggtcacaggcagtggaactcgtcttcggcatttagtaagagatggcctttctgactttgtgccccagccacggtgcagtcttctggatctttcccagcagcgtcgacaccgtgagtgctgcctgtgcacgcattcgttgcattcttgctccagatggcagtctgaccagcacgactcaactcccctcccctcctgtccctttctagtaaaattgcctgtatgttaccccaacctctgctgactcacaggtgactgctgtcctgatttttaaccccgcagaataattttgtctgtttttgagattcacataaatggaattgtatagtacacactatttggtgcctagtggcttgaatttagtacagtgttttagaaacacatccctgctgttttgtctgtcagtagtttatttgtttgctgggtgatgttccattgtataattatcctataatttctttattcattctcctgttgttgtgcccttgtttatttccagtttttggctactgtgggagacagcatgtgtagcagtggcgctagctaggcttggacattagtctctctccagaacttgggacaggccattaaggacaggactggtgaatgtgacccagagcttgctgaccctcagctgcctgggacagcagtggcagtctgaccctgggggagtcagaggagggccacgtggtgaccgttacaccccaggagatacggactcaatgagcaaacccctgtggacaggggtcaaggaatctccctcctaaggaaatacagggttttgtgattttctttggttcaatgtcaagagaatcaagttgtgggaaatgctggaaccctcctcaactcagtgcactgagtccctgaatgctcactaaaggagacaggaaaggtggagtgcaggcctgcacagcagctactgggctctggatcagggagggcatcgtacaatatccaaggagagagcaacggaaggaaacaccagttaattcatttaaatctcacaataacatgtcatctctatttcatagatttgaaagctgaggttcagatatgttaaataatttgtccaggggtagcagctagtgtcagagccgcttcttaataactggccacagaactagataattctccaaagataaaatgcaaactaagtgactagtagaaaacattgattatatattagttttatgccaaatgctattcttgccagggtattacagttaaaaagacagacagaaattcttgccttgatggtgccccaggatgagatgaatgatgaacaaagtgaacacatagagtattctagaaggtggtctatggagaaaaataaaacagagaagaaacaggggttgtggtttcaggggtatttgcaagagtaaatatcttgaccaggaaaagcctatgagaaagtggcatttgaggacagacttgaaagagatgagagcatgaccctggggtgggattgagcattaaaggtgaggaaatggccgtgcaaaggccctgtgacagcagtgtgccaaggctgagaaaatgcagagagggcagggtgacttaagtgactgagtgagggggagtcataggagctggcgtcagaggggggtttctggggatgagctcaggtggacctcacaggccatggtgaggaatgactctttgctgagtaaggtgggaaaccatggagggtttggaacaggggagtcacatgccctgagttgcgtttaacaggatcgctctggctgcccagttgacaacagataattgtgggacagaaacatgaagacccttaggacattattgcaataattcaagcaataattcagatggtgactttgaccagagtggctgttccacacgtggtgaaaagtggtcacaataaggttcaattgggaaagtgggacccaaagatttgctcacggataggatgagggatgtgaaagaattgattctgactccaaggatggtgacattgctattcaccgaggtggggcaggtgacaggaaagcagctttgcagggaagaacaggaactcatttttggatacttcacactgggaaatgccaaggaaagctgttagacagctggatatctgcatgtggagttgagggaggggtccagctcggaaatataagcatgggcgtcatcagcgtacagactgtatttcaaacatgagagtggatggggttatctagggagtgcctctgacattctgaggttgggctagacccaggggaggagacagtagaggggcatccagtgaggggagaggaaagcaggaaagcagcggtggactggagggggtgtctggctgtgtcacagcagctcttaggtcaggtgatctgggggcttggcaatttggagctcatttgagggagattttgcagcaaaagcctgagtgggttgggttcaagagaattggggactgtggacacagacaactgcaaagggttgggtggagaggatgtaggccaaaagaggctctgtccagcctgaccaacatggagaaaccccatctctactaaaaatacaaaattagccgggagtggatgtgcatgcatgtaatcccagctactcaggtggctgaggcaggagaatcttttgaacccgggggtgcggaggttgcagtgagccgagattgtgccattgcactccagcctgggcaacaagaacgaaactccgtctcaaaaaaaaaaaaaaaaaaaaagggaaagaaaagaggcttcttctaactctttttcatggcagatttcaaacatatacaaacacaggatgaaagaacaaaatgcttgtgtctccaccacccacttcaacaatgatcttgaccaatcctgctccatctataccattccttcccttgcaaaccccaaacatgtatattaaattaattgatattgccccacctgcaaaccccaaacatgtatattaaattaattgatattgctccacagctcactgaggccccacagctcactgagaccctgtaaaagttttttgtttttttttttttttgagttcttctcccctctatgcttcatttgggataggtgccatggggctgccttctagtttgctgatcttttcttctccagcatctaatgtaccattcatcttatccagtgaactttccatttctgatattttacttttcatttctagaatttcatttgtttggtttttgtatcttccatttctttgcttgtcatgtttatgccttcctttttggtggctcacgcctgtaatcccagcactttgggaggccgaagcgggtgaatcatctgtggtcaggagttcgagaccagcctggccaacatggtgaaaccccttttctaccaaaaatacaaaaaattagctgggcgtggtagtgcatgcctgtaatcccagctacttgggaggctgaggcaggagaatgacttgaacctggtaggcagaggttgcagtgagctgagatcgtaccattgcactctggcttggacaacaagagcaaagctccacctcaaaaaagaaaaaaaaaaaggaaaaagaaaatatttgtaagattaaaaataactgttttaagattcttatcagatagtttcatcatcattgtaatttctattgactatcttttttaaaaatccagtttatgggttatggttttcttgcttctttgtatgcctggcagttttttattagatgctctatatagcgcacttttcattgttgagggctagattttgttgcatttccataaagagtgttggattttcttttggaacacacttaagttgcttgggatcaggttgaccacttcaaagcttacttttatgttttatggcaggcccagagcagcatttagtttgggactaatttagccctactgcagcaatgtccacaactagggcatggcatggatggagtggcccatgcagagtagggaggggcaaggcacgttcaagagctgagaggccattataggaaagatcatcttgtgactattaaagtggccaaggtactaaatctgtttgtccttccttccttccttccttccttcgtccttccttctttccttccctccctccttccctccttcctttcttccctccttccctccttcctccctcccttccttccctccctccctccttccctccttccttcattccttccctcccttcctttctttcctccctccttccctccctccattcttccctccttccctccctccctccctctctccttccctccctccctcccttccttccttccttccctccttcctatctccttccctccctccttctttccttccttcctttctgaaagttgggaaaataaagaactaaattccgtgcatgatcctagattggatcctgaattgggggtgaggtcctataaaagatattattagaacaatttgatgaaatttaaatttgtacagtatattaaataataatacataaataataaatttcctgaattgggccaggtgtggtcgctcatgcctgtaatctcagcactttgggaagctgaggcaagtggatcacttgaggccaggagtttgagaccaggctggccaacatggtgaaccccatctctactaaaaatacaacaattagccaggcatggtggcgggtgcctgtaatcccagctatttgggaggctgaggcactaagaattgcttgaacccaggagacagaggttgcagtgagcagagatcatgccactgcactccagcctgaatgacagagtgagactctgtctcaaaaataaaaaaaaaaaccataaaaatgaataaattttccaaatttgatcagtgtattgtgattatataagcgaattccttgttcttaggaagtacatatgctgaagtattgagatgcaaagggtcaatttactctcaaatggttcaacgacataaagagagaaaaaagaaaaaagagaaagagcacaaatgtgataaaatgtgaacaaagaatgaatcattgttgtactataattcccgggatcccaggaatatgtactcactaggacagtcatttgtcacgttgcttaggaagcaggtttggagtcttgtgtggggaattcgtcgacaccaccagtcccgagtttatgtgcagtggaaaatggagcagtgtggtcagcagtaggagagccagcttccaccctccacctgctgttccacgtggtgggtctgcacagcctggcttgtgagcaaatccatttttccttctctttgggaccaacatgggcttagagatgacatagccttgggcatccaataaattcaaatttgagaatctcaatgattcaaaattgctgctgtcaattaatacatgatgaattcatgttgttttgaaaaaagaatgattgaggtgaccaacagaagacttcaatgtttgtccccaagtaggtaggccaccccagatttccaaccctgggtgcattgcattggcaatctaaatcccaaggactgtgaactctgtggtcattctgcagtttcctctgagagtattcatgggttggggaatctcctgctgaaaaggatattgggtaaaattgctttatgtgagcactagtaaacatttagcatatattaccaagaaaagcaacactgtaagcccaggaagcttagagcttctcaaacagaaggggatgatggagaaaaaaggtgaaaagtctggcaggcaggatgaaggtcaatcaaaaaagggcagctggccacagggaaatatcatttcacccctactagcgtgactgaaaaaaatgtatgttggtgaggatatagagacattgctgatgtcattttaaaatggcatagctactttggaaaacagtctagcaattccttgaaaagttaaatgtagagtttccatatgacccagcaattccactcctaggtatatactcaagtgaaataaaaacacatgcccccgcaaaaacaaaacttgtacacgaatgttcattgcagcatttttcatgatagcccaaagtggaaacaacccaagtgtctacaaactgatgaacgaataaataaaatgcggcatattcataccaagaactatcctttggcaagacaaagaaatgaaatactgataaatgggacaattggggtaagctttgaaaatgtgctgagtgaaaaaaagccagacacaaaaggccacatattgtatgactctgtttatctgaaacatccagaacaggcaaatctgtagagacagaaagtagattagttgtggcagggctagaaggagagggatttagggagtgatgacttatgggtgtggtgttttctttttggggtggtgaaaatgttctgaaattagatagtagtgatggttgtacaactctgtgaatatactgaaactaactgaattgtacgttctagaaggatgaattttatggcatatgcatggcacctaaaaaaaccaaaagagggcagctgtgtatcctgggtttttccttgcttcttgtatgtgtgtttctgcagtccggttgagcagctatgcctcaaccctcgggtctatcctggtcttgaatgttcctgactgttgtcttcagtcttggaaccacacagcaccacagcacagcctgcaagccttcctgggaagatttacacctctaggctgagtctctgctactgcactttctcctccctctcaaatgaaaccgcagtgcctctctgtgtgaccttctcagtcatgcaatgacttctctttcatttcctataagcctctgagctctgccttctccttgccaattccccttagctccatcttcctttggccgtccgccgttgtgtaaatctgtagggaaatgtcattcaaagacaaaacccactgcttattcttctttcttaattgctccttgggaaatgtttgcttctgtgttcttggtgaaggaaagcttaattttgtctgcttttatatcactagtcttttcagattacacattcccaatcaatcacctcttgaatcaagtaattagttttattgtatcagtctatccttcagaatttcattatgcaaatataaacatgcataaatacattcatgtttccccgccttttacacaaaaggaggcacactgttttgtgccttgctttcgtttcacttactatgtctgagaacttttcacatcattatatggagagcttcccctttctttatcagctgtgtgagagtccagtgtcaagatggactgtgtttggtttcatcagtctctgtggaaggatcctggctgacctgtgtcttttgcttttacaaaccttgctggatgatctcacaatcaccttgttgcatgcacacgtaggcagagctgtagaatagactcccagtggggcagttgctgggcaaagggtaaatctctttataattttggcacatattgccagagtgccttctacagggttctatcaactgctgggcactcctgtcagcagtaagagtggctgcttctcccagcctttccagtaaaatatgttaccaacatttgaagccaggtgcagttgctcatgcctgtaatcccagcaactttgttactaacatttgggatttccgcaatggtgtgtgctaataaatgtttaacaaccacttctccaaacaaaacgaaacaaaacaaaacccaaaaccaaaaaaacaagaagccctaattgtagtatctgctgatttccatagcataaatacttctacccaggccaattgcaagctatcaacatgatgtccctgaacacggagttgggaagagatgggccgtagcacccactgtatagtatttctaccacacagatgcaagagatgcaagtagcatggataattgtgaaatgtggtaaaataataaggaatttaagagtttttatttcctttgtatttgtatgatttatttagttataaatttatataattaaatcttagcaacaatctgcatttaacaacctactcataaaaccagctcctaaaaatctggtaattattcatggtcaactgtcaagagtcagctccagcacactactgcaatgctgccaatttgaaaggtagcgaatgccatcccaatgtagttgtcatttttattgttattgttttacttgtttaaggacgatttgcatttccttttctgtgaaatatgtttctgtccttcgcacatttatctactgagttttattctcttgttgatttctaggagatccttatacatgaagctccttctgcatatcttttgtctgtgttataaactgcagtgttttttcccggtttgttatttatcttttgtgcttgcccatggcatttttctttttttctttttctttttttgccatgaagttgttgttgttattgtttcaaaatatagttgaattatttttttcattttttctggtttttttttttttttttttgacacggagtctcattctgtcacccagactggagtgcagtggcatgctatctcggcttaccacaacctccacctcccaggttcaagcgattctcctgcctcagcctcccgagtagctgggattacaggtgtgtgccaccatgcccagcttattttttttttgttttgtatttttagtagagatgggggtttcaccatgttggccaggctggtctcgaactcctgacctcaagtgattttcctgccttgacctcccaaagtgctgggattacaggtgtgagccactgtgcccagcccattttttcttttatggcgtccaaatgttgaataactaggaacaacaggattaaatacattttttttctaatcacaatcaagtttcacatacttaagcaagtttcttatactctaagcagtctgtacaattcctgtatctccttggagttcattatattcaattttgtctttttcttttgagtcagattattatttaaaaaccctctctacttaatggtatcacaaatatgcataatatgttagagacaggcctggcacacttcagctaaaaagaagtatgcatagaggttataaaatatttatcaagataccatcactagttcagtggtggctaaccccaccacttttctgtgactagtattatttcctactggggagtttcttcacttgtgtttgacttcccatgtgggcattgtcttagtaattttgtgttgctgtaacagaatagcacagactaggtaatttataatgaatagatatttgtttgacttatggttctggaggctgggaagtccaatattgaggtactgcatcagataagggaagctctcatatggcaagaaagtttacaggggagagaaagagagggctgaccttgcttttataacaaatccactctcaaggtaaagaatccactccctcaacaatgacattaatccattcccgatggcagagccctcatgaaataataattgcttaaagatcctatttctcaacacagttgcactgggaaacaagttcccaatgcatgaactttggggaacacattcaaagcatagtaggcatgtactggcttagtcctgcattgctctctccatcagacttcaaggcccaaagctctaagaatgatgctggagtgtggtttgtgttcaagaaatattagttgagacaccacattcaaaggtatgaacccctcagatagactttcatctgcatctccaccatccctgacaatgcccattaacatttagtcagcagccacacatttccagcattacttgagaagctgtgcatgtggtctatgtggtgtagcctcagaatacggtcatgcagaaagttctaactcagtgtatctaaaagccacttgaccacttagagtgagcttttatttctagcatctcatttttggttctgactttagaaatgtgaaaaccagatctcaggtatgatatgtaatttacccaaagttacctcattgctactttggcttttagtagtgcgtctggcacatagtaagtcctcaataaaatgaagagcatttgagatgacatgattttcccatttcccagtccagggctcatgtcactgtcctattacaggtatgacccaagatggtggtggctggatagtttccttccaaggtactctttaaggggtagacatgaaaggcagtgatcactcatgccaacaccctatgcttgtaacctgatctccccctggctggtaggccttattctgtcaagatttacccttagaaaagcatatgataagtataacaactacaaaatattgagggcatattatataccagttaatgtgctatgtgtccaatcctcatccaaccctgtctggtgttaatattattactgtcattttataggggtgcagagaggttataggactagtccaagaccagacagaggcaacagtagagccaggtggaaattcaggtctgtcatggtcacaatgctctttgtccgtggggcatggagttgcccaatatattattgttttacagtctttagacacagtgtcttcgcttgacaggaggcacgttcctttatgttgtaggaaatgcactgaacctgaataactctacaggagagctctcatccccccttccaggtcgtccctgctctcagcctgcacctcccattttttgatcaagacagccttgaagttctttatgtctgtggaaggaaggagacggagcttgtttttcacttttgctgccatgattaattatttttaggaaagcattgtgtcttttgagagaggattgtaagtgctgggagaataaatggatcttagagtgagccttgtgtgctccagacttccccagcttgataaacagcttcctgaccagtggctgccagtccctggtctcactggacggacattggctgggggccaatgtctgagttgaatggcgaggactggacagtgcttcttcccagccagtgtggcaatgagcccactcttaagaaggcgccttggcttgggaaaacacattgcacattagatgttggtatccgcggcagggacctgaggctggagtcactgccaggcaccttctgggaggcctggctttccagcaaggcctgcttcacattctcaggagaaccagacccagcataggaaatgccctattgcccaagaggaaaccccatgtcgaggaactgatataattaggatactgataaaaattagaatgagaaggggagggcctaaatgaagggtcatggggtgtactttttaaaaaaaacaaacaaacaaacaaaaaaaacaaaccttcctgcccttctctgcatatgaatatactacatgcttatccaagaaaactttgaaaagtaaataaaaatttcttccaataatttcacccagaaatttaacttctactatttttaaaggagtgtcttttgtatgccaaacttctcctatttttaaataatatatcatgaaaatcattttattttgtaaattggacctcaggtgtatgaaactgggttaattgtgacctatgattcatagtgcatgtattagtccattttcatgctgctgataaagtcatacctgagactgggaagaaaaagaggtttaattggacttacagttccacatggctgggaaggcctcagaatcatggggggaggcaaaaggcacttcttacatggtggcagcaaaagaaaatgaggaaaaagcaaaagtggaagcccctgataaacccatcagatctcatgagacttattaactatcacgagaatagcatgggaaagaccggctcccatgattcaaatacctccctgctaggtccctccctcagcatgtgggaattctagaagatacaattcaagttgagatttgggtggggacacagccaaactgtatcattctgcccctggcccctcccaaatctcatgtcctcacatttcaaaatgaatcatgccttcccaacagctccccaaagtcttaactcatttcagcattaacccaaaggccacagatcaaagtctcatctgagacaaggcaagtcccttctgcctataagcctgtaaaatcaaaagcaagctagttacttcctagatacaatgggggtacaggtatctatgaaatgggagaaattggccaaaacaaaggggttacagggcccatgcaagcctgaaatccagttgggcagtcaaattctaaagctccaaaatgatcttctttgactccaggtctcacatccaggttatgctgatgcaagaggtgggttcccatggttttgggcagctccgccctgtgattttgcaaggtacagcctccctccaggctactttcacaggcttccattgagtatctgcagcttttccaggtgcatggtgccagctgtcagtggatctaccattctggggtctggaggacggtgaccctcttctcagagctccactaggcagtgctccagtaaagactctgtgtgggggatccagtcccacatttcccttctgcactgccctagcagaggttctccatgagcgccctgccactgcagcaaacttttgcctgaggatgcaggcatttccatacatcttaaagatctaggtggaggttcccaaacctcaattcttgacttctgtgcacccacaggctaaacaccacatggaaactgccaaggtttgggacttccaccctctgaagtcacagcccgagctgtatcttggcccctttcagccatggctggagtggctaggacacagtgcaccaagtccttaggctgcacacagcacagggaccctgggcccagcccaagaaaccactttttcctcctgggcctccaggcctgtgatggcaagaggggctgccatgaaggtgtctgacatggcctggagacattttccccaaggtcttggggattaacattaggcttcttgccgcttatgcaaatttctgcaggtggcttgaatttctccccagaaaatggatttttcttttctattgcacagtcaggctgcaaattttccaaacttttatgctgtgcttcgtttataaagctgaatgcctttaacagcaccaaagtcacctgctgaatgctttgctgcttaaaaatttcttctgccagataccctaaatcatctttgtcaggttcaaagttccacaaatctctaaggcggggcaaaatgccaccagtttctttgctaaaacacaacaagaatcacatttactccagttcccaaaaagttcctcatctctacctgagaccacctcagtctggaccttattgtccatatcactatcagcattttgggcaaagccattcaacaagctctaggaagttccaaactttcccacacattcctgtcttcttctgagccctccaaactattccaacctctgcctgttacccagttctaaagttgctcccacattttggggtgccttttcagcaatgccccactctactggtaccaatttactgtattagtccattttcacactgctgataaagacatacctgagactgggaagaaaaaaaggtttaattggacttacaattccacatggcttgggaggcctcagaatcaaggcaaaatgcacttcttacatggcagcggcaagagaaaatgaggaagatacaaaagcagaagctcctgagaaacctgtcagatcttgtgagacttactatcatgagaatagcatgggaaagaccagcccccatgattcaattacctccccctggggtccctcccacaacaagtgggaattctgggagagagaattcaagttgagatttgggtggggacacagccaaaccatatcagtgcactctcttcatttgaccatgcaatgcatgtttttaataataaacatctccatccaatatgaaaactcatactgtaactgtgatttataaaacctttggcccaatctttttcctacaactacacttctctttatctaccttttatttttactttttgcttacttgagcacatgctatacatgcccctttttatgcctctcaggaggtttacagtggtggaatttcatcactcagatagctttccactccacgccctttggatcccaaaatggactgcccatttatctctttctgtgtgaaggaagtcagggttaggagagtcatctgtatatgcctcctcgtttatctctgattctttagcaaaaccaccctgaaacccaggcagatgtcaagtcagcttgtccttgagggtctctgctaaaggagaggccccagtggccactgcagcctccataaatcgctgtggtcaagcatgcatcttgccatcagaccaaccaccacctgatatgtgaaattcacatttgttaattatttgctagaaatctaagaagctgttatttattgtcatgtagttgaaagcctctttccgcctcctccagaattcacttttctttctatctttcctctgatcattgtttttatcctttgactgttcttttgtagttcttttctttattcctgaatttatttaagttgcagatgaggattttggctatgtccacaccccagacttcaccaggaaggtaacttagggttccccaaaatccaaccaaactgttctcaaatgcaggaggagaactctccccttcccctctacccctgccccctcatttcttctcttacaggctttcctagctcttttccaccccatgccccttctgtctctccttccatcctggggtttgtggtagaggattacccagttgcggacgagtcacatgccttatccagtgaaaatattattgtcttatggatgccaagaacaactcctgaatgtacaaactatttttaatgctcatttgagattgatagatatcaggcaaataataaaagtttcacaagattgctacaaataaataattttgaaaacaaaaccaaccaaagcaaaaaacaaacaaacaaaaacaaccttttctgttgtgattagcatttttgctaaactcaccttgggcttttgactttccagacactctcattgcaggtgtttggagctcagttctgttcctccaggcttgtgcgctctccttgaccccaccttttgtgcgtgtgctgtccttgtctgaaaccagcctggagctccctatacagatgtgtcaaggtcaggccaggtcaaggctgagcacagagaaaggagctgctgtaggaggcccacaaggaattttgttggatctgtgagatcagtgtatgctccagcccctctgacatatccagaggagacagccttgagtttgggcccagtactgccacttattagctgtgtaaacttgaaaaagtcaattaattttgcataagtctagtgcaataagtaagagtcttcaagtcatcaccctgttgtgatggattacatgagatcaagcatgtaatgtgtcaccatgataactggcaaaaataagtgcttagtaaatgctgaccattcttcttcttaacaacatcatcatcatcatcatcatcatcatcatcatcaacaacaacaacactaggtgcaagcgccagccccggccaaggccaataggccctgtgtaggttgcgggctacctactcagtctggatgctggtttcctgttctcctgctcctgtctttgctcttgacctgttttcttcttgcctctgcaatggactctgctgctggttgtgccatctcctcaaggttggacccttggaagctgacgtatagctggtaccttccagctacctcttcaacacccctgcatagcttgaactcaggtgacctgctctgctccaggctccgagtcccccaggtgcattttcctgtccttgttcccaccatgggctcagacagtgagtgccttgaaggcaggaatagggggtcctcaacccattccctggcccctgacaagcagctggctgcaggatgtcctccactacttgttagtcaaatgcatgaaacattggatgaaggcaagaaggtgagatagccaggtgtggtggctcactcgtgtaatctcaacactttgtgaggctgaggcaggtggattgcttgagcccaggagtttgagaccagcctcggcaatgtggcaaaaccctgtctctacaaaaaaaatttaaaaattagccaggcatagtggtgtatgcctatagtcccagctacttgggaggctgaggttgggggattgcttgagcctgggaagcagaggttacggtgagctgagatctcaccactgctcttcagcctgggcgacaaaaaagagaatgtctcaataaataaataaataaataaataaattagttaattaattaataaaggagagataggaaccttctcctttgttgaatccaagtttagtaggatgttcctttcttttctctctctttctttttctctctttctctctctctctttctttcctttctttctttctttctccttccttccttccttccttccttccttccttccttccttccttccttttttctttctttcttgacaagatctcaccctatcatccaggctggagtacagtggtacaatcatagctcactgcagccttcagctcttgagcttaaactatcctcccacctcagctttccaagtacctgggactctaggagcaagtcaccatgcctggtggatgttcttttctattgaaagtctagagtaattcatggccaatacttaattttagcagctttgttccttttgaatgagccctcaagccaaaaacatatccatcttttaacagtttcatttatttcctttgaaatcacttcaactggattcaatgcaatgcatttgaacagatgtttacacagtgtgttgggcattgttatgggcacatgactgagaagagaatggtcaagtttcctgccctggacagaactaaaattttaccaggaagagagatgctgagcacctaactaataaatacacagggtaatttcatttttataagagtttccaaagcaattaccatcaccaccaaagaatcagggtagattactgggtctcgacaagtgtgtgtgtgtgtgcgcacacgtgcgtgcgcatgcatgtgtgtgtcttggggaagagataaggcctgaataaggagggacagctgtcctgtggagatctggagaagattattgtagtagaggaatggcaagttcaaaggcctggaagtggtagcagagtcattgtgtttcaggggcagaaaggaggccagcgtgcctgggtgccaagggaaggaggtgagggtgaggaggcggacaggcatctcaagtgcatggagagccacctcttcttgggtccccagtccagggcactttctttggacccaggatgtaggtactgacagctgccatgaatctcggagttgtcagcattcacagcaaagggcatttccaggctaaaatctaagtaaacaagctccagaacaaagaagacaccatgttcaaagtgtgtgaaaatggataacaaataggaaacatttaaaaacaagcactttgtggaaaaccatgtttccttgatgtgctttctgtcatggtatctgaaacactgcaaaaggacattgaagatctgggagggagagttgacaatcttcccaaataagatacagttatcttatttcaaataaaaaggaagcaaaattggcacaagtttgggtcaaatttctcctgtgccaagtctagaatcagcaggtagtgctgaaatcactgtcccacatcccagacatagtgagcattcttttaaggctccaggctcaagtgtgtgcaaacagagggaaattacacttgaaaaaaaagatcaaggaccgtgaattagatacaaccttggacaacaaaagcagcaaccatgaaaggttgtatgtacttaagaagtcaaacacttctgggaaagctgtggggaagagagttggtatatgggaaaaaagtggtaaactcaaaacgccttttgtatggagaaaggcattggccagctttaaaggcactgcagcatcagttgagcaagtgcttttaataaattactctcttttgtagctctgtactttttctgatatggataagctatctagcatccaaagcaaactcatcttaaaccaagaattcaaacaaatgataataaagatggtagaatgcctattccactccatttgaaagagatgcacaaaagaaaatggtaggtgttgcttgcaggagtgtgataatagtgttgctcttctaaactggcaactttatgagtagatcatcaaagccaaggtattttactttgtggaataagaaacgatcacaccgaaaataataaaattcagcactgcaggttttctgccctttataaatgtttttcaaagacggaaccgaaagaatagcttgagtgataacaagcttttcagaaggagctctggaaattaatatgggacaggtgatggagcaagactttcagcatgaagaagcccaggaactgggaaaacacaagtctttacttcagaatcaccccatagcctccaagtagtgtgttgcaggttgaatctagctgaaaatggcataaaacagaatattaatagctatatccacatatcactaaactaggtacattcttgatgttcctgaatataaggagattataaattaaaatgattctgaaaaactacagacattgatgcaagtttctagtttcaaccaggataatatcacatctcacctcaaacaaaaggcattttcttcagaaaggaactaaaaaaaaatggcctttattctatacttgcttatggttctggtttaaaaacaaaaacaggttccagaagactacttattcaaagaccctgccccacattcctcttgaggatcccagtgaatgtggcactgataatatgaatggtttaccttccgtgagattgcattgaggggggaaatattcttagaaataaaatttttaaaaagaaaatatgatgtaaattgaccaaggggtttaaaaaatctgtcaatctcatatcctatacctagcaaaaatatccttcagaaatgaatggaaaattaagacattctcagatagaagaaaaataagaaatttgtcaccagcattaaagaatgactaaagggatgtctctaaacagaaagtgaataataacaaagggaggctggaacttcaggaaggaaacaaaacaatgcaatggttaaaaattctcctcaagtgtttaaaaaattgtgttgaagcaaaaaaatataacatcatctggtgagatgttcagtgtctgtagtggaaatatttatttaacatatttgtattttaagggggagggtaaacagacctaaataaaagtcagatttctatacttcacttgaagaggtaaaatgctgatacagttagctatgacatattatgtatatatattgtaatatctagggaaattagtaaaaaactatatgatgaagagatatattaaaaatgtactatagatatgaatatatgtgtgggttagtatacatacatagttttccttactctgtcacctgagagaacaaagaagcaatgacaaccctctagcaattagcacaccggacacacagatcttggtttctaacaccattcaccaataaaacaaatcagggctccttggagaaatggctgattccaggccttgggggaaaaatatatgagatgaacctggagcattttgtagcaccagaatgtaaggaaatgtgtgtgtgtgtgtgtgtgtgtgtgtgtgtgtgtgtgtgaagagacacaggagccaaccaaaagagctctcaatggccaaacttggaataattggagcaagaaaataataaagtagtaatgtattatcacccaaaataaatatccatgagtccatagtgatataagtaaatacttgaataaataaatggggggaaaaaagacaactctctcttatgaagaactggaaatagttaatacagatactacaacctgaaggaggagaagtgtaagttcctggtccttaggtatgggcctacatagtgattttcttccaaagagtgtagaatagatagggggtgggggaaagtagatttacactggagacacctgccaagcactacttcagccaggtgatcatggtcaacacctgctgtgataaatcgtggtgtgagtatgtaccctggatatgatgtgatgaaaatgacacttcactgctttacccattacccttgtcgaatcatgaaaaaagcctcaggtgaatttcaataagggggtatcatagaatacattgaatataggataatacctaaccaggactcttcaaaattgtcaaggtcctaaaaatcaggaaaagtttgagaaactgtcacaaccaagaggagcctgaggagatgtgatgactaaacacagtaagtatcctggatgggaccctggaccataggaagatgttaggtaaaactaaggaaatctaaataagatatagactttggttaataataatgtatcaatattggctcattaattgaaacagtcgtgctaattaatataagatgttaataagatgggacactgagtgaggatgtatatgggaactttctgttctaccatctcattttttttaaacttataaaaaataaagtctattaaaacattatagcactttgggaggctgaggtgggtggatcatctgaggtcaagagtttgagatcagcctagccaacatggcgaaatgctgtctctactaaaaaaacaaaaattagctgggcatggtggcaagtgcctataatcacagctactcgggaggctgaggcaggagaatcacttgaatttggcgggatggaggttgcagtgaggtgagatcatgccacttcactccggcatgggggaaagagcgaaactccgttaaaaaaaaatcatgagtttaaacataaaacataaaaatatataatgtttagaaagaattcacaggagaaaatctttgggacctaaggctagacagaattcttagacatggcaccagcagcactatccataaagagagaagaaaaagtcaatatactatacttcgttgtaattaaaaacttttgtggtgtaaaagactcggtgaagaggatgaaaagacaaactgcagactgggagaaattattttcaaatccatatcttttttttgtttttttgagatggagtcttgctctgttgccaggctggagtgcattggcgcgatctcagctcactgcaacctccagctcccgggttcaagcgattctcctgccttagcctccagagtagctgggactccaggcccagctaatttttgtatttttagtagagacagggttttaccatgttggccaggatggtctcgatctcttgacctcgtgatccacctgcctcggcctcccaaagtactgggattccaggcgtaagccaccgtgcccggcctcaaatccatgtcttacaaagaccttatatctacaatacacaaaaatgtatcaaattcaacagtaaaaagacaagaagaaaaatgaagaatcccatcagaaaatgaggggaaaatatgcccatgaatttcaccaaaaagactatacagatggtaaagaagtgcaggaaaggatgttcgatatcactagcctttagggaaatgcacattaaaaccaccgtgagatattactacacacctatcagagttgctaaaattgaaaacaaattataacacaaaatgctggcaagtatgtggagaaactggatcacacctacattgctgggtagaacaaaaaatattatagtcattcagataacagtttggcagtttctttaaaaactaaatatgaaattgctgtttgacctggaaattgcattcctgtgcatttattgcggagaaatgaaaatgtatgttcacacaaaaacctgtacaagaatgtttatagcagctctattcataatagctaaaaactgaaaagatgcaagatgtcctttagtgggttaaaccatccacatcatggaatactactcagcaataaaaaggaaccaactattgatacacacaaaaccctggttaatcttgagaattacattaagtgaaaaaaagccagtcctcaaaagttacatactatgttactctatttatacaacattttaaaaaggacaaagttacaggaatgaagaacagattagtggttggtgggacagcagtgaagtggggtggttgcaaaagggccacatgagggatgcttgtggggatggaattgtttcatagcttgactttctttttgtttgtttgtttgttttttttagacggacggagtcttgctctgtcacccaggctggagtgcagtagtgcaatctcagctcactgcaacctccacctcccaggttcaagtgattctcctgccttaggcctcccgagtagctgggattacaggtgccactaccacgcctggctaatttgttgtatttttagtagagacggagttttaccatgttggccaggctggtctcaaactcctgacctccgttgatccacctgcctcagcctcccaaagtgcaaggattacaggcctgagccactgcacctggccaatagcttgtctttcaataatagtgttcttgctgtgatatcatactacagttttgtaagatattaccagtaggggaaatttggttaagagcatgtgatgtttctattatttcttacaactgcttatgaatctacagttacctcaaattaagtgtaatttaaaaaatactggaaaacaacaacccccttaccccatgcagatattttcatctattttggttgtatttatttggtattgacttccacaatgtatatagtatgttttgattgctaatctatgatttattaattgaagacgattttagatagatctgtatctttatggtagagtttatttattgtagctgcattttaatttaaaacttaattactgttgctttgtttccttctggtttctgcatgatttccactgcgtctcttgtgttctgtttgtttgttttggagtttctcacattgagagatttttctcattgttgggtaaccatgactctatcttcctgtttaagaattaggggctgggcaccatcgctcaggcctgtaatcccagcactttgggaggctgaggcaggcagatcatctgaggtcaggagtttgcgccagcctggagggttggagaaactggctgttgcattagtccgttctcacactgctataaagaattaactgagactgggtaatttatgcagaaaagaggtttaattgactcagagttctggaggctgtacaggaagcatggctggtaggcctcaggaagcttacactcatggcagaagggcaaagggaaagcaagcacatcttcacgtggtggcaggagacagtgaaagaagaagcactacacacttttaaacaaccagatctcgtgaggactcactcactatcatgagaacagcaagggagaattctgcccccatgatccagtcacctcccaccaggtccctccctcagtgttggggattgcaattcaacatgagatttgggtggggacacacagccaaaccatagcagctgttacctcatgctcctaattttgtggaagatcagataacaacttagtttcagtttggtggaattgtagcatagataactctgttttgatttttagtctggttgttggggcgtagtgagggggcttagtgggggccctgtgtgttttatctggtgaccctccagtttctcagcgccatgcatttgcttgtcctggcctctgcagtcacctttgctggctgtggcattgtgagggtgtgaaggctgcagattcttagagggggcctattccaggctctcctgtgttcatgactgtcacatcccatcttgggcgaggccaggctagagtccacaggctccactcaggctctctttcccagaccccgacacctctgtcagcctcgttgtaggtcctcttttgattgctattgccttggacctggacagtttataaaccaagcttgccaagaggcaagagtgaagaggtctgttaaatagggaaagagcttggagtctcctgggccatgtgctcagtacacaagttcttacaggtgggtagtcctgtttgggatagttcagacacaccagagtagggagtgagggtcccatgctggccacctttcttcttcacctccctcttctcatgcctccctgccaccacccaacattttcagccttgagaaattccaagtaagccccttgctcagggctgggaatccagttggcagttcgggaggcggtggggtcagagttaccgcttctttccgggcctttccagaggttctgctgctcccccaatacgccttccattgtgctccagtgcgtccctccagcacattcccacagttagattcttctggggactgttgtaggcacatccctgaaattcccgagggatctccccctggctagtgtacttccttttctcaaggtatgtgggaacaggagctgtctgccgggattagcagcccacatgatttcccagtctcaggacctgtttcctgttgggagcccctgagctctgagacatgtggttgccaagtgcttgcagcgctgggtgtggtggagccccaggctgactctcctaggtggcagactcttgggggcgagctctccccagggcggggacaggctgggggtggcgggctcttgggggtgggcaggatctccttgggtgaggggtgtctctgggggtttggctctggggaaggggttctgaggagggggcagattctcctggggaggtgggctctgggggtggggagcaggttttcctgggtgggcctctcctgggaccaactctccctggccgcagtctctcttggccacgattctttcctccacagcaacatccatgtgcagaggtgctagagctgccagtactagcttaccagcgctggctacaagatcttcaggaactttttggcctggttgttaaccagagcaactattaaaaattatagaacctcaggtaagcaaattaaatcgcaaacaaaagtaatggatacacaaaacttatactaccttttttatgacattttaccatttcctgtgcccttgaggctctttacgttatggtacctgtgtggtggaaatactgtactgggcgacggggcagctgtgcttctctccccagttcctgcttgtgtgggagtatttcaccatggaaatcagcaaatcatgcttagttatttggacagctggttattaaacatttaccagcacacaccattacctgagttctatcagcttattaaattaaaaaataaatggagccctttaatcacattgttcttattttattttattttttattattttttagaggtaggctcttgctgtgttgccccggctggaatgcagtggtacaatcatagctcaccatagcctggaactactgggctcaagtgatcctcttgtcttagccttctaagtagaaaggaccactggtgcttgcaccatgtctgactaactttttttaaaaaatgcttttttgtagagatgggtccttgctttattgcctaggctggtcttgaactcctggcaagagatgcaagtgacccttgcgtctcagcctcccaaagtgctgggatataagcatgagtcatcgtgcctggcctaatcacattgttcaagcattgtgcaaatcaatggaagcctagctcacaacacttctggtttaaatgcaggcacacttcccctctgcctggccctgactcctgctgccctctcctactcagttctctggcagctcatccccctcacccactctactccattccctgcctgctttccagtctctcgacctggacaggttttctgtccctttccccattgtttctttgaagtatttattatgtaccttcctttatcctctcagctaaagggtttcccttttcttgccaaggtttgtgatccatctctctcttctcattctcctgattctgaatttatcataacatttcctgggcacaatttaaatatgcttatttgaccttcccaggctgtgctaacagcaccaccaccactgctgctgccgaaaagagttagtgatatttatctacacctgtacctgtgccacctgtgtcccatgccagagaccccggagcactccatgggcaggtcccatttaatgctgatacctccatgagaaatgagtgtttggttgaatttaagtactgtaagggaactttttagactgccctaggtggtatgtgaaacctgagggctttgtggttgtgccaaggggcttctgagtagagaagaagaagggataccagagaagatgagactcacccacagcccttctaaccccagacctagcagagcatttcactgtccagaaataggagttgaaactgtggccttcagagcaatgttttaacctggctttagtattcttactagctgagtgaccttgggcactctgtgcctcaatttcctcatctgaaaaatggggataatactattaccttataaggttttttgtgaggtttaaatgagttaatgcacataaagctcttcaaaaagtgttcaactaataaatattagccattgtcattactgaggctatgtgcaaaattgtacttaataaaataatgcttctggtaagaggttgaagaccacatatgtagctctatggcctttattttatagttgagaaaactgaagctcagagctaagaactggacacagccagtgagcagcagagtcaggactaaatccctttctgctctgaatttttcaacaaatggtattaatcctcttctttgacctggaaggggcatgacacctacaacatttgatacccatggcatttgacacccacaccactcaacacccttgtgcctttattttgattaaaggtgtgcctttaaagtgatgagaatagtgtccaaataaatatgacagaacccttctatccattttctctgggaagaaatgaatattaatatctctggtaagatttgaatattaaacaaagagaaagaactagcccctttagtggatatagcatgatctggggaacaaagagacagcccagatgggagcatgttattggagagggataaggagcgtgcaaggtaaggtgtcggtgaacaaaagttctctgtaaaagaattggaagggaagagactttattccactaagcagtttgcaaaatggggagatgtgacctgtggtctaaaatgaaggttccttccagggagcaaaaggaggtttcagttttgacagcaaaagttcctgtccgggttcccactcaagtccatttatgcaaatgaaggattcaaacttgcttagttctaattacttgatgaagctaagttctgattggttggttcaggtgagttctgaaagtcccaaagttgaacagaggtatgggttttctgttgacacagagtacatctgtgatgtctagtcaataaatgaccactaggctcaatgttaaatttaggcccagttagccactagggatccatcttgaaggactggctctttcggtttcatattcattcccatgaccgaggcaggacccatcctgcagcttttgcccagcgggtaggagaccaggcttgggaggccattaagtcaacttcagacactgttttactgcccagggtggaggaagatctctaaactaaatgcctacagcatccacagctgaatctggctggcatgtaaagaaccagcagtaagcgatgtgcctggtgtgctggggtacacgaacggaggcgagccgggccctgtagtgatagtcagtttcactgggactaccctactccagacaggaagtcctcattgctgacagcacttaggagcagtgcctctccaccagaagtgtattctcagcaggggtggatctgagagcagaatacctagtggagaagaggggtttccacttgtggggtagagctctttcaagcacccgggccacattcagagaagttcccctgcactgggctaaatgagtcaggtggcctcacttctctcagacacatctggcaacctgggcagcttttggggtgacactgcaggaccacaggagggactccttctctctggcattctgagaggtgaagggcttcacattccagtgatggaaatcttggcaacactagagaaaggagtgcagctcctacctaaccagtgagagaatattatacatgattttgtataatctgatttgaaacttgaaataatgcaacattttcttagttgaaaaacaacaaaaaatacataatttcaaagctgttcttgggggcgaggtgcggagcgtgaactgtctcccacttcagggggtaagcaggtagacaggaatgtcaccatccattgtctcgtgggtgtgaatcactgcttctagactcctgtgcttttgataattattgcaaagtcatttcaacttttgctgtgttatgatctttaaaacaaatagtgtattctactgcaggataggttaattgtcattaagaggtgattccagtggtattgttaaaaaaagtacacccacaatcagtaaatttagaaagaaagttaggtgagataaaatatcatgaagatttaaaaacaccaggaaataaataccagtctgctaattttatgacaagcatcccaagaaatattggagatgatgctgagaaaataaaaatagcattaaagatcctcaaacagcccctgttcctctgactttgcagcatttggaggggaaagcactcttacattatgagggcctctggagccccacctaaatccttaagtgaaaactcccagggagcatcattttctgacagttgcagctggattagcaccacgtgggccagtagcctcagagaagggagtgtgcaatatcagcttcctccagagagatgccgatgggtccattctgggcccccgtttccatacctgtagcctcttaggggacacagaatgactgggaggtgctgcctattcacctgtggaatgtgggcacttctggggtctgactttctcctatatagctctgtagcttttgaatacctataataattatgtacttgtattaatttttaaaaatctattaaaaagaaaaaaaataaaggaagaggggctgagctctgctgtggaaatcagatctatttagaaagcaagaaggtctgtggacaatccaatacaaggtggcccagcctccataccacctccagctgtccccaggctgctttgcagtaacaacctatgggcaaatggcagcgtgcgcctccgtctttctgccctatatgcctgaagtcacagcggtccttcaggagtgttatgactcattcccatggggaggtgggggcgtgctaggtgtcttagtccattgtgtttgctctcataaaataccatagactggggggctttaacaataggcatttatttcttacagttctggaggctggaagtccaagatcaaggtgcagcagatctggtgtctggtgagggctccctttctggtttgcagatggccgccttctctctgtttccacacatggtggagacagggagagctctgatcccttccttttcttataagggcactaatccatcatgagaaccccacccccatgacctcatttaaacctaatgatctccaaaggtaattacatagggggttagagcttcaacatgcaaatttggcagggacagggggtggggaacatgaacatccagtccattaccatagagatattcaaatgggggtaaatgcttctgtggaaaatccccccgtgggaggctgctctgggctgtgtgtccaccccaacttggtgctcccacgagactgtgggaaagggtggcagtcctctatccccagtatggccttcagcatgtgcagtccctggcctggctacctgcagaagcccacaggaaaggggcagccaggggttgaaggagaaaagaggagagaggggtggggatgagacactccattctgaggagaggtccccaggaagaggctacgcagattctttggaactggaattgcctgagaaggcttaggacagcgctgctcattagaccactgcctgggaaatggccatcagctgagaatgtgggaccttagtgtccctgtgtctgggggagtccaagagagagagatggatactgaagattttgcaaagtggcatggctgggtgagtgggccctccaccaggagacactgactacaggtgcttgctgggcataaccgaaggagggcccggcagaatccagaccctccccattgccgtgagaggctcagggggctagcttatgaggaagagaactaaaaactaggggacacattctgaggatacaaaatgcacaatgagccctcatttagatgaggggtagggtcttaaccaaactccagcattacaccccagcctttccttgtggttctatgttgtcatgcaccatgtgcttagctacagctctcctgggtgctgccttccagagatgggaccacctcagtgacagtgaagagattaagtgtgcaagctggggacagcgggcaagtgattaacatttcctgactctgactcgtcctttggagggtgatgctacatacagcccatcatacgcactatcatggcccaatctctctgaaagtgaaatcacttctccccactgagctgcatctggaattttagcagcttggagcaatgcaaaataatggtgcttaaactcagaccagcctcctcaattttgagctgggcaatccattacacatacattttaggcagaatgggatcctggtaaatttgctgtctgtgtatgtggcccacaaatttccattcattgaacagttgtcatttttaagagctgcagggcaaaaaggttatttgttgactttttgttttttgcaaatgatattaccttgcaaaagagcttaccctgaaactgaaaagaatgattctgtgttaccatatgcttttataggcttagctcttgtctgtgggaagtttgcaagcattccctcctctgctccccattcatttataaagaaacctcccacatggtgctattaaaataaaaacttactcatatgcttagtcaatgccgagcagaatttctttcataggttccgtatgaatgagttctgaagtaacaggtttagaaaatgaaactgctcaaaaagaatatgaaaatgacttgaaaaggtgccagaaaatactttgactgtgtgtgcatgtgtgtgcacgggggtgggggaaatatcagatcatgggaaggttccaagaccttcaggttataatggcatgtgaacaacctcaggagttggtgtgggaataaacgattcaggcttaaaatgagaaactcctgttatggacaccacgggatgttctagtcaacagatctaaacacgtggccccatgactacctgtttatgtgggtgtaatcaatgcccagctctgctattcaccagctgtgtggcctggggcaagttgctccaccaacctgatcctcagttcccttgcctgtaacatgctgataataacagcatttattccataggacataggatccccacaaccccaattccttggagctcaaaaattagatgaatcttgatccttgttcacagtactttccaccacggatccatccatgactttgtcatttatttagttatgtaactagttatttccaatattgtaatgagcacccatgaatctaccaccaaacaaaagctaagtctaggacaataacctacatcttatcagctagtccccagtatcttattaacctcttctccccacttctaaggtctacaccatcatgaatcttgtgttcctgatacccctgcttcccattttatttggttttatgcttccatatgtatttctagaaagtaggtatatttttatcttaattgttttttaactttataaaacttttagggacttacttttttccatttaatgttatattgctaagagtcattcacagtattgtgtgtcattgtaatttctttgttctgactgctgcatagtagtgtatacaaataaaccatagtgtaatcatccatactcccattgaggggtacttgggaaaggagagggtccagacttttgctagttagaacagggctgttatagtcctactggtacatgtcagcctttgtacaagtataagagtttctcttgggtatggaccttcaaggagaatcatgtcagagaacatgtgaaagttcaactttaggagacaatgccaaaacattctctaaagactctgtgctaatctacaatgccacaggcttcatcctctccagcacttaattgtgttaggctttttactttttgctaattgaatgagtataacatgttatttcattgtgattttaattttcactttttttctttaacaaatttttttatttttagtttttgtgggtacataataggtacatatatttatggggtacatgagatgttttgatataggcacacaatgcataataatcacatcatgggaaatggggtatccatcccctcaagcatttatgttttgtgttataaacaatccaattatactcttttaggtatttttaaatgtacagttaaattattttgactatagtcacccttttgtgctatcatatactaggtattcataatttttttcacttttctttttgaatcttttcataagtttattgggcatatatgtttcctcttctgtgaaatgccattggtgctttttttccccattattatactggttatttgtgctttgttaacaaaattgatttgtagcagttctacatatattcttggtactaaacctttgtggttgatattatgaatatcttgtcccagtttttactttgtctttttactttttaaaggtatctcttggtgaacaaatgttctttattttgacatagttaaatttatcattttatagtcaacaatttaagtgcttaagaaaaactttagctgcgtgtattagtccattcttgcattgctataaagaactccctgagaatgggtaatttataaagaaaagaggttaaatgactcacagttctgcaggctgtacaggaaacatggttgggaaggcctcaggaaacacaattatggtggaaggtgaaggggaagcaggaatatctgcatatggccagtaggacagagagagaaggggatggtactacacactttaaatacagaactagggggatggtgccaaaccactagaaaccacctctatgatccaagcacctcccaccaggcctcacctccaacatttggaattacaattcaaaatgagatttgggtggggacacagagccaaaccatatcactactccaaggtataaaatagttacctgtattttactataaattataaagtttcttttttgacatttaattcctgaatctatctagggttatttttcggatatagtttgagagagatattcaagttcattttttcccatatgaataactacttttttccacctccatttgtttatcagcctcctctcctcactgacctcctgtatcctctgtaataaaccaacattctttatttgcatccatctttttctgggatcttattcataccccatggtctgtttttctgtctctgcaccaaaactacagggttttaattgctccagcctcataaaagtccagacatcaataagggaaacccctgatcactaccttttcagaaacatcctatttttggtcttttatgctttcacataagtttagaatcattttttcaggttctatttttaaaaaaattattaggaatttgacaagaattgcactgaatatatagatcaaattacactattaaattatataatccatgaacacaatatctctctccaattacttagccctttttaatatctcttaaagttttacacttttccttctagaggtcttgaaaatgtgtccattgttaggtttattctaggagacttgatattttaatttttttttttttttttgaggaagggtcttattttgtcatccgggctggagtgcagtggtacgatcatagctcaccacagcttcgaactcctaggtccaagtgatcctcctacctcaccctcctgagtagctgggactataggcacatgccactgtgccccactagatacctgatgttttctgatgctgttgtaaagaatattgtcttttagcctgggcacagtggctcatgcctgtaatcccagcaccttgggaggctgaggtgggcggatcacttgagatcaggagttctagaccagcctggccaacatggtgaaaccccgtccctactaaaaaaaaaaaaaaaatacaaaaattagccatgtgtggtggtttacacctgtaatcctagctactcagggggctgaggcacgagaattgcttgaacccggaaggcagaggaggttgcagtgagctgagatagcgccactgcactccagcctgggtgacagagtgagactctatctcagaattaaaaaaaaaaaatattgtcttttaattaaactttctagctgtttgatgtatgtaaattttatatcttcactaaatttaattgttcttaatcatttgtttatggattttgggcattttctatataagcagtcataccttatgtgggtgataatggtttctttccctcataagatgattttaaaagtgaatggggttatataaacaaagcaaacaacacagtggttggcagctagtcagtgctcagtaaatgcttgtgactactgatattatcgtcattactcattaacagaagaattttagaaatttctttaacaaattccttcatgttgaagaaagaaacagaggcccagaacaagtccatgatttgcctgggatgacatgacaactcaatgccaggactgcacctggaaaacctgggtctttgggctacaaagtcaagtgccctttcttttaatccccaacaaatgcaggcttctgtctggcataaacttttgcaattgtagtgtttacatgaatggggctttctggcacatccatgaaaaaaaatctattaaatcagcagcatgaattaagctctttctgtgtgctgggcttcccacattgcacacgcttctagcagaggaagaatttacaccctgcaactcagaggggcagaaaatgataatttatttccttttaaatattctctatatggatctcatcatttcctgttgatggcagaggaaggagggagaaccttaaacttgcccattgaaagcaacttagactcttttggtctaactcactttcttttgggtaaatacacagttaaataaaaattaagatttccttctcaaaggatgtctcttcactctctatgtcccaggttggcagctggaagagggaaacaattatggattctcacagtgtggagtggtgcctctgaactcatcctgcctttgagacatagcaggtgctgattgagctgggcctggcctgatcatgtctttgagcatccaattctggggccactaggtctagctgtctctgctggtgctttgggacctccactgctcagatcttcctggccccaaagatctctaaatctcagctttgtctgtcatctgtctctaggctctgcaaaggtgacctctcagcagtctggctcgcagctacaccctctgggggcacgtagaacactgagacccctttctggccacagtgtagcagaggaagaggcaggctgtggggcacatgtgaggtattctcagatactagctcagccttaacttctctcatcttctcttctctctgcatccctccctccccaacttgcctcttggccagaagagtgtctccttcctgttgggtggggtttccctaacttgatgtcctctgtcttctctttattcaggcttatagcaagctccacagtcacactggcaaggcctagctctttgaagatgaagggaactttcagaatctagaataatgtgtgtcctctttcaacaaaacttgacattggaaacctgtttctccatggcctctaaaaatgtcagttttggcatgcaaatattttctaaatattatcccaattacccatggttatggctgcctttgggattatgatgaagactgtagttgtgtagaacatgtcatgctcctgactcccctctcgggatatggaggccactgtctttgtgagtggatggagctccttcctctgtccatctcttaactaatgaaagccaggtctgtctgttctcagcagtctttctctgcctagccactgtacaggacactgtcactaacacgtcctcaaggaatgacctctgacttctggcctgaagatctctgtggcctctattcaacctttattgagagcttattatggttacagctctgtgctcgtgagaacccagagagagcgagacagaattgtcttcaagctgctcaaagagtaaaatccatgcataaagacctggctgtatcacagctgtgcttatgatattagcaaaatccagtacaactaggaagaacatgtacagagaaggaaggaaaggcaaaactgttgggtctagttttcttggttcctacatgaaagaaggctgggcaatatttaccctcgataaagttcattatgccttgggtatagtaaaaatctgaagttttgcctctgtagaccactattctgccagggctgggtgccagagtgtattttacaatgctgacgcctgtccgagacagtgggttgtggtttctgttccactctccaatgcacttttgggaaggcaggtgactgggatggacctgctctagtcatcaaatgtggcaggcccactttccattgccaacaaaagttaagtaaattaaatagggccccaaaggagctctctaggagttggtgtatcatgaaatgtgaagtgggcttgcccctatgcaagaactaaaagaaacacaatttagttatctttggcttctgaggcatcggcagagttttctgctgccaatatgagatttcagtggagagtagggtttcccaaatcatgttgaaacgtgacattgttttccttaggcccacagggccttggcctgacactgagcatgtattcgtgtgtgcacacacgactgaccactttctgcacgcttcttacacatccgccatgtgtccgcctcagccagtggaagccctgtgccactcttgagatgcaggtggctgtttcttgctgctgtcactgttactgctgctgccgcttgcagcctaattcctcgctggtttcaaaatgtgtctcagagatttccccaaatccatttctccaaattctgagttgttcatccatggataacaacaggatggcatggatgtaggcactggtaaagaagcacagaagcatgtactgagggtgttaattctgaacatggagagactgcatgttctgaaacacatcttagcatttctgtgtccacatatgtgtattgcatttcaagcatttttattattattattattatttttgctgggtcgtgtcaatagaactgacagcatcctgtgaccatatcttcacctttagtgctttctaagtaaaactcagtgtcttaatatagccaaagggaagaaaatcctagtgagagaatgaactttttctgacattcctggttggtgaaatgcaatcctcttttcctggcatttggtgaggataattgaatttatgtctggtaactaaggggatgctcgggagcctcaggaaccatgagcaggaatgaggatggtcagaaagcacattgggttatgtggattcagtgacacaaaccccaagaaacctggtggcttttggcactgcatgtgattagagacaaatgatctattttcatcttctggaaaaatcaataaatacatatataaaagagtgccttcaagtcctttgagctattaagaatagctaacgttttgattgcttattgcatgtctattgctgttctaaaggctacatatgtattcactcatttcttcttataacgtccctgtgtggcccacggtcatgttattttcattcccattttacagataagaaaatggaggtcacgagctggagaactccttgctcaagttgcatagctaataagggacttagctgggattcctggccagcaatgtggctccaggcctggtttctaacttccccttcttggcaaccaccttcacagaggaatgcaagaggtgagtggatttgatgtgatattttatatcatgcctatttctatccactttctctggagtccactaagattaaagaaggagagaaattctctagttctacaggaagtgcgggctgtttccagtgggtccttgaagtcctttgtctgtttccagtttttccttcaggtcttttgagcccagcttccctctggccagctcaggctcagggagacgggcatacaccggtggcctgggtgacagtgtgcagctgatgagccacaggacttgggcaggccatagtgggtcaggagagactggacgcttcgtcttttatgcttctgggatttctgttgtggcttctgttttcaccgcatttcaaatcctttaagttaggtcatatggggaaaatgcttgtgcttctcatttatctccctggaggctagcctggatctctgatgaggaggagcaccaggccactccataaccaccgggctgcaggatctccagggccacccaggaagccaaaatcagaacagagctccttgctgtgggggctttgctcaccctagttctgggagccagccagctctatcttggggatataactttccagggacaagagatgcctgattttgtgcagacacctgtgtcatggagagtatttcttatgttccaagcagagaagttcaaatttaccagtcttcctgtcactccacccccaaaatctggcgaccccactcagctgtttttcagggcccaccctcatggcaccttctggggactccctctttgctactgaggttgagacctagcactaggttttgtgctagaagcgccttgggggcagaaacccccatatgccagctgcccaggtcaggactgcatgttttcctactcaccgccaccttgccttgtatagaagaggtgtggccacgtgcggaatccgcgggcacaggcagcgaggccaatgaatggtatcttgcctgcggtctgctcttgggaagggtcctctagtcccggtgtccagggacccacaggctacgtcacatagtctccatgtcttcttgtgggaaggtaccgtgtgagtctttttaaaaagtaatcttaaaagagaacatctttgactgggcgcagtggctcacgcctgtaataccagcactttgggaggccgaagcaggcagatcacacggtcaagagatcgagaccatcctggccaacacagtgaaaccccgtccctgtcgcttggaatccctggaagaaagcagaaccgagaagagaagcccgggtttaacgctgtggtttcttttttgcaagataaaaccatgtgatttagatatatgcaaacaaatcttgagttaaaggaaactgagtttcaaattagataattgtctctgagaaaggcattcatatatctcatatttcatttctaactttttatcatagaacatcttaaacatacaccaaaatagagaaaattataatgagctcccatctgtcacttgccttcaacaatgatcaacttatggccaattatgtttcagctacaacccaatctcgccccattctaatttttttaaagcatatcctaaacattgtatcattttatctgtaaatattttagtatatatctctaaatatatatgaactcttatttttaatagacataatcgtaatcatcatgattttaggaaatgattttaataaaaatcacacccaattcacgaagttaaaaaaccctcccaatattcacacccttctcattactcttggttttaaatgacttttcctgttgtttgaagcctgcgttgcagtctgactctgatccttccaaaaactgctcctagagaagctagaggtacactctgagattaagctacctcaacttcaagcctctggattctgggaggagttgagtccaccctctgatctagagtttccaggcatggctttgtgaatgcacctaccttcttcccagatttttgcccgtctgaccctcttacatgagaacatccccatacatggctgtggaaaatcctcaagtgcaatgaaggcaagactgaaaacagagccgctgccaaacagagcagcaagttgaagggcaagtgcctgtcaacacaatccccttgaaagactataaagagctgccaaaacatgagatgcatctgacatccagatagtattagctgactgcttcccaaatgggttagctgtctacagaaacgccctaggtagctgatatgaatcgcaaatgtgctgtgacttgattaatttgtaacagtcagaaattaggtagttcagtgctagtcatgctcaagcttagtagtagctggtttagttgttttttgttttttgtttttttctgtgggtaattggatctaggatgatagtgtaccatcccccagcagtcatagaagacatggtaaaaactagctttacacgggtcctggacttgaggtcacgggtgtggaaggtgattcactagggagttggctcttagcttagtgggtcatgtatttctgagaagcttctttcctgaggtttacagtcagtttcagaggtgaatgaactgcttcagatgatcagaaagatacactctgtcattattcccccaagaataatctttgcttctgtagttacattaaagctaaattttgctgccagagtaggagccatccattatattataatcgatgacatgaatgttttgctcaagttcagatgtctaataagagtcattttctttccgagggagtgttatcagtttcatgaatatgcgctctgtatttcattagcattcttctagcaaaacatgattctgagtcatttctgaaatatctgctctcgcctgcaacttgtttctcagtttttacaaaaattgccttttctacttactggcagaaaagtttgataccacacgagcctaaaatgggtatgctgagaaaaaacacagcacacctatggaaccgtgaccacaacagtgcatcggtctctgtcccaccgtctcattcgaggttaatccctctccacagggcggcacctcagcagggaagggcgagtctgaggactgagggtaaacagtcatgacatgggtattcactatcatggctttcttagatttttaagccagaatgaagttcagagagcttgtcagaggatgttgaatgaacagaaaaggaaatttggaacccatatgaaaagagctgctttatgaatcacagagagcttttgagttccagcttacagtaattcaaataccactcacttatattcaactgagagcagctctggcccagccttgtcccctgaccccggggacactttctctaggatgaacaagagaaggtgttctccactgtactagctgccagtgtgtttctttcaaccaaggaagtatccatgtctcttattctatgtcattattgtaagaatggtctaccttgatccttagaagccaaccaggatggagtcccattttgcagagtctgctgtgactgccagccacccctgtaccatggacttccacagcaatgatgctgtgctgcatctccatccaaagggattgcatctgttttaattgcttgactttcaaggacactcagggacaggtactcttccataattctacgtcatcccagtttcacaggggcgtgaattccccatcccctgcaaggtctactgctctccaaagtgtgtgtctttgagatggaggctcttcacagggttcaccacctctgcaagtagggctgtgacaactcagccttgtgcactgccacaaaaggcccttcaagagcttctagaaatttctggctcacagaagccactggaatactgtaaatggagttggttttggtggctctgtcctttgatgggaggctctgtctcctgaggccaagattgaaggcaggatctgaagattgtgcgcctggatcaactctaatcctttccagcccaagagagttgttcttgcttcttcttggactgttgtgagaaacttccacactgactgcttggaagtgtcacatgttggacctcttggtaccagtgtctctgacagactcataccactgggagctcagagcgagtggctgaggccagcagagctgaacacttagtgccctgtccctgcattctgtgggatcaagaatgaactggaagtaggatgccgccctagaggaggcacaggtgctacagaggcagctcagctcaggaagcggacgtgaaccccttcctaccccccattagtgctgtggccatgaggccccctcacctgagggggaacacctctgtcagcctggctatctgccaccaacaaacacttttcctgggaaggggcctggattcctccagttgagcctccttagatgcacaggttgcaccagggtggaggccacagccaaaaccaaacagtgtagcatgaacaggccaggctcccagagtgggaagggaggactggctggaggcagcaggaggctggagccacatttgcctgcaaaaagtcttttcagacgcacatctcaggccagttacgcaactggctcctggatccctctgcccaggcccagtccctcccattgcctctcagtgtaaagcagggaatgctgcaggatggagagtcctaagccttaatcgtggatcttgggattcagagtccagagaggataaagaagcaaattcacagtcaacacttcctttttttggatgtttaccatagtgaagttttgtgcaaagtgctatgcggacatgatctgacacatcatgttcccccaccctcccggcccaggatctgaaggtccagcaggagaggcaagccaatgctaaccaaggctcaatctgatacagggacacagactgctctggacttccgtatatgcctttaaaaatatatatatatctttaggctgggcgtggcggctcacgcctgtaatcccagcactctgggaagccgaggtgggtggatcacttgaagtcaggagttggagaccaacatggtgaaaccgcatttatttattttatatatatataattttattaataaataccctggaaggaccttgttcctttaacgtgctggcacctatagcagggaccaaatttgtacttttacaaactgtctgtactggtctaaggaggagcagaggcgcacatacaatagctgcttatgcagaatcactggaaaacaggtgattcctgaacgttgctagatgaatataactcagaaataacccacagcctagattagtaatctgtgaaagttggagaccaaatgaaatttgtttagcaataaaatgcttttgaagagaatttctctttctttgatgttcttgctcattactgtacactctaatggtgttgggctcagaactattgctcaatagaggtttgataaatgaatgctccagaagacacacagaggctatcagtgtggtcgttgtcaatgagtgtcccagacattaaataagagcctgcaatgcctgagagccatgcgcagagatcatgggactgacacctggggagaggttctgaagggacctaagcacacagacaggagggaggtgtcatcagcagattcatccagccccatgttttgtagatgaatagttccaagacactttttaatagttatccaatcctgtatctcctgagcatgctcagtgccatagagcctcagtttccacatttccaagcagacttttctgttctctcataagcacatttgagaaaggacttgtttccccttgctgtcataaatgcccttgctttcaagttcaagccaaaaagaagcagtgcaattgttcttcaagctgatccggtgcagaggaaccgcaaatgccagctccagctatggtttctaattgaatatgactttctttgtaaatgcctgtccttgcccccagcagcaaactgacaactaggacttgcctttgtgagctgaaatgatgtcgctgataaccaacagcttgtattaatttttcctgataatctcatagtacttttaatgagattggtggcaaacatgccattctggggcaaattaatttgtccttgcaaaacagagtgtcagcgatttttatttcctttgtctgacgtgtaaatgggttgtttccaatggcaattgatacaacctagtattttcggctgcactgaagggagaacaagattttgccaagagcaacaaaatcagcacaaccacaattaaagcagatgatcgacatttggaaaatggtctgctgatgtttcttccttcgttttccatgctgaaataggttgtgatttagacaagggccaaagagatgaacaaggcagccagcggctgctcagcctccatgtagcctggtcatggagaagcaaaatcgacatgaaatgtgaccctctctcttttatgtgctttcacatgctgtggtcaggaaccaagtactgtatttgcattcactgctcaggcactgtgcggtgacctgcttttatgccactttgcattgctgaagtgatgtgggtgaaaactggaatcctagttagaaggaaacatggcatccgactcttccattctctcatttccaatgtattgtgttgcctctctcacccgccaaagaaatgaaatgtgattttctaccagagttggaagagttttggccacaatataagtcattatggcagtttccattttctttgctatacattttgaacaaggaaccacagttcatggaattgcattgaaaattaacagcttttttttttctttttttttttttggccaagctagccagaaaggaacttgcatgagaaattcactaatgctaatgcagtttttcaagtggtaatatttctagaattttaattaggactttttttttgctttgaagggtcccatcacagaagagaaaggaatgctaatatttgtctttgatggccagcagggtcctggaggacattaacgttttgcaagctgaatgaggtcttcccactgacacgagcataaagagcaggtggatttaacagctttcattccattttctatttagtttaatcaagataccagttaagaacaaggggaggctgctcccagagcttctctgtccttttaggggttgaccctactggctcggctggctgtggattagaccacacctgctacaaatcaacaaataatgaacttcggatgctgagaacctgaaacactacataaaagagggcataaacaaactcttctttttcaacatatgatgggcgattgaagcggtcagtggaagatagctgtgcacaagaatgtgggcctcctcccttgagccaaggtctcagttttatgattcctaacttagagttaaaagaagcaagccatacaggtaaatgattatcaggcagagaggcctagaatgcattacagttatgcaaaacctgggtttttcataggtgtttttaatgttggtgtgaacagtggagccaaatagcatcttgtagcccctacgtgggcacgattctttcctgggcgacaccgtctgcatgccccatggtgacattcctgtgcgcttgctacagttggctagtaatcctggctttgaagaaggttttccagtgccaatcaccatgttcaagacaatgtgtgggccagtattctgggtcatgcgtcttccccaggagctttggttaaagtgagtttgaggaaaatatgggtgctctcagatgctcacagaccacgtggatgtgaaatttagacttttatttggatgataataaagacagactttaaatgttttcagagtaactggacagctctatctgtctcaataactgcaggcagttcaaattcagcaggaaactactcaggttcctcctagccctgccccattctttataacatggaaaccctgattccccccgccgaacactttccttcaggtagcaggatttttgcttcaccgtaaacacaccaggatcacggatgatgatagcatttattgcttggaataaaaagtgatttgcggccctgtaaataggacagcaaatagttttgcttttgacctaaggctcccatgtcacttcatgatttcattcatcttcatattcaaaagaaggataaataaactgctttcctgcttagtagcttggtcatctgaaatccagtatctgacatcaattcccagtgggagaaattgtgctttgctgcgtgtgtcttaactcagtctctgatgttctggttctgactcaggatgttggtgacagctgcaccacatatgccacgtctttcatgctagactaagaccagacatcttttctggtgcgcatggagtcacactgtgacctagaagacagtgctttgaaataatgacaaagcacagaggcaaggaatgaagttgacattgcataccaacggcatcatcaaatttgtcctcaaatgtcactgtgtaatgctgagtgatttttggaatctccctagtttcccccaagcaaattacatatcttcataggcacatcgatatcaatgttttgaatgtaatatattttaatgaatatgtaaacatgtacaaataaatataatgaatataacaagtatgactgtcctatatgagacatagatattttcaataaatgtatatttattatgaatatatatttataatataaatatcaatacaatgttgttgaatgggtgaataaatcctttaaagcagcctcaatgttataagtagtcactgtgattcattcatctcatacaagcattctctttctatggatgtaattaatacttatggcaaattgacttttcttgagtctcatgaaatagaaaaattcctttctgacattttgactattctaatatggcacaatattataattttagtgcatgtaatcttttccacccagaaaattggcactttctaaattcctggtttcttatttgaaaacaaaaaagacaaaaattatgacaaatactaccaaattaatatttaaattatatttgaatggcaaattaatacttaaaattacattgctaaaaactaattccagatacggagcaaacttaaatgagaaagataaaacaatttaaattttagaagaaaatataggagggcaacttcatgattttggccaaggcaaagatttcttaattaggatgccaaaagcaccattaaaaaagtgggtaaaataaggcattgaaataatattgggggctgggcacggtggctcatgcctgtaatcccagcactttgagaggccaaggtaggtggatcacctgaagtcaagagttcgaggccagcctggccaacatggagaaaccctgtctctactaaaaatagaaaaatcagtcaggcatggtggtgcatgcctgtaatcccagctactcgggaggctaaggcaggagaatcacttgagtctgggaggcggaggttgcagtgagcagagattgtgccactgcaccccagcctgggacagagggagactctctcgaaataataataataataataatattgggtacagataataatttcctccacatgtgtgaaaaagaaggttatgagaatcagaaagcaggaatttagacaatatgtaggggcagcagatttcccttgttttgtaaaacaggcctcagagaggagtatcaacttgcaaataggtcaaaaaccctttgagggaaggaagtttctgggcagcagaagctttaccaccatccactgtcacatggatagggattgcaacatactggcccttcactaataacatctcgtcccatttggatggcaaccctgtgaagtacatatgatcatgctagggaaactgaggttgagtgaggcctggtgccatgcccgaagttgggctgctgtccagtggtaaggcacgggctagctgtgtcagccctaaagggcaccccactacatatccccaagatacaggccacggggctgcaccctcagccacggcccagcgtccccaaggctcagcatgagtttgcatctgctccttccctaggaagtcatttatttacataaatgactaatgatcctgggcaagggctcctgttgggccacatgttctgctttttaaaattcagagcctaggtcaactgtttgatagaaaaatgaaaacataatgtaaattctaaataaagctgatatgcaaagaaactgccctgttaacttaccttacttgtagatcatattttcggtggaagtctgttcagtttaaagataaacatgacatgattagaggagaaagaggatagcccctccctttaagctccaagataattcaagacatcagttaactattgagcgattagagaaggtgttttgggagctgaccttgacctagtattctcaaatctccttcccctccataaggcctggtatacttcatgttgctggcagtcaacatctgtctggcttatgaagaacgagataatcacactcattttggggcctcaggctatgagcacctgagtgtgttaatatcaattaaaaaccccagtacccatctgttgaggtcaggactattaaaagtcaggcgtggctgggcgcaatggctcatgcctgtaattccagcactttgggaggctgaggccggtggatctcttgagcttaggagttcaagatcagcctgggcaacatgatgaaaccctctctactaaaaatacaaaaaattagccaggtgtagtggtgggcacctgtagtcccagctacccaggaggctgaggtgagagaatcacccgagccccagaggatgaggttgcagtaagccatgatcgtgccactccacttcagccttggtgatgggagtgagaccttgtctcaaaaaaaaaaaaaaaagaaaaagagtcacgagtcaggagtcaggtgtaaatgcctgtatatcagactgtattttagaaatttgcttttaaaagttacccttgtgactgagactcaaaaagaaacttccaggatgaatgttcaagctttttttttacttaataaaaatacagctttaaggctgggcatggtggcccatgcctataatcccagcactttgggaggccaaggtgggaggatcatttgaggtcaggagttcaagaccagcctggcaaacgtagtaaaacctcgtctctactaaaaatacaaaaattagccaggcacagtggcatgtacctgtaaccctagcgactcaggaggctgaggcaggagaatggctgaaacccgggaggtggaggttgcagtgagccaagatcacgctattgcactccagcctgggtgacaaagccagactctatctaaaaaaaaaaaaaacaaaaaaaaacaagtaaaacaaaaaattttgcctgtgatacgataatgagtttcttttaaaacttctgagattagtgtcttagagatttaactgttgtgttttgctgctttcagcttgttctccctttaaaaaggcctgggatcattgctgtctccttttcctttttcatcagctcctgtgacgttttcatctcaacactttgggaggctgagatgggcggatcacttaggccaggagttcgaaatcagccttgccaacatagcaaaaccatatctttactaatattacaaaattagctgggcatggtggtacatgcctgtaatcccagccactcaggaggctgaggcatgaaaatagcttgaaaactggaggcagaggttccagtgagcccagccaagattgtgccactgcactctagcctgggcaacagagcgagactccatctcaaagaaaaaacaacaacaacaacaacaacaacaacaaaatgatcccccaagaatcaataataaccagaataaggagccattatcagatattctttattactcttaattactgttaggcttcaggaagccactagttgggtacagctgcccaggactaaacctgtttcttacaaggtcctacagccacaaaaggtggacaccacaacctccatttataaaacagaaaacttaaggctgttgttttgcaaacacatagattaataacatggttctgtaggtggacctaggagcattaatttttccctctcttccaattataattttcttgtttaacatcctagtaaagtttatgtcttctaaatttcatgtaaagatgatacggtctgtcataagtcttccaacccattctgtcttctgaccccacaaatgaatgcatcgtgccattgggccccttagttcaggtaccaaagatttttactcctcaaaggctagggaaggcctgcccccataaagtcagcaggaagcacttacagaaaagggactctgctcttctgcagtccccttaagattaaggaggagtatcgaatctctgagggagcaatgagataggaggtaggtgggactcaacccaggaccagattgaagactggctgacacaaggaagagacactggaagcacctgtccataacacatgcccaccagtgccatatcagtttaccattgccatggcaacacctgaaagttattgcccattttctagctatttctgaataacccactcctttattagcatgtcattaaaactggggataaatatgagtgcaaaactgcccctacgctactgctcttggcacaatgcctatgtggtagctctgtttcacaagaacagtcacaaagctgtaacactgccacctcagtaaagctgttttcttctaccaccagcttacgctgcattccttcctgagtgaagccaagaacctgccctgcaccacttttgtcaagtcagttgacataaaattactcataatatcctctctttattttttgactcctgtaggctgtgtaatgacttcttcctttccatttatgatattgtgttttgtgtcatttttctttccctcttctttttttttgagacagattcttgttctgtcacccaggctggagtgcagtggtgcaatgttggctcactgcaacctccgactccccagttcatgccattctcctgcctcagcctcccgagtagctgggactccaccacgcccagctaacttttttgtatttttaatggaaatggggtttcaccatgttagccaggatggttttgatctcctgacctcgtggtccgcccgccttggcctcccaaatctttccctcttctttatacacccttcatcaagtagtcacaggtttcaattcagttctttcttggtggtagtatggctcatgaaaaaagctgattcttctgtgtttgaggccattcaccatgtttatatgtaatactgtaaaaagtcctgtgacataagcctctgcttcacaaactgaccgctgtcaaacatcatctccccaccaatagataatttttttgttcctcaccagtataattcacataggagtagaaatctcaagtttaaagtgtggatttgcactttaccacttggtgtattcaagaagatgaataatattaatacatcagtagggccaggcgcagtggctcaatcctacaattccagcactttgggaggccgaggcaggcagatcacctgaggtcaggagtttgagaccagccgggccaacatggcaaaaccccgtctctactaaaaatatgaaaattagctgggtatgttggcacacacctgtaatcccagctacttgggaggctgaggcaggagaattgctttaaattgagagatggaggttgcagtgagccaagattgtgccactgcactccagcctgggtgacagagtgagattctatctccaaaaaaaaaaaaaaaaaaatcagtagctttgaattttaaacatctatttgacaagaaattcacagttctttctctcttaaataacgtaataattctttcagtaatgagcctggtttgatgcctctctccccaacatgataaaagtatcacataaatctatgaaaaattcaatttccctgttcctacaactgtctgggatggaaaacttcttcccttgctctagtcctttcttctacacctagtttcacctaatctgtgactcaaaacaatacttgtcaggaaacattctggaaagagcaaaaggcttctaagaggtgtcagagattcctggaccaacatctgtccatctctagagggggttgtgagtatgaggaagagcagagcttgtaaatcttctccttgctttcactcccactgtatttcctaacaacaacaaccacaaccacataatatcatagaacaagcatctactacttccaaggctttggtctcagtaaatcttctctacctctatcacagcatctagaaggtttgatactcatacaaatagtgctgtagctttcttttcataactggaaaagtgggcaagactcagtgtaatgcaggcattccttaagctacttagcattcagtttttagattatcattgcacacatatacccagcatatgtctaatatacatgtaaaaatccatgaagcaagtgttatattagcttgtgttttctattgtattaaatttttctcttatatcgtcttctcctttttgtcattaaaaatctgttcaagtcagtcaattaattattggatcataagtagataaagtcttttatttcataacacattgactcaatgaatatgtttctttgcaagacacagtcctcatttccaagaaaacaagcctgaaaagattatactggagcaagtctacaagtaatgatggtagtttttccttattgtcagtcctggggcaagaataacataaaagataacaaggtagaataaagattacataagaaagaaggacagcaacaggacatgggaactatttatagggtaacatttaaataatggatgatgagaagtaatgcgttagacagggatggatgggaatgattgaaggtctgagtactttagcacagattaagatcaaatcattaggattttaagagttgtgtacagttactgaagaaaatgccttagaatttaatttgactgtggataaaacattcttggattagatttaagactattttccatggtaagtatatttataatgatgatgactgtagtgctgaacatttaaacaatgaaaacaaaattaattgccacacacataatgtcctgaatactactgtaaatgttttatcttattttctttaaactgtctacagcactgtaaggcaggtaccactattgtcacagttacacagatatggaaaccgagacacagggaagttaagttacttgattaatttcaagcaatcgggaagccatggagcatctatgtcagggctgccaggacatgtgactgtaaacagaagtttttaactcaaagagggtatgtgtctgggttaatggaaagcttcaggaccctcagaaaacattactaataagcaaatgaaaggtgtatctgggccgggcgcggtggctcatgcctgtaatcccagcactttgggaggccgaggtgggtggatcaccaggtcaggagatcgagaccaccctggctaacacggtgaaaccccgtctctactaaaaatacaaaaaattagctgggcgtggtggcaggcgcctgtagtcccaggcactcgggaggctgaggcaggagaatggcgtgaacccgggaggcagagcttgcagtgagtggagatcgcaccactgccctctagcctggaagacagagcgagactccgtctcaaaaaaaaaaaaaaaaaatgtgtatctggaagattaagttctaacagactcttcatttccatagatccaataatgcacttagggagatgactgggcatattgaggacaggaagagagaaatgaaaacacagccttttatattgttcttaacagacttgtgccaaacattatacgggtgtatttaggtgattgaagagaagaaaggcacaggagtgaaattctgtgagcacaagggaggagttctacactcagactgagccaacagacttttctgacctgacaaccaaggcggcgcaggatgctcagtgcagagaggaagaagcaggtggtatctgcagctggaagcccagctcccaccccagctgctttgcatgtccctcccagctgccctaccttccagggcccatatcaatgcctgggtcagagccctggggaggaactgctcagttaggacccagacggaaccatggaagccccagcacagcttctcttcctcctgctactctggctcccaggtgaggggaatatgaggtggttttgcacatcagtgaaaactccatcaggagttttctctgatcagcaagaaatataattaaaattcaaagtagatcaacaattttggctctactcaaagacagctggtttgatctagattacatgagtgcatttctgttttatttccaatctcagataccaccggagaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataacttacctcccacagtgattcaacatgaaacaaaaacctcaacaagaccatcagtgtttactagattttaccagctgcttcctttacagacagctaatgtggccactcagttttagcgtctctgctctatttggacattttgcagttctaaaaaaaaatcattgaataatttggactttgattcttggactctcttcaactgaggcaccagaatcccaggtttccagaaatagtgactcactgtatgaatccttatatagcctcagtggttcttaactttcccagtagaggtagctcagtgcatgctacactgctccatttgaattttgcaacattctaagtagtagaaaattctatttatttatccaaatagttgactcagtaaaagctgttcatgtgaagatactaccatggctgaataaatcccattctttttctttcttcaggctatcaacatttcagtggcaaatggttattatggaaacatttgccatttaaaagtgaactaaattatttcttcaattttctctgtgatgcagtagactgtaaaaagattaaagtttgttaaaataaagtacatattcgataaggaagaaatagattattcctaatgacgtctgcaatgacctagtagaaggagtgatagaagcagttgttttcattatttttgtccaaaacttccttccaaatgggatttcattgatcatattcatttattaccacctataagacatgttgacattatgtaacatctgatgtgaagcgctgaggatacatctgtctgtattattcttgccaaaaattaatggtgtgaattgaatcagtagtaaacatcatatacaaacccaactaggaggacattcttcaacatacctggacagtaaacttcaaatgtttgaaggccatgaaagagaaacaaaagtgaaaaactatcacagatttaaagatattaaggacaggataaccaaataaaatacagaaacctgaattttatcttgtaacataaaaaaagtcatcaacgggaaaaatcagtgaaatccatatggtattttaaatgagttaacaaataacattatatctatgttcatttcatggttgtgatacttatgctgtggttatttatgatgctgacattagagcaagctgaaagaggcacatatgggaatcatttttactatatttttcaaattttaggtctaaaagtatttcacctctctcctgcatcctgggattgcctccaattaactacctgcttacaagacttttctttattttctttttgccttttattctttacatgtaaaagatgagtccatctggagcttattttaaagcacagtatgaggactgacattgacctgtttttttaaatgaaataactagctgtcccaaccctgcttgttggataacactgctctgtttcaggagtacccccactgtcatacacccgtgggtccatacccctgggctctccatctgggcactcccctgcctgtggcacctccttcctgagggccggcctcacccagggcccagctgccctctccatggcctgtgtcttcctttcctgatgcctcagatttcccccattctctggcactctttccatcctcctggcctcactctgcacctcccctgaggtgcaggactgccctgccccagcccccagcttcctcactcccaaagccttgtgccactgaagcacgagctccagagtgcacctggatggcagcttctctcctggccaacaaacgcctggtgctggctgccctcccagcatctcccctcaactcctcagctccaccccagggccttaacacacacatgcatagcacacacacatacaaacatatgcacacacagacatgcacacaaatgtacatacggacttacacagacacatacaaatgtgcacacactcgtgcatacacagatgtgttcatgcaaacacacacgtgcacgctcacaggcacgtacacatgtgtaggttatgctaagaaatccattttgtgtggaagacactcaggctcaaatatgtgtccaaagtcacacagctatggagcggcagaactcaggtctctagtgcacacagccccgacttaccgcagttccacttaacagttttcaactttatagtgatgcaaaagccatccacagtcagcagaaaccctcgtgtgagtcccacacggccagtttttcgctttcagtacagcagtcaatgattacatgaggtatccgacacttgactacaaaacaggcttcgtgttgatgcttctgcccaccgcaggctcagggcagtgttctcagcaggccaaggtgggcccccccacgctgtgctattcggtagtcaggtggactcagtcattttccactcgcagcggccttatcgggccgcagccaggggtaagttgagcagtgtctgtacttttagctccaccctgggtatttttaagtggcagatttacaacaaaaaataaaaataaaaatgaaaaaatacagcgttccaaatagtaggggcataaaaggagagaatgcacgttgcggtcagcccatgcctgggagcataagcacttcagaggcatcaccaggcgtgactggctgttgttcctgctcttcctggcagcagcggcctgggcctgagagggatcgccctggccacagctgtaggcaaggctgctgggagccaggagccgccgcgctccgcggtagcgagtctgcggcgccacctcgtgggtgctgcgtggaactccccgtggtgcgggccgggaaggccgggtccccacaaagccggagcccgagcacagcggtgcgagctcgccccaggacatcccacagcacccggagacgggggctggtcccccaaaaccctcaggggtgagaggaaggaggtccccagcctgctgagagctgtcctctgagcacgcactcgcgcacactcacacgtgcatgtgtgcatcctcaggcaccctgacgcgttcacatgcacgtacacgcgtgtgcacacgcacagtctttcacaagagtatgacgcattcacacaagagtgtgacgcgttcacacgcacgcacactccctctccctcgagcctggaaggtgcactgggctcataggggtggaaacctctaccgcggcagaggcacagcaccagggccaggatgctcgcttttatttcagacgtgaaaaccgaggcccgaaagagacagccagtgtccaaccctgtccaacgtctctgctgattgcgcctcctgtgtgtggccggggccggtgtgagggcagcgggcccaccgcatgcctggcccgccccagggcctcgagccacttcctcaggagctgctggcagctgcagcgacggcgcacccagagcccgagggtcccatggagccaggcttcccagcacacaggcacggtggagcctcggggtgggcatacaccccgcgagctcgcgggggctgggcactgcgggtcctcgggtggggactctggagttcagtcttgaaggacacagtcactgagggtcagggaaccaggagggtagggagggtagggaggggtgcctaggcctagtgggagaagcatgtgaaagttccctaagagggctgggggtgaacaagctctcggcccggcctctccgggtagactgctctggtgccctggagcctcccttctccaaggccccatggacgcccccagaggggtgacgccctcgcccacgctgagctctgagtgctgcacgagaactcccagagccgtgtgcacacgcactccccttgttataaccggcattaagtgcactcacattgtcgcatatcccctaccaccgtccatctccagaacttcttcatcttcccaaaaggaaaccatacccactgaacaccaactccctccttttgttaaccattgctctttctgtatttgaatttgcccattctgggcccctcatgtaagtgaaatcgcaatgtatttgtccttttgtggctggcttattccatctagcacaatgtcctcaaggttcatgcgtgttggcacacctctcagaatttccctcctggctgggtgatattataggctcacgcctattatcctagctgttagggagacagaggtaggaagatagcttgaacccaggagttcgagacctgcctgggcaatatagcgagaccgcattttccacaaaaagaaagaaaaaaaagaatctccttcctggtaaaggttcagtaacagtctactgtatgcataaccacatttcgcttgcccatccactcacccatagaccctcagaatgcttctaccttttgactcttgtgaatcacgctgctttgaacatgggtgtgcaaatatctgtgagagagcctgctctcaaaaaaatccatattcttggcaccatgaagaatcacctctcacagacaccagcgaaaagcaagtctgtctgagagcagagggtgaggaggggaaagccgggctgcggatcacagtgggcggaggaaagcccacccttgtgctcccatgtgtgggaggagagaggagagatgccctctagtgaaggaactcttgtagcagccagctccattcctgcttggcctgtggagggccagctcaggaacccagaccaggaagaagtcaaatgaccgacaagatccatcaggaagcagaagtgtgctgtgtctcatcggcaacaacaaacagagctaggaccagccacccaccccccaacccaggggaaatgcatccaccacacaactaccaccgctgcgctcatgacactctcagagacaggcacgggagctcctggcaaggcacaaccagggcaagtgacagtttgccagtcctgggcaagcagacacttatcctctctccagtccccaatcccaccagcctgcacaagcagagaaacatcctgcataaattaaaagatcatccggatcatcaaaagatctgagcaaacaaaacgactgagacaaaaaacaaacaaaacaaaacaaacaaaaaacagaacaacaacaacagaagaacactcatttttacagagagatttgagcccatcccaacagagtacaatgctctttccaagctcatggatggcgtttgggaaaatttagctgtgctaaaggagcaggaagcctcagcccctttcccaagaattgctgttacacaaatcacattctctcaccagggtgcaacaaaattagaaacatgcaataacaaagaccatgttaaaagtgcattttggggccgggcacggtggctcatgcctgtaatcgcagcactttgagaggctgaagcgggtggatcaccccaggtcaggagatcgagaccagcctgggcaacatgacgaaaccctgtctctactaaaaatacaaaaaattagccaggcatagtggcaagagcctgtaaacccggctactagggaggctgaggcaacaaaatcacctaaacttaggaggcagaggttgcagtgagatgagattgtgctactgcactccagcctgagtgacagagtgaaactctgtctcaaaaaagaagaaaaagtgtgttttggaaacaaagttagttttcacaatgaaaattataaaatgcctggaactcaatagcaatagggtattacatattaaaattatgaaactcaacaaaattgacatttagggagaaatttatatcctcagattaatttgtcagaaacaggataaaaggagaaagctcatgataatttgagtaaaagagaaaataaaaactaaaatgaaaaacttttcagaaacaaactacaataagtgtgtgacctatcaaaatctctggatgtgtccaaagcagttctcaggggaaacgttatagctggaagtgtttgttaatatgcttcaacagaagacatataaaattatataaactaagtaaacatacaagaagcttttttaagggaaacaagaaataaatgtatttaattttaaaacagccataataaaagtagacttgataaataaaacccaaaaccacttctttgaaaagaccgttaaaaaaacctctgagaagtcaagcaaaagagaaagaaaaggcacaaattttaaaatgttagatttagaaaaatggcataataaccaacgtggagaagctgcttcaaatcaaggagacgggaggccagcttcattccatgggaggccagcttcattccagtaggttccgtttcacctggatgaaatggaagattttcttggaatgtataaattggcttagcaggaggcagaaaacctgaacaaacagaacaaacagaaatggtaagcaggtgctcgaggggctccatcagcctccagggatgggctgctgtgttagggagggccagagcacaggggaagtggagtgtaattctttctacaagattagcaagctgaacttgaatctcacacacgcacacacaccacagtgacgtggaaagaatccacaggacacttatgagaggtaaaaatagaaagtttctgcacaaaacaatcgtgtgtgtttaaaagataccatgtggcagaaaatagtgatgtttgtttgccagtgtctaggaagaaaccttgaaggcgcacgccagactggcggctgggttggctagggaggagacgatggggtgggagcagctaaggacgacacacactcttttaactctgttcctgcgttgtcgggacgtttacaaactgaagatatatatttttaattaattatttttttttttaaaattttactttaagttctgggatacatgtgcagaacatgtaggtttattacataggtatacatgtgccatggtggtttgctgcacctatcaatttgtcatctaggttttaagccctgcatgcattaggtatttgtcataatgctctcctttcccttgcccccaacccctggatagaacctggtgtgtgatgttcccctccctgtgtctacgtgttctcattgttcagctcccacttatgagtgagaacatgaggtacaaactgcagatatttatacattactttaaagtaattaagttaaactaaactaaatgtaagccaactacatgtaaataaataaaaccaataattaataacaagataaaaataattaatacttaaataattactaatttatttctcagctaaaaattaaaaatttagaaaatgtggaaatgtgtttcataataggaggatatttaaaatgaaagggcatttctgtagtcaaaggggtaggagactcacccaaacaagacacaacctcaaaaccaaaaggaaaactatcaggtttgattatacgaatactgaaaacctctgaatacatgaaaggcaaattctatatcccatgaaactacccttcagaaatgaagagagaaataaagacattctcagaggaagagaatataggaatttgtcactggtcaatttagaaatgctaaaaagtggctacggaaatatgttctgtcatttccacaatacaaaaaattaaaacaaaaaaatcaaaataaaaaaatggctatagaaagttcttatgcagaagggatgaatatgggactatgggaggagggacaaaggaaagacgagaaatgtggatacatacgcgagacaatccacagttcttaaaatcacatctgacgactgaaacaaaaactataccaccacctaatactcaagccagtgatttatacaagtggaaaaggtaaagagacataaatgcaaggcaggtttccacactttgaagtggtaaatactggtaccagtagactactatattacaatacacatattgtaacatccagagcaaacactttaagactatacaaagagatacacgcaacaacattttacagaaatagatcaagatggagggaaagaaaaaggaaacaaaaaagcaaataataaaaacatcaggcataagcaattatgtaacaataagcaccttaaatgtaaatggtctaaataaaccaaaagacagattgatggagagcctataataaacacatggcccaactaaatactgttcatgagaaacttcaaactcacttaaggacctaagtaggttgaaagtaaaagaatggagaaagatatcctgtgaaatcattaattttttaaggaagcaggagtgactatattaatatttcatgaagtagacttcaagcaaaataatttaccagagctggagagggtcttcgctgaattttaagatctaaaatttcctatgctgccttgacatctttgagcctcacagggccccaaaggcctagccgtgggttttcctgtttctaccagacaccccctaccccgccacccaacaggaaaggctccccacctggctagttcttttatcagccagaacagttgcacctcagcctaagaagtttcgcttcacctgtctgccagcccatgaatttattcaaacaagccaattgcattccccctcgggaaccattggtcatcgtgtgctcttgttactaccaagcccgcctgcttcctcagcccgcagccctcactccactacagagtgcggtgcccatctgaccctgtgtggcatgcagtgtcctcctccgagctgtgggtatatgcgactaaaacactgctgtcaatctcatccatccacgccaggtgtcatgttcggccatctcctacactttagggcagggacccctccttcaccaatggggtgaaaaggaagtgaccataacaactgcttaatgacaaaaggattaacccaccaagaagacatctacttcaacatcctcctcttagcaactgttaaaactaggcagaggccgggcacagtggctcatgcctgtaatcccagaactctgggaggcaaaaacaaaggatagcttgaggccaggagttcgagcctgggcaacatagcaaggcctcatctctccaaaaaattttaaatttagccaggtgtggcggcacacacctatagtaccagctactcaggagattaagccagggggagtacttgaccctaggaagtcaaggctgcagtgagtcatgttcgtgccaccgcactctagtgtaagtgacagagtgaaactaggcagaaaaggagcaaggatttacaaaagatctgaacagtcaaccagcaaaatctgacatccgtataacaccccactccccaacagcaaaacacacacatttttaaagccaatagaaatctaccaagatgaggtacacttggggcaataaaagaactcacagcaaatctcgctgtgtgcccctctgcgccggcgccgtgcccctctctgcgccttcttttctcaccatggggaagcgtttgggggcctcttgagggaccccctagatgcttctactcagagcccccaaagccggggagcctccactcctctgtctgcagcctcccctgtcggttctcgctacccagggttcagtggcctgggggtgacggagggggtcgcctctgccaaggcccctcccggcgcctccctggctcatctagcccaccttcctcccacgctggctcacgcaaagtgctctggtcaccaggagcccttcctgaccagccccagccccttcttggccttcgcccacctggcctcccctggagccctgacctgggtgccgggcctgctgggtccagagcccaccccgccctgaacaaccccgagtctcagccaccctcggttcttaccctttcacagctggggagtggagcctgggcctgcacctctccgcgccagagccggcgccagcgcctctccgcgcctgcgccgccgctgcgcgcctcgccgccgctgtctgcctctccgccgctgtccgtctctccgccgcgccgccgctgtccgcctctccgccgcgccgccgctgtccgcctctccgccgctgtccgtctctccgccgcgccgccgctgtccgcctctccgccgctgtccacctctccgccgctgtccgcctctccgccgcgccgccgctgtccgcctctccgccgctatccgtctctccgccgcgccgccgctgtccgcctctccgccgctgtccgtctctccgccgcgccgccgctgtccgcctctccgccgctgtccgcctctccgccgctgtccgtctctccgccgcgccgccgctgtccgcctctccgccgctatccgcctctccgccgcgccgccgctggccgcctctccgccgccgtccgcctctccgccacgccggcgccagcgctgtgtgcctttgcgagggcggagctgcgttctcctcagcacagacccggagagcattgcgagggcggagctgagttctcctctgcacacacttcggagatacagcgaaggcagagcaatgttctcctcagcagagacccgggcgggcgggccggtggcaccgcgagggcggagctgcgttctgctctgcacagaccttgggggcactgcctcgctttgggacaactcggggccgcatggacggtgaataaaatccttcctgtttgcagccctgtttgtggttggtggcagcgatggacactgcagccagccagagcgtagaaaggcgtcggggtaagtgcgctatccaggctgcactgtgggtggcctgggacgggttgggagccctatctcaggcgtcactgcccgtcttgggtggccggttgggtgtgctatctggggctgtgctgcctgcaccgggcggggggtggggggtggtttgggggccaaaccggggctgcactgcctttggtggggagccggttgggggcactatcccagactgtattgctggcaacagtgaggtgggctaagtgtgctatccggggctgcactgtgcggctgtcgggggggtggcggtttcgggttgagggcgctatggggtgctgtaatgcccatggtgtggggaggcggggcagtttgggtatgttgggtgtgctattgggggggtgacactgctggtggtagggggcagggtgggttgggggccatatcaggggctgcactgatggctttagctaggatttctggtactatgttaaacaacagtggtgacagggggcatccttatcatgttccagatcttagaggaaaagctttccatttttccccattccatatgattctagctgtgggtgtctttcctgtagtttttattatgttgcggtatgtttcttctgtgcccgtttctttgaggatttatagcatgaagggatgttgaatttcatcaaatgctttttcggtttcagttgacgtgatgatactgtttttgtcgtttatttggttgatatgatgtatcacattgtatgttgagtgacccttgggtcccagggatacatcccacttgatcatgatgaattatctttctaatgtattactgaatttgattcactggtattttgttgaggatttttgcatccatattagagatcctggcctgtagtttccttctttgatgcttttgtctgattttggtatcacagtaataatggtctcacagaataagtttggaagtattccctcctgtttttcaaaatagtttgagcaggattcgtactaggtctttaaattgtttggtgtgaagccatcagcagtgaagacatcagttcctgggcttttctttactgggagactttttctgatggcttcaatctcattacttgttaccaatctgttctggtcttggatgttttcattgtttaacctaagtaggttgtatgcatctaggaatttgccaatttctactaggctttccaatttattggcatatagtagccagttatgatcctttgaatttctgaagtattagttgtaatgtctccttttttaatctgttgattttatttatttgaatcttgtctcttttcttagcctggttaaaagtttgtcaattttgtttagctttccagaaaaccaacttttcatttaatcttgtatgttttttatttcaattttgtttgtgctacgatcttatttattttcttattttcggtttagtttgttctttactagttctttaagatgtattatttgaaggttttcttttgtttggatggtaggcacttatagctgtaaatctctgcctttgtactgctttctgcataacaagttttggtatactgtgttttcattaccctttgtttcatgaaatttttgaatttctgtcttagtatcttcattgatccgctagtcatttattcaggagggtagtgtttaacttccatgtgattgtattgtttccaaaattgcttttcttattgatacctagttttattcctttgtagtgaaagaagatggccacggagacagacagcagcgtggtcagagtggtaggagccggccatcagcgagagctgctccatgcctggctgctgggtcctagagcctgtggcccactggcttgcctcactgtggttggtggtggtggtgacagagactgcaggacgaccagatggtaggacaggggctatccagggctgcacctttcgcagtgtggggtgggttgagggcgctatccagggtgtcattgcctgcattaggggtactggttggtagcactgtacagggctgcactgcccacggcagggagggtgggttatgggtgctttctggggctgcaatgcccatggaggaggacaggttagggcactatcggttatacgctactggcggcattgggggacggaggtggggggcgctattgagggcaggactagcagtggagcgggggcgagttcggtgctatcaggggctgcactgctggtgtcggtcaacagagttggcatcccaggaaggagtggttctcctctccctgactccacactccagagggcgacccactcttggtcatactggagtgcagcagggcacgcagcgtttgcgtgggaatcctgagcatggcagagcccccacacccaccgtggttcctggttcctgggcctgtgtactgtgggtctgtgcctcagaggctgccaggcacccctggggacaccacgggggacagggccctgtgcgtggaggcgtccggaacaggaattggcacctgggtgtggagggctggctgggtctgaatttttctgcttctcctgctccccgaggagtgcagccccagtgggcccaatggttcctgtggagtggggagctgggtgctgtggtgtctccagcacccaccccagaccccagttcctgcccagcttgggccaaaaggagaggctggactttggagggtgggtgtgagtgcctttgctgaaactggcccctgccacccagtggccggcatgacaagttgaggctctaacccttccacccctcacgtctttctctaggcttttctggctttgcccgcccagctgctctgtgccaggaagaggaggagacacctagagcctgcgacaccatggctcgcctcgctgcgggtgggcggcagtgacggagactgcagtgcgccagagcggtaggagagcggctgcgctaggagggcaggcggctgcagccagggttgggggtcaggcttagagcgatggacgggctgcagcagtggccagatggtaggagccttgtaaggagggctggtgcattggcaatgggcctggctttgccctgcgcctgccgtggatctggccctgtactgccctgccttgccctgtacctgccctactgttacttggactctcggccctgtcctgctctggtcccatcctgaccctgtcttggccctgtgctaccctgtccctgccctggtcttgccctggcactggctctgccctgaacctgcactggcctgaccttggctctggccgtggctctggccctgcctcttgtcctgaccctggtcgtgtcatggcactggccctgccaatggtcatggtcctgctcctgttctggccctgacctggccttggacatgtcctggccctgctttggcccatccctgccctggccccaccatgggcctgcctgttctgccctctcctggcactgaccttgccctgtcatggcccagtggtgccattgccctgccttaccctgcgctggttgtgacttggccccgcttggtgctggccgctccctggacctgccctggacctgccctgaccctgcccttggcttttgccctgccctcactgtggcctggccctggccctagccctggtcctgccatatccctggccctgcccttatccaggccctgcccctgctgctgccctggccctggcctggaacctggtcctgtcaaggacctgccctgactctgccatggccctggccctgctctgccttgttcctggccctgacccagacccagaccctttcctggctctgcactggactttccctggccctgagctggcaatggtctgcccctggtcttgccatcaccctgccctgctgcgctctggatgtgtcatcaccctgccctggccctactctgcctttgaccctgccctggccttaccttggccctcaccctagtcttcgctagaccctgctctggagctggccctagcacagacctggccctgatcctggccgtggtctttgtcctgccatagccctggccctgaagtggacttggaggtgtcctggccccggcataacatggctctgcattggcctgtccctgccctgccgctaccatctccttgccctgctctgtcctgtcccagtactgtcccggccgtgctatttcccttccctaccctgccttggctgtgccctggctcggttctggccctggccccggccctgccctggacatgctctgacactgcctcagcctcggcactagcctggctctttcttggcatcagctctgctctctctgtggaccggctcttgtcctgtcctgcactggccataccatgccctgccctgccctgccctgactcagtcctggctcagccctggcccaaccttggccttggcattgcccctggtcatgccatatttcttgccctgtccctaccctggccttggccctgacccttaccttgctgtggccctgcccttgccctaacgcagcccctggccctgtcatggccctgccctggacctgtcctggccctggcccttccctgcttgagaacttgccctggttctcccctggccctgaccctgaaatgcctggccctaccctggccttgcactgctctggcccttgccctgactctggtcctgtcactggcctagccccagccctgttgctggtcttaccatggcccagaccctgccttggccctgccctgacactgtcctggaccctggctgtgccaagaacctgcactgtccttgccattgttttgctcctgccccgaacctggtcttccccaggccgtggccgtggccctggccctggccctgcccaggtcttggcactgtcctggccccgccctgccctggccctatgctttcctggccctgccttgccggccctggccctgccttggccctagcctggctttgaccctgccctggccctaccttggccttcaccctagccttacctgggcactgtgttggacctggccatagcacagacctggttgtggccctggtcctgccgtggccctgtctcagaccctagccctgccaggtacctgtcctggcccagctctgggcctggctttgtccctggttcttagatgaacctggtcctgctcctgcccttgctcttgccctggaactggccttggacatgtccatggtcctaaccctggccctgcccaggagctgccactgtcttggctgtgccctggctctggccctgccccggccccaaccatagacctgccctggttggtcgtgaactaccttaaccctgtgctaccctgggcctgctccaccctgccctggccctgccctccctttggccctgccctgaccctgccttggccctcacactggccctagcacagacctggtcctatgtgtggccttggcctggcattgacccctgctcctgaccccggtcctgccatggccctggccctgccaatgaccctggcagccctggccctgtcttggccctggccctgaactggccctgccctgaccctggccctgaagtggatttgcaggtgtcttgtccctgatgtaacctggtcttaccatggccctgtccctcccctggctctgtcctggccttctgctgaccctgacccagaccttggccctgccccagccttgtcctagatctggccatggccctgcgtctgccctggaccagcgctggcactggcatggaccctggccctggcccttcgctacttaaggccatgccctggcccagccctggtcctgaccctgtcctggccctaatttggcgtggctctaccctggcatgctattctggccctagccctgaccctgtccctgtccctgtcctggccccagccccattgctggtcctgccacggcccttgtcctgacattgccctttcctggttctggccctggccctgtcccagccctgctctggccctggtctgaaccctggccctgcaatagacctgccttggtcctgcccagaccctggctctggccctacctctgccctggccatacccttgccctggcctggaccccagtcctggtccttgtcctgccccagccgtggccctggccctgccctgcctgtgccctgttctatcctgggctggccctgccatggcctggtcttgccattgccctgccctagcctgccctgcttgtgccctagacctgccccggcctttgcccctgtcttggttctagccttgactgagccctggaccttccctgatcttgcctcagccctggcactaccctggccttgccttggcatttgccttactctctctatggcctggctctggtcctgccctgctctgctcttgttctgtcctggcacagccctggccctggccctggccctgccgtatcactggctctggtcctgcccttatgcagacctgaccctgccactgccttggctttggcctggaccttggccatacagtgaccctgccatgaccctttcctggccctggcctggaacctggccctgccaaggactcgccctggctctgtcatggccctggccctttcctggatttgggtgtgtcctgtcccttatttgccctggcccttccctggctctgccataccccttctctggggtagggccagggtcaggaccagaccagggcagggtcaggaccagggtagggccatggtaaggcctgaagatgggaagggccagggcagcggctggaccagggaagggtcagggccagggatgtagtaggactaggggcagagccggcactagggctgagccaggacagagcaggagagattacattgggctattacgtaaaatttttattttagatttttaagataactatagtagtagtaatgtctatactatattgtttgtaatagtaataatatttgcagtaatcactaaattttaactaatactatctttgcttccagtagtgttctatgagtataattttatcaatatgttaatatgtgaggcattgattctcacaataattctatgtgctaggtacttaaagcatccccattttccaaatgtaggaaacaggcataaagaagttaaatacttggccagattactcctgtaatcccagcactttgggaggccaaagcaggcagatggcttgagctcaggagtttggaaccagcctgggcaacattgtgaaaccccatctctactaaaaatgcacaaaaagaactaatttaagtttcttgtaggattctggttacaaaacactggtcaaacacacagggcatggatagggcagggccagggacaaggtcaggccaggaaggggccagggccaaggcagggccagagatggacttggaagtgtcctggtctgatttgccctgccccaacgttggcccagccctgctctggcacttcctgtcatgccctgtccctggcctgagcactggccctggccctgtcctgcttctggccctgccccggagttgaccaggcactgccatggcccagtcctgcattgccctgccctcctctgccctggtgctaccatggccctgcttgggccctagctctgcctctactctggacctgccctgactctgctcagccctggatctaccctgactctgccttggtgttgccctcccatctctatggcctggctctggctgtgccttgcatagatcatgctctgccctgcgtgtcccagcctgggcccagcccttgtcctaccatattcctgaccccagccatacccttcttctggccgtgaccctgccgtggccctctcctggcccttccttggtcctgccctgcccttccatgccctggccttgccctcaccctgcattggccctgcactggtcctgccctgccctggcactgccttggccccggccctgccttctccctggtcttgcctttgccctgccctggcctgaccccaggcctaccgagtccatgaaatggccctggacctgccttgccatcgtctgtcctggccctgtattgtccccaccatgctctggtccagcgcttgccctggccctgttgctagtcctgccactgttatggccctgccctgtttttggccatgccctgtgctaccctagccctgccctgccttggccttggccctaccatggccttctcctaccctggcctggccctacactggccttttctaccctggccttgcccttcccctggtcttgccttgccctggccttgccctgccctggccttggctttgccttatcctggtcctggttctgccctgaccctggccttgctctggatcctctctggttctgctttctccctggccctgcccttgctctggccctgtccctggcccagccttgaccctgaccctggccctgacaatccccaggtctgacactggccatgcttggccctggcccctccttttggccctgccctggccctgccttggccctgtgctatcttagtcctgccctggccctgaactcaccctggccctaccctcaccctacactggccccgccctaccctggccttgccctgccctggccctgcctttggcctgctctggctctggttctgccctggccttgcccttgccctggaccctccctggccatgttttttccatggtccttctctggccttgcccttgccctgtcccctttctggtcctgccatatttctggccctgtcctgtccatgtcctggacctgactctggccctggacctccctgtccctgccctgccataccctggcccgttccttgctctacactgaccctgccctgccttggccctgtgctaccctagccttgccctggccttctgctgaccctgatcctgccatggccctggccctgccatgtccctgccctggccctggttctgccctgcttctggccctggccttggtcctctcatgtccctggccgtgaccctgcccctggtttttctctggccatgaccctgcccctgttctgtcctatccctggccctgtcttagttctgtcctagccctggcttttcacagtactttatgcttagtaagggctccatggtgtctgtgagttgaatgttgtgttcatagtatctgccaaaacagaaagaaaaaaaacaaaatattttgataagaagttaaagctttgtatataatatgccttgaattgtaaatgcctgttattagttgtattacatataggtcatggttttgtacacataactccaaaccattgatactgttaaaagaatatatgaatatatgaaagaatgtgtaaatgtaagaatgtatcagtatctaattacctttccaaattaatttttatttttagctctattagatttttctcagtgtaacaaatgtttattcctatgtaattaagggcgtatttcctgtacagaatattcatattacctaattgaaaattatatgatacaaaaatataatactatttttaggccaggcatggtggctcatacctgtaatcccaacattttgagaggccaagtttggagaatcatttgagtccaggagttgaccagcctgggcaacatagtgagaccttgtccttattaaacaaataaataaataggttgggcactgtggctcatatctgtcatcccagcattttgggttgccagtgcaggaggattgcttgagcccaggaatttgagaccagcctgggcagaatagcaagactccatctctacaaataataaaatattaaccaggtgtggtggtgcgcacctggggtcccagctacctgggaggctaatgtgggaggttttctcgaggctgcagtgaactgtgaatgcaccactgcattccagcctaggccacagaacaggaccttgtctatgaataaagaaataagtaaaaatataaataaaaataagtaaaaagaaatattagtaaatataaatataaatacatataaacataaaaatgcatgcatgaaaagaaacaatttttaaatttaacatcactgagggcatcctatccatttcatttcatgattccattatgtcatttcacttagatgaaatgataagatgacttgagatgagatgaaatgatgagatgaaatgacaaaatgatgagatgagatgagatgatgagatgaaatggagagtggaaatgagatgaaatgatgagacgaaatgacaaagctgaaaagaaattgaaaggagatgagatgagatgaaatgagatgaaatgatgagatgatgaaatgatgagatgaaacgagatgaaatgatgagatgaaatgaaatgaaataatgaaatgatatgaaataatgaaattgaaatgagatgagatgagatgaaataatgagataaaatgagatgaaatgagatgaacgatgagatgacatgatgagatgaaatgagatgaaaaatgatgagatgaaaaatgagatgaaatgaaataatgaaatgaaataatgaaatgagatgaaatgaaataatgaaaggaaattatgaaatgtaatgaaattgaaatgaaattgaaatgagatgagttgaaatgatgagatgtaatgatgaaatgaaatcatgagatgagatgaaatgagatgaaataatgagatgaaatgagatgatgagatgagatgaaatcatgagatgaaatgatgaaatgaaatgaaatgatggatgaaatgatgagatgaaatgagatgaaatgtaatgagatgaaatgaaatgacataatgaaatgaaataatgaaatgagatgaaatgaaataatgaaatgatgaaataatgaaatgaaaatgaaatggaaatgatgagatgagaagaaatgatgagatgagatgagataaaatgagatgaaatgatgagatgaaatgaaatgatgagatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgacataaaatgagatgaaatgtaatgatgaaatgagatgaaatgatgagatgagataaaatgatatgaaatgatgagatgaatgatgagatgaaatgatgagatgagatgagatgatgagatgaaatgatgagatgaatgatgagatgaaatgatgagatgagatgagatgatgagatgaaatgatgagatgaactgatgagatgaaatgaaatgaaataatgaaatgaaattgaaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacataatgaaatgaaaaaatgaaataatgaaatgaggtgaaattaaatgagatgatgaaattaaatgatgaaatgaaataatgaaatggaaatgatgagatgagatgaaatgacgagatgaatgatgagatgaaatgagatgaaatgatgagatgcaatgatgagatgaaatgatgaaatgatgagatgagatgtaatgatgagaggaaatgatgagatgtaatgaaatgagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgagatgaaatgagatgaaacgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaatgagatgaaatgaaatgatgaaatgatgaaataatgaaatgaaaatgaaatggaaatgatgagatgagaagaaatgatgagatgagatgagataaaatgagatgaaatgatgagatgaaatgaaatgatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgatgacataaaatgagatgaaatgtaatgatgaaatgagatgaaatgatgagatgagataaaatgatatgaaatgatgagatgaatgatgagatgaaatgatgagatgagatgagatgatgagatgaaatgatgagatgaactgatgagatgaaatgaaataatgaaatgaaattgaaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaaatgaagtgatgagatgaaatgatgaaatgataagatgaaaagagttgatgagatgataagatgaaatgatgagatgaaaagatgtgatgaaatgaaatgatgagatgaaatgagatgaaatgaaattagacgaaatgtaatgagatgaaatgaaatgacataatgatatgaaaaaatgtaataatgaaatgaggtgaaattaaatgagatgatggaattaaatgatgaaatgaaataatgaaatggaaatgatgagatgagatgagatgaaatgacgagatgaatgatgagatgaaatgagatgaaatgatgagacgcaatgatgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaatgagatgaaatgaaatgatgaaatgatgaaataatgaaatgaaaatgaaatggaaatgatgagatgagaagaaatgatgagatgagatgagatgaaatgatgacatgagatgatgacataagatgagatgaaatgtaatgatgatatgagatgaaatgatgagataaaatgctatgaaatgatgagatgaatgatgagatgaaatgatgagatgagatgagatgatgagatgaaatgagatgaatgatgagatgaaatgatgagatgagatgagatgatgagatgaaatgatgagatgaactgatgagatgaaatgaaatgaaataatgaaatgaaattgaaataaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaaatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacgaaatgaaaaaatgaaataatgaaatgaggtgaaattaaatgagttgatgaaattaaatgatgaaatgaaataatgaaatgaaataatgaactggaaatgatgagatgagatgacatgacgagatgcatgatgagatgaaatgagatgaaatgatgagatgcaatgatgagatgaaatgatgaaatgatgagatgagatgagatgtaatgatgagaggaaatgatgagatgtaatgaaatgagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgaaatgagatgaaacgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaataatgacatgagatgaaatgaaatgatgaaatgatgaaataatgaaatgaaaatgaaatggaaatgatgagatgagaagaaatgatgagatgagataaaatgagatgaaatgatgagatgaaatgaaatgatgagatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgatgacataaaatgagatgaaatgtaatgatgaaatgagatgaaatgatgagatgagataaaatgatatgaaatgatgagatgaatgatgagatgaaatgatgagatgagatgagatgagatgatgagatgaaatgatgagatgaactgatgagatgaaatgaaatgaaataatgaaatgaaattgaaataaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacataatgaaatgaaaaaatgaaataatgaggtgaaattaaatgagatgatgaaattaaatgatgaaatgaaataatgaaatggaaatgatgagatgaagtgacgagatgaatgatgagatgaaatgagatgaaatgatgagatgcaatgatgagatgaaatgatgaaatgatgagatgagatgaggtgtaatgatgagaggaaatgatgagatgtaatgaaaggagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgaaatgagatgaaacgagatgaaatgatgaaatgatcagatgagacgagaagaaatgatgagataaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaatatgatgagatgaaatgagatgaattgaaatgaaatgaaataatgaaataatgaaatgagatgaaatgaaatgatgaaatgatattgaaatgaaattgaaagatgagatgaaatgatgagatgaaatggtgaaatgttgaaatgaaatgatgaaatgaatagatgtgacatgaaatgagctgaaatgatgagatcaaatgaaatgaaatgagattaaatgatgagatgaaaaatgatgagatgaaaaatgatgagatgaaatgctgagatgaaatgagatcagatgaactgagatgagatgagatgaaataatgaaattaggtgaaataatgaaatgatatgaaataatgaaattgaaatgagatgagaagaagtgagatgaaatgttgtaatgaaaggaggaaatgatgagatgaggagatgaaatgatgagatgaattgagatgaaatgagatgaaaaatgatatgaaaaatgatatcaaaaatatgagatgaaatgaaatgagattatatgaaatgacaatgaaataaatgaaattagatgaaatgaaatgaaatagtgaaatgaaatgatgaaatgaaataatgaaaatgaaatggaaatgcgatgagatgagatttggtgaaatgatgagatgaaatgatgagatgatatgaaatgatgagatgagatgggatgagatgaaatgagataaaatgatgagatgaaatgatgagatgaaatgatggggtgaagtgatgcactgtcacgtgtgtgtctattctttttcccaagcaacaaaaattataattcattaattttaattttattatttaagaatattcttaagagttgaaggaaaaataatatctgtacattatgggttacaatctaagtataaataatacataaatatattaaaacttacaaagaatatgttttggaatcgaatataccatgcttctgtgatgacagttatttcatgctggttgtcacaattttacatgaaaaactaatgaaaaaatgtttttaactgtttctaaaaataacagtttccaaaacagttttacattcgaaatatgaaaaagttgtctttgtgttccttaatctgatgagattttcacactctgcacatgataattgttagatttttattgtgttgataaattgtatatcaaataaaaaatgttattacctcttaaattaggatttttaggtgatataggcagaaaggacagcaagtttttataactttgtctaaatgaactttctaaatgcctgagtattaaaagatagcatgtctataaatcacaatgtatatattactgtatgacctaggaccaatcaaaaccgttacctctgataacattatattgtgcccagtataaaatagatataataatacctcaaacttaaatccgggcattgtcattgaatatcttaagaatatgcaacaaaggtgcttttaaaaatacaagctagtgattgtaccaaatttgtaaatcacataggatagtgggtcattttaagaatattagttatttcaatctataaacgtggatgtctttccttttttgtgttttctttaatttctttcattaatatttgtcatttttgttgtcgaaatcttttacttccttggttaaatttatttctaagtacatttttgtagctattgtaaaaggaattgctttcttaatttcttgtttcagctagtttactatcaatatatagaaatgctactgatttttgtatgttgatttatatcctgcaactttattaatttcatgtatcaccctaagaagcttttggtagagtcttatttttttccatgtataagatcacattgtctttaaacagggacaatttgactgtctcctttccaattcagatgtcctttatttctttctctcacctaattgtcctggctaagactttcactatgtgaaatatgattggtgagaataggcatccttttcttgttccagtaaaatctttttcttgttcacagtaaaagctttcaccttttccacactcagcatgatcttagttgtagatttgtcctttatgtccttctgttttaaggcatatattttctatactaaattgttgagaggttttttgtcatgtaagaatatttaattttgccaaacgcttttattgtgtttattaatttaatcatatggttttcagtatatatccaaaggaaagaaaatcagtatatcaaagacttacctgcacccccatgtttattacagcactattcacaatagccaagatatggaatcagcaaaagtgtccatcaacagatgaatggataaagaaatgtgatatacatatataatggaatactatttagtcataataaagaacaaaatcctgttatttgtggcaacaagaatgcaagtggagggtattatgttaggtgaaataaacctggcatagaaacataaacaccacataactacgtgttctcacttatgtatggaagctaaaatttttaatctcgtagaagtagatagtagagttttggttaccatatcctggaaagagtaggagaaagaagagtataagaaaaatgtggttaatacatacaaaattacagctggagagaaggaagaagttctagttctctacagcactgttgggtgactgtagttaacgggaatttattgtgtgttttcaaataactaaaataaaagattttaaatattctcactgcaaagaaataatacatgatttaggtaatggatatgataatgactctgacttgatctttacgcattgcataaatatatcaaaatatcactctgtaccccataacatgtacatttattatatgtcaattaaagtaaatttaaaagagaaaaaatgaggtaaaggtaaatatacataatttaattactttttcttctataaaacccgagtcagtaccaagaagagtcaatttattagttttctaaaataaaaaaaatcaaaatcaccaaaaaagagcaatatccaagaaaacattgaaaatgaaacacaacattcagtaagaatagaaaacttgggcaccgtatcaccctgttcctagataccgatttactgatggccatttaaatagaattttattctatctaattcatttatactcccagagttcgaaattacattttacctacaataaatgagataacacttgtaaattatatggtactctgcctaacacacgttaataactcaatacatgttagcaataagcttttaatatagtagtcaaagtattaatttctcacattgcaatttccttcaaagacatgaatacaacctttctaatgactccttgttcatcaagatacctcttcaaattattctatttgtttcattcagtatattatctgtgtataccgatattacactcttttctttttttgagatggaatctcattctgttactgatgctggagtgaggtggcatgatctcggttcactgcaacctccacctcccaggttcaagcgattctcctgtctcagcctcccaagtagctaggactacaggtacataccacgatgcctggctaatttttgtatttttagtacagtcaagagtttcaccttgttgtccaggctggtctcgaactcctgacctcaggtgatccacccaccatggcctcccaaagtgctgggattacaggcataagccaccgcacccagcctgatattgcactcttggattttgaacactgaatatctttttgaaagattacacctctttactttgtgcttcagaaattattttccttcaagtgttctaagagtctaatgaagaatgaagtcatgttttatcacttttgtccttaaagatttcagacatgctgaaactgattgaagtatcatttgctactagatagattaattatctccagttgtaggagtggatacatctttaatggtatattttgggttattgtcttatttttgatgcagtattctataaataatttattaaacctggcatccttgggtgagcacagatttttcaactttggtgttatattgtgtttgcttttaaaaactgcttctgaggccaggtatggtggctcttgcccatacccagcactttgggaggccaagatgggtggattacctcaggtcaggagttcaagaccagcctggtcaacatggcaaaaccatgtctctactaaaaacacaaaattagccaggcatggtggtgcatgcttgtagtcctaaccactcgagaggctgaggcaagagaatcacctgaacctgggaggcaaaagttgctaggttgctgtgagccaaattcgcaccattgccctccagcctgggtgaaaagagcaaaactctgtctcaaaaaaaaaaaaaaacccaccaaaaactgcttttgaatggagttgtacatataatttttatgaaaaaaattaacaagtgcataagttcataatagaaaaaccaataatactccaggcacaagttagtactaaaaaaattatgttgaatattctctaatacaacatgctttttcccttcatgaacaatttgtgttttactgagaagagtcactgtttatggtagacattagactacagatgaatatgtactttaaacactcttagttgctttcttaattttatatctgctgctttatgcttctgtttattttcattctttccaatgtccacattctagtaaatttgaatattttaatccaagtttatatactatttaatattgcttgtatagtttagtatttttaagactcaaaaaggtttacagaaagaagaaaaagatcaacatgttattaatcatttaaagatcattttgaaatctttgacctttatattttaatgaataaaatattagtagttattagtataaaataatttatgtcttttggacttagcatccagtatttcttttttaataaagaaaataattattctcttgcaatgtactatgtttatctgggttttgaaaagtgatgtttcctaatatgagaaagccatttacagttttaaatctacaaaggcaaatggaatggtactaaattatttacataataatgtttagatggtggcccttataacattctttctatacttcctacagagttggggatatgcaatcctagaatatttctgggagctaatcctttagcttgatgaatgaaacaagacttttaaataaaattaaactttcaaattatccaggtaatgggcctgtcttttaattcaatggatatggagcataatgaattaacccctgttcattgggtaataagttctcattcttataatactcaaaatgtcctttaatttttaatttttgatagtcatatcattatccctaggtattttagcttctatcttaaattctaaaataattttgaaataggagaaagtattctttattactatatgtattaaacatcatggttttcaaattgaactgcaaatgtatcttttcattgcttcttgatgacacccttcaccctatccatattgtcactaccaagtggtgattacttttcaggttcacatacttattcttcagaaaaatcttctctgtgccttataaagaatatgattgttggcattcaaaagccagcgaagtatacattattagcctgttgcctaactcatttctttaagaaactacactaattacccacatacttatgtttttatttcctcattatttctggagaaaacaaatactgctaacatgatatttgtaagagagaaaaaagtcttttcttgaaaagtgctgtcattgtagtactaacttatagtatcaacttctttataaactccttagacactttttattctgagagaaataaaaaagctaaaagtcaaatgactttttttactctccttattataagcacccatcttggtaatttagggtctttatagttagggtaagttgtgtcataccgaggttacaaaataaaaagtattttgtctttttgggcctttccttattcagtaatactgtcagtttggctttttttgtaggtcaacttattgaactcagtattctgaaataatatgtttactatcttttgagaagcacttaaaatattagatttattgttactcttctgcctttattgggctggaagaataattgtttcactccacaaaaggcaagttgcggagaaaaacacatagacattcaaccgcaaagcagagaaacttgactattttctgcaattttaaagtgtatattgaataaaaccatctttttattttcttttttgctcactggcaaatattaacaacatcaagtgtattattataatgttatctagttaaaaatctcaaaaagttttcataattaccattttaaagtatataaataggtgacctaatgttaatttttattgtctgagaccatgtctgttatttcactctttaaattcagttagtagtgcagaacctagcacttagtagatactcaaaaattatttgctgaataaaaaaaggttaaacatgtaatatatacaaaatgtactggaaaaaaatgcaccaaacaattttgttataccagtttaatgtaaatattgcctttaaaagataatatagttttcaggtgtctacagtgattttgtaatatttgtgcacatataaaataatatttccaaaaatgtaatccagtggggaaatatactttctaaattctagatttataatttagggtttaaattataaaatcattaaataagacacaagtgaaatgtagtcaaatatccccttggaaaaaaattaagtggcctctaaagtgaggtattcatatatgtaattttacaatcctctagtgatagaattaattaaatacaccaccaaattgattaattcctactgtgttaaaagagaagcactaacaatgccagttaccatgtaacatggatttaagctacaagtcatagaaatgtgatgagaagcctcagcgctgtaaaacagagggtggaggaaagcttttcctctctcaaatgagctttgcgaggtatacttcttgaaggataggaagttgaagtgttcaggacttttatgtctattctactttggcttagtttacatgattcgtagtttattagcctagaaatggccaagaaaacttaaggttcaataattagttataaatatgaaatatccccgatttttaagataaaaacaacttataaatgtatttgtctgtaaaaattgtgtatatttttacagaacatctatttctttttttatttttttatatttatttattatgctttaaattctagggtacacatgcacagtgtgcaggtttgttgcatatgtatccatgtgccatgttggtgtgctgcacccattaactcatcatttatattaggcatatctcctaatgctatccctcccccctccccccaccccacaacaggccctggtgtgtgatgttccccttcctgtgtccaagtgttctcattgttcaattcccacctatgagtgagaacatgtggtgtttggttttttgtccttgcgatagtttgctgagaatgatggtttccagcttcatccatgcccctacaaaggacatgaactcatcattttttatggatgcctagtattccatggtgtatatgtgccacatgttcttcatccagtctatcattgttggacatttgggttggttccaagtctttgctattgtgaatagtgctgcaataaacatacgtgtgcatgtgtctttatagcagcacaatttataatcctttgggtatatactcagtagtgggatggctgggtcaaatggtatctctagttctagatccctgaggaatggccacactgtcttccacaatggttgaactagtttacagtcccaccaacagtgtgaaagtgttcctatttctccacatcctctccagcacctgttgtttcctgactttttaatgatcgccattctaactggtgtgagatggtatctcattgtggttttgatttgcatttctctgatgggtctatttctttaaaacaaagggaggggagtctctcatttgcattagtttttttcatagccttttgaacttcacaatttctatgtttcagaacctatttcttacagtttttctatgctaaactctgtcctagtcagttctagagtgtatgaagaaccaaatgatgtaatagtatgccacctggctgtagtggaacaaatttgactcttaagtatgcaggctctaattttcctgtctggttttggcaagtattccttacataggttttttctttgaaaatctgggattgagaggttgatgaatgaaaattaatcctttcacttttttgtatataggtttgcaataattaggtcagagtggagttttaaggtcacggaggggtctgatgacttacaaataatgggctctgattgggcaactactcatctgagttccttccatttgacctaattaagcttgtgaaatttacactaagccatgagctcatctttaaaaagttttattaaaagattttcagctgttccaaatgggacttattactggaatgtgttttaaaggatcatatcagatgaatgaaaggtatttgatccttcgtttccttaataataaaatgatggtttggaaaaataggctacagtctaaccacagtgctattattaggctttcttgttaaacataggtctaagcctaagtatgtcaatacaacaaatacttactgtttcatttctagtaatgaaaaaaaaaaaaaaaacaagtctttctggcataaggatgattttcatctggttattttgaaacatttttgtaaaataaatttccatctataaagaacatttttatttgtaaggaggggtatgtctctgtgcactggaagagagggaggactaaatcactgggaagtcttatgataaagaagccattggcttaaatcagcgaagcaagccgtcccttggtttaaggtgtttttcctggccatcctgtcttgactagaactttacctacaccttcctttttggtttaggcaaattatagtatctaaaactaaagtctcagctctgtgtctttgacatataaatgttctaccatgtcttctctggaatctgataactatctatctctttaaaatgcaagtctagggagatgactcatcagaaaaagaagaaaaaagaggtatttggaaattgtgcaaattaaagcagcccctgatgtcaaagtctacacattcctgagtgagtcagttctggccagttctagctggatcaagagagctcttctgggcaggcctgaagagcacctgaatggcagccacctgaggagccaggtgcctgaaacttccttcacctgcttgaggagcgccaaagcccaggtgctggctggacaaccacttctggctgcctaagcagatggcagaagaaggaaacaaggtcagaggcagagtattgaaccctgcctcccaggtgggtggaagatgcctgtcgccaaactagggcccagcttgccgggtgagatgggtgaactggtgatcccccgagagagtggacgtcagaactacatgttcctggacttcacctcggccagcgaaggagagagagggttaatgttaactgcacgaggcccactctagccttaaattctgtaattcaaacccttcccttggagacaaaacaaacatgacaaggaattctgaggtcaggggacaagaatcacaaagtgggagattgaggaggcagtgtccttcctgcccttggtctactggctaagaaccttcctcagcctgacctttgcacattgcactttcagctctgtttgcaattttcctcctttagtgctgagggaatcccagtgttccatcctgaaatctataggttcctaatgggtggttaaaaaaaaacctcagcgagagaagcagaaaatgtttcctcttcctgaaaaactgtagaaaggcaggcaccattctgggtgaggacatggtccttgcaaatgtctttgtgttgtttttgtttttgttcttgtttttgagatgaagttttgctcttgttgcccagactggagtgcagtggtgtgatctctgctcattgcaacctccgcctcctgggttcaagcagttctcctacctcagcctcccgagtagctggaattacaggcacctgccaccacacctggctaattttttgtatttttagtagagatggggttttgccgtgttggccatgttggtctcgaactcctgacctcaagtgagccacccgcttctgcctcccaaagtgctgggattacaggagtgagccaccgcgtccagcctgcaaacgtctttaaagacagcgtgtttcagaggctgtgacagtgccctgtgaacatgccaattctcacagtcccgggagctctgaggagcaggcccggctccttgccaggctgatggtactgaaactctgctctccaagacataacctgatggccatgcaagatttcttaatcgactgtggaccgtgagagtctgcatctcattttaattaagatgggaaaagaaagaacaaaagagcaactcccaggttatagagaaagtggattttagtataatattcaagtgtagcattgctaataataacaaacctttcccctcccaaacggtaaacacttgcactgcctattatacaaaaattcaaccaccctctctgttaccccgatatctcctccccagtgaccccccctctcatgcggcctcatgagcctggccagtggtgaatggcactttcatgggcatgagactccacgtgagtgggactcagctgggacccctctccacgtgggagctggggaagccaccctagtagcagctcaaagtgtccgtgatgtccctgctgctgaggtaggggccgcctctgagctggtctcggggtgtgagctgctgctggtagtgggctctgccctgagggcctggtggctggtcagaagggcaggcacacatgggtgactccccaggaactcaggccacctccccaccacagccctgcactgtgtgctccaggcatgtgctgagtgcctggtcaatcaccagtgccctattgatcccagtctccagagagagcatttagtgtcactccacagaggggaaactcggcccagagaagtaaagtgactctccccagtcacagggctggtcagcagtaggatgggaggctagtcccttgctgtctgactccctgagcccacccatatcccaaggcagccaacctctgcccgccctggttcaggccccgactggcccctgtggtgggtgatgtctatcttcctggcctttgtgctcccagccaactgggatggagcctccagctggcatgacaggttgtagctacggacagaagagtggctgtgaggctgccaggaatctcaccagggccccctcccagggcctgtccagagtgaggtctgggtaccccaggcattgccagaccacaggatctgatgttggccaagaggccatggccacaggctttctgaggctggcccccagggagagttcaatcctactatcccaattcctgtcctggccttacctctcagtctcaccgagccacttcatggtcccaaaccaggacccaaagtgctgcttgggctcaaggttgtaattatttgcagccaactggagcagtggacctccttgcttactttgaattcctgggtccagagggaaaaactgggtgatgacagggactggacagggatgccacaggggccctgtgggggtgttagatggggtggtggccagtctttgctcataggggaccccctcctcctctccagtcctgtccccacctgttctcagagctggctcaaacagcagctcctccaggaatgtgtccttggtttcaacctggtactcccacctgcaggtcttcctggagtgtctcctctttctctctgtctccccataaatctaagacgagggggatggatctgcccactgctactcaccgtatgactcttgtgaggttgatcagtctcccctggaaggccaacagctgaagtccatcagaaagggtcctctggcccagagccagcccctgcccacccctgtcttgctgcacccagggtgcaagacccagatcaggtctgggtgacaggaggggtatagaggggctgaggctcaggggccttctagcctaacttgtctggagacagttggggaaactgagaccccaagcagggaggtatggctccgagagattattctcattaatctggaacatttttgcaagctgttaggtataggaagtctgtcacaggtaagagaaatgctttttaagagcatgagagacagcagggttgtgacaatattgaaacaccaccgtgcagattcaccaattgccaccaccgggagccccctgagagtcattgcagatgcacagccctcccctgcaacccctggacctccccgtggtctggcacctaaagggttatgcctcatggcaggaatcaggaccctcagggtgccctgcccactccaaggtctgcctctgctctgattggtcactgacattcagattgtcacccaaatataaggacattagcagaaagactcattcaatacaagtggactcagacatagataggaattgggttgcaagaagccccttttgtttcttttattttattttggaaaaaacttttattgtgaaaattcacatatatatatatatatatatatatgtatatataaactcaatcaatgcaaaaggatagacaatgaacaaatgaattccccttccactccagatccccaactcagatccagacctcctgagcccacttcccccatctcatcacagatccagacctcctgagcccactttccccatctcatcacagacccagacctcctgagcccactttccccatctcatcacagatccagacctcctgagcccactttccccatctcatcacagatccagacctcctgagcccactttccccatctcatcacagatccagacctcccccactttccccatctcatcacagatccagacctcctgagcccacttccccaactcatcaccagtgatttcttgggctctgcattagttttctattgctgctgcaaccaacagctacagactcagtggcttccatttctgtcttatagttctggttgccaaaagtcctaagaggatctcactgggctaaagtcaaggtgctggcggggctatgtcccttctggaggctcaagggatgaatcgggtccctgccttttctagcttctaggggctccagcttctaggtttgtggcctccttcctccatcctcaaagccagcaacagcaggtgaagtcctcgcccatcatgcatcactctcccttcttcctccttcaacttttttttttatatttagggggaacgagtaccggattcttacatagtcaaaaagctccttatagagaagctcggaactttcaatacaactttgccttttctgccattttaattttccatttaatttaaatgtattctctcatttgaccttcatactctgtggagaaatattcctatttcggcttgtattgacaagctgttttcacacagcccccacatcacccaaccaaccagcaagaaacagataaagaaactgaggcccagggaggctaagagtcctgccaggatcattcacctttcaaggtaaggagccagttccagacctgggtttgtgcagctccaagctcccccgtctttctacaatgctagatttagactatagcaatctagcaagtgtggccacacaatgatcaagttggatttagatgatgttccctataaatccattctcctctcccgtgtaagcaaggcaaagtcctccaggccatggggagtccctgaagactcgatgaactgcagtggccacatcaggaggttgcaggttgaccagaactcaccgacacagcaggagagcagcttggaacctgcaacctagccaaaacctagtgccttggattgggggagaaaacaggcagccattcctctctctctgctggctagaggggattctggcttttcctgccagagccacccctttccctcctcctaaagttgatggtggttctttaaggaaagggagaagtgcacggtgtgatagggcaggaagagaagaaaatggaggagaggaggggactttcccataagcaggcagaagaaaaggcagctgtggtgtgtgatggacatggatgcagtggtgtccaatgtggggtcagccctagaggagagacagagagagagacagaaaagtgagagtcctgacccttacgattaacatgggatctgcctgcaaatgctgtttagggccatcgcctcttcctgtactgctatttttgagagtgatgctcctgagccccatgacccagtcaaatttgatgtcccctcgagccagattcagtgctgggagtccagtgtgatctgcctggatcttgctgcattgagaacaggccagtcttgaccccaatacaggggctggatatgaacaggcaacagctgggtttctgagtcagaaagacttggttaattgctaattgcttaggcgagtaatttaattttgttgagtcagattcttcagctacaaaatgcagatgacagtacttattcctccaggttgtggggaaaatggagattctaagcacgatgtccatttcacagaaaggtaccaatttggtggcttattttcctttctaccttcagaagtggctatccctgccacccaaacagacccttgactctcaagtggacggggtcccatttgcacagggggagaccttacagcctacgttgagtctatacttaccacttagtgagcattgtgtccgctcaggggcctctgtgggcatccgtctcctctgcagcatctttcctccccactgctgggtctgcacatgaccccctccttgggttaggcctctgatcagtgatgaccttggtatggtggtgatggtcagtcttggcatcaaatgagccagtttatatcatcagctattcaataaaatactaatctaggtgtcaccgtgaaagtattttgtgacattgttatgtacgtgttgttacaaatgtgcatgatgcatttactacagcatagaattttgcctgggtgccagcctgaagtctgtccgacagatcatagccatgttagtcccacagtcacaggggccaattgattaaattattttatctcccttgaaaactaaaaataaaatcctaagccccccacccgacttaacagaccccctgttggccaacggaacctcaaataaatcttaaaattcagttcttggccatgacaggacaggaggtcagacatacctccctgtacctccctccctcttatggtttagaccccacaactgaacagcattaatgttaaaatagagatcatgagactgacagaacagactctttgtggcaataagacctcaaattataaacaggagctagggccatgccaggcgagcgttaagtcttgtaccctactcttaaagaattaactagattctaactaccacgtgggttttatttttctctagcaaccaagcaagcactggctgtgagagaagcaagattaaaacaattacaactcacccagttcacagacgctgagtaactgatctcctgccccactaaccttaatgacagctttctctggacaagggactgatttcagtaactttctcctgataagagaccatcctccatggactggttctggccagttttggaggctgtgcctgtacagaggctgagtaccttcatgtccctgcttcactttttgatgtgtagggcctaattataatacatttaaatgtcaagtctccaccccagaatgaacatgcatgtttatggaatatgcatgcattaggacctcttttatgagtattctcataaaatgatatagctcctctgatatcctattgagtatgtatatgtagccaattcatttggctcaaattcctgtcctctccttccctccctggaaatgcctgcctctggccttggctgtaggccacacttcccagcctgtcataatggccaccttgcagactgcaaacctatataagaaataaagctctcttttctaaatttataaaattgtgtgatttttcagttgatgctctctttctacacacacacacacacacacacacacacacgcaatttatacagaaggaaatctggagaatatatgtgggaatggatattaagtgtgtggcaccgtggtggaagtaacataaagttggattaggctaaatttattaatgttggcccactaaacagagattctggactcagggttgtaggtcaaagctttagaaagggctccaagggttggtttgatcggttacttggttggttgcttgcttggttggttggtgcttgcttccttgcttggttgtttggttggtttgttgcttgcttgcttgttggttgattggttggctgtttgcttgtttggtgacttggttggttggctgaaacagaatcagagtttacctaaggtacataaagttgagatgccacaacttccttggtttatgtgtacagaaaggtatgcaaaaactcagggagactggatttattatgtcagacctgctcactcacactggagggtctacggaacatactcctcacaacgatcatgagaaagaatattgtgagaggagcccagtatcctggaagagctttgagcttgtgctctcagtaggcaaaatgttacagcaggaactgcagccactggactgggatctttaagtaaaatgaggataattgaatcctggggtggcagggaacatgggctgtccttaatcaccaaagatgaggtgggtgtggtcaccacagtggaaagcagtgtcaaagcagcagtcagaatggtttgactcacagacacccacggcattgtgtagtccatggtatccacagggagagctaatgggctgtaccaaagtcttagttgttctttaaaaaatgaagaattctaggtcaactgaataaaagactaactcaaattaatgaaacacagatctaaaaccctcaatcaattcccagacttgagccagttcacaggcccacaaccccttaagtgaaggggaggctgggtgatcttggggaagtacgctgctacgttgccaaaaatttacattgttaatctttttcccagtcttccccaaagggacttacagccttctgccaggatgactgtgacttaaagaaaagaaaattctcagatatttggggaattactggacactggctctcatttgacactattatcactatgttgcctaggatggattcatgctcctgggttcaagcagtcctcctacctcagcctcccaaagtgctgggattacagacatgagccactgtggccagcagagctttgaaactagaacatggaggtccagtggtaaagatttgacaagtctgggaagagattgggccaaggcaatgttgatgattcttttttttttttttttttttttttttacaacagagtcttgttctgttgtctaggctggagtgcaatggcgcgatctcggctcactgcaacctctgcctccggggtccaagcaattctcctgcctcagcctcctgagtagctgggattacaggtgcccaccaccacaccaggctaattttttatttttttgtgttttttgagacagagtctcactctatatcgcccaggctggagtgcagtggcgcaatctgggctcactgcaaaccccgcctctcaggttcatgccattcttctgcctcagcctcacgagtagctgggactacaggtgcctgccaccgtgcctggctaattttttgtatttttagtagagacggggtttcatttcaccatgttagccaggatggtcttgatctcctgacctcatgatctgcccgcctcggcctcccaaagtgctgggattacagggatgagccaccatgcccagccacaccaagctaatttttgtatttctttttttagttgagacagggtttcaccatgttggccaggctggtccctgaccttgtgatccacccgcctcagcttcccaaagtgctgagatgacaggcatgagccaccgtgcctggccaatgttgatgattctaaacagcagccgttaatgtgaaaaccatccaactggaagccctggccttgcccagaggacacagtctgggtggtgggcagagacttcagctgccttccaaggcaagcagctccttgctgcccgcttgctggggattttacttacagggcagaagctggcaggtgatttgggggcaggaattgcttcctggatggtataggatgaaccacactccccaggaaggcactcatcctggtggcctaacagaagcagccctcaccccaaaaggcaatgctgctccactagttttatggggtgactccttcctgtaggttccttccagctttaccagaaacacagaacatctttcctgacagggcattggttttgtttttgaacagagagatccttcttttaaaaagttagttttttgttttgttttgttttgttttttgtaatggaatcaacctaggtcctaagcctagcaggttgttattattatttttatgattattttttgagatggagtcccactctgtggtccaggctggagggcagtggcacgatctcagctcactgcaatgtctgcctcctgggttcaagagattctcctgcctcaacctacagaggagccaggattacaggcatgcaccaccatgcccggctaatttttgtacttttagtagagatagggttttgccatgttggccaggctgatctcaaactcctgacctcaggtgatccacgcacctcagcctcccaaactgctgagaatacaggtgtgagctgccatacccagccacaggttatttttgctgatcttctccctcctcccaccctcaaagaaaacgcggtacatctacaccatggactactacgcaaccctgaaaaggaacaaaatcacggttggtttttttttttttttttttgcagcaacatggatgtagctggaggccattatcttttttaattatttttattattttttttctattctactttaagttctggggtatatgtgcagaatgtgcaggattgttacatagatatacatgtgccatagcggtttgctgcacccatcaacccatcatctacattagatatttctcataatgctgtccctttcccagtcccccacccctgcagtaggccccagtgtgtgatgttcccctctctgggttgatgtgttctcattgttcacttcccacttatgagtgagaacatgcactgtttggttttctgctcctgtgtcactttgctgaacatgagggtttccagcttcatccatgtccctgcaaaggacatgaactcatctttttcatggctgcatagtattccacagtgtctatgtgctacattttctttatccagtctatcactgatgagcatttgggttggttccacatctttgctattgtgaacagtgtggaggccattatcttaagtaaattaatagaatgctgcgtgttctcacttataagtgggagctaaatgttgtgtatatgtagacacagagaagggaacagatattggggtctagttagggggagagaggaaggtagaaggacaagagttgaaaaaaccaactgtggggtattatgctcactacctgggtgatgggatcactcataccccagacctcagcatcacacatcgtacccatgtaagaaacctgtacatgtacctcctgaatccaaactgctccatcatttgcaccagcaattccaagactgggcatctacccaaaggaaaagaagtcattctaccaaaaagacacatgcatggtaaagttccttttttttgtttgttttttgagatggagtctcgctctatttcccatgctggagtgcagtagcaatctcggctcactgcaacctctgcctccagggttcaagtgattctcctgcctcagcctcttgagcagctgggattacaggcatgcgccaccatgcctggctaatttttgtatttttagtagagacagggtttcaccatattgaccaggctggtctcgaactcctgacctcaggtgatctgcccaccttggccctccagagtgctgggattacagtgcctggccctgtaaggttcatcacagcacgacttacaataggaaagtcatggaatcaacctagttgcccatcagtggggtaccggataaagcaaaagtggttcttctacagcatcgaatactacacagccatgaaaaagaacaaaatcatgtcctttgcggccacatggatgtagctggagggcattatgcttaatgaattaacacaagaacagaaaatcaaataccacatgttcttgtctggataaagcaattgtggcccttctacaccatggaatactgcacagccatgaaaaagaataaaatcatgtttttgcagccacgtggacacagctgaagggaattatgcttagtgaattaacgccaggaaaagaaaatcgaataccacatgttctccactagataaagcaaatgtggtctttctgcatcatggaatactacacagccacgaaaaagaataatgtcatgtcctttgcagccacatggacacagctgaaggacattatgcttagtgaattaatgccaggaacagaaaatgaaatactacatgttctcaactggataaagcaaatgtggcccttctacaccacggaatactacacagtgatgaaaaaaataaaatcatgtctttgcagccacatggatgcagccagagggcattatgcttagtgaatcaatatgaggaacagaaaatcaaataccacatgttctgcactagataaagcaaatgtggtccttctgcatcatggaatactacacagccatgaacaagaataaaatcatgccctttgcagcaacgtggatgaagctgaagggcattatgcttagtgaattaacgccaggaacagaaaataaaacaccacatgtttttgcttataggtgggagctaaacattgcctgcacctggacacaatgaaggggcaccacagaccctcaggactaatagagtaggaagcaggggcgggggtacaagggttgaaaaactaccctgagattctttgaatttcaggcagaaggcagcaactggagagatctttgggtcacggatttttctgttgcattttcttgcttgtttgttttctatctctctctctctcttttttttttttcttttttttgagatggagtctcactctgtgacccaggctggagtgcagtggtgcaatctcggctccctgcaacttctgcctcctggattcaagcaattcttctacctcagcctcccaagtagctgggactacaggcacctgccaccacacctggctaatttttgtatttttagcagagacggggtttcaccatgttggccaggctggtctcgaactcctgacctcaggtgatctgcctgccttggcctcccaaagtgctgggattacaggcatgagccactgcacctggccctcttcttatatatttctagaactcctctcgaatttggggtttgtttttcttaattacaaggaatcaagttgaatcattagtgcatatataaatatacattttattttagtacacattatatacctcaggaatgtacaatgctcagcgcctgggtgacgggattattcataccccaaacctcagcatcgtacaatatccccaggacacaaagctgcccgtggatcccctgaatctataataataataattaataataataataataataaataaaaagtgactttgtcattcgcagggaaatgtgaatgacattcactctgcctctcaggcccttggattcccaaagtttgttttcctcacgcccaggggacactcagaatgtcgtttgcagaacacgggttgtttttcttagaaacgccttgcaaaacaaaataggaagcaaaatctttctcactccttccactccataatagacaaaataaaatgagggggcaggaatccagagactttgaccacagttggcagatttattgtggtacagacatgaaggcaagcagtgttctctctgattctacgaaccgtacagcccgggccagctgccttctgctttctggatggtgcaggcgtgagctccaagcccaaatttcactggagctccaagaatcgagcctggcccaggcactcactgcacgggggccaagcgtgaaaccagtgatcgctccagcaaggtaacaggacagcttggtgatccttcttgccggccacaaaaggttatagccagaattccaccgaatgtggtctttctgtgtctctccccagatagtgaagctgcacaaacctgggggtggggggtggggggtgctgacctcagtggggtgtcctggagaggcaggaaccagagtttacagggtgcagatcctactgaagcaaatggacgtggcatccgtgggcagagctggctgtggctggccttccagcctggatgtctcccccccccccgcctggggtgtcaccaaatgcacccagagaccccttctaaacctggggggatgtgctgacctcagtggggtttcctggagaggcaggaagctgggtttccagggtacatatcctactgaagcaaatggacgtggcatccttgggcagagctggctgtggctggccttccagcctggacgtctcccccactgcctggggtgtcaccaaatgcacccagagacctctcttctgaaagcccattcatgggaagcctccaggtctcctcagcaggcagcatcacgtctgatttcactgcgttatcaggtaatgcaggcctgttctacctgtgtgcgtgagcgcgtgtgtgccgtgtgggagtgtgtgtgttgatgtgggtgtgggtgtgtgcttgtgtggctgtgtgtgtgtgcctgtttatgtgatgatgagtgtgtctgtgagtctgtaagacaacgtgtgtttccatgcgtgtttctgtgtgagcgtgcattcctgtgttttatggaagtgtgtttttgtgatggtgtttttgtgtgcacctgcgtttatcgtatttgtgtgtttgtgaatatgagtgtatgtgtgtgaatctgtatggcaatgtagaaattcttttttttttttttttgagacggagtctcgctctgtcacccatactggagtgcaaaggctcaatctcagctcacagcaacctccacctcccgggttcaaacgattcttctgcctcagcctcctgagtacctgggattacagacacccaccgccacatctggctaatttttcttttttgatatggagtctcgttctgtcacccaggctggagtgcagtggcgtgatcttggctcactgcaacctctgcctcccaggttcaaatgattctcctgcctcagcctcctgagtagctgggattacaggcataagccaccacatctggctaatttttgtatttttgagtagagatggggtttcaccatgttggccaggctggtctggaactcccgacctcaagttatctgcccgcctcggcctcccaaagttctgggagtacaggcgtgagccaccttgcccggccccagtgtgtgaatttttatgtttgtgtgtctacatgattatgtgagtctttttgtgactgtgtttccatgagtgtgtgactgtatttatgtgtttgtgtgtgcttgtgtgattctgagtgtgtctatgagtgtgtatgacatatgtgagtgtctgtgtgggtgagtagccatccacgtgtttatatgagagtgttttcatgattctgtttatgagtgactttgtatgtatacgtgtttgtgtgctttgtgagaatgtcaatgtgcatgtgcacccacgtgtgcaaaaaacccacacatttttgtaattgtgtttgtgtgtgtgtccctgcatttgtgtgagtgtgcatgtcttcgtgtgtccatgtgtttctatgagtgtgttttgtgattctgtctgtctttgtgttgatgtgtgtttgtgtaagtgtgtggttgcatttgtgtcagtgattctggagcaggtgagctgatcacaagtctgagccgagaatccatggagctcatttacaacagaagccgggaccctgtgcaaatccttctgaaatatccccggtttacagagctcctaggggtggggaagaaaaattccctgacttttcggcctcagggaaagagagagacaccccgctggccgtacacctctgctgtttctcagaaaacaggtggggtatcactctttcctaaatgacggtgattttaagaacggttcaccttttgaagagacgtttctgccctggcgatccatacatattgaacccaaatgaatattttttaattaaaaatttttatataaatatacattgtgcatactttatattaatatattgatataaatatattttaatataaacatgatttttatagttcatataaataaagttatatatagtgtatatgtaaaatatacttttatttgtgatacataattttatagattaaattttatatactaagcaaagttacatgtgatatatacatgccatataacatcatttatataatatatctttatgtaaataagtatataataaaattgatcttatatttgttaatacataattatgtatatatactatgtaaaaataaaattatatattgtatgtgcataattatatttctataaatacacgcttatgtgtgtatttatacatgaatgcctgtgtttgtgtgagtacatcagtgagtgtgtgaatgtgtgtgcatgtgtgcctgtgtttgtgtgagtgtaagagtgttgtacatttatacactcacattttgttttctggttaataacaagatctatctttgatttaggatatgaagaattcttataagcaaccccccacacaaaatttgtatttattttaaaatattcttaaaatatgggttcttttatttttgcacaaacagacaagagtgttttttctttccaaaacttttatttcaaattctgaccctgaggagcagaaaaagaagaaaacattgtgtaaccttatatacattagaaacataagtagttactaaatgcaatacagattttgacaacatgcatttaggaaaaatgaggaattcaaactcgtagctgcctcaatattgaactttctaaagtttaattttttttaattaaaaaatattcatttgggttcaatatgtatggatctccagggcagaaatgtctctccaaaaagtgaaccactctgaaaatcaccgtcatttgggaaagggtgatgccccagctgtcttctgaaaaatagcagaggcttccggccagtggggtgtctctctctttccctgaggccgaaatgtcagggaatttttcttccccacccctaggagcccagtaaatgcagaatatttcagaaggatttgcacagggtcccggcttctgctatttatgagctccatggattcttggctcaggcttgtgatcagctcacctgctccagaatcacttcccatcttagcttctgggctaagacacctcaaaaccagcaaaggaaagtcctcactggtcaacgcgtccatcccaactcccccatctccccttagggtgggtttggggttcgggactgctttactgttcctttcaaagcagactgggaggtaagattttattctgcttccagaggttcaggatttctgcagacggtcagcaactctttgcatcctactggtaaaagttttatatactttgtatttatagaaatacgcattgtgtatattttatatgaatagattgatataaattattttagtaacttaaccatatgacttttatatttttatataaataaagttatatgtagtgtatatgtaaaatacttttatttctaatacataattttatagattaaatttaatatattaagcaaaaatatatgtaacatatataacatataacatcatttctataatatataacttaatgtaaataagtatataaaattgatattatatttgttaatacataattatacatatatactgtgtaaaaataaaattacatattgtatatgcataattatatttctataagtacaattatatactatgtataattatgtataaaataattgtataataaaattatataataaattttgaaacgttataaattattatacatagtattttattgtattaaatttagaaatgtgttatatgtaataaaattttattataataaatgtagattatataaaatcttatttataataaattaccttatgtataattataatatgagaaaataattacatatcattgtattataataaatttagagatgttatacattattacatataaaatttcattatattaaatttagaaatatatgtaataaaatggtattatgttaaaatttttatgtaacattttattatacatgtataattttatataatgttttataatatatagaatataagtacacagaatataagtacaaaaatatttatatacagctacacgtaatataaatacatcagtgtaagatgttttgtgtgtgtgagatggagtctcgctctgttgcccaggctggagtgcagcaacacgatctcgtctcactgcaacctctgcctcctgggttcaagcgattctcctgcctcagcctcccgagtagctgggattacaggcatgcaccaccacacccaatcaatttttgtatttttagtagagatggggtttcactgtgttagccaggatggtctcaaactcctgacctcaggtgatccacccgcctcggcctcccaaagtgctgggattacaggcatgagccacagtgtaagatactagctattaaaaaataaatatatatatatactgcaacagctgatttgtctggaagagtttggtcagaagacagtgtattaagaagactgtgagttcccagaggaatataagaatatacatcatgttgatatattatatataacataaatagctaactacatctgtgtatatagtataaacaaaagtacaaaaatatttgtatataactatatgtaatataaatatatcagtgtaagatattagctattaaaatatatatatatatagagagagagagagcaaccggtgatttgtctggaatattctagtcagaagacagtgtattaagaagacagtgagtccccaggagaatacaagaatgtgcatcatgttaatatattatatataacataaatacctaacaacatctgtatatatagtataaacttaaagtacaaaaatattagtatattactatatgtaatataaatatatcagtgtaagatattagctattaaaatatacatatgtgtgtatgtatgtgtatatgtgtatataaatattatatatatatatagtaaccgctgatttgtgtggaagactttggtcagaagacagtgtattaagaagacagtgggtcctcacaggaaaataagaatatacatcatgtttatattatatataacataaacaactaattacatctgtatatacagcataaacataaagtacaaaaatatttgtatataatcgtatgtaatataaatataccagtgtaagatattagctattaaaatatacatgtgtgtatgtatgtgtatatgtgtacatataatatatatacatatataacatatataatatataagatatagcataataatataatatattatatataatatgtaatatgtaacatatattatataattaatatattctatgctatataatatataatatattctatgcaataaaatatatagcatatatatatatatagcaacagctgatttgtctggaagaatttggtcagaagacagtgtattaagaagacagtgagtccccagagaaatataagaatatacatcatgtttatattatatataacataaatagctaactacatctgtatatatagcataaacataaagcacaaaattatttatatataatataaatatatcagtgtaagatattagctattaaaaaatatatatatatagcaaccggtgatttgtctggaagactggtcagaagacagtgtattaggaagacaggcagtctccgcaggaagcatggtgcaggtgggatctggaggtgactctgggctgccagaagacgccccactgctttgcggcagacacaggtggagaggtcctctctgtagcttcagcatggacagtgtgtgtgtcttgctgtgggaacacttctttctgcttccctctccactgtgaccccatcacactcactgacctgccctcctccttcctctcgctctccggggcccctgtggaaagagggtcttccctccgtgcagcaggaacccccaggaccatccccatgctcctgggttctgaacttcagggacatatgatcctacctgaccgggcacaggctctgttcaccctcaggaacccctgtcctcccaggccaccgtggactggagaactggcctcctgaaaatccagagagaacttagcactcacaacttctttctttttttcttttttctttgagactggatcttgctcttttccccaggctggagtgcaatggcatgatctcagctcactgcaacctcctcctcccaggttcaagcagttcatcctgcctctgtctcccgagtatctgggatcacagtcatccacccccgcggccaactaatttctgtatttttagtagagacggggtttcaccatgttggccaggctggtctcgaactcttgacctcaagtgatccacccgcctcggcctcccaaagtactgggatgacatatattagcatgatgtatattcttctattcctccggggactcactgtcttcttgggcagtaaaccactgtgcccggacttctctgtccacatctgcacacatctaaacctctgtagattctgaattgtttttccttttgcacagaatgagaggaactgaagtcgggaggcccagccccaacacggtccctgtggctctgtgctcaggtggtttatggctgagaaggacttggggggttgagggcttcctatcagcccaggagacattacctgggtctgggaagcctgctctgcacttgtgggtctcgaattgtctgttgcatttacctgcctcattattttttcttcctgtctctcttcttacatatttctttcgaatttggagcttgtttttcttaactacaatcaacttgaatcattactgcatatataaatataaattttatattgagtagacattatatactcaatctactacacattccaacacgggccatatctaagacgaatatttatatttaatgtttaaaatatgtttacatttcatatagaaaaatatatttatatttaatatatatgtgtatatttaatacaggaaatatatatttatatttaacatataaaaatatatgtttatatttaatatgggaaatatatgctttgtttaatatacataatacatgttgatatttaatatagaaaaggtatagttatatttactatgcaaaatacatgtttatatttaatatagaaaatatgtttatatttaatgtacaggatacatatttacatttaatatagaaaatacatatttatatttaacatacacagtatttatatttaatgtataaaatatgtttacatttaatgtgctgaatatatgcttatatttaatgtctaaaatgtctatatttaatgtactgtatacattaaatgtaccaaatgtattcttatatttaatgtataaaagaagtttatatttaacatataagatatgtttacatttaatgtataaaatgtttatgtttgatgtataaaagatgtttatatttaacgtatacaatttatatttaatgtaccaaatatattattatatttaatgtccaagccagccaagccagtcagccaagccagctaagccacccacccagccaagccagccaagtgagtcagctagccagccagccaagccagccaaaccagccaagccagtcagccagccaagccagccaagccagccagccagccaagccagccaagccagccaagcaagccagccagccaagccagccagccagcccaggagccccagccagccagccaacccaaacagccaagccagccaagccagccagccagccaagccagccaaggcagccaagccagccaagccagccaggcagccaagcaaaccaagccagccagccagacaaggcagccaagccagcaggccaagcgagccaagccaagccagccaagccagccagttagccagccaagccagccaagccagccagccagccaagccagcccagccagccagccagccagccgagccggccaagccagacagcgagcccagccagcccagccagtcagccagccaaaccagccagccagccaagccagccagccacccagccaagccagccacccagcaaagccagccaagagacccaagccagccagcaaagctggccaaaccagccaagccagtcagccaagccagccaagccggccacccagccaagccagacaagccagccaaccagccagacagcccagccagacagccagcccaggcagccaagagacccaagccagccagcgaagctggccaacccagccaagccagtcagccaagtcagccaagccggccacccagccaagccagccaagccagccaagccagtcagccagccagccagccaagccagccaagccagtcagccagccagccagccaagccagccaagcctcccagccagccaaaccagccaagccacccagccagccaagccagccaagccacctagccagccaggcccgccagccagccagccagcgagccaagccagccaagccagccagcctgccaagccagccggccagccaagctagccaatccactcagccactcaagccagccaagtcacccggccatccaagccagccaagccagtcagccagcccagacagccaagccagccaagccagccaagcccgccaaccagccaagacaggcatgctagccaagccagccaggcagcgaagccagccaagccagccagcaagcaaagccaggcatgtcagccaagccagccaggcagccaagccagcaaagccagccaagccagccagccagccaagccaggcatgccagccaagccatccagccagctaagccagccggctagccaagccagccaagccacccggccagccaagccagccagccaagccagccaagcctgccaagccagccaaccagccaagccagccagctagccaagccacccagtcagccagctagccaaaccagccaagccacccagccagccaagccacccagccagccaagccagccaagccacccggccatccaagccagccaagccagtcagcccagacagccaagccagccaagccagccaagcccgccaaccagccaagacaggcatgctagccaagccagccaggcagcgaagccagccaagccagccagcaaggaaagccaggcatgtcagccaagccagccaggcagccaagccagccaagccagccaagccagccagccagccaagccaggcatgccagccaagccatccagccagctaagccagccggctagccaagccagccaagccacccggccagccaagccagccagccaagcctgccaagccagccaaccagccaagccagccagctagccaagccacccagtcagccagctagccaaaccagccaagccacccagccagccaagccacccagccagccaagccagccaagccacccggccatccaagccagccaagccagtcagccagcccagacagccaagccagccaagccagccaagcccgccaaccagccaagacaggcatgctagccaagccagccgggcagccaagccagccaggcagcgaagccagccaagccagccagcaagcaaagccaggcatgccagccaagccagccaaccagccaagccagccagctagccaagccacccagccagccagccagccaaaccagccaagccacccagccagccaagccacccagccagccaagccagccaagccaatcagccagccaggcagccagccacccagccagccaagccagccaagccagccaagccaatcagccagccaggcagccagccacccagccagccaagccagccaagccacctagccagccaggcccgccagccagccagccaggcagccaagccagccaagccagtgaagcccgccagccagccaagacaggcatgccagccaagccagccaggcagccaagccagccaagccagccagccagccaagccaggcatgccagccaagccatccagccagctaagccagccggctagccaagccagccaagccacccggccagccaagccagccagccaagccagccaagccagccaaccagccaagccagccagctagccaagccacccagccagccagccagccaaaccagccaagccacccagccagccaagccacccagccagccaagccagccaagccaatcagccagccaggcagccagccacccaagccagccaagccagccaagccagccaagccacctagccagccaggcccgccagccagccagccaggcccgccagccagccagccaggcagccaagccagccaagccagtcaagcccgccagccagccaagacaggcatgccagccaagccagccaggcagccaagccagccaagccagccagccagccaagccaggcatgccagccaagccatccagctagctaagcccgctggctagccaagccagccaagccacccggccggccaagccagccaagccagccaaccagccaagccagccagctagccaagccacccagccagccagccagccaaaccagccaagccacccagccagccaagccacccagccagccaagccagccaagacagccaggcagccagccacccaagccagccaagccagccaagccggccaaaccagccaaccagccaagccagccagccatccaagccagccaagacagccagccagccaagccagtcaagccagccatacagccaagccagccaagccaggcaagccacccagccagccaagccatctagccatcaagccagtcaggccagccagccagcctgccaagccggccacccaccaagccagccagccatccacgccagccaagccagttagccagccagccaagccacccagccagccaagccagccaagccacacagccagccaagccacccagccagccaagacagccaagccacacagccagccaagccatccagccagccaagacagccaagccagccaagccatccagccagccacgcaagccaagccagccagccagccaagcaatccgtgccagccaagccatccagccagccaagcgaggtgtccggccaagccaccccaccagccaagccagccagccagccagccagccagccaagccacccagccaactaagccagccaaaccacccagccaggcatgccagccaagccacccagccagccaagcctgtcagccagcgaaccagccaagccagccatgccagccagccagccaagccatacaagccagccagccagccatgccaggacgagactccatctcaaaaaaaataaaaaaaaaacagcctggccaacatgatgaaaccccgtctctactaaatgtataaaaaattatctaggcgtggtggcacacgccagtaatcccagctactcgggaggcccaggcaggaggatcgctttaaccagggaggtggaggttgaagcgaaccaagattgcaccacctcattccagcctgggcaacagggtgagactcaatctcagaaaaagaaaaaaaaaaaggccagcctggccaacacggtgaaaccccatctctactaaatatgaaaagaaattagctgggcgtggtggcacatgaatgtaatcccagctactcgggaggcccaggcaggaggatagcttgaaccctgggggtggaggctacagcgagccaagattgcaccactgcactccagcctgggcaacagggcgagactccatctcagaaaaaataaaataaaatagaccagcctggccaacagggtgaaaccccatctctacaaaatatacagaaaaattagctgggggtggtggcacacacctgtaatcccagctactcgggaggcccaggaaggaggatcgcttgaatcagggaggtggaggctgcagcgagccaagattgcaccactgcactccagcctgggcaacagagtgagactccatctgaaaaaacagaagcattccagcctggccaatagagcgagactccatctcaaaaaaaaaaaaaaaaaaaaaaaaaacaccagcctggccaacatggtgaaaccccgtctcttctaaatatacaaaaaaaatagggccaggcgtggtggctcatgcctgtaatcccagcaccttgggaggccgaggtgggtggatcacgaggtcatgagatcgagaccagcctgaccaacatggtgaaaccccgtctctactaaaaatagaaaaattagctggatgtggtggcacatgcctgtaatccctgctactccggaggctgaggcaggagaattgcttgaacctaggaagcggaggttgcagtgagccgagatggcgccactgtactccacggtggtgtcagagtgatactacatctcaaaaaaaaaaaaaatagctgggtttgatggcacacacctgtaataccaggtactcgggaggcccaggcaggatgatcacttgaacccgggagggggtggttgccgtgaaccaagattgtaccactgcactccagcctgggcaacagggcgagactccatctcaggaaaaaaaaaaaaaaaagaccagcctggccaacatggtgaaaccccgtctctactaaatataaaaaaaattacctggatgtggtggcacatgcctgtgatcccagctgctcgggaggcccaggaaggaggatcgcttgaacctgggaggtggaggctgcagcgagccaagattgcaccactgcactccaccctggataacagaattagactctatatgaaaaaaaagaagaactccagccagggcaatagagtgagactccatctcaaaaaaaaaaaaaaaaaaaaaaaaagaccagcctggccaacatggtgaaaccccgtctctactaaatacacaaaaaaattagctgtgcgtggtggcacacgcctgtaatcccagctactcgggaggcctaggcaggaggatcgcttgaacccgggaggtggaggttgcagcgaaccaagattgcaccactgcactccagcctgggcaacagagcgagactccatctcaggaaaaaaaaaaaatatcagcctggctaacatggtgaaaccccgtctctactaaatatacaaaaaaaattagctgggcgtggtggcacacgcctgtaatcccagctacccgggaggcccaggcaagaagatctcttgaacccagaaggtatatgctgcagcgagccaagattgtcccaccgcacttccgcctgggcaacagagcgagactccgtctcagaaaaaaaaaaaaaaaaaaaaaacaagaacaggttggccaacatggtaaaaccatgtctctactaaatatacaaaaaaattagttaggcatggtggcacacgcctgtaatcccagctactcggaaggcccaggcaggaggatcgcttgaacccgggaggtggaggctgcagcaaaccaagattacaccactgcactccagcctgggcaacagggcgagactccatctcagaaaaaaaaaaaaagaccagcctggccaacatggtgacaccccgtctctagtaaatatataaaaaaattagctgggcatggtggcacacggctgtaatcccagctactcgggagccccaggcagtaggatcgcttgaacctgggaggtggaggctgcagcgagccaagatagcaccactgaactccagcctgggcaacagggtgagactccatctcagaaaagagagaaaaaaattaaaaaaagaccagcttggccgacatggtgaaacctcatctctactaaaaatacaaaagtattagctggccgtggtggcacacgcctgtaatcccagctactcgggaggcccaggaaggaggattgcttgaacctgggagtttgaggctgcagcgagccaaaattgcaccactgcactccacccgagtgagactccatctgaaaaaaagaactccagccacggcaatatagcgagactcaacctcaaaaaaaaaaaaaaaaaaaaaaaaaacaccagcctggccaatatggtgaaccccgtgtctactaaatatacaaaaaaattagctgggtgtcacggcacacgcctgtaataccagctacttggtaggcacaggcaggaggatcgcttgaacccgggaggtagaggctgcagtgagccaagattgcaccactgcactccagcctgggcaacagggtgagactccatctcagaaaaaaaaaaaaaacaaaaagagcagcctggccaacatggtgaaaccccgtcaatactaaatatacaaagaaattagctgtgcatggtggcacacgaatgtaatcccacatactcgggatgcccaggaaggaggatcgcttaaacccgggaggtggaggctgcagcgagccaagattgcaccactgcactcgagccagggcaacagggccagactccatctcaaaaaaaaaaaaaaagaccagcctgggcaacatggtgaaaccccatctctactaaatatacaaaaaaattgctgggcgtattgctacacacctgtaatccccgctacttgggaggcccagacaagaggatcacttgatcccgggaggtggaggctgcagcgagccaagattgtaccacagcacttcagcctgggcaacagagcgacactccatctcagaaaaaaaaaaaaaaaaaaaaaagaacaggttggccaacatggtgaaaccccatctctactaaatatacaaaataattagctgggcgtggtgacacacacctgtaatcccaggcaggaggattgcttgaacctgggaggtggaggctgcagccagccaggattgcaccactgcactccaccctgggcaaaatgtgagactccatctgaaaaaaaagaagcattccagcccgggcaatatagcgagactccaactcgaaaaaaaaaaagaccagctggccgacatggtgaaaccccatctctactaaatatacaaaaatattagctgggcgtggtggcacatgcctgtaatcccagctactcgggaggcccaggaaggaggatcgcttgaacccgggaggtagaggctgcagcggagccaagattgcaccactgcgctccatcctgggcaacagagtgagactctatatgaaaaaaaagcactccagcctgggcaatagagcgagactccatctcagaaaaaaaaaaaaaaagaaagaccagccttgccaacatggtgaaaccccgtctctactaaatatacaaaaaaattagctgggcgtcatggcacacgcctgtaatcccagctactcggtaggcccaggctggaggaatgcttgaacccgggaggtggaggttgcagcaaaccaagattgcacctctgaacgcctgcctgagcaacagggtgagattcaatctcagaaaaaaaaaaaaaaaaaaaaaaaagagcagcctggccaacatggtgaaaacccatcaatactaaatatacaaagaaattagctgagcatggtggcacacgaatataatcccagctactcgggaggcccaggtaggaggatcccttgaacccgggaggtggaggctgcagcgagccaagattgcaccactgcactccagcctgggcaacagggcgagactccatctcaaaacaacaacaacaacaacaacaacaacaacaaaaaacagcctgcccaacatggtgaaaccccgtctctactaaatatacaaagaaattagctgggcgtcatggcacacgaatgtaatcccagctactcgggagtcccagacaggaggatcgcttgaacctgggagttggaggctacagcgagccaagattgcaccactgcactctgctctgggtaacagagtaagagtccatctgaaaaaaaagaagcactccagcctgggcaacagagagagactccatctcagaaaaaaaaaaaaaaaaaaaaaaaaaaaaaagaccaggttggccaacatggtgaaatcccgtctctactaaatatacaaaaaaaattagctggacgtggtggcacaggcttctaatcccagctactggggaggcccaggcaggaggatcacttgaacctgggaggtggaggctgcagcgagccaagattgcaccactgcactctggcctgggcaacagagtgagagtccatctgaaaaaaaagaagcactccagtctggtcaacagagcgagactccatctcagaaaaaaaaaaaaaaaaaaaaaagaccaggttggccgacatggtgaaaccccgtctctactaaatacacaaaaaaattagctgggcgtggtggcacatgcctgtaatcccagctactcgagaggcccaggcaggaggatcgcttgaacctgggaggtggaggctgcagcgagccaagactgcaccactgcactccggcctgtgcaacaaagtgagactccatctgaaaaaaaaagaaacactccagcctgggcaatatagcaagactccatctcaaaaaaaaaaaaaaaaaggaaaaaagagcagcctgtccgacatggtgaaaccacgtctctactaaatatgcaaaaaaattagctgggcgtggtggcacacgcctgtaatcccagctactcgggaggcccaggcaggaggatcgcttgaacccgggaggtggaggttgcagcgaaccaagattgcaccactgcactccagcctgggcaagaaagtgagattccatctgaaaaaaaagcactccagcctgggcaatatagcaagactccatctcaaaaaaaaaaaaaaaaaaagaccagcctgtccaacatggtgaaaccccatcagtactaaatatacaaagaaattagctgagcgtggtggcacacgattgtaatcccagctactcgggaggcccaggcaggaggatcgcttgaactcgggaggtagaggctgcagccagccaagattgcaccactgcactgaaccctggacaacagagtgacactccatctgaaaaaaaagaagaactccaaccagggcaatggagcgagactccatctcagaaaaaagaaaaaaaaagagcaccttggccaacatggtgaaaccccgtcagtactaaatacacaaagaaattagctgagcatggtagcacacgaatgtaatcccagctactcgggaggcccaggcaggaggatcgcttgaacccgggaggtggaggttgcagcgaacaaagattgcaccactgcactccagcctgggcaacagagcgagactcccactcagaaaaaaaaacaaaatgaaaaaaaacaccagcctggccaacatggtgaaacaacgtctccactaaatatacaaaaaaaatagatgggcgtggtggcactcatctctaatcccagctactcgggaggccaacgcaggaggatcacttgaacacaggaggtggaggctgcagctagccaagtttgcaccattgcactccagcctggcaaaccaagccagccaagccaaccagccaagccagtcaagcgacccagccagccagccagccagctaagccacccaaccagccagcctgccaagccagccaagccagccagccagccagccggccaggcagccaagccaagccagccaagccagctagccagccaagtcagccaagccagctagccagccaagtcagccagccaaaccagccaagccacccagccagccaagccacccaagacacccagccagccagccagccaagccagccaagccacccagccagccaagccagccaagcaagccagccaagccagccaagccagccaagccaggagccagccaagccagccaagccagccaagcctgccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacacaagccagccaactcagccagctagccaagcaagccaagccagccagccagtcaagccagccaagccagccagccaaccaggccagctaaaccagccagcctgccaagccagccaagccagccagccagccaggccagccagccaaacaaggcaccgcagccagcccagccagccacacaagccagccaagtcagccagccagccaagccagccaagccagcccgccaaggcagccatgccagccagccagccaagccagccaagccagccaagccagccagccacccagccagccaagccaggcagccacccagcaagccaggccagcctgccacccagccagccaagccagacaagccagccaagccagccagccacgcagccagccaggacatccagccacccagccagccaagccatgcaagccaacaagccagcccagacagccaagccagccaagcaagccagcaagccagccagccaagccagccagccaaaccagccaagccacccagccagccaagccacccaagacagccagccagccagccagccaagccagccaactagccaagccagccaagcaagccaccagccaagccagccaagcctgccagccagcagagccagccaaccagccaagccagccagccagccacttaagccatccaagcaacccagccagccaagccagccaagccaccgacccagccaagccagccaagccacccagccagccaagccagccaagccagccaaaccagcctgccagccaagccagccaagccatccagccagccaagccagccggccagccaagctagccaatccactcacccactcaaactagccaagtcacccggccagccaagcctgccaagccagctagccagcccagacagccaagccagccagccagccaagccagccaagccagccagccagccaatctagccaagccagccaagccagccaagccagccagccagccaagccagccaagccagccagccagccaagccagccggccagccaagctagccaatccactaagccactcaaaccagccaagtcacccggccagccaagccagccaagccagccagccagcaaagccagcccagccagccagccagccagccagccgagccgccaagccagacagcgagcccagccagcccagccagtcagccagccaaaccagccagccagccaagccagccagccacccagccaagccagccacccagcaaagccagccaagagacccaagccagccagcaaagctggccaaaccagccaagccagtcagccaagccagccaagctggccacccagccaagccagacaagccagccaaccagccagacagcccagccagacagccagcccaggcagccaagagacccaagccagccagcgaagctggccaacccagccaagccagtcagccaaaccagccaagccggccacccagccaagccagccaagccagcgaaccagccagacagccctgccagacagccagcccaggcagccaaaccagacaagccagccagccaagccagccaagccagccagccagccaagacaggccagccaagcaagccatggaagccagacagccagccagccaagctagccaacccagccagccaagctagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccagggagccaagccagccagcaagcaaagccaggcatgccagccaagccagccaggcagccaagccagccaagccagccagccagccaagccaggcatgccagccaagccatccagccagctaacccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagacaagccagccaaccagccagacagccctagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccaggcagccaagccagccaagccagccagccagccaagccaggcatgccagccaagccatccagccagctaagccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagccccaagccagccagcaaagctggccaaaccagccaagccagtcagccaagccagccaagccggccacccatccaagccagacaagccagcaaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccggccaagccactcagccagccaagatggccaagccacccagccagccaagcctgccaagagacccagcaacccaagccagccaagacacccagccagccaagctagccaagacacccagccagcgaagccagccagccagccagccagccaagccagccaagccacccagccagccaagccaggcaaacaacccagccagccaagccagtcaagccacccagccagccaagccggccaagccacccagccagccaagctggccaagtcactcagccagccaagccagccagccagccaagccggccaagccactcagccagccaagatggccaagccacccagtcaagccaactaagccagccaagccacccagccagccaagctggccaagccactcagccagccaagccagccagccagccaagccggccaagccactcagccagccaagatggccaagccacgcagtcaagccagccaagccagccaggcagccaagccagccaagacctccagccagccaagaaaggcatgccagccaagccagcaaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccacgacacccagccagcgaagccagccagccagccagccagccaagcctgccaagccacccagccagccaagccaggcaaacaacccagccagccaagccagtcaagccacccagccagccaagccagccaagccagccaagccacccagccagccaagctggcaagccactcagccagccaagccagccagccagccaagccggccaagccactcagccagccaagatggccaagccacccagtcaagccagctaagccagccaagccacccagccagccaagccagccaagccactcagccagccaagccagccagccagccaagccggccaagccactcagccaaccaagatggccaagccacgcagtcaagccagccaagccagccaggcagccaagccagccaagacctccagccagccaagaaaggcatgccagccaagccagcaaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccacgacacccagccagcgagaggcagctaggcagctagccaagcctgcccagccagctcgagccagctaagccaggccaagcaagctagccatccaagcttgacaagccagccaagcatgccagccaagccagcgcagctggagccagccaagccagccaagccagccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacacaagccagccaactcagccagctagccaagccagccaagccagccagccagtcaagccagccaagccagccagccaaccaggccagctaaaccagccagccagccaggccagccagccaacccagccaccgcagccagcccagccagccacacaagccagccaagtcagccagccagccaagccagccaagtcagccaagccagccagccagccaagccagccaagccagccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccagccagccaagccggccaagccagccagccagccaagccagccaagccagccagccagccaagccagccaagcaagccagcaagccagccagccaagccagccagccaaaccagccaagccagccagccagccaagcgctttacccgaacgtccgtgaggcagtgagagccaaagcagcctgccagccaagccagccaagccatccagccagccaagccagccagccagccaagctagccaatccactcacccactcaaactagccaagtcacccggccagccaagcctgccaagccagctagccagcccagacagccaagccagccagccagccaagccagccaagccagccagccagccaagccagccggccagccaagctagccaatccactaagccactcaaaccagccaagtcacccggccagccaagccagccaagccagccagccagcaaagccagcccagccagccagccagccagccagccgagccggccaagccagacagcgagcccagccagcccagccagtcagccagccaaaccagccagccagccaagccagccagccacccagccaagccagccacccagcaaagccagccaagagacccaagccagccagcaaagctggccaaacccgccaagccagtcagccaagccagccaagccggccacccagccaagccagccaagccagccaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaacagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagccaacccagccagccaagccagccaagccagccaagccagtcagccagaaaagccagccaagcctgccagccagtcaagccagccaagcctgccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccggccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagcctgccagccaagccggccaagccagccagccagccaagccagccaagccagccagccagccaagccagccaagcaagccagcaagccagccagccaagccagccagccaaaccagccaagccagccagccagccaagccacccaagacacccagccagccagccagccaagccagccaagccacccagccagccaagccagccaagcaagccaggcaagccagccaagccagccagccagccagccacccagccacccagccagccaagccagccagccacccagccggccaggccagcctgccacccagccagccaagccagacaagccagccaagccagccagccagccagccagccagccagccaagccagccaagcctcccagccagccaagccagccaagccacccagccagccaagccagccaagccacctagccagccaggcccaccagccagccagccaggcagccaagccagccaagccagtcaagcccgccagccagccaagacaggcatgccagccaagccagccaggcagccaagccagccaagccagccaggcccgccagccagccaagacaggcatgccagccaagccagccaggcagccaagtcagccaagccaggcagcaagcaaagccaggcatgccagcccagccagccaggcagccaagccagcaaaaccagccagccagccaagccaggcatgccagccaagccatccagccagctaagccagccggctagccaagccagacaagccacccggccatccaagccagccagccaagccggccaagccagccaaccagcaaagccagtcagctagccaagccagccaaccagccagccagctaagctggccagcctgccagccaaccaagccggccagacagccaaggcagccaagccggccaggcagccaagccagccaagccaccgacccagccaagccagccaagccacccaagccacccagccagcccagacagccaagccaggcagccagccaagccagccagccagcaaagccaggcagccagccaagccagtcaagccagacagccagccaagccagccagccagccaagcgagccaagccagccagccagccaggccagccagccacccagccagccaagccagccagccacccaaccagccaggccagcctgccacccagccagccaagccagacaagcctgcgaagccagtcagccacccagccagccaggccagccagccacccagtcagccaagccatccaagccagccggccagcacagacagccaagccagccacccagtcagccaagccatccaagagagccagccagcccagacagccaagccagccagccagccaagccagccaagcaagccagcaagccagccagccaagccagccagccaaaccagccaagccacccagccagccaagccacccaagacacccagccagccagccagccagccaagccagccaagccacccagccagccaagccagccaagcaagccagccaagccagcgcagccaggagccagccaagccagccaagccagccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacccaagccagccaactcagccagccagccaagccagccaagccagtcagccagccaagccagccaagccagccaagccagtcaagccagtcagccagccaagccagccaagccagccagccagcccagacagccaagccagccagccagccaagccagccaagcaagccagcaagccagccagccaagccagccagccaaaccagccaagccacccagccagccaagccacccaagacacccagccagccagccagccaagccagccaagccacccagccagccaagccagccaagccagccaagcctgccaagccaaccatccagccaagcctgcaaagccagcccgccagcaaagccagccaagtcagcctgccaagccagccaagacagccagcaagccaagccagccaagccagccagccaagccagctagccaagccagccaaggcagccaagccagtcagccagccaagctagccaagccaggcagccatccaagccagccagccatccaagccaatgaagccagccagccagccaagccacccaagccagccaagccagccagccaagccagctagccaagccagccaaggcagccaagccagtcagccagccaagctagccaagccaggcagccatccaagccagccagccatccaagccaatgaagccagccagccagccaagccacccaagccagccaagccagccaactcagccagccagccaagccagccaagccagccagccagtcaagccagccaagccagccagctaaccaagccagctaaaccagccaagcctgccaagccagccaagccagccaagccagccagccagccagccatcccagccagcccagccagccaagccagccagccacccagccggccaggccagcctgccacccagccagccaagccagacaagccagccaagccagccagccagccaagccagccaagcctcccagccagccaagccagccaagccacccagccagccaagccagccaagccacctagccagccaggcccaccagccagccagccaggcagccaagccagccaagccagtcaagcccgccagccagccaagacaggcatgccagccaagccagccaggcagccaagccagccaagccagccaggcccgccagccagccaagccaggcatgccagccaagccagccaggcagccaagccagcaaaaccagccagccagccaagccaggcatgccagccaagccatccagccagctaagccagccggctagccaagccagacaagccacccggccatccaagccagccagccaagccagccaagccagccaaccagcaaagccagtcagctagccaagccagccaaccagccagccagctaagctggccagcctgccagccaaccaagccggccagacagccaaggcagccaagccggccaggcagccaagccagccaagccaccgacccagccaagccagccaagccacccagccagcccagacagccaagccaggcagccagccaagccagccagccagcaaagccaggcagccagccaagccagtcaagccagacagccagccaagccagccagccagccaagcgagccaagccagccagccagccaggccagccagccacccagccagccacccagccagccagcccagccagccaagccagccagccagcccagccagccccgccagccagccaacccagccaccgcagccagcccagccagccacacaagccagccaagtcagccagccagccaagtcagccaagccagcccaccaaggcagccatgccagccagccagccaagccagccaagccagtcagccagccaagccagccaagccagccagccagccaagccagccaagccagccaagtcaactgagccagccaagccagtcagccaagccaggcaagccagcaaagtcagccagccagccaagccagccaagccagcccagccagcccagccagctaagccagcccagccagccagccaagccatccaagccagccagccagccagccagcccagccagccaagccagcccagccagccaaccaagccagccagccagccatgccagccaagccagccagccatccaagccaaccaagccagccagccaagccagccaagccagccaagccagccaagccacccaggcagccaagccagccaagccagccaagccagccaggcagccaagccagccaagccagccaagccagccagccaagccagccagccagccaagagagccaagccagccatccagccaggccatccagccacccagccagccaagccagcctgccacccaaccagccaggccatccagccacccagccagccaagccagcctgccacccaaccagccaggccagcctgccacccagccagccaagccagacaagcctgcgaagccagtcagccacccagccagccaggccagccagccacccagtcagccaagccatccaagccagccggccagcacagacagccaagccagccacccagtcagccaagccatccaagagagccagccagcccagacagccaagccagccagccagccaagccagccaagcaagccagcaagccagccagccaagccagccagccaaaccagccaagccacccagccagccaagccacccaagacacccagccagccagccagccaagccagccaagccacccagccagccaagccagccaagcaagccagccaagccagccaagccaggagccagcccagccagccaagccagccagccacccagccacccaagacagctaaaccagccagcctgccaagccagccaagccagccagccagccaggccagccaagccagccaagccattcaagccagccagccagcccagccagccaagccagccagccagcccagccagcccagccagccagccaacccagccaccgcagccagcccagccagccacacaagccagccaagtcagccagccagccaagccagccaagccagcccgccaaggcagccatgccagccagccagccaaaccagccaagccacccagccagccaagccacccaagacagacagccagccagccaagccagccaactagccaagccagccaagcaagccaccagccaagccagccaagcctgccagccagcagagccagccaaccagccaagccagccagccagccaaaccagccaagccagccagccagccacttaagccatccaagcaacccagccagccaagccagccaagccaccgacccagccaagtcagccaagccacccagccagccaagccagccaagccagccaaaccagcctgccagccaagccagccaagccatccagccagccaagccagccagccagccaagctagccaatccactcacccactcaaactagccaagtcacccggccagccaagcctgccaagccagctagccagcccagacagccaagccagccagccagccaagccaaccaagccagccagccagccaagccagccggccagccaagctagccaattcactaagccactcaaaccagccaagtcacccggccagccaagccagccaagccagccagccagcaaagccagcccagccagccagccagccagccagccgagccggccaagccagacagcgagcccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagccaagccagccaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaccagacaagccagccagccaagtcagccaagccagccagccagacaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccagccaagcctgccaagccacccagccagccaagccaggcaaacaacccagccagccaagccagtcaagccacccagccagccaagccagccaagccacccagccagccagccggccaagccactcagccagccaagccagccagccaggccagccgggcaagccattcagccaggcaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccagccagccaagccagccaagccagccagccagccaagccaggcatgccagccaagccatccagccagctaagccagccggctagccaagccagacaagccacccggccagccaagccagccagccaaggcagccaagccagccaaccagtcaagccagtcagctagccaagccagccaaccagccagccagtcaagccggccagcctgccagccaaccaagctggacagacagccaaggcagccaagccggccaggcagccaagccagccaagccactgacccagccaagccacccagccagccaagacagccaagccagccaaaccagcctgccagccaagccagccaagccatccagcctgccaagccagctggccagccaagctagccaatccactcacccactcaagccagtcaagtcacctggccagccaagccagccaagccagccagccagcccagagagccaagccagccagcccagacagccaagccagccagccagccaagcctgccaagccacccagccagccaagccaggcaaacaacccagccagccaagccagtcaagccaaccagccagccaagccagccaagccacccagccagccaagctggccaagccactcagccagccaagccagccagccagccaagccggccaagccactcagccagccaagatggccaagccacccagtcaagccagctaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccaggcatgccagccaagccatccagccagctaagtcagccggctagcccagccagccaagccacccatccagccaagccagccagtcaagccagccaagccagccaaccagtcaagccagtcagctagccaagccagccaagccacccggccagccaagccagccagccaacccagcccagccagccaaccagccaagacattcagctagccaagccagccaaccagccagccagtcaagccggccagcctgccagccaaccaagccggacagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccactcacccactcaagccagccaagtcacccggccagccaagccagccagctcagacagccaagccagccagccaagccagccaagccagccagccagccaagccggccaagccactcagccagccaagatggccaagccacgcagtcaagccagccaagccagccaggcagccaagccagccaagacctccagccagccaagaaaggcatgccagccaagccagctaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagcaagcaaagacacccagccagccaggttagcaaagacacccagcagggagccagccagcaagccagcgagccaagctgggcaaggccaccaagcgagcccggcagctcagtcagtcacagaggccagcagaccgtggtcaagccacccagccagctaagcagatctacgcacaagctctccaagccactcagccagctaagctagccagcagtcaagccggccaagccactcagccagccacggcgccaagccacgcagtcaagccagccaagctagccaggcagccaaggcagccaagccagccaagacctccagccagccaagaaaggcatgccagccaagccagccagggagccaagccagccagcaagcaaagccaggcatgccagccaagccagccagggagccaagccagccagcaagcaaagccaggcatgccagccaagccagccaggcagccaagccagccaagccagccagccagccaagccaggcatgccagccaagccatccagccagctaagccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagacaagccagccaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccacccagccagccaagccaggcaaacaacccagccagccaagccagccaagccacccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccaggcagccaagccagccaagccagccagccagccaagccaggcatgccagccaagccatccagccagctaagccaaccagcaagcaaagccaggcatgccagccaagccagccagccagccaagccagccaagccagccaaccagtcaagccagtcagctagccaagccagccaagccacccggccagccaagccagccagccaacccagccaagccagccaaccagccaagacattcagctagccaagccagccaaccagccagccagtcaagccggccagcctgccagccaaccaagccagccagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccactcacccactcaagccagccaagtcacccggccagccaagccagccaagccagccagccagcccagacagccaagccagccagcccagacagccaagccagccagccagccaagccagccaagccacccagccagccaagccagccagccaaaccagccaagccacccagccagccaagccacccaagacagccagccagccagccaagccagccaactagccaagccagccaagcaagccaccagccaagccagccaagcatgccaaccagcagagccagccaaccagccaagccagccagccagccaagccagccaagccagccagccagccactcaagccatccaagcaacccagccagccaagccagccaagccacccagccagccaagccagccaagccagccaaaccagcctgccagccaagccagccaagccatccagccagccaagccggccggccagccaagctagccaatccactcacccactcaagccagccaagtcacccggccagccaagccagccaagccagccagccagcccagacagccaagccagccagcctagacagccaagccagccagccagcaaagccagccaagccagccagccagccaagccagccaagccacccagccagccaagccagccagccaaaccagccaagccacccagccagccaagccacccaagacagccagccagtcagacaagccagccaactagccaagccagccaagcaagccaccagccaagccagccaagcatgccaaccagcagagccagccaaccagccaagccagccagccagccaagccagccaagccagccagccagccactcaagccatccaagcaacccagccagccaagccagccaagccacccagccagccaagccagccaagccagccaaaccagcctgccagccaagccagccaagccatccagccagccaagccagccggccagccaagctagccaatccactcacccactcaaactagccaagtcacccggccagccaagccagccaagccagctagccagcccagacagccaagccagccaggcagccaagccagccaagccagccagccagccaagctagccaagccagccaagacagccaagccagccagccagccaaaccagccagccagccaagccagccagccacccagccaagccagccacccagcaaagccagccaagagacacaagccagccagcaaagctggccaaaccagccaagccagtcagccaagccagccaagccggccacccagccaagccagccaagcctgccaaccagccagacagcccagccagacagccagcccaggcagccaagagacccaagccagccagcgaagctggccaacccagccaagccagtcagccaagccagccaagccggccacccagccaagccagcaaagccagccaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagtcagccagaaaagccagccaagcctgccagccagtcaagccagccaagccagccagccagccaagcggccaagccgcccagccagccaagatgccaagccacccagccagccaagcctgccaagagacccagcaacccaagccagccaagacacccagccagccaagctagccaagacacccagccagcgaagccagccaagacagccagccagccaagccgccaagccagccagccaagcaagccatggaagccagacagccagccagccaagccagtcagccaagccagccaagccggccacccagccaagccagccaagccagcgaaccagccagacagccctgccagacagccagcccaggcagccaaaccagacaagccagccagccaagccagccaagccagccagccagccaagacagccaagccagtcaagccaggcaagccagcgagccagccaagccagccaacccagccaagccagccagccagccaagcggggggagccactcagccagccaagatggccaagccacgcagtcaagccagccaagccagccaggcagccaagccagccaagacctccagccagccaagaaaggcatgccagccaagccagctaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccgcccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccagccaagccagccagccagccaagccaggcatgccagccaagccatccagccagctaagccagccggctagccaagccagacaagccacccggccagctaagccagccagccaaggaagccaagccagccaaccagtcaagccagtcagctagccaagccagccaagccagccagccagccaagccaggcatgccagccaagccatccagccagctaagtcagccggctagcccagccagccaagccacccatccagccaagccagccagtcaagccagccaagccagccaaccagtcaagccagtcagctagccaagccagccaagccacccggccagccaagccagccagccaacccagcccagccagccaaccagccaagacattcagctagccaagccagccaaccagccagccagtcaagccggccagcctgccagccaaccaagccagccagacagccaaggcagccaagccagccaggcagccaagccagccaagccactgacccagccaagccacccagccagccaagagagccaagccagccaagccagccaaaccagcctgccagccaagccagccaagccatccagcctgccaagccagctggccagccaagctagccaatccgctcacccactcaagccagccaagtcacccggccagccaagccagccaagccagccagccagctcagacagccaagccagccagccaagccagccaagccagccagccagccaagccagccaagccacccagccagccaagccagccagcaagccagccagacagccaagccagccagccacccagccagccagtccagccagccacccagccagccaagccagccagccatccagccagccaggccagcctgccacccagccagccaaggcagacaagccagccaagccagccagccacccagccagccaggccagccagccactcagccagcccagacagccaagtcagccaagtcagccagccagccaaggcagccaagccagccaaccgaacaagagagccagccaaccaagccagccaagccagccagctagccaagccacccagccagccagccagccaaaccagccaagccacccagccagccaagccagccaagccaatcagccagccaggcagccagccacccaagccagccaagccagccaagccatccaagccagccagccagccagccagccaagccagccaagcctcccagccagccaagccagccaagccacccagccagccaagccagccaagccacctagccagccaggcccgccagccagccagccagccaaaccagccaagccacccagccagccaagccagccaagccaatcagccagccaggcagccagccacccaagccagccaagccaaccaagccatccaagccagccagccagccagccagccaagccagccaagcctcccagccagccaagccagccaagccacccagccagccaagccagccaagccacccggccatccaagccagccaagccagtcagccagcccagacagccaagccagccaagccagccaagcccgccaaccagccaagacaggcatgctagccaagccagccaggcagccaagccagccaggcagcgaagccagccaagccagccaggcagcgaagccagccaagccagccagcaagcaaagccaggcatgccagccaagccagccagctagccaagccacccagccagccagccagccaaaccagccaagccacccagccagccaagccacccagccagccaagccagccaagccaatcagccagccaggcagccagccacccagccagccaagccagccaagccacctagccagccaggcccgccagccagccagccaggcagccaagccagccaagccagtcaagcccgccagccagccaagacaggcatgccagccaagccagccaggcagccaagccagccaagccagccagccagccaagccaggcatgccagccaagccatccagctagctaagccagccggctagccaagccagccaagccacccggccggcaaagccagccaagccagccagctagccaagccacccagccagccagccagccaaaccagccaagccacccagccagccaagccacccagccagccaagccagccaagacagccaggcagccagccacccaagccagccaagccagccaagccggccaaaccagccaaccagccaagccagccatccatccaagccagccaagccagccaggcagccaagccagccaagccagccagccagccaagccagcgaagacaccgagccagccaaacaagccaagccacccagccagccaagcctgccaagagacccagcaacccaagccagccaagacacccagccagccaagctagccaagacacccagccagcgaagccagccagccagccagccagccaagcctgccaagccacccagccagccaagccaggcaaacaacccagccagccaagccagtcaagccacccagccagccaagccggccaagccacccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccaggcatgccagccaagccatccagccagctaagccagccggctagccaagccagccaagccacccggccagccaagccagccagccaagccagccaagccagccaaccagtcaagccagtcagctagccaagccagccaagccacccggccagccaagccagccagccaacccagccaagccagccaaccagccaagacattcagctagccaagccagccaaccagccagccagtcaagccggccagcctgccagccaaccaagccggacagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccgctcacccactcaagccagccaagtcacccggccagccaagccagccaagccagccagccagcccagacagccaagccagccagcccagacagccaagccagccagccagccaagccagccaagccagccagccagccaagccagccaagccacccagccagcccagacagccagcaagccagccagacagccaagccagccagccacccagccagccaggacagccagccacccagccagccatccagccagccaagccagccagccatccagccagccaggccagcctgccacccagccagccaagccagccaagccagccaagccagccagccacccagccaagccagccacccagcaaagccagccaagagacccaagctttttcagccaccagccatcactatcctcttgttttcaaacaggattgggatttgattatttcaaacccttcatgggattgaaactttgtcttaagtcagtgactactacatttccaagtactttcgaggagacatattttcatgtgtttttttgcatagctctggatttcaacttacacacccagaaatgtcacctttagaggcccctttgttgagtacatttgatctcaagtattccaggtctggggatggatctagctggaaaatgttcagacactgaagtttctagagcctgaagatgctcccctatcaggtaccaggaccagccagatctcattctctgactctacataacttctgacaaatgaaatgaagtttccgtttttggccaaccatggagcctgctccgtgtctgatattcttctttgaagactgaggatgtgacctgattgttctctgcctcctttttctagctacatttttttttttagctggttctcacacgggctttccatggcctctctctgattgtggggactggccgtttcccaggcacagcaccttggcctgggggagccgtgagaactgatgagtgtcttttgaaggagtcactgggcttctgcaatgggaggatcttggtgtgtggggagcgtgggaacttttccttttgttggttcaggaatgaaattgttgtgtaaatggaccaagagacctaaggaaagggacagtccttttggctggtgggtcctctccactgatagatccaaacaacagagtggaaaatgtaccacaagaagactacgctcgttgcctggaactcagtagcccctgtggctggtgttggcacttgccttaccagtgtgagcctggttttcccgatcatttggccttccacaataaggacaatttaagagattatttctcaatgttaactacttccttgattaattttgtgatctacctttctcctttctgaccagtagtagaatccatttatgttttcaagatgttgctacttaggatacaattatttctaagaaatacaagtgacattgctttgtagaatgggaaccatgttctacagccctgcaaagacctgtcctgagagagctggggggacgcaggcttggaggaggtgagggcaggcactgagtgggtggagggaatcaaacggctgccagaataaacatcagatggagctcctgggcttcttgaggggtagaatttcctctgagctctctacaagacctcagccacaaccattcatctacttaatacattgaagcaattcacataaaaagccagacagatttttttctctgaatttaaaactggatttagagactagattaataaatattgtctttgtcatgtgagtcactttggagagaatcatgtccccactgtatggcaatgcagcagatcctgaccatgcatatttagtgtgtccttcctgctctcttgggcagaccatcccatcaggctatagcacggagctctcacccatctccctgctctgccatgcaccctccttcttgcctgctctttcttctccctatggccagcccctccagccaacatactttttatctctctttgttttgcaaaatccttttctcctatcacttccatcataaaactagtatttggcaaacaatcacatgtcggcataaagctcttaaattgacctgctttagattaaagcacaatatgggttttatagtttgcctcaggtgaccatttaaatgtcttgaataatgaaatgaaaaactggacagactaaaataagagtcctgtctgcctgtgacagtgaagaataagagtcctgtctgcctgtgacagttaaagaatgatccctcattgcctctcacacagctgcagtcagggttcccaccaccctttctgctgattctgaaatcagccctagttcataaattatcagggaatttggtgagttttctcttttaatgtcagtctgtttatttgactggtagtttctggccttaacacatcccactaatgtgttgtttagttgagcacaataataaatagaacttttgtttacttttacatccaaagataaatgttgagtgctattaaaaacttttctaacatagtaggcctccaatgaggaattttccttcagcaaatcataaaactgggtctagaagtgccaacccaagtaaaattactgatgaactaatcatagttgttatttttccttcatcttttcctttttttttttagacaatcttgccctgtcgcccaggctggagtgcagtggcgtgatctcggcttgctgcaagctctgcctcctgggttcacgccattctcctgcctcagcctcccgagtagctgggactacaggcgcccgccaccatgcctggctaattttttttgtatttttaatagagacggggtttcactgtgttagccaggatggtctcaatctcctgacctcgtgatccgcccaccttggcttcctaaaatgctgggattacaggtgtgagccactgcgcccggctccttcatcttttctatgtgctttgtttgacacttattgaggatacagttgctgaagaccagctgagtaggacataggctctgtcatgcattaactcatccacccattcatttattcactcatctattgagcatctgctatgtgtcaggctctatgccaaactttctgttcaggagccaatatatcaataactacagtgtaagctaagtcatgcaatgaaagacttagagaatagacaccaagttgaatattaacccaagtaaattattggaagatatattagttatctaaaataggcttaaaacaataaacatttattatcacaatttctgtaggtccagaatctggacatgacttagcttgatgtttatggctcaagacctcttgaggtttcaataaaggtgttagtcagggctgcagtctcatctgaaggctcatctggttgggggtggtgtctgtatctatgtggttattggcaggccttggtcctcactacactggaactcttcaaagggttatctcatgacacagaagctagctttccccagggtgaagaatgtaaaagaatgtgagaactcttaagacagatgctatagtcttttctataacttaattttggaagtgatattccatcacttctgccatattctttgttagaatcaagtcagtaaatccagcccagattcaagtgaaaggattccacaagagtgtgagtaccaagaggtagggatattgggagccatctgagaggctgcttaccacagagggccagccagttaggaagtgggttcagctgctgctgttaacaggctcgacctaagtggcttaaacacagaagagttgttgttgttgttgttttttctaatgagaaatctggaggcagtcagttgctggccttggctcaaaggctgagggcactgtggttcttgtagcctttcgcttatggccctaagctgctggaactcttgccatcatgtctgcattccaagcagcagaacaacaagaaaagaacagggggagaagagaaagagggcaccagcccactgactatcctgttcatcctgggaagtaccactcaacaagctcaactctcatttccacagccatctccagctgctcaggagtctgggaaatgtaatcacatgcaccattatccccaagtgcaccactgcctccagcccctttccacctttcagttatagccataaacatccagttagccataaacattcagctaatgcatgtgcagattcttgatctacagaaattgtgatagtaaatatttattgttttaagtctatcttagatcactaacatatcctctacttaacatttcacttgggttaatattcagcttagtgtctattctcaagttttccattgtatgtcttcgttcgcactctcctcattgaaatattggctcctgattagaatgcttgagtactgttcttttataccaccaagcctgctcctcaagccgattttgtgccccgcaagccagcgatggctctattaatggttgtccttgtcttttatgagttcatgtgactgggtgggggagattcaacacccaccctcatgctgctcactctcaagtaaacaagtaagccaacattagagtctcagggctatgaatgggagcacagaaatcacagtgcaacctcccaagtacaggtcaggaagcctggtttaaatatttgaaagcaatttgaggaagttcccagtgggaaatgaacttgagaactaggtcattcatatgtccattcaacatctaccttctgcttatctggagtgtgcatggcactgcctggggccactgcagtgaataagagagatgagaacccaggcaactccgagagacccagtcccacctgctttgctggcaggggcttaggatgcagtcactttccattaaagtcagagtcctggagtcccatctgctttgcttctgcattccctacaatgatgagtggttaggagtccaggtctcagagaaagactgtctaggtgtgggtccccaccttgtcacttctgtgtccccttgtgtgagctgctggacatctctgggcctcagtttcctaatttataatgtggttgcctgtcagaggattacatgagaagatgcatattgcttagcgtagtgccaagggcatagtaatagcccaacacttattaaccacgttgatgatggctatggagatgatggtgatgatgacaatgatgttgatgatgacaatggtgatgattatgattcagtttctattctaagatgtggttacagtttcctaactttgggagatatgcctatctgtatatatcacggcatagtctctttctcttattgtagagaaaacaccttcacattatagatgcaccgcttggccttcctatctctcagtgtagaggagactctggaattcctcttgactggtccagatgcccacaaaattctacagacaagcagcaccaaacttaagagcatacatgtgatccaaaatattcttttaaagtcaaagctgtcattgcatttttccagaaataaaatgataaaaactgtgcacaggactgcttatcatacttaactcttaacacagctgacctttaaatggcattaagagtaccaacctgagttctgggtcctaggaaccaggaggagataaaagattaagaaatagggaaggagagcccgggtgtggtggctcacgcctgtaatcccagcactttgggaggctgaggcgggtgcatcacctgaggtcaggagttcgagactagctggccaacatggtgaaaccctgtctctactaaaaatacaaaaattagctgttctgcagacttgggtctagaggtgatcagtttttccccagccaaagcccaagggcagccttgctcctctctccctcccctggcttatgttcccctgtgtatgactgtgtccctccagcccatgacctatagagaatgcagaccatctctctgccagtgttggagaccagatcccatggaagggcactcatgtccagcctggggccccctgccttggcagacactactagttgacataatccagctacttgggaggctgggacaggagaattgcttgaacccaggagtcagaggttgcagtgagctgagattgcactgctgcactccagcctgagtgacagagtgagactctgtctcaaaaaaaaaaagaaaaaaaaaaaaagagaaagaaacagggaaggaaaaatgactggaagaagatgaatatgctgagccacattctgagattgagaagtctatctatgatcacttgcacctcttctcttctgggtagtgtctacttccccacgtccctctgccattcttttgctgaagccatgcccaccttaccatggggtgcagggcagtgaagaagcagcaagctgcgaaggctgagccatacctggaaagagtgactgctaagtgcgtgtgtccctggaggcatttgttccttcacaaggaaatggttgtgaactcaaactgggttctaattgtcaacattcaagggagttggcaaaaagagtcattattcaataaactataccaaatactacagtatgtgcctggcatgttgtagatgctggagacacaggagtgaacaaataagcaaagcccctgccctgtcactgcatttctgcagaaaagatgttttgcttcagggaagccaaatcgctcaccaggagcctggccccgagtccactcttggggtcaacacccagggctgcccagtgggctgtgtctgctgtccccccggtcctagcccacaggctttttgaaatctccagtgtgctcgccatgaggaaagcaggggtgaagtctgctgggcagcctttgtcatgtctgtgattaaggacgactcttttctggaaattaaaatgagcagtcctgctatctcaccgtacaatcactggcatagtttacttttttattctgtgtctggattttccccctggggctgcagcagtaagcctgcttccttggttcaaagccagtgtgtgtttctgcaagaaagaacttctggatcagcagggccccttaacaggctgcaagctggctcttgagagggagcaggcagccaaacaatatttggcctgtccttcccctccatgccagccttagttctggttcctgctcagtaggcaaggggcagcccaggacttcagagggaacctgataacttgtctttgtgtgattaaggctgggtagcagagcccactgagaaccagctatgcttcaccataaaaatagaacttagctctgggtaccagggagttttaataatgtggaaaaatgcttatgttgtcatgttaagtgaaataaagtagagtcctaagcaatgtatacagtgtaactacaactctgtaaacagagagagagcagaaggaaatataggaaaatattaatagtgtgtggctttggaaggtgggattaatatgctctacttggctgggcacagtggctcatgcctgtaatcccagcactttgggaggctgaggtgggtggatcaagaggtcaggagttcgagaccagcctggccaacatggtgaaaccccgtctctactaaaaatacaaaaataagccaggtgtggtggcatgcacctgtagtcccagctacttgggaggctgaagcagaagaatcacttgaacccgggaggcagagattgcagtgagccaagatcatgccattgcactccagcctgggtgacagatgagactgtctcaaaaaaaaaaaaaaaaaaatacgctctactcttctaattttctaggttatccccaggcagcatttataacttttataatcatacaaaaataaactttatattaaaatatacatattttgcatattttaatacttttccccagctttaagaatatctgataaaagaaatttatgttactctaacgagcagctgctatcttggttaattcatattttttcacaattaataatataaacattaaacagaaactggtgggagcaattgtccattgggtaatcagtgggcgaaactgcccatgaaatgaaagcaaaacaaaaaacaatatgaaaataaaaacaaaaaatccacaaactacatcagaaatgaatttcctctttgggacatgctgaaaaatatcctgggtaaaatcaaggtattttgcaattatttttcaagtaaatattgtacagagggacgcagtgatcaatgctgctttcctttactgctttgcaggcctgtctagaaactttagtggccagagaggcggcctgcaggctcagggataactgtcttgccaacaaggaacttgttaagttccttgttgcagtttcctactatgaaaatgtggggtagttttgtgggaaactgttagttccctagtcaatttctgaaagatctaagagaataaggaagttcaccaaatcgcaaattacggtggggttacagccacactgcagatttttacaatgtggtacccagagttgattaggatggggcccactgtatcaattacacttaacggttcgttgcatatagcagaaacctacaataacaaaggctcgaatacaagacattttattgtttcacataaaagaaatccagaggataatgggtctggggttacctggccactgctcatccctgctaactcaggctccttcgacctcttcaccctgcctctccccagtggtggccacccccagctgcaagggcgataacacacgtggagttgttctaggaagaattattttgtgcccagctgaaaatcaggggcttgattatcagggaagggggagaacacatgtggggttaggcaatcagcagtcactgccgtggccatgactggagcatgtcgaatgttctgaggcctccagggggtgcatggcagtctctcagtagtgtgcaacttggcctttctcgacccagaagcctataaacagataataaagcaataaattagctgccacacacagctcggtaccctacagtagaacaggggcaggataatagcaacagcaccaccattccaagaggagcagacaggaggcacacaggggcccctgcctagcaataaaccttctgagcatgcagtgggaggcctttccccctggttttctggtttatccctggggaacctctctactcactgtcctctggggcccctagcttgtgctcagagagaccctctggtctctcactctggatagctgtgtatgatatgggattagggacatgcccttagtggggtctgcacagctcctccttcccacttgctgctgctgaaggttggaggttccacagttgaatagtcgaatgcctttaaaaaaattgagatgtcgtggggcacagtggttcacgcctgtagtcctagcactttgggaggctgaggccggaggatcccttgagcccaggagtttgagaccagcctggaccatgcagtgagacctcagctctacaaaaaaataaaacaattagctggatgtggtggtacgtgcctgtagtcccagctactcaggaggctgaggtgggaggattgctttagcccaggaggtcgaggctgcggtgagtcatgaactcaccactgcactccagcctgggtaacagaaccaaacactgtctccgaaagaaaaaaagaaaaaaaagggagggcggtgaaattcaggtaacataaaattaccatttaaaaatgaacaaattcagtggcatttaggacaaccacaacatcgtacaaccaccacttctgtctggttccagaacattttcctcaccccaaaaggaaaccttgtactcattaagcaattattctcattcccacctccccccccagcccctgacaaccgctaaactactttctatctgaatggacttgcctattctgaatatttcatatcaatggaatcatgtagtgtgtgtccactttgcataatgtattcaaggcttgtccatgttgaagcatgtattaatatttcattctttttatggctgaataatattccaatttatccataaaatatatttttaactcatggtttctttgacaattcaggatccacaaaaacacagtcagcttctgacctagttgcttctcatcagctccctggctgcagtcacactgaattcttgccaagacctatgcctcagacctgctttattgcttttcttttgtgccccttccctcactctcatttgatggaatggtggctaccttgactcttcccggaacaccatatggcaaacgccagtcctttcccttcatctcattctgagccgcttcagaccttgaccactcaaaggccagcacagtctcatctctaatatttgggctttataagcagtcgacttttctgactttgcaaagccctgaatttctgaactctattcctttcctaagaacaacaattccgttgacttctaaacagcattggttgcatcaccaaggggaaaaaaataaaccaaaaaaacccaaaaaacccaaaaaccccaaacctctgccagttaaaccatgtcatgccgtataaagcaagtgccattacaatgtgaaaaagaaatatgcaccgcagagttgacgacgtgcagtaaaacagtaccgatatgaatggctgacattagttgaggttctacgctgtgtcaggcattgtgaatcttttgagagagatgtcagaattgttatctttcttttacagaggaggcagtggaggcagagtgaggttcacacccagcaaccctcactcagaaggcttctgcttgggtagagcttgcattggccaaacctcatccacttgccattcattcagtcattcagtgacaagtgtttatggtcacctgtgggagtgtgtgtgtgggaagggtggaaaatttccctcttggtgttttcaatttagtggaggagtaaagccttgcagcaaaatatgaaagatcattcaaacattagggactcaagtgaacgcaaaggagttggggaaagttccgcttaggaagtgacatttgaatctggtcttcaagacgaagaaggaatttgcttggagagaggggctggaggagaaatgagcaggctgggggtggggggagcacaggtgtaggcagggagaaaagaaaaggggcttttggtttgagaccctgcgaggaggcagcatggaggaaggggctgcagggagctttggggttggggagaggatgcagctggaggagtccctgatgtcacttgggtattattaatgtcaataatcagcttatatagaatgaccttctcactagaataaacagtcataactgtggtgctttaatcaacatgacagcattggagaatctactcaaactcacttgggtctagaggggatcagtttttccccagccaaagcccaagggcagccttgctcctctctccctcccctggctcatgttcctctgtgtacaactgtgtccctccagcccatgacctatagagaatgcagaccacccctctgccagtgttggagaccagatcccatggaagggcactcatgtccagcctggggccccctgccttggcagacactactacttgacaacagatacccctctccccttcttgcttaatttaaaaaaattctatttcagatggcattgtgtcagttgaaagatcacattttctagactagtctgcagctaggtgagcccaggtgatctagttccatatgtggaaccattatgtggaattttcagtaggctccgtcacggtgggaagagatggcgttacacatttttctgtcgtccctcacttcctcctactgtcaatatggggaatacggacttgctggctggagtgccagcaggcatcctgggctgtgaagccactttgaagatgaaagccaggctctgggatggtggatcaggaagacaggggcccaatttcctagcaatgctttggggctgcacccttggcctgtgcttcctatgccaggctacttttacatgaaagagaaaaagaagtcctgacttaatgcattgctgtatttttccagaaatgtgcagccagacctaatgataggtggtttagggtgggaagcagagtaagatgacagaactttaggaccacatgaagggaaggagagggtcccccaggaaagggtgcagtttgttagacagaacaatagcatatccgttacaaagagctgccatttgctgggcgctaagggcctggccctctgtgaacctcaccatctgcatcatctcacttcatcctcaccagggtgggggcatgaggactctctcatgaccagggctattctcaatttacaaatgaggaaacaaaggctcaggaagggctctttctcaaggccactgagttgggagctacgttccactctgggtctgtttgtttcagggacaaaccttgaagccacacaagggccccgagaaactgtgcagatgtgaaacccagagtggcccgatcagatctatgactttgtgtcatcacaaaagtgaaagaagcagttcacagaaggagtggagtgtgcaggtcagaggcaggaaggacaggcagacactgtgatgatgataggctgtgaagaggtgggcgatgcctgggatgggagggactgtgttggacccagtgctgacctgagaacctcctctcaggccctcagtcaggctggcccctgttagacatgagatttgactcactggttcccattaacagccactagagatgaatgcactctatcaagtccatgtctgattaaattcaacaactcaggagtagtggtcaggaagtgtgctgattttttttcaatacaggtaaagtttttaattatgaacttttcagagggcaaactcagattgcttagggtgtatttgtccttgtagtgtttttgagggagtcattaggggcatggaataattaagtgaaaattaagaagctatgaaagaatcactcagctaagaaacaagatggtagatcaggctccgtctgatctcttggcagtatgcattagaccaaagggttatttaggtgtcaaggattttgttttgccagttatcaagcctaagaaacttcccagttacatcaaatcaagcaaaatgatgaaggctatcatccacccttgcttacaacaaaaagaaaccacttataagttcttcccgttagccaaaactgaagaatttaaactgccttggctcttaataatagttttactttatggttttcttgctagtatttcaaatacatagtctgtcttcaccaaactagaaatagttgataccaagaaaaacgtgtttgcccggactgaatgatgtcattgcacactcacggaccatgcactctttagcagcacccatctaattccatgctgacctgccttctccatttgtaggataactgcaatactcagaagccggctggtggatcccaggcctctatcattcaattgccatcactgtacttggtggggcctcaaaggatgctccagatcccattttcctgcttctctttttgaaagcattgtctatgggtgctgcacccactccctgcagccaagctcctgtgcctcactcatggaggctgccggggccatctccctggtcaccatggcctccatgtggccaggtcagtgcatcctgctctgctcctgtctgacttgacctctcagcagtgctggcaggtggacctctcctgccttcttgatacgctcactccttggcttctgagcggtgattttcttggtgttcttccaacctcaccctcactggctgagggtgctgggttcccttctcatctttctccacatattctctctctctctctcatccaggccaggtctttaattccatctgtagaacattaactcttgaatctgcctctaatattgacttttcccaagaattctaagcctactcaacatctccacatggatatctgataggcacgtccaaattaagatggccaaaaccaaatctgggatttcacaccacccatctctgtaagtggcactcctcagttactcaaaccaaaaatcgaaggattatgcttgattcatctctctccatcactgccctcgaacccaatccatccaacaactctatctccaaaacattactcaaacaggtcctcatctttctgtctctgttacactcatcagaccccaaggggacccactgatctcccttggttccacttggtcctacacaagggcttcacacttagcagtaagagttatcctcagaggctgggcatggtggcacatgcctgtaattcccgcactttgggaggctgaggcagctggatttcttgagctcagaagttcaagaccagactgggcaacatagtgaaactctgtctctataaaaactacaaaaattagccagcagtggtggtgtgcatctgtagttccagctatttgggagactgaggtgtgaggatcacttgagcccaggagattgaggctgcagtgagccatgatcacgtcactgaactccagcccgcaacagagcgagaccctgtccaaaaaaaaaaaaaaagaaaaaaaagaaaagaaaaaaagaaaaagttgtcctcagaaaattcaagtcagatcatgtcactctcctgtttaaaagcctccagtgtctcctcatcacacctggcacaaaattcaagctccttccttgccaccttctccagccccatcccatcttctcttgctgttgcttactaagcagcagccatcctggggactcttacttgttcctttgtgtcttggggtcttggcgacagctgctctcttgtcctggaatgctgctgactggctcctggacatcattcagatctcagcttaaatggcacctctccagagtgaccttcctagatgacctgcccatctcaagtatttccctcctaccctatgctaattttttgcactgttcaattcactagcttgtacttttctcatgtacttattttctgtctcaccctcctagaatataagcttcacgagaacagggatcttttgtgccttcttcttgctgtgtcccaggacctgagttggagcttggcatctggtgtgtattcattaaagattagttgaatggttgagtcccaaacttactgtcttttgctccatgtgttctgatatcttctttattatggtctgctttgttgagtaatgtgttatgatcatcgagatttactcataggcactgagtttcaaaagatgatgcatatttagtgtatgattcatttatttaaaattctagacttttgactgcagcctgtgactcaaatactgtattggtggaaaaactttcaaatcatcaaccacacgtatttgggttttaccagctccatggcacatacgaaaaatagccagtacttagagattgttcttattatcatcctagacatttgtggatattaatttttaattcttatataaccctatgagtatgaaactcttatccccattttgtaaattggctgaatgtgtcagttctctaatgctgtgtaacaaattcctgcaaatggagtgacattaaaacaaaccccatctatgagttcacagttctgtggggcagaagtctgggcagactccactgggttctctgctcagggtcacacaaaccaaaatcaagatgtcaaaggggttgggttcatgtctggaggctttaggggaaaattgacttgcaagctcatcggagttgttggtggaatccaattccttctggctataacctagaggtatctgttttactgctggctgtcagctgggggttgctcttagtgcttaaagacctcccgaattcctgacacgtgaccttctcctgctttgcgtctctgacttcctcttctgctttcagccagagaaaacgcgctgcaattttttttttttttttttgagacaaggtctcattctgtcacccatgctggagtgcaatggcatgatcacagctcactgcagcctctctgagtagctgggactacaggcatgcaccaccatgtctggctaaatttttaattttttttataggtaaggtctcaccatgttgctagctggtcttgagctcctagattcaagtgattcttccgcctcaggcttccaaagtgttgggatttctggtgtgagccaccacgcctggccaatgccttgcttttaaagggctcacctgactgggtcaggcctactcatctattctccttattttgtggtcagttaacttggactttattatacttacaaaatcctcttgcagtattacctattattagtgtttgactgaaaaagcagagacaggaatcttggggaagtatctttagaattctgcccactgccctgaggttcaaagaagttaggtgatttatccaaggtcatacaaccagcagtggaaaccagattcaaatcaaggcattctggcccccagagtctatgaccttgaataataccctgcagtgtgatgagaatccagtgctgcattggaaattctgctgggcagattttctgacaatctgatgtagccatgcaggtgagacgcactgggctactttgttcataaggaccggaactatccatggtgccttgtctcctcactcccatcacctccgatgtaaccgaagacagacatgaccaaagaagtcaggactctgcttttcaatggattgaacccacggatgctgcaccattttccacgagtcagcagcaccatttccaggtttttgctgcccccagaacttggttacccctcaaatcctttcatcatcagcatgagtgaaatcaatgtgactcccattaacaagaatattattattgtgcacatgagaattaagcccaaaatgcaatctgtgctcacacaggtttgatgatggatggatgcagtggtgtgctggcagtgacttgttctgggttttggaactaatttgttcatctctgcccaactcactttcagtgagagcatgctggtagtttgcaattggcaattggggagaatttacactagagaaatcagcaaacactacaaatcagggtttgctttattcatttatatttgaagatgtgattgctaaacatttgccagcacacctctggatggatggatggtagatggaagcggtgagagccaagagagcttggggattccagctttcataaccagaagcatggacattcttggaatgcttatgggggtgtggagggaggacccccagcatcagcccaggagaatgagtcttgtgagctgggagatgaagtctctaaataagtgagaagggaggtgatttgagctaggaatcttggcaaatagccccagggcagaggcagaggggaggagaaaaaagaaccatcagagccaggaagatcagtggaaaactggaggcctcacagaaagcaagggccttgcttgagcagaatgatgcctcttgagtttcttaaaaaggaaaaggtaggggtaaggggctgtttaatctattaatacttcagcccactctcagcacccaaataatagggtgggtgcatcaaatcttggtagccatatacataagaatacttgtaggggttgtttaatttagggccttataaagacaataaaatgacttattgagaatcactaaaccaacacccaagtatttaatgaaaatactttttagctcatatagcttgagacaccaaactatgactatgtaaatagctataccatgtttatagattggaagacttaatgtagtaaagaagtagattctacacaaattcattgataggtttactgcagttcctttcaaaatccaagggggggacattttgtagatacaaatgaactgatactagaatttatatagaaaaaaaccaagaatagccaaaataattttgaaaaaagaagaataaagttggaggaaacatactacctgattttaagatttaacatatagctgtattaatcaagattgtggtgttgggaaaggaatagactggtagattaatggaacagaattgaaagtccaaatataaatgcacataatatggccaagtgatttcttttttttttagacggagtcttactctgtcgcccaggttggagcgcaatggtacaatctcggctcactgaaacctccctcttccaagttcaagcaattctcctgccttggcctcccgagtagctgggactacaggcgtgcaccaccatgcctgtgtaattttttctgttttagtagagatggggtttcaccatgttgcccaggctggtctcaaactcctgacctcaggtgatctgcttgtcttggcctcccaaagtgctaggattacaggcgtaagccaccatgcccagccagccaagtgattttttttacaaagtcccaaaaacaattcaatggaggaaagatagactttttaacaaatggtgttttattggatatcctcagtcagaaaactcctcaatctaaacctcacatattgtgaaaaattaacttagaattgataatatgcctaaatataaaatgtaaaactctaaaacttttagaataaaacaggagaaaaatcttcattactagagttaggcaaatattccttagaagacctaaagcactatccataaaaaaaagataacatcaactggatttcatcaaaatacttttattctgcaaaatatattgttaaagaggatgaaaagaccagatatagactgggagaaaatatttgcaaattacatatttgatctaaaaagttgtacctagaatgtataaaggtggctctaaactcaacagtaagaaaacaaagaatccgattaaaaagtggagaaaagaatgagcacacggaaagatgctcagcatcattagtcattagggacatgcaaattaaagctatgaggagacaccatgactcacatgttagagcagctaaactaaaaatactgacaataccagcaggggaaaggatgaggatcaactggtctctcatgcatacattgctggcggaaatgcaaaatggattgtatggtcactttggagaaagtttgacagtttcttataagggtaagcatacagttaccatatcacccagcagtaaattaactatttactttagacaaaagaaaaacttacatccatacaaaaacatgtacacagatgtttacagcagttgtgtttgtcacagccaatgtggaaaacaaaacaaatttccctcaacaggtgaatggatgaacaacctatggtatatccataaaatggaatagttctcagacatcaaaataaataaaatcccacaacatcaccaaaggagactttagtttcatctgtaatgttttaaggttttaagtagacagactattttcatgttctatttgttgttgaatttttaaaattgatgtttcttttattacaaagtatgaaaactacaagagcatatctctgtgcctggtcaatgtcctgtcatgtagatagattctccctcaccatagccaaaccctctctttgagcagtaggttctagccttctttctaccccaccaaattccttctcattctctcttgcatcatcaatttttctctttctaccaaattatttctatcaacaagtacacggatgggctattatttttcccatcttaacaaataaggaaatctctcttgacctcatttccccctccagctatagctttatttctagaaagcagtgtctgttctgtcttcaatttctttcccctttctctcctcactcaattcagagtttcaccccctcttccccagcaaatccttttttttgccaaatccatgtatacttttctgtctccaccttacatgacctttcagcagtgattatgcaggtgatcagtctctcctccttgaagcaccttcttcacttgcccttgaaggtcctacactctccaggcttcccttccacctcaccagcccttacttcccccactcccatctttgctggctcctcctcactccctgacctcttaaagctgcagggcagggctcagttcttgctttctttttctacgttcatttctgtggtgaactcatgcaattccctaactttacagactacattagatccaatttaagatgtcctcaattataagatgcaccattaagttaaagttccactaaggaagaagaaagcactgccaattaaactcttttcaaactctttttttttttttttttgatatggctctgtcacccaggctggagtgcagtgacagtcttgggtcactgcaacctccacctctcaggttcaagcgattctcctgcctcagcctccccagtagctgggattacaggtactcaccaccatgcccggcaaatatttgtatttttaagtagagacagggtttcaccatgttggccaggctggtctcgatcacctgaccttgtgatccacccaccttggcctcccaaagtgctgagattacaggtgtgagccactgagcccagctgccaatcaaactcttacatcctatcatcccaatttcagatgtctctttgttctcagagtccctaaactgctctggagtgagtgatgatgcttctccttcccagcacccctcttggggaacagggttcgcacccttccttctatctctttccttctaactctcttcatcacccagcctgtggaatccttatatgagcttgggatggtatcgcctgtttctacacctagctttgccacatatggttgggcacatcacaacttgtatggatttactccattgggttgtgcagtatataacctgtacaactatacattgttgcctgacttcacccattcctccaaggttttttatttttctctttataatactgtcttagtctattttttgttgctgtaactgaacacctgaggctgactagtttataaagaagataaatttatttttagcaattctggagtctgggaagtccaaggttgaggggctgcaactggtgaggggcttcttactggtagggactctctgcagagtcctgagatggctcagggcaacacacggtgagaggacccaccagagacggccaaagtggctttcatatgagacccacttttgtgataacccattaatccattaatttatgaatgggtccattcatgagagcagagccctcatgacccaatcatctccgaaaggccccacctctcatattgctccattgggatccaagtttccaacacatcaacttctgaggaacacatttaaactacagcaaataccttgtcctgaacttttgaaactttaaagcaagaaggagactctttagttctgtgcattcttccctgttatttcttgcctgaggcaatcgctgtagccttggggtttttgctccagttgggcacccctgagcttaccacggtggctagaaaaaacatgccctcactgacataggcctgggagcccatctaggagccattcacagtggcaaggggtggcccttattttgcatagccaatgagaagactcccctggctatgagggtggagtccatcttaaccaaatgtcaaggttgctgccaagggaggaggaatggaatgaatgtgggggaacccattgggtctactccacagtgtcaaaggcagggatagtattactgggatgaaagagacttgagcctgtgtttaggtctacagacaggaagcgattaaagacgttggaggaaagagcctaaatttggttaggagcaaaatcctagagaacaaatgaggtgtacgggggagggtctagatttgaaatgaaggcatgaaacttctcctggatggaggatgatgaagagacctgctttgaaggtgtaagcgaaggaagggatgtgagggcctctaacagtcttgtgtcctccaggtaggaggagcagcgcagctggagatattggtagtgtggacagcttcatggtactttctgggaagtgtccaatgtgtaattttaattggctcttttcattaaatagaattgatattattttaagagacagatcacttgaaaattaggattttgattcacttctcaaatgaagagaaagtgcctttgcctcatgtatgtgtgcagaatttgggagaatacatcatgagctcagggaatgtgtatgcgaagatgtttgaaaagtcacttgtgggaatttgcctggcttggtggttaggaatgtggactctgaagccaggaggcctgggctcacatccaggctttgcagccttgggcaggctcctgaacacctctgtttctttgctaaacagtgggcaggatatcactatttttggtatagacctactggaaggatcagaagacttaatacctgtgtgtgttttggagagttattggcacatattagatagttttactgtgaatcatcattatttataataattctctgacatgctggaatgtacactgtctttagaaatgaaatttgttttgttttcctaatttcgtgcaacctacatttttccagtgctattttctttggggaaagagcatgcagatgttccgtgttttcaatgtagcggtgtataaaatgtcatcattgtttcctttctggtggaatattaagagccagcttaaagataatctactcccagaaagttccatattagcaattatgtggggctggtgctcatatgcctcaatgaatgatttatttattagtatattgggaatggcctccctcttctcacactagcaccttttccccactttccagcccatttccaaatgagaagggctgaagtcaatcaggaattaagatttagcatttgtgggattatctttgaatgcgacactgggggggacacagtttcactcactctccatggtggcagtccaaattgctctttcgggaccctggctgtgtctaaagcctcagaatgatccagaaggctcctataacagtgccactgtggaagaaaccacttctaatatggcaggaaggtgtggccctgcttggagcccatgttttctaactatttcacatttctttctttcatccctggtgttattttttgaaattaatttttattttcagttctcctaggaattaatgagttaacttaataaaagtaaaagtcttcataaagaaggtaaaggctggctttccacatagagaacaaacataacaacccacatcctctgcagagctcctggtcaatgcattcttctagtggggctgccacacccctggggcctcaggcaagcaagccccttgtggatgacaggggctgggctcaaagcagtctctggggctgtgcctccttcctgttctccactcttttctctaaaggaaatgcactgcaatgaattgcacaatacagacattcctaaattctggaaaaccagcaggctttgaactctcctgggggaaaaaacccataaaacacaaaactgcaaggaatgagactatttggccaaatggccaatatgctacaactttcatagggaactcaccgcacttggtattgcctgatggaaaaaaatgccctgaatttcccaataaaatatttgagatgtggcaaaggaataaatattttttccctaagataaatctagctgtagatgaaaactgggtctcatgcctcggacaaaatattatttccttatttactctaagtctatatcagaatatagcctacacagcatcaggtactaagccaaaaaaggctccaagggcaccattgttcatccatgactttgactgtgtcaccccccagaaaccttgagttgggcagatgtaatcacagcagcctttggtggtttcttgagcagctgctaaggatcacatggattctgctcacacccagtgcttctcataatttaaaaatgcttgaagctgtgggaggctgcccagccctctgcattattcaaaagaaaaccaggaggcagcgacaattcttgattcttgcagataaacattctccaacaattattaagagttggattgctctaccttcatttaattccttggtgctttactatttgaatctagaatattcttgaagtctgaaagatggatagaaaagaggtaagtcatgtaaacttataaacagggcacgaaccccgctaacagacagctttgaagagatgatgattttagatcttgtgaattgttatgtcagaggaatacatgcagaagaaaacaggcaccgaaatagttattaccagagcaaagtaaatctgaacacctaaaagaataagaaaatatcttatgcttctctctactctgaactgccttgaaaagagcaagaatttcatacatgagcctgtagcacattacaaaatctgagtatgtatttgaaattcaaatgcacacaaagttcatgcattttattttccagttgttctcaagactcctaaataaagcatttcccctgtgtgggcgacccctgggtcccatgtggggtcagtgtttgggtctctctgagaggatcaggaaggctgctcttccaggaagggctgcagggaccctgggaaccggaccagtccagctcacaagtatgaagagaatgtcgggagaggaagtggtggctatgagtcagcatgagtcatctcgttccaatgagaatgaaggctgaggtgtgcgcctttttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccttggtgagtatgtttctgtcatttttagggttgcttctgcagtttgccttggagtctgggctgtgggaaaggctgctgcgtcctggtgaggacactgcgtttctttcagactttgaagatctgtcgttttagaaaagtggctgcctctgtcaccagccccatggttactgtcctttagtgtgactgtcaggaggtgtttctcagtccttcgttgtaagaatgtagatgccggttgcaccttctgttgtcttggaagagactgcagtgcttggctggaaaataagctgctcgggactcctctgagaagccaaagtgaagctcagagatggaagtgggtatacttgtgctaacccagggttgctgaggttgggtgagcttccgcttctccgaggtggaggagaggcagctcctgagccatttctggcctcgtggtcagagctgcccaatttcagtgtgagaaataccagagaggcagaactttggctgccttctctaaaagcatatgaatgattgcaggagcgtattttacgtcctttccttttccttaacgttgaaagtcacaaactgtagtaaaatcaggaagaacgtaaaaatgctgggggccagcgctgggggtgggggactggggaggactgaggagggggccactcagtctttgaggcctgacttgatcttgataggtatttctcaggctgttagtattccgatgaagcttagctttactgtcaagtaaaatacaggaaacatttttttttaatgttgttctagttactgtaaatgaaacggttaaaatgtcataaataccttatgataaacatttttcaaatttgcttaaaaagcaacacatcagtaggcagggtatgacagggagctttttcagtacagtcatttgagtgtgtgggcttcctgagttaataatgagtcagcacccaattctaaaattggagcagctaagagaatgttcaatctgctcctcagcacagcacggtggctggccggccccccgtaggaaggcttggggttaaaatcgacttaggatgccgcccttatgtaagtgaccagctcccagcttgggtcccagctcctctgggctactgctgagagaccccctctgctaagggatctgtctctgaggcaggagctaacacatttggcttccaacctttggctaatgttgacgatttttaggttgtcttgaggcaacaggttgaacatagtttctgaaatgaaaaatctagtgtttattaaggctagggcagctgagggctgagcctgcatctggagccttgagatgttccgcttgcacgtcaccctcgccgagggattgggcgggagagtcggtcaccgagtgaacttcaaagttggcgctctgcatgtgacgtgtagcgtgggaagattaagtcagcttaaaatgagagaacaagattccaaggaagaaaacctccccagaaccttactcgtttatagataaaagaagataaatattgagaaaattaaaaaaataaaacgaaatagttgggctgcaaaccagcagctctgggaccagatgcagccctggtgaaggcatcccccaccaggttctgtttggcctgctcaggattgtttttttgtgttgagataactgtgggtggggtccacactctccggatctcaggccctgccacaccctaatgccacaaagcttggagagtgcgattacagcgaggctcagaagccaggctgagggcctgccagcctcgtggggctgctgtgtggtccccatgggttagcatctgcccggccgccggaacagggcctggatggagaaggaactccatcagcactaactctgctagactctcttattaatctgccctctgaaggcatttgggcttgtggcccttgagttagttccatggctttttcaagaaagatcctgcagttccaatgtgagcagcagttgtttccaaggctaacaatttcacgccaactagaagcctccacaagtcaggtgccaggcatttctaagccagtagagcagctccgcttgtttctctgggtgagtcctctcagggtgagaccctgtctccttgtaagcactcggagacgtgccaccttcatggagacgggagccaatcaaaggcaaactgcgttagacagctcttccatgcggtatggacaccaacattcgatcatccttgtttcagagaaggtgccgggccccagacatgtgcttatcactgggtcccatggccttcaatcctttaaagggttttaaggtggctgatttttatcccagacattgatcatgttttttttcatgcagaatttgggcagttgtctggacattaggagttgagtcacctcctacccatgaggaacaagcctgtggggggactgatattatcacttctgtcatcaagaaataaggccgcaggcatccctgaatatagagcatttattaatcgaactgtgaaaatgaaacacagacagtgatgacagctggaagttggccaatgtcctgttgtcatattgccctcagcctagggactggcctgtggctcactgaccctgtctcccactctccacctctcatcagcaactggacctggtgcacctggtctacctcatgtccagtgttttccgcagtacctgactggtatccccacccttggttgttgtgtggtgagctcgtccctatgttggcaagttacttaattcctaggtgtcccgccttcctcactgtaaaatgagaaaagtcatagcacgaatgtcatgagtccttgtgaagattttatgattagcacacaagttacaaggagacacgataactgttacgtacgtactcattcgttcggaaatataacagacagcttagtatctccacccgggtccctctgccctgtgggaatccataaagaattgattctcatcccccagaagtgagatcccgcttgtgtcatcaattacatggcatgttctgcatttacaggacatttatttattaggtaagtggggaatcctccttggttctctccaggaaaacctggagttctagttatcatcatcatcatcatcatcatcactgtcatcatcattgacatcatcacaataagaactcccattgtattcagccctaaccgtatggtagcaactttatggtattccctttaacctccccccaccccaatatccatcctggaagatgggaaggatgataggtttgttgactcactcaaggcggtgggactctccagcaggtatcaggcacagcatctgcttcaaagaacacatcggcgacaggggagccccttgcactcactcaggacaggagaatcaggaaaagcagcagatctgcagggctttgtgtgtaatccaaccagactgatgccacaggccaggaaaccgaggacggttggcttcagacctaccctggagtggaagcagctggattctgtcctcacgcttcctgtctaaagccagctagagtaaatttctagtcatctagattctggttatttggaaatcatcacagtatctggagatgactcatattgaaaaaaattaaataagatacacttaaaacttaacccagggtgaacataacatggcctttccttgtcaattctgaagaagatcattcaagtttgtgcagtgccttagaagccagatgctctcttccattctgccagggtcctaaagaagtactactgtgtcctttagatcactctgccttgatcactctgtcccgtcactctgctatttcacctgtcagtgaaatacctggtatcgtcctgccaacatgaagcattgaatgctttatacgtctccatcctgattgtttaggctttgaatgctgagaagtatctgcactttgttggtcaattgtagatggtgctaatttgtggggagtttttcctgcaaattccccctgtgccataatccagaggacctccctctgcccccagtgctgtaggctaggcagctatgggcctggctcagggctgtcgggcaaggattggactctctataggttccgtttggttctggttagatcacagagctcaggcaaggaaaagccgacaatagatcagaaggaagttgagcgctcaggaaggaggagtgggcaggatgcttggtggtgtcagaggattccttcggattaaaaaaaatagatgttattgcactttgtgtaatcagaaaagctaaggttgacagcagatcttatccactgtggttttcctgcttatcttttgttttaggagtgataaccctgcgagtgagggcttctgctacagggtcttgtagctcttctcttcatcctgccctttaaaacatttattggactaaaaatcacaggatttttaatgatgacagaaaatgtattattttagctgttctcactggacaaatcacttacggagtgttgattaatacattgataagtttctatcaattcagctagatacaagggaaaatgtataaaatagcaagggctccgaaaagagtcaggcttaatttctcttgcacagaaaaaggattctattgctctttctgttccgtcctcaaacaggaagcaggttttctgggacaagggtcaacaggcagccagttcatccatctgcctactcagccatccttagcactggcttccttcctccaagttatcttatgcttcaagaaggctgctggagctcctgccatcacttctgcattccagacagaagagaggaaggaagtggagggcaaaaggcaaagcctcctagatgtcagactcctctgcaggcctttccttgaattcccagctaaccctttcagcctagtctttcactggccaccctatctgtaaaggagctggaggaggaagatggaggagtgaggcaaggccctgagatgatgcagagcaaggggcacacaagaggggactcaggtccaaggtgaaatagcagcaagcactctccctccaaaacccaccgcctccttatgaatccctttggccttgattatgccagtagataataggtatgtgacagttttagcttctctggcctttgatcaggttgatttatgtgaatagactccatgtccttggagatgaacctgttctaaaaattctaagcaaccagccatttggctctttgctggaaagtagcctggcttttgaagccaagtctggacagtttccttgctgcacctcaggactcaaaggacatggtcctgactcaggaagagctggctttgagggaaggggtgagtcatgaacccaagcacagcagagattcttggtgtgtgctgcagaaggtgagagtagcccccatctccctgtgccagtcttctgggggaaatttatgatggccttacataattgggcttatatgtgtttcactagaaagacaaaaaaaggtgagaccttgtctgccaattcgctaccacctccttggggtctaagagctaggctgtttgttcaaagctaggctcctttgtgtattaacagtgtgaccccgggcatcatccttaacccctctttgtcccaattccacatctgaatgatggggatgataatggtagactctgccacatatggttctgaggactaagtgaggccacatgtgcaaaggatccggaacagtgcctggccccaagtcagccctcaggcaacagaacagtgtttggattgtccttgttgctttattggatacgtgataagtactggtgaaatgcatgaatgaaaagaaatcccacttgattttaatacaagaatcaagcaagtgacttctgtccctttgaataccctcctccaagtggtccaaagtccttgaagctaccatctccttggtacccttcctgatgcttctggtgtgggcaatgtggttacttcatcaagtagaccctggttacagagaagttaaatgatttgtccccaggcccactcacaggagagagtactatacaatatcaagctggttgtcttcagcactctgttgtagagacttccagtatgcattctcttctgcttcctctgttgtcaaccacaagtccatgttgttagggacaacagtgtgcccagttaaaaaacgatatttcctagtctcctttacagatacggtggccaatgaaagatataggctgaaaggttagctagggattctagaaaagctctctaaaggagactgacatgtaataggcttagcattttgcacctgaattctctccttccccctgtctggaatgcagacgtgatggctggagctccagcagcctccatgaagccataagacaatgtggaggaaagaaaccagtgctaaggatggcagagcaggcagatggtcacaggtctttgggtgaccagctattttgcctgcctggagatttgactatttttggagccggatgcagagggaggtgggaaaaatattccagctgaaattcaacctgtaggagtatttttcagggtgtcagggtcacttctttgtggagctgcctttcaggtctctggtatagggggcaagggtcatggcctcatggtgatgcccagggaccccaggtgctttggtctttgcagaccactttcttatgaaaaagcagagtgtgactgctctggcagaaagataaatgtcattcaggctgattcattattatacattcattatcatttatttgtggttttcctctgattttaaaataaatcaaaattaaaacacttttgcaggcccctaacagtatcatgggccccatgcactgtgcccagcatgcccaatggacatgtaggccccaagagggcagagagcaatcacagaaggacttgccctggccaacataggctggtctctctaggggcagcttcggaattgtgaattacccagagctgcgtgccaggaaatgtggacctaactcttgcctctgaggaaggcaggcaggcttggtttcatgtactgttgatgagcccgacatcctcaatgctcactcgagctttggaaatgacaagcaggattttcagaacaggattctctgtcctgtccctgttttaatttcagcctccttattccccatgtaataattccccatactggctcaattatttgtttaacgggtatgaattccagtctataatgccaaggtatcaaaatgtgacgtacctttactctagaaatctctaaattatattaaatctgctccaagatcgccctgccctacctcaccctctctgcctggttattgggagattcaaattctgtcattattggggatcctttcttgtcataatgctccagatgtcatcaaacaaacttgggcttaggtgatgccaggaaacctgggggggagcatccattgtctgcggtggctgctaccattgcaacttcgacacctgcagtctcagtgtgtggggggctctgggagctgctcagggcctgctccagttggggtggaccccacacctctcgtgatctgtcctctaactgtaggctccgctgctggaaatgtgtcgctgctctcatggccactgtgtgagctcccagtctcagcaaatgcacccagcaatgtctgattgatagggcaccctctgtgggctttgtcctgcttgctgctagctgctgctgggcctctcccagcctgggcctcctgtctcagtctgaaggccaagagacagcagcgacagcagaggaggcagaaacagaaaactctccgaggacccggggaagtcacaaggtggcttcccaaactctctagtgcagcactgtctgatagaaccttctgcaaggatggaaaagttctgtatctgtgctggtcaaagcagcggccacaagtcacatgtggctcctaagcaactgaaatgtggctactgtgactaggaactggattgaaagttttatctaatttcagttaattttaatttaaatgcccacaactgcatgtggctaccaggttggacagcatacatgtggaacacagactcctgatctgggagccttgaaagatgagccgtcactctgatgaggtggagggcctgaattgagccctgcggtggcactcggcaggtcttcagaggggctggtgacccctccaaggtgcacagcccctgggctacgagcagtggctagtcaggttggggtccctggcctctgccacgagtggccactagtggaagcctcaatgtctccacttccagtgggctctcaggcctcacatgcccatgccagggtagggggcctgtcgaggaggatgccctggcacccagagcttctctgctgtttgtcctgagggttcccttgggctgggggcctcaggtgcagggcacatgcagccggactgtccagccttgtggtatttgcacatgaactttcctgcgtggggatagacagccttattcttgtttgtgtaaagccattccaggaactattaatagttagactggcataaataagcctcaggtttggttcttgttagtgtcctacaaatccctcaaactttactcttttggctttttaagggagaagatttacagtatgttcaggcacaattgacaagaaacatacaagttgtgcggagatgagcagacccagggccccaggcctgagcctcttttctctcccatgccctgcctgctcaagttaccttgagcacaaatgatgtccttctgtgtgtgggatcacagactgagacatggggctgttcctcccctgaagtcacccctcaagttccccacatgattttactcctggctactccccagtttgctgtagtttgctggaccatgtgaccttggaggggctcacaaggcccagtgatgaagccaccgccagggctgagcctcagctcagccagctacttaatgcatgcatagcaagttacttaacacctactgacctcagtttcctcacccgtaaactagaaatagaggaacaattaccacagagagttgttctgaggatgcaaagagttcttgcatgaaaaattcttaggaaagtgctgcacatagtaggtattcaatagcattagctatttagattggaattagtggctttttgccatttactcctgactgtaggagctgttctctgggccccagatctccattccagcaatgatctctctcctccaactctggcattggaggagtaccacaatcctgcctccacatttcatttgctgacacccaggggcagcattaggtgtagagtgctggacatctaagggaagaggttcaattgtccatctgtttagttatttactcattattcaatgaatgttaattgagaccagtcagggcagctgagaagcagtgcggttgtgaggagggctgttagtaggggagatgcaggtgctggtgtgcttccgtgtatgaatatggcagctagtgcagggtcatgaagagggaatcagggacactctggggatgttaaaaactctgttgatgtggaatcagaatccctgggccagtcctgccttcctcttgctagctgtgtggccatgatcgagggtcctctttgatcctccctgatacatgggcgaggtgacccacagtggcagatgcttaaccatccaacatggagtcatcatcattacttagacacccttcatttggaatcacgattctcagtgtgaagggcacttcccaccatagaagcccctctctgtgagccctcagagggctgtctaatccataagccctttccctcccaaagaggcagcccagcgcatcactgcaaagcgccagctgagaagacgttctataaattatccaaagcctattctctggcacatccatattttggacctagctctgcccccgaagtcatataagcatagccacgatgggaaggatggtcataactcaacatgcccattcatataccttgagcacatatcctgtcccagagactgctgaattattgcatgagccccagctccttccacaccaaagcccttccgactgcatggacctcaccacttctgttcaagctcttccttcttctcatggttcctggaaagattctttatgtgctgaggtgttcagctacccttgatcttgtgctgccttccacagcatctacttggcaactttccaatgtcccacttcaggtgggcacagtgacctcctttgtctggtttttggcaaccatacctatctgttggacctgggcactgcactgacagccagctgacctccctgcctctctgtgtgggaacgtgctgcaaagccacatctctctaattctgtgtgtgtgtgtatatatatatcttttagagacaagatctcactctgtcactcaggctggagtacagtgaagcaatcatagctcactgcagccttgaacttctgaactcaagtgacccttgacctcagcctcctgaagagctgggactacaggcatgtggcaccatgcctggctaattttaaaatcttttttttggtagagacgagcgtctcactgtgttgtccaggctggtctcaaactcctgtcctccagtgatcctcccacctctgcctctcaaagtgctgggatcattctgaatatgaggtggtgacttttttaaaaaaaacttttttttttaacctaagtagaactttgcattatcgttggtgttgtcttttagatttagcccatgtattctctaatataaaacatgaagcttcatgtcatctataacttggagtggtatcccctttacatcttcaccagaagaccacttggatcagtgaagaccaagagcagagacctgtgacatccactagcgattgtcttcactgttgccactatcccagtgctctcgggcactgcattgaacacaaatagctccccttgctgcacaagtttcactgatgggggtaaagggggttatgaaacgtatcatatgatcaaatatgtgatagtgatcccacagacaaatggagcgtgtggggatgatttagacactcagccagccttgtcttgatggatacccatccttctctgctgttctctctttcctccatcctcaagcacagggagcttttggcgaggttagctaacttcggggcagctgtgaattagatactggctgtaagttacctccaacatccagagcatttaaacgctcggctgtcaatgattgtcattttcattgtttacatatagtcacatcctcagtttgtggggtggatgcatttgattcaattcagatatgcctttcaagctggccctgctgagctgggcctgaaaggcacatggctcatctcatctgcatgtgacagtctctttgaagtccccagaagtgcctgctcagagtcatgctcgggagggaagaggtaaggcacagaatgagtacagactgccacccagccgcaggaaaggtgactgcacaccagaggttcctggtaaggaggtgactcacccgcgactgtctcacctgtccaaagtgtgtgtcacctgctctgtgttcacccactgggttcatcagaggggcacttgaacaaaacaggaatgtcactggagaggggaacaaatgctgtccccaagtccttccctgccgtttagagtaacgcagcccctgtccgcacatcctcacccccatctgccctctgcttgccagaattatcagaatctctcaattctaatttcagccattctctgtgaaaatgaaaagttagtggcaggcaatggacaccctattgaaatagaaattgttcttcatatgtcagaaaagtcccagagtaatctgggagtaatctgagcaaactgattcaaaggattattacaatttcttagtcttctactgctgcaaaagtggcactctttgattctcatgtttgaggttctaattactacctcatgcaggacttacaagagatcagccatgctgcttacattgtgtgtagtgaatcaatgttattctgaagggcctcctggaagcagtagggattggagaatgtatgtcttttaacatgatcattcccatcctatgggggttgggcactcttaactcatgttgcagatgagtaaactgaggcttttgagagtttgagggtgcacagcttgaggcagaggtggaattcccagcttcatccaagaaatcacgaatctccaatggcttgcacacatccaggtttgctggatcctatttgtcaagaccacatgcagattaggagccttcaaacaaattatttccaagggagggcatctttctctgtaacccctaccctggcaattctccatggcctcagggagtccagccggaagctctgcaatgagtcctggggaactctcatctggaaaaaggcgctcatgacaggtggtgccaaccttccacggatgcttttcagcatctcttgggatgaggatacagaatttctctttcaccctgtaaatgtggtaaatgagggaatagaatttccagctttaatttttctgaataggattcaaaaatgaaattgtataaaaaggtatccagtgaaaaacacacacccatccccatctcccatccagttccctccgtaacccttttcttagtttcttatatgtcctttcagagtttctttatgcaaatacagtataagcaaaaaagaatgggcctttttcttttcttccttattttccacaaaatctatcaaaatgggttttttttgttttgttttgtttgagacagggtctcactctgttgcccaggctggagtgcagtggcacgatcacggttcactgcagcctcgacctccccaggctcaggtgatcctcccatctcagccttctgagttgctgggactacaagcatgcatcaccaggcctggctaatttttctattttttgtagggacagggttttgctgtgttgcccaggctggtctcaatttcctggacacaagcaatctgcctgcctcagcctcataatgtttttttttaatgttaaaccccttcttgtgttgagaggcctggcttgtgtgtttgagcgcagctgcctacctttgcagctgtaaatgtcagggctccaggagggctggctgggtctcccctcctcccctgttgggtgggtggggccctgagcttatccaggcatccctaggtggatggatgggtggatgggtaggccctggccttcagggaatgcactgtgtgtggtcttccagccccagcaaagtctcagggggcccgagcgggaagtcgccatcctcagggggtccgagtggggagtcaccatcctcacggtcagccgtggtttcgaattgagctcccaggggcggagactccattcccccggggaacaatctgatagccagaaatgagagcagtgagtgacttggacgctgtgtgattcaggagggtcccagtccctcagagtcgcctggacaccagattgtatttacaaaacagatggatgaggaaatggagattgggtcttcaaaagaattaacctcagattttatttatttattttaaaaattttaatttttcccaaggaccctttccaagtcaagaattgttttaaaaagaagcctggtgaaggcaaatgctgtctgtggccgaaggcaccgtgaggagctgaggctgacttatgtttctcctctgggctatgtgcgcctctaaggagttcacacactttaacccccttaggaaccctacatgatcatcctcgtttcttaaagaggaagcagagccagcaaacaagtgggggagccacagttccagcccaggtgtcactgggccctgcctgccccagccagctcctcaggagcacacggcaccccacgtgcgtgcaggggacagctgtcctcacaggaacagccccgggacctacaggacttcctggggtttaccctcagagcacccatgaggttagaatcacaaagcccgggagtcaggagacacagggcagctggagggaggtctttactgaggctactgaggcacagcagccccgtctagaggcctccccgagaggcacttcctgaggagtctggtggattttgagctgctttttaaacaaccttctccttagcatagacactgacactgaagggaaagaaagcaaatggtctgttcttagtgggaaggcaacttgctttcaggggaacgagtttgggggaagaggactggtagaagacacgactaagaaagtgagtaggagtccagacgtgtgtgattcatcctttagggcctctgtgtgtgatgggttgacttgtgtgtcccaaaattcacatgtggacgtcctcgcccctggcagctcagacgtgaccttatttggaaatagtgccattgccgatgtaattagttcaaatgaggtcatgctggagtcgggtgggcccctgatcccatatcactggtgtccttataagaaggggaaatttcaagacagacacacactcagggagtacaccatgtgaagactggacttaaacagctacaccaccagaagccgagagagaggctggaacatagccttccctttggaggtagcctggcccggtgggcactgtgatctcagacttccagccttcagaactgtgagacaatattttattgtttaagccacttattttttggtactttcttacggcagccctagcagatgctaatccagcgtgcgtcctgacagaggttgaagggggcttctcaagtcccaggtccagcttggtgtggttcagctactcaagagacatctgctgctaatggatgagcagtcaacctggacgcaggaaatcattttttatttgggtgaatacaatattctccttttgttttcacttttcctaaaagttaaatcaaggttcaaaagaaaatcgaggttcaaaagaaaaatttggtctttacatgtgctaaaaagaaaaaaacaaaaagactcatttcatctttatatgggatgggatccgtgctctggtgggctacagagtgtgtctctgtgtgggtccctgtactccgtgcgaggttggcggccgagccacggttcccatgtgagcaggacagcacagtctcacctcacacagagaacctcgcccgaacatggaactttcacccacgttgccattttcccgctccctttccctcctttgaggttcacactcgtctctccaaattaaaatttacaaagagaggagatggaggctcccaagtggccacaaagtcacattttatgtgagacctttttgcctcatttgctagttattgaacaaaggtgactctgaacctagcagaagcacgggttcaacacacagttcagaaaaacaggaaccatcaattcataagaacttaaagaaaaaaatagtttaaagaactgagaagttgccacattatagtgaaagaatgttgggttttggaaatgacaaaaacgagcaatcttcaccttgaaaatccggtggagtcagttacacaagacataaccgcacacaaacatggcatttctgatagtataatggcatttacagtcaagaagcttctttcagagtatttcatggaaagttattttagtagcaagggtagccttaagcagtgagtattcgtcaagagagtgaaaccttgacttcaaagtcaagaggcggaggagtgaggactcagatctggaggcgacctgcagggcgggtgcccacgcacaggtgtcccagctgtggacatcccacgtgcacaggagtgggccaaagagaggcccatggatccctgcccacctcagaaatgtgagcaggcagctggggggcatttggactctagccgggacaacctagtggccgggcaggggatgcaggcaccacaggtcacagtggtttgctacgagcgtcagcttttaaaattttaaataatcctcttattgtaaaattgaggacattatttgaagcaacgcaaaaaccatgtaaaaaaatgtctgtaggatgtgaatagcatgtttctttaaggcaatatctgaagaaaatataaaagccccaggtgaaagacaccctgggagcagaggtgcccctgagggtcggctgccccaggacagaggagggctctgctggtgcccaggtggcactgcctgtcttgatgccaggtgcaggggtttagaagaaaagacaaggaagaaaataaaactcaccaccgacattcctaccactagagttacccactgttcccagtcaggcatatttcctcccaatcctgtcctctctgtgtatttggtaattgcgtaaatcatctctcccataattaatctcctttaaaatttggaataatatagttgttagaataatataataatcatgcagaataatttagaataatgttgtttagaacaatttttgtagtcatgctaccttgcagtcattcataactcagaagaactctgcatttagaaggtctatttaaaatgtgccttctttgctgaagagttagttttatggtaaaaatccaataaaattgtagctaagcactgaaaaaaagtaaagaattaagctcagcctccagaaatactgattttatatatatttgctctggggaagattggtttaagaagacctatagcctgttaattgcccttttataaattgcctccctatattttttgccctcttttcccctccctccctcctttattccctctgtctcttccctttcccctccctccctcccttcattcctttcttccttctccttttcttccttttttttattgttgttctgggggaacttttctaatatcctggattttaagactttgatatatatgctgcaaatactttctctcaacctgtcttaactttctttactgtgtcgtttatattatggaactatttaacttttaagtagttattattttccttttaacacccaggttttgtcttgcttagaaagtctgttcctacccctagattcgaaaaatatcctcacatttttttcttctgatacttagtaattttatttttggtttaaaatgtcaagtcaagtagaacttatttttgtttataatttgaagtaagggagtttcattttaccctaaatgtgtagcaaattttcccagactatttattaagtcattcacttttttcctgctgaaattatgatatttaagttgataagttttatgtgttggggaggtgtcaaatgggcagtttccagttggaatgtgggattgggtagagctttgacacaacgtctgtgtctttccgactcccatgtgacttcagggcaaagaggcagaggaatggagctcagagcttttagagaatatgggccagaaacaggaaggagtcaggacctgataacgggaaccagcggacagtgaacgcagtggagggccactggggccggagcagccgagagatttcaggaggtgagcttcagagagcctcggcataaatggatccagggtgtggtcagctcagggaaagacagacaaccagggctgagcacaggccaggccaggccaggcagggcccccggagaatcacgttttagtatctgcatattgagaaagtttgaccttgagtgtgaaatgtagacaagcaacccaaataaaaaataggcctgattggggccaaaaacaaaacagattgatgaaaataatctcaagagtaggaatggacacaacctacaagaaggagactgaacccaccaagtgtggcgcttgagtcaaatcaaacgattagaggctgccaagtcggcccaaaccccaagagcgtgggaatctgggagggcaccgagggctgggctgagagcctcttttcaaggaagtctttccaggatgctgtacttctgtcttgccaccttgcaggccttacagtgagaccatgaagtccctggcactctccctgccggacccgtggccgatgttgatatctgctcggccggcctcacaggtgtgcgcgctgtgcagtcgcttagggcctcccctgcgcagaaggtcctggcttggtttaatgccctgctgttaccatcttaaaattcttaatggtttttgaacaaaggccgcacatgttcattttgcaccgctttgtaattacatgatttaaaactctgtgcttttctcttcctttttattaaaaacaagaatgtcagaaattgcccctttaaaactgtaaaacaagaaggcattaaactcttaatatttcaggtcaaatttgacactgtctctggacatgcaggtctgggtattggtgggccttagcccctttcctgctgagcccagaacatgcttctagtcacctagcataggtctctagggggcctctgccacaaggcagggccaacgccaaatgacatgcagttgcctttgatgaatgggactctccaccactgctttatgtaaacagcaggtcctgatatatgaaatgtggcttcaaagcaacttaaagaaatgaagggtcaaggatagaatatgtgatgagattctgataccatggagcctccagccccatggcttgctgtgcttgggctgtgttctctgtcctggaagggtccacagagagggcaggctgccagcaggaggcctgcctgctccaccagactgatgacacttattccacttggttcccagaactaagaggtcaggggccatgaaggactagttgcaggagaactctctgtcttaatttaaggcatgctctgtggagtggggctgttgggcagcctttccaatttatccacccatccctgggatctcttgggattgagaaactgagtttctccagggttcttctctcaccactcatatcctgcaaccttagggtcctccctgtactgggtatcagcctggtctcagcattcagggactcagagagaataatcagaggtgcatttctatcactgtgaggaccttaggctcaggccaataatgtaaagaagcaccctacctgggagaaacttactgtctagttgtaaagaaagcaccagggggccatgatgcccatcccacccatgttcccacccaaactctcctaaacccacagctcccaaacaagttctggattgtacagatcaggctccagccaaggtgagctcactgaggtcagagcttacagaatctgggagctcaaccaacatgatggcttcagagatgaaatacccagcacatccagctgcagttgccccataaggagcagaaagtttgctatcacttcctctgtactgtttttatgttcaggtgacctgtgggtcagttgttcgtaatgtggtgatgcctgtaaagggagcactggaggtcagggggtgccagtgagtggaggagaccattataaatactgtgtccccaaagggtgtacagtcaaataaatatagcatgggaaaagccaggttgacccaagagaaacatctttttctaaaaatctgcaagacttctcagagcctttggtcgtgcattttaaatatccaaatatgtgttttgaaaatatgtgaaacagcataacatttgtggtatatgttaaatgtagatgatggtggaactttctgtttttttcttagagaatttcatgggaccaggcttccaaaaaacacaaatgttttgaggacaaaacatatgaatattgtagaagattagaagcgataaattactataggcagaagataagtgacattggattgaaatttttaaaatgggaaaataattacaaatggaggagtggcatggtcagaggcggagtgcaggtgcctgtggcacatctgggctcactggctcaggcaagctgcggtggagcagaaggctggggacatgtgtgtagagtcccaactgtcagatcacagtgttgggttgggtctttcacctgcaggggcgtgtgtgtgtgtgtgtgtgtgtgtgtgtgtgtgtgtgtgtgtgtctgtgcacatgtgtgtgtgtgctgcttagagtttttgagcaaagtttggaatgatcaatgtgcagctttagaataatgacttggtgggaagaattgaagtgaggaaacactggagatttgtagccctcctagaagtcactttcagcatggatcttggtgtggcctggaaggaaaggacctggcttgtgggaggcagcagcagaatggacacatgagagccacaatcaagacagacgtggcagggtgaataactggctgaattgtgaaactctaggctgcccatatcacactgacattttgagaattcagaacagatggcaacacctgggcccctgcctgtgcagatgggccagaaaaacgtgacatgtgtgaaggtgggcatggggtggcagcagtttctctcgcccaagcattaagagtgttacagagcagaactgttattacggaattggtgaagcacctctgggggactccctctccttcccccaagtatatgttggctaagtagccaccaataacaaatggagacacctgcatgctcctgcagccactgcagtgtggccagctcctctgctgggctatacacgtggagatcgtgtaagtgaccagggccaatgtctctggcagccatggagaaacaggtggcccagcccggccctttcactgcccgtgatggacagcttgccatcgctggtcaatagctgcactcccagatagtattaggtaatatataattaataaagaatattccagttgatctggttcttttaaaacaaggaaacttcttgctatttggtacccacaaattccactactccctgaattgtatgtcctgaaatctcacaaatttgcatgctgacattgttaataaaagaacaggagataatttaaacagccctgtggtttggaagtcacaggttctgctgcttcatgttcatgcacgagactaagagcctttgaagaagatcacttcctagaccaaggctttatgtttggattaaatgcagctcctccagatcatctcccgaggagattcagccagcctctgttctctctactatccccgtcttcttgcctcatcccatgcacacatttatatgtgttcacatttatgcatggacatgctctagtgtgccctctagtgcagacattttatgcatgaaactttaacccctcttgcatcaaggcatataagcagaagagatgagtggaaagattttagggcttggaagggcaaacgtgatagtcactgtacattataaagaacaccaaatgacagtgtgctttggaatatactactaggaatgtttctgctttgcaattggaaagtaatgacattgaaaagaagtgaaaaaaatcacaggtatataattcagcaccaaattgatgaggacacagaggtgaactagaaaggcatcccagcggaaaccacttacagccccataaaagcaagatctaagcaatggggatataaaaaaggaagggaaattgatgaagatgacttggggtgacgtgacctggagtttagggagggacagggacttgccttggactcactatgggtgctcatgaaggaggcagcatttggacaaggccctgagaggcaggtggatttggatgtgcagtggtggtccgggtgtgtggagtgggggtcagcatgtgcaaaggcatggaggtcagcaaaccaaggctgagagcacaagaggttcgctgtgtgtcttccagctgcccagtgagcacatggaggtaaaggtgcacaacttggtaagcgacaggagtttgtgtggatcaggcctgctgtgacataaatatgcaaatgatgtggtccctcgtggtagcaccctcaggatgacgcactcttctaccaaaacatggctgaaaatttttggtgtgtgggggtgtaccctgggagcccatttagaagctacagtgaaaagagccctcattgcttcagctttgagccatctgggccctcccacctggctcatttcacctgacagtttctaaaacttctcacaaggaatttgtcggtttattacacatccatagaatgccctgaagagctattccaaaagaagagcttgaaagtcgaacgctaagcagaaaaacagtgacttccaaaccacagggtttgttcgaattatcaacttagtcctttattaacaacttcaaggtgcaaatttgtgagattccagacaggcagttcaatgagcagctggattttgctggttcccaagagcaaggaaaattcccttgttttaaaaagccagatccatttggaatagtctttcttccccacatattacagcatgaacgtgactctaaagtacctgccgagggtctttctttttgtgacggtgggcgctgttccccactgtcgtggacttctcacagcgctcagtgtgcattcggttgcttctctccataacgcctctcagctaactgtgctgtttctgtgctcctgggttgttaatgttcaagtcttggctctataccattttccttatcatttaggattccactgggaagacatcactaagttgtgaaatcaaacttcatgagttggctgagatcatagggttgggtgtcctctgagcacttgcaggctgggggaagacagaaaacctggacaacttgcaattgtttgcaacaaagtggaaaaactaaagtagttttgatatgtgcattagtttgcttggactgctataacgaaatactacttggtggcttaaacaacagaaatttcttttcttacagtcctggaggctggaagtgcaaaaggaaggtgtcggcaagatcgtttttttctgagagctctctccttggcttgcagatggcagcctgctcctggcacagtcttttctctgtacgtgctcatgtctgtgtcctgatttccttttcctagtagggccagtcaaattggattagggcctaaagtaattatctcattttactttacttctttaaaggccatatgtccaaatacagtcacattctggggtgctagaggttaagatttcaatatataaatttgcaggggacacatctccacccataacaatttgtttttcgtaatacgtttaaaatacccatttctgggctggatgcagtggctcatgcctataatcccagcactgtgggaggatcacttgagcccaggagtttgagaccagcctgggcaacatagccagactctatctataaaaaaaaatacacacacacacaaacttggccagatacagcggtgcacacctgtagtcctagctgcttgggggactgaggtgggagggtcgcttgagcccagaagtttgaggttacagtgagctatgatcatgccactgccctccagcctgggcaacaaagcaagactgtgttacttaaaaaataaaataaaacaaaaagacccacttccatttatttcacccatggataaattgtgtagcaagtggttaggtgaaatgtgaaatgtctggccaattattgtcatcatgctcaattatagagacacagtatgctcccctttgcattcttcattgctgattctgtgctttacatctggcagctacaaaaatttagtattttgctagcaggtgcatcaaatctatttttggtttcaaacaatacactttttgttttcagcgattctgaccagtagtcaacaattgcaagtatgtggaatgtgattctcctgctttgggaacaagggagctcccagttttgtgggcaggatccgacattcccatcataagggcggcctcacctgtctgtacctctgacacctcagtcagagcccttggagtcggctaggccagttttggccctccttactgagacctagtcattctgtagacatacttcattctcccaggcttgggcttctggttcaacctgtggctctgtcattatcaccagaagatatccatctggcccaccttctgtggcttttttcccatgcacctttcagactaaattgtatacgctcatcctccaaagggttggctgtctttggtggtattttggcctgagttctgccttggatttatgttttttgttacatatatatatatatatatatatatatttttttttttttttttttttttttttttttttgagatggagtcttactctgttgcccaggctggagtacagtggtgtgatctagattcactgctacctctgcctcctgggttcaagtgattctcctgtctcagcctccagagtagctgggattacaggcatgcaccgtcatgcctggctaatttttgtattttcagtagagacggggtttcaccatgttggccaggttggtctcaaactcctgatctcaggcgatccactcgcctaggcctcccaaagtgctgggattacaggcgtgagcctaccgtgcccagccttatttcataatttttgatcgtaattccacccacatgttctattcatgtgaaatttactaaggtgagaccaagtggagataaaaactatctaaacgaaaaacttaggtctctctttcagacttttttttggttttatggtggtaaatacaacccacttggcctttcccctgagactactggttcttttgtcactggagtcccagagatcagggtttgaactagcccaccacttactggtcatgtaactttgggcaattcagtttgcatccctaagcctcaatgtcttcatctgtaggatggaggtaaccataatgcctgtctcagaggctgctgctagtgttaactgtgggacacaacacagagtgaggcacagacgaggtatgcagaaaacatcagcttcgtggttttttactcttctgcacttgctgtagcattctgcaaaactattattcctttcctagactcatgcccaaagttacggaggacccagcaaccatctcctgcagcccctggaaacctcttgactcttctgtgatgtccccagtgatccagcagccctggccttcttttgatggcttgaacatttggtcttcattgaacagtttgtatattggaaacttgccagcctccatccacattccaacctccgtctgcatccctcggtacaaaatggttcaatctgtctacctcctttcacattccaccaagatattccaaggcccagggttcctttgaccacctcacacctaacaagttccctcactgtctctcactctcccctgaagattctaagctgcctctgtcctgctaaaactgtagacctgagaatgaagtaaggtgcttcaggtgaggcttgatcagcccagagcagaaaggggccacctcctcccaccctataagaccctattagtgcaccttggagccctttgcttggctggtggctacaatacacttctgttaatgacggaattccataacatttttccccattaatttctgctacaaaacacaaaagtcttagccaggtgtggtggtgcacacctgttgtcccagctactcaggagtctgaggtgagaggatcgctgagcctgggaggcagaggttacagtgagccaagatggcgccgttgtactccaacctgggtgacagagggagaccctgtctcaaaaacaaaaaacaaaacaaaacaaaacaaaaaccaaatacacacacacacacacacacatacacacacacacataaaagtctcatattttacacttatgaagttaggtgggttttttttgtttgtttctttgttttgttttgttttgttttgtacccaaaagtacataacctactactacctacctttttggtttttttttttttttgagatggagtcttgctctgtcacccaggctggagtgcaatggcgctatctcagcttactgcaacctctgcctcccaggttcaagcgattctcctgcctcagcctcccgagttgctgggattacaggcacctgtcaccacacctggctagttttgtatttttagtagagacaggatttcactatgttggccaggctgattttgaactcctgacctcagatgatccacccgcctcagcctcccaaagtgctgggattacaggtgtgagccactgcgcccggcccctttcctaaggttttctaaagcatgtttgtggcaatctatcttagaatcttgtcaaaggtaaatacaaggttcagggtttacggagccaccttctagccctttaagccaccagaattgctgatgtcttatggactcctgagaagtttgtggtggtgattcttagagctcagctcccgactgctggactgtcggtcactgggcagaaacagaactcagttctcatcacctggatgccgtttcatactctccaccctctcctgggcttcagttgccccacacaatgtcagtctctttgtgatggttagttttatgtgccaactttgctagggcatggtacccagatatttggtcaaacattatcctggatgtttctgtgaaggcactttttagcagattaacatttaaatcagtagattttggcaaagcagagtcataatgtgggtgggcctcatccagtcagttgaaggccttaatagaaaatgatgggctgggcgcagtggctcacgcctgtaatcccagtgctttgggaggccgaggcaggcggatcatgaggtcaggagattgagaccttcctgactaacatggtgaaaccccgtctctactaaaaatacaaaaaattagccaggcgtggtggcgggcgcctgtagtcccagctactcgggaggctgaggcaggagaatggcgtgaacccaggaggcggagcttgcagtgagctgagatggcaccactgcactccagcctgggcgacagagtgagactctgtctcaaaaaaaaaaaaaaaaaaaaaaaaagaaaagaaaatgacgaacctccccaaagaagattggattctgtcagctgacccaaactgcaacagggactcctggggtctctgcctgccagcctgccctgtggattttggacttgccagcccttaccattgtgggaacctaatccttaaacaactcaatctccactaccctcctcgcccttctctctctctctctctcacacacacacacacacacccacacacacacacccacccacacacacccacacacacacacacacacacacacacacacatccaattgattctgtttctttggagaactctgactaacacagtctccttctcagtattaatgtttttttcttggacagaaaatatagataaaatagaagtctagaagttctgttttctctcacgaccaaattcttctatttctcttttaacccattcagatttgtgagtcccggagcgtgctttgccagggctctgttgagttccacagtgcattgagcaccactatgtgggaggcactggctctcaacaggcagcaggcaccttttccctaatgaactgtctttccaggtttcactcaagccctttctatcagacttctaccatgcagctctgccaatttctttaagcatctctcccttcttcctgactgtcctgaccaggaaactccctaatctctaatatctaaagtcatgaagccaattgcatcattagatgcgcagtatatataaataacatttacttacaagaatatttttatagaaatgtatgtaaacatacttacatacatttctataaatacatttaaattcctaaagacttgtttgagcaatttaaaaaaaaaatgctccagtttaacttcctactacaattaggaatttggggcagggtgcataattgccagtgtactcacagtgactgcaattagaatgtgctgtggagtcagaggaactgcctgacagtgccgggcagttgaccctgggctgggttcagagctctccagtggccactgagaagtaggagagtgtttcctgcacaatcctgatttcttgggggaggaggtactactgcacgctgctgggaggagcctctgaaactctcctgggccaggtctcctcccgtgcttcctctccctgaggcagcctcacctcttgacgcctgtccccagcacacccttctgtagctttcctctgactcacccctctgtgtgtctttctctccaactcggggtcctgtcacctaggcctctctcctttttcctaggtggctggcagttgctcttcccttggttttctctaatttgatctctttcccacccttccagtctgccacagtcacccttgatatccgcagaatccaccctccttggaagggatgaggaagggggtttatataactcaatttcatttgtaatgtttcaaatggtattttttttctgggaataattggcgctggattctgaactatctttcctgttgcaaagaatgaaatcccttctaggtgatggggcttgatctttctctgttgcaatagcagcgatgtccaaaacaatcaatcagaggcattttctaccgtacctgagccattcagtggtttcgacctctgctccagattacccagggttatccagatgggttaatgcgagtccttagaatggtgtttcccaccttgagagtgggttgttggctaggtgtgtgggggagctgtttgtctacacctcagaaacgctcacaacagcaggttccagggaaagtccctgggtgtccagtaaaagctgggtcgccctccctagggggctctgagactagcagaactgatggccccataatttgagcacaggtatgcatatttcttaggggttggtgggcagactcattcatgttcccatcccaggggtgcaggggacccttctcccttccccacatcagcccagggccacagaagctcctcaggaggcaaggaagggaatggagaggacaagagtgcctacagagtgggaaggagacaagcattctcaggtatttatccagggtaagggcaagggcttttctgcagtccaggacattagaagagtcctgaaccaagaactccacccctgccccgatatcagctgtttttattgactgagctgttggagaacagttttggtgtgcggaaacagtgagatccctaaccctacacccctgaacccagcagatatatccacactgaccagaaaggactggctaaccacaagcctgcctgtgcatggcagggaaaggaaagccattcttgagtaaatggtgttcaaaggttgggcaatatatgtatatggtgttctcctgtggacataattgtgcacaagggtcagaagaaattgctttcattgggcaagctacttaacctgtctaaagctttgtttttttatgatctgtaaatgaagacagatcctatctcatggctctgcacgtcacacagcgatagcagacaggtaattaggatgcaggtagttagcagacagcctgggtgtactttagctgttcaagtttcctcaacctggcctcctagccatgacctttcacagaggtgcaaatcatctatgagtttgcacagaatcccctgcaaggaaatatgttcttgttcttgacttacatttgagttggttggtcttacagttaaggcggaggtcatcactcttaataaaggccattttaagtggagtgacaagtcactaagggacttgttggcattgtttacttcttatccagggctttccaagaagggacagtgtgtctgagtttttatcttatgaaggtttcccacctgcagtttagtttactattattctaagggctgtttataaatgaactagcttgtctttgcactcagggtaattcacagatttgtcagtgacttcattgcagctgtgagctttacacgaaccttgcaatccgccttgaaaaatgaaactgagtataagtggggaccaaggaagaatgtttttgagggaaatagaaattaccatcctaaaaatggttccttctgtgtgtctgctgatagaaacccttgacctctttagaaacaaccgcaaaattattcactacaattatctgaatctcataaataaaataatgattacagctgcatggaattattcaggtctaaattcatataaacatatccctaacaaatttatttatcatgacaggaaaggaaagcatagctttgtgcaccccatcccacaccctccaccccctacaaattttactaacactgtttctgggttcagaatttttttgcctgagttggtacctcaaatcacttgagttaaactgcaaatgaatcacacataatgcagataaaatgacttcatgccctaatttctagaacgtgacctgaatgtgaactagacattcgttttcctaaaccccatgagacccaggtattcttgacatgtgtagagaggattgaaggggcccgaggctgtctgtcctctctccgtgggcctggctctccttggaccaaatcgaatgcatgggaacacaccccccagttgtctttttccttcggtttatataattcctggcatgtgcctttcaacactccgtttatgttagaagtttggtattagcctcggggctttactcttgacactgctactaattctctactttatattcgtgattgcccttctgaaaggagaatcttgtttcaaaattgcacctgggcattttaaagtaaataggatgcaaatccttagttggcctcttgtgtacattaacttcagagtgaagaatgaatatgtaagacagtgatgggggatggggagttgagcaaggaaaataatttgcataatggtgtttgctccctggtgaaactgaaacccagcctgtgtgggtggggccttgtttccaaacgtcagcgctgctgcccacgaaggcctgcaccaacgcacggtgccctccgggccgcccacagaggccggcgtctggccaggagcaggggctggggacagcaagtgtgaaaccagctgaagcacctgcagctcaggcgggctgcaggctccctgctctccccctgtgaagaagcacacattgttctttcttcccgcacatttgaatctctcagtggggtctcattttctgtgacatggcaaacctcaaaaaatgggagtaaatcatttctaaagagcttagctaggcatggtggctcacgcctgtaatcccagcactttggaaggtcgaagtgggatgattgcttgagcccagaagtttgagaccggcctgggcaacatagtgagacctcatctccacacacacacatgcgcgtacacacacacgagcgcgcatgtgtgtgcacacacacacaaattagccaggtgtggtggcatggtaattccagctactctgggggctgaggttgggaggatggtttgagccagggaggtcgaggttgcagtgagctgtgatggcactgctgccctccagcctgggtgacacagtgagatcttatctcaaaaaaaataaaaaaatcaaaaataaagagctcctgatttccatcccccaccgagaatcattttctgagtcagctggagtgtttcagagcccaacacccaaggagcagtgcagggatggtgcccagttacaggggacaactcagctctgaatgttacaaagggcacttcatggaccaccaccttttctctgcttgctctgtacccctaaagtactacaaggcatttttggttaataataatttgaatactatgtgatcttgtagattctactgcgtttggctagctaatgtctctaagtagcaagatgatttattttttctggacaataccaggactatatgctgatacaggactggcttgctctaaggatcagattttccagtgtaaaatatatactccttatagggttgtaagagcagaagcccttcatagcctgtttctttttgctctctcttcagccagcagttggcctggatctttgctggtagacacagggaatgttctccttgacgagtggttcccaccctggcagcctcagatcccaccatgttggcagggatgctgaaatccacctgcctatcagcctttgtaaataacaaaaatcacaagtggctctagcatttatgtattctatgatattgggactcgtgatataaataatacaaatgcttttacatgcataattcaatttatactatgttttatctttaattactggataataaaaacataactactctcaggaagtgtgggggattgtgactcaggctaaggtgagcctcacagcctggaggctggctttagtgctggctgggagagctgcaaggagatggcatatgctgccgatgaaggtgttctccaggaattttcagttagaagttttgatcattgttcatttggcctcaggatgaacatcatggtactgctcttcattctctataattaatatacttttcaccgtcaactttgcatttgaaagtatttattttatgggaaacagtgaaaagtagataattagcacatgtgcaaatctgtttggcatttgtggggtgtttgccctgaaaacctatggatgaagcccaaagacaggagctggggggtttcatttagttaacttaaaagttttaattggtctgtgttactcttcttgttacatatttttttaaggccctaaggtgagcaagttacattttaaaataaggaggaaaagccagttttaaaagtagaattgagtcattgcatgtgttttttttcccacaaacattagctgtgtgattattatgtcccaggcacctaaggaatagtgcccttgtcctggggaagttcacagtttggaaggggagatagttgggaaaggtaatgtgaatattaacactcgtgtttcctgggggccaaaatgttccagcttctgggccaggttaattatctgaattatcttatttcatccttacattgggaaccagatgtccccaatgcccttcagtgatttttttggtggctttgaggaaaaatgaggcccagagaggttatgtaacttgtccaaagtcacacagcaggtagatttaaagtcaaacagttagctcccaatgtgcacactcttaattaccatgccactaaaccagactctgaacaaagcactctgggagcacagagaagacctctgagggtctgtctgtgtgagtctagggcatgttcaaagttaagagctgatgtttagctcagcaggaaagggctggggcacagtgttggatacacatatcaggtggcatttattgctgatgacagtaaaagaaaagtgtaaaacaagataatttgtttacatttcaagatacattaagtttttttttttttttttttttgagataagagtcttgctcggttgcccaggctggagtgcagtggcgcaatctcagctcactgcaacctccgcctctcgggttcaagtgattctcgtgcctcagcctcccgaatagctgggactacaggcgtgtaccaccacgcccggctaatttttgtatttttagtagagatggggttttaccatattggtcagtctggtcttgaactcctggcctcaagtggtccacccacctcggtctcccaaagtgctgggattacaggcgtgagccactgtgcccggcctcaagatgcattaagttttaaaggcccctggttatttctcgtcttctgagatgtcattccagtgtgacatggttaacatcagtgaggatggcattcctgtcccacacagtaaaatgtcacctctcacacatgtaactctgggtgtaaagtgagtaaaaatatgagacttagaagaatatttcatcatggtatgctgactggggatttcacttactgatactagaaaggttttgcatttcagaacacgatgaaataggtaatatttatctgaaagacgcagacaagtggtggaggaaccagacacccccagtgccatttgctggcttttatcagacagaaagcagaaaggagaaacatgttttatcccatgagaaggaaatattggcttgatgcctaccatgcccagccttgcactagacatccaggtagctgctccatggagaagttcacagggtggtcaggatagcacagggaggaggtaatacgcttgagggaagtccaggagggactcagggagtgtaagccagtaggggggtgctcctgagaaagggaatgaggctgtgccttgaaagactgattagatagaggaggaagtgaagcatcagaggctgcccaacagaggcaggagctggggctggggtgggcaaggagaaaatcacgccatcctcctgtgtggacagtagagtttcatctgctgagggcagaggccatgttttatccatctctgtccccttctatgtccctttttctcctcccttccccattccctggcatcatattgggacttgttaagggctgaattgtgtcccatcccaaattcgtatggtgccaccccaactccagtaccttggaatgtgaccgtatttggagaaagggtctctgaagaggtaattaaggtaaaatgaggtcatatgggtggcctctaattcaatatgacttgtgtccttataaaaggagattaagagcacaccaacatggcacacgtatacatatgtaacaaacctgcacattgtgcacatgtaccctagaacttaaagtataataaaagaaaaagaaaaaaaaaggagattaggatatagacatacacagagggaagacccacatgacaacatagcaagtaggtggtcatctacaagccaaggagagagggaggcctcagaagaaaccaccctgccaacaacttggtctcagacttccagccatcagagctgtgaggcaatacatttctgttgtcagtctctaatactttgttatagtagctcaagcaaactaataatccagtgctcaacatatttttgttgaataaaagcacaaagagattcatgagaagagggaaatgttgcatacttagggtaggagcaaaccacagaggtctttctcagcctgggcaaagaatgtcaactctgtgttggagccagtagggagctctgtgggtcctcgagcaggaaaatcccatggcttaagcagtgtttcaggaagactgggatgttaggctccggagctctgagcaagtcagatgggactgggagtcataagaaggcttgactgtggctagtgataaccaatgagcactggaaacatggaggggaatctttcctcccttttatatcagggttctctcctagaggagcaggtgaggacctctgatggaccaggaaattggaattctgcctgggaggcaagcccatggaggccctgatctgcttggacagagagtagctcccttcacctgtaaaatgagagtgaacgagctggtgtctaaggaattcagaatccacacccatggagttccacagggtatgtgggattttagggggaccagggtgtccccagtgcaagaaggaggctcccaccaaggggctgcagcactgcagataacccccaggggtatgaaaagaggctgaactgggggcctccacagtcagaatccatccattgacccaggatgccaggaagggggaggcccatgggcagcagaggctcaacgaactccgtggcctgacttggccactaggttttttcagctcttcagccactgcctgtaggaggctagctggcattccttccttggcccttagcttgcatggatcggggtttcacgttaaattctaagcccaataacatggctctttttatttaaactcagtgctgcacaatgatgaatgaatgaatgaaagatcagggcagatgaactgtcaaacctcagcagttgcccttatagttagaggtgtttctgtgaagcaaatcaaagcttatagtatcaagaactttttaaaaaagtacactttgatccaagttggatgttatttctaagtgtactcagggtgaacacctcttaaaaccccttattatgtatgctgagctattctgaacctcagtgagaaatcagtaatgtcaagaaacctatacataattatttgttataatataaaaatccagagctcttcaagcattattctatcctagttggtcagattctgcaggaatctgagcctgaaggaaaataaattccttgagttgaagaaatttgtgtcttgtaaaaaagctgaatgagaaataacgttaaaaatggaaggaggcctaatgatgatattatgccatctcttgtcattacttagtcctctgttgtttcagtcatttaatctggttttctttctggatgctttaacttccatcttaattttccttataattgttgtgcaattataaaagacaatctgagggacccgccttgacagcctggggtaatatcactgggagtaggatctctcagaatgctaaggagcagatgcactaagagagctgcatttcactccattttattggatcttttggtatatacgtttctgtgactttagttcaatgggatggactgttgcataatactgagggctatatgaaggaggagtcgtctacacttgtaaaaaccttcttctttaggggtgggtagtgtataattgcaaaggcatttctgatttaattaagagttgtttggttggccgggcgtggtggctcacgcttgtaatcccagcactttgggaggctgaggtgggaggatcatgaggtcaggagatcgagaccatcctggctaacacggtgaaaccccgtctctactaaaaatacaaaaaattagccaggcgtggtgttgggtgcctgtagtcccagctacttgggaggctgaggcaggagaatggcgtgaaccctggaggcggagcttgcagcgagcccagatcgcgccaccgcactcccgcctgggtgacagagtgagactccgtctcaaaaaaaaaaaaaaaaaaaaaagagttttttggttacaagtgacggaaaactcaattcaaagtggtttaagcaaaatccagagttttaccatctcatgtaagtgaacaatctaggaaaagggcgtcatacatacagctcaaaatgaagtcaagatatttcagatctgtcttctcctcctggcccagtttttaatgctttgaccccattctcaaataaactcaaccctcatgatcccgaggtggctgccatttgtcctttcaggtccaaatccagcaggaaaaacttttgtcacagcattcctgtaaaaggtatgaggttcgccctgattggaccagccgaggtcacatgcctacacatgagccaatcacagtggataaaggactgtgatgtactcattaatttacccgccattatctccactcctgtcctgagggtggagttatgaagcttgctaatggggcactaggatgtccactaggttttactcagtgacataggtgacccactaaatttaagcatattggtgtgcaaaggaggcatttgttgacttgcaagtagacacctctcacttatttgtcacactcgctcttccttttgtaagcttcctgggagagggatctcagtggctttcaagatcaccccttgcaaattaggcatcatgcccatcattccatcccctgtgtgagatggcggcagaacagttcctattcagacacctgccctcatgcctcttcccccgtcctcccagcagccccagctcctggttcccagcatctagctccttccttatcagcacagggagttgctttttgtttgtttgtgtttgagaaagacttcttatttcgtgcatgcacatttcctttctgtgaagcagactcgggagctttgcctttctgacttattctgtgcatcctatcagtgaagtcagtgagtggcttcaaaaatgcttgctttctttctttttcttttcttttcttttttttttttttttgagacggagtttcgctcttgttgccctggctggagtgcagtggtgcgacctcggctcaccgcaacctccgcctcccgggttcaagctattctcttgcctcagcctcccgagtagctgggattacaggcgcctgccactgtgcccagctaatttttggtatttttagtagagacaggatttcaccatgttggccaggctggtctggaactcctgacctcaggtgatcctcctgcctcagcctcccaaagtgctgggattacaggcatgagccaccgctcccagcattttgtttgtttgtttgtttgtttgttttagacagagtctggctctgtcacctaggctggagtgtagtggcgtgatcttggctcactgcaaccttcacctcctgggttcaagccactctcctgcctcagcctcccaagtagctgggattatagtcacccaccaccgtgcccagctaatttttttgtatttttagtagagactgggttttgccgtgttggccaggctgatgtggaactcctcacctcaggtgatccacccgcctcggtctcacaaagtgttgggattacaggcatgagccaccgctcctgacccaaaatacctttttctttttttttttttttttgagacggagtctggttctgtcgcccaggcaggagtgcagtggctcgatctgggctcactgcaagctccgcctcctgggttcacgccattctcctgcctcagcctcccgtgtagctgggactacaggcgcccgccaccacacctggctaatttttttttgtatttttagtagagacggggtttcaccgtgtgagccaggatggtctcgatctcctgacctcgtgatccacctgcctcagcctcccgaagtgctgggattacaggtgtgagccactgctcccggccccaaaatactttctgatgctgataaaatgttttgtctactcttatgcccaaggaacagttcctcccttagcagaagttagtggttaaagcttcctctatgtttgccagtcaagaatgccacagggccagcctaagtgtccatgagtggatgagtggataaagaaatgcagcacacacacgtatatacacaatggaatactattcagcttttaaaatgaggaaatcctgacatttgcaacaacatggatgaacctggaggacattatgttaagtgaaataaattaggcacagaaagacaaacaacacatgatctcacttatacgtgatatagaaaaaagttgaacttacagaagtagagagtcgaatggtggttaccaggcattggcagggatagggtaatggggagatattgttcaaaggatacaaaagttcagatagataggcgaaataaacttaagagatctactgtacaacatgtgactctagttaatagcaatgtattgtattctgaaattattgagagtaaattttaattgtcttcaccataaaagataagtatatgtgaattagctcaattgagccattccttaatgcttatttccaaacatcatgttacacagtaaatgtaatagagtttttgtcaattaaaaaaattaccaaaaaataaaaaatgaattccatagagacgttctctccaggaagggtccccttcctagatctgactactggttagggttaatcaatgccccttggcaaaacaaaaccaaccccacatttcttcatctcccatgtccaagacacatgcagtgagttctcagtgtttactaccagcacacaaatgatggctgctttattatttggtgacctttgttgtttgctgtgattgttctgttcagttttagtccctcacagcactttcggccatttagaaagacagtatttgttctgctagagcatttgcaatctgtttctgattagcttaactggtcttgaccagtgctaagttcacacttcagctttgatttatgccgtctctatctgcagatatgtttcttgttacactatacaagaggaggcctcttcttattgacttcttattttcatgtgaacgaggtaataggtatcaggaataattagacaaggccatacgcgctaatgtcataggagactgagatatggagagtaaataataacaaaattcctgattactagggcatagaaaaaaaatcataggcaactccccaagttgataatcccaaatgtctaggcgtccttctcaaatagggaaacgtgacattaaaactactcaaaataaatgagactcagtggtatttataaccatagataaaaaagagcaagggtcctggggaactgtgccaaggcccagccctttgattcacaagtatccacaaaaacagactgtacgggctgctttcaagagaaaatgtggccatcaaggtcaacactggaagccctatggccactcattcattccatctcattggccctgagcctttcgaaaagtaggcagagaagaagcccaaagaacaacatggcaggcaggttaaggaagaaagcagagttcacagacatcactaacaatttcgtaatgacctcatgacttcgctggaaggattccagtggaggcgtcaccagccctttgtccacctcttaggctgagaacctcaaaggttgcccacaccttgaccacatactttcttccttttcttacacaatcaagctctgcaccaaacattagggggacatttgcattttcattatattcatgcgtatttctagcaaaatacaaattcttacaagatgttgacttgtacagtgtggcaaggaatactgtcatacagttgtgccaaaaacaagcccatttacttatttttttaaaaattaattatatataattcttataaaataacaaattccatttatttcctcttgatctctgtcatcagagacatttgaaggtcggaggtgggttcaattgaaagacataatgcacttgacaagttgttgtatgtgtgcattgtgaataggccttaacagtgcattcatttgttttattttttcccatttatacagacttttgttctgctcttagataaaatactaataaacaggaagttgaaaaaaaaatgtggtgcaattgttctgaatgttgtttttcttgcaaggctttatgggctacaccacaccatcctattcaaagcagtccctgtaggtggtggtgttaataaagaaatgaggctgcccagggccgcctgcctgagcctctctgcagctgctcacctcctgctgaggcctctgccttcagagctagtggggcctgctcacacattccagtagtttcctctttatttgtcctgaaccaagttgtagaatttaaaggaggtgaagtaaggcgatttctatggaaaatatatttttcttctttactcctcatgctgagtgcataagaatttattatttcccctgaatgttcaaagtggtgtgtgtgtgtgtgtaaaagaaccaggagcaaacaatcttaataggaatgtgcgatcttgtgtttatctttagcacacttaattagctacaacccgggactgttgccatttgaacaagttgttaagaaaatctgccatgttttgctcttttttaaaaggaatgactttaataaccatagcaacacttactcagttttgtgatccactccaagattatgggagcaagaacagatactcctgaaagcaaccctcacctcctcccccgccccctgccctcagcaagtcctggcctgtgtgaactgaagggtttggaagctctggtttctaggagtgcccagaagctagaaagactagggtgtactagttattgaggggcagttgtcagtggcagtgtgggggcaccccagttgttattcgaggcactgcattgcttttttgtctcctctgtaagcatcctgcctcagtgtcagggcttgcagaactaggcctggagttatgccccctacccaaccaaggctttgccttttgccccccactatggtgccacctacttgggtttcccacagttggtagtgccaggcaggaagcaggagtgcaggttgcaggaagggagagcagaggaaacagaagttgcttaggagggagttgggcaggctctgtccccagcagatccaagggtccctgacaaagagaacacctcacctccgcccctccccagaggcacacagaatgccccctcccaccacctccaggctgttaattcacacccacccaggctgcccccaggctccccagacctgtgccagtcaagcctggcctgtggctgtgacacctgcattaccccagacggttgcctgacctaggcctgtccttctatctgctttgtttttatgttgattactaggtgaagcacagtgttaaaaacgggaagaaaaggctaggaatgcagttatgggagtgtgaggctgggttggaataggtgggagaaagtccagggctgagtgtgtggaccctgctctagggatctgaccggctcaagctcccaggccattaaacaaagttgttaatgaaaaaaaaaaaaaaaaaaaagggagagagtaaacaaatctctcctctgttattctgcacctggagaaaagtaaaccccttgggcataataggctgtcaccaattagacatccgggaaaggcttttctgggtttagcccttttggggaagcatgggggtagatgtaagtgtgtgaaccttcacccaagttctggagaaggattccagagtgaaagaggtttccatgctgagtcttgcatttaagggaccttccatggcatagctgcaaagaaacctgaattgcccaggattaaccacctttcctttagacggtgagcagtgtgtttcacgaacacattacacattttagggttgtctatggaggtatcggcactttcattactatttttaacattttattctctgttcagggttaagaacttcacccacctaagtcagctcctgatacaacatggaatgttccagcaatgaaatgtgaacttaagatatttggattaaaaccccaaagttgagtcaggtttaaatattctgcaagaagcagtgagctccttttgtctatttgggcacagttttcgtgaattatttaggcttttcttagatgcctgagctccgtggttagacagcagataagttatttttccctttaatgctgaggcattttcactgatttcagtcttactcattagaaaattctgtgctcacccacagctgccagggtttctagaacacaacaccctaccttctcctgtagacattttagtccgtcctcgctcctgcactgtggctttcacagtcaaatgtgagttgaccagccgtcatttgtgagctgtgagcggtatttttggaacttgcccacccccgttcccccagagtcctgtggaggtcatgctcatgggttctgccaccgggacaggaaagtttggacattactaccaaaaaaatgcaacgtgactaagcaccgtttaaaatagcctttcttattctcttgtaaaattgcagggatttccatgacagatgtcgttttagtcattttaaaacttcagcgcgctgaacctcatcagcatatttttatttttgacatttcatattttagagtggattgaaaactaatttgatccatttcaatttggaacatccctcaaggtcattttaccagcatttaggccagtgttgatcttgctttcattttaaacatagttattttctctctgtgaagtgattactccttgcttggtgtgtggtctggtgacttgttaatttcaaaattctacgatgcaagcgggtttggacgtggagcctggcccggtgtggccaggctgtggctttgcccatcgcaacggctgcctttgcctcaaatggctcgaggctggcacctggtcaatatttgcttttgtccaaaagaaggaaacagtaggggacttgggtggtgtaattttagaactttactgttgggttgttggcttgaaagatccattctcttctataaatacagatacatatttactcctccaacctttccctccacacaattaagaaaccctacaattaattatgccaaatcaagatttgcttttctacatgattttttcccttttccctaggaagtctgtaatgaattttcttctttattgtaatattttatgtttttatatacacttgtatattcttatagcacatatatgtatatatgcaaactttctgaggcttctaaaaaagagaaataatattggttgattaacctcaatttcttttcaatatcaaatgtgtaacaataaccccaaaaggagaggtttcagaaattaaaacaagttgacatttgcccacttctgaattaaaatgcagcatttgacttttgtactgttttggctgtcaagccttagttttttcacactatcaggtattttcagatcaaaggtaaatatgatttagaattatatttcaaattagaactgtcatatgcccacacatacattttgctgatatacttacaaactggtaaacaatgctctttaatcaacaattcataatctgggtcagcgatttttatctccatatttgctcatactgtatgacatcaatattttatattggcttgcccataacttaatattttataaaagcctacctatgaaattcatatttcatatttgcttggctatgaaattaatttttgtgatgctgcagttcaccttgtagcatacaaattgagaaaattagcaagctgcatgtagttccttgctgtacaaaaacaaatgacacatggtgtctttatcacttgttttgtatttacagataaattttaaaaataaaacttgccatttctgttaacgtggaaaactccccaccccactcccattcttgttgactcttttttatttttaaacaacaaatacataatcaacttcagtcatctcattttcaggggagttactcattgtattttctacttacagtcaccggggctgatgttgggatctgtgatcagtttcctgttgttacgcatagcttttctcagcggtgagagagacatcatgtacagagtacacacggagggttgagatagcagcctggtttatcttacttctgatatgacttttaaaatattgattttaaaagtgtgtctttgagtgtaccaaaatagtatgtccctgatgcttctcgctggatgcaatccctgcgcaaatgctttctatgcaattagattttggggctcagcttccattttttaaatctgtgaaagcattgatcatgccagcggccctggagagggccactctgttttagtgccatttacatgtatcaggacaggacagaaaagggacagcatattacaaacaaaataaaactataatcttgttcaatccttgtcatgctgaggatgtttgtaaatataaaaaaaattgtatggattccacttacatgagataactggaggggttagattcatagagaaagaaattagagcagtggttactagtggctggaggcaagggggggaatgaggagttattgtttaatggggacagagtttctgtctgggaagatgaaaaagctctggagatggatggtggtgatagctacaccacagtgagtgtacttaataccactgaagagtacacttaaaaaatggttaaaatagtaaattttatgctatgcctattttagcacaataaaataatacacattcatggaaacagggcatttaaatcattatgcataataaagtgagaagctagttgtgatttgcaaagaattatagaaattatagggagaaacacaatctcaagagccaccctggagtccagagctctcgttttacagattcaggagtggaggctcaaagaatatatgctttcttaatgactggaacccagacggcaggacccccacacagggctccttgctgaccctttgctgccttcccccctcccttagaggggccattctttattctgagtaaacgtgccactgattagatgggcttcatgataaagacctgcagtaaggacgttttaatcctttaatctagacggttcacgagttccactggtgtgtctctgggggcaggctcccagatcacagactggttccaccgtgccccgtgacctcagcgtgccattagatgggaggccgttatttcaggggaaaaatcatgtttgaaactaagtgggtccccggcagtttgcagcaacactggctgctcaaaaggacagcacgaggcttttcacagcatgtagatgccatggctttatgagagctttgagcttgggagggtctacttgtgcttttgcaaccttagtttagatttcatttgcatctactatttgtaagtgcaccatttttctacgggaagtatgtatgtgagaattatctacatgatttttgtaggtggctcacaaaacaaatgtcagtagccattctatggccttggagtatcatttcccacaccttttctatggactgtctttatttttgactctaatacgtatcccttatcatacaaaaagttcttgagcatatttgatatattttaaaacttccaccccagtggaattaacactaattatatttaattccacacaaacttttgtcccagttgtagaccatttacctacttcctgacagcaaacactacaccgctgtgaaattttattttaacacatttgtgcccattttcagcattaataatcgtgtgtggaagtggcagcaaaatgaagatatcgcctgagcatggaaccacaaatgcctgaacgtgtgatggcatttgtgaaacaaaagcatgacatactttttctttccaaatgaggcagtgccacaactaaaaaagccagttcgcctttcgctttctaaaatcatcttgctggagagaacggttatcaaatcccatccactgcccatgtaaaataaataccattcagaaaagcgtggcatggatggccatacttctgatgggtttataactgtagattgcatacgatcccaacgtgaagcctgaaatacgacattcaacgtcaggcttattccaggctactgctgtggctacttttgtaattcaaccagtggggcgttttaggctaacgtatattgcctctaagctgataagcattttcctgatcccaggccccttctaaaattgaacacacacgttcagctggggacacctagatggaaggaagggaaagaggagaacccgaagtgaaggaaaagtcaccaagaacagtttcatggaaaaaaaaaaaaaaactctcaagaattaagaatgttgagttgcttgaatggagcttgggcaggaaaaagaccataactctcacacacgtgaaggttactgatacccaggaggtaaaagaagtatttaacatgctctaaagaagggtaaccagagtaatggggcgaaaccaagggaggacgtcctggaatgtaatattagaaataaacttccaaacagggaagtgtccatccgagtgtgaaatgggtttatcagaaacaagctgcatgccagtttcattgacattgcaaagaaggttagaataaaaagctaatgaacagaaagaagaaagaggcaaacagggtgtgtgttgagagtggtggaatatgaaggatggtgcatttgtccaggctggggctgctggcctgaggaatggtggtggagtttttttacagagcatcttctgagcaccaggagagtcccggaagctgagtttgacactagcaagacctgccctgaattggggactgctggatgcctggaagctcccctacacttacgttcctgaagttgggctttttatcaccttaggactatggcttcccaaacttggcagtcagcgtcccggcaaaagcctctctattactgcgaggtagtgtttatggagtcacagctaagaattacagaaaaaatcataataggtgaatcttttttttttaaaaaaaacaacattttttgactttgcaaataaattgcagaattatcaccattgttgaaatattttccattaaaactagagtttattaaaagtgcctggaaggatgccccctgctgcctccctgagtcatcgctttggatttgttcttcagaggcagagatttatttccatagcaggggttttcagttttgtgcttacagtcccgcagtaagtcttactggcttcatcttctgacctgcttttaaaacagtcctccaccgtgctaggtacacaaagggatactttttgggtttttttgagacagagtctcgctctgtcacccgggctggagtgcagtggtgtgatctcagctcactgcaacttctgcctcccaggttcaaacaattctagtgcctcagtctcccgagtagctaggactacaggtacgcatcaccacacctgaataattttttttttttgtatttttggtagaaacagggttttgccatgttggccagactggtctcaaactcctgacctcaggtgatctgcctgtctcggcctcccagagtgctgggattataggcgtgaaccactgtgctgggcccaaagtgaaactattataacaaggtaagagcaacttttcccagagttaaaggatggtgctccatggaatagtgaaagtctgggaccaaagcaccttttccctttaatttctccaattgcttttaaaatattctatgcaataagcatctgagtccaaagggaggctgtgtcttcctctagggtctctctgaatgaggtcagtttctatgttaacttttacgcttccttttttgtctcatcccaaaccatttctcctcttgtcatcctctttttcctcctccttttccttcttatttctcctgttgccttttttctacctttttattttttgccaatatacataaaattgcttgttaaaaaaagatcaaagacagcatttttatatttttttcttaaaaaacaatatgaagggctgggcacggtggctcatgcctgtaatcccagcactttgggaggccaaggtgggcggatcatgagctcaggggttcaagaccagcctggccaacgtagtgaaaccccgtctctactaaaaacaaaaaaattagctgggcatggtggcgcacacctgtagtcccagctactcgggaggctgaggcaggagaattgcttgaacctgggaggcagaggttgcagtgagctgagatcgctccactgcactccggtttgggcaacagagcgagactttgtctcaaaaaaaaaaaaaaagaagttaaaccatgaaaccacccataatatattagtcttcagaaagaaaagaaaaccaaggtaagatgcaaataacagaagtacaacttttatttttctaattgtggagtgactccaagaggattctgctcccaccaggtgggcgataggcgtcctgttggtggcgtgtaaaggaatggaaagctaccacgacctggggggtccaagaggggctgctgcaggtagcctacccccccagccttccccatgaccacagccacccactccctcaaagtgggacttcaggccaagcaggggaagatctcaggcgaggagaaacagtccatccgagagctccctgggagaatcttgtagactacacgctaatgagataggcctgtcgccaaaggtcacctccgcactgtcttggccacaaatgaggcctgaaatcctgctattagagttgcacacacacaggagcctcctctgggagttctgttaaccactggtctgggagaagagacggcacagatggcctccccagtctttccagggcagagcggtgggggcgggaaggaaaggaagtgccgagtagttcaggagagggggtgggcatggggttggggggcagcctggggacactatggccccatcctagcctggtgggagctagaggaacagggaaagtaagtctaaagtaagctagactcaggaaagggaaagaaaactctgcgtgtctttttttctttccttcttttcctgacacacatagtcttgtgctctctctgggctggttccactagtgcagcgatgctatgggggaggggcccagggccctgataacaggtgggcgtgtgtcaaatagcaactcaaccaatgaatgaatgaatctgcctctcctacctctccggacagttttgaagtttaggtgaaaccatgtgtacaaaagctcctgtgaactgggagacactttgcaatcccaaagtggttaataataaaaatagtaatacttttaaaaaatcataacaaataataataatgctattggaaccatcaatctaatacactttttttctgtgagagacttattggattctttccttggcatgaaagccctgcttctcccaacacaggcaggctccctctggcacagggtgattgcatcatagacctgacccaacgtgacagagaagcggttctttctgagttaccaatggccatccatctttcagcaggcgtgccttcccattttccttgctctgcccatgagaattttcagcagaaccttggattaggtgtgccagacatgttctactcttgattgtgaagattatacacactctcaccttctgagataaatgttattaaattggataaacaaccttgtgtagttttgcttttctgttttatctcaagatcctgctgacatggctaacagggcaactgtgaaaagatttttattcgtgtctacatcagtgtgaaaggcttcatcctggtgtgtactaatcactcagacagtggtatgaataaatgaaggaatgcattgacaaactaatacacaaggtgattccggaaaggcgcacctcctgggataaatacggtgacagtggtgagtctgctctaggtctacgaagttcttgctcttagtagagatccagacacccaatgttgaagacagttcctctttgctttagaaagctttgtgtgcaagagatggcaaactacttcttaaaaaacagagagtcccgtaaacatatgccaaggtccacggtgctccaggcagggtgcttggtgccagagagacagagtgaactgagctggccatggcatctgtcctggagaagtcacactccaatcaggaaggcaggaatgtgggccagacctacagcctctggggaagggtgtccataagctgtgaggtggtggctactgactccaatggcagagaaggtgtggtaaaaaggcaaggacatctgcaatccttctctaactcttgacttattgttatctgcagcaggttaaccacccctctgttaacttccttctctctaatgaggatattaagagtagttgcctcagaaggttgagcaaatttggtaatttacacaatgtgtagttgtcccttggtatccatggggaattgattctaggatctcctatggatatcaaactccaaggatgctcaagtctctgatacaaactggcataatatttgcctgtaacctacacagatcctcttgtgtactttaaataatctctagattacttataatatctaatgcaacataaatactatgtaaacacttgttatgatatttttattggcattatttttattgttttattatttttaaatatttcaatccatagtgggttgaatccagtaatgtggaacccacagatatagaggccaagatacctcaatgattggcagttccagcattgcccatctccctgtaccaatctgtgccaacctcggaactgtggttgagtcccaagctagggggtcggttcacaccatccatcccaccactgcagcagatgctcacccagcgtcaactctgaaccaaacaccattctgggcaggggcgaaggtgagaagcacagaccttggccctgctctcccctcctcaggagcccagcagagccagtccccacaggtgggactccactacccaagggaagcctgaggcatgaggcctgtgtgttgctcagtgaccgggtccatcctcccagtgccagagaaaaggaggtgcccctcaaaccacaaagtaacccttggacttctctttagctggggtggtggctgctggagagggccctgcttgctcatctctgccagcttcccagtccctgcaaccagcagtggccagcctctggccacccccatgaaagcacataaaagggttggggaagccgcaaccccagaattgaggtgagctagagtttgaggacataggttgcttttcacttatctccagcaagaaccatgttatagatcattggtacagtgacgattttatgcttctaattgaatactgatgaaaaatggcaatggtttctcagttacttcttggaaataaattgtgggtaaataacatctgcttaaagcttggaaacccagtttcctttggtttgtgtttttaaatgctttgacgatgcggtttgcttttttactccaagaaaaaaaaaacaattaaatagaggctgacaactaggtgagatccacagccaagctattctaagagcccgaagtcaccctggacacccagcttgatgacaaagggcagaaattcaatatggaaataggatccactccaaatgcaccatctccgacattatgatgaagagaatatgtatttcatgacagggcaaatgttgccatccttctgagggaagatgtaaatgaggatgcttttagggatgatttctacattgtcactaaactgagacatttgtgcttgctcgtgccaagtgaagattgctgttgctgttgttctctcgcagtgattagggttcattccctagcaacaggcagcagcagaaaggaagctttgcaggcagagtcaccgaataaacgcagtgggaacagtatcaacaacaaacccagtgatgaagggaggggcatgtggggcacaccacattgcctctctggcttctcgtctgcacctggggccagaggcaggtgggaaggagaccttgacaatgtgggaagtccctttgatttgctgaaatggaggagttcacattttactgtgcagtctaacattgcccattctggattagctccatcagacacgcttttgtgctttactgtaactctttctttatttgtcctcctcgaaactgatccataatgccaatttgctgatcagctgtccctgggacttcggtgtactgggctagaacctcagtctagtgttcaaaggagctggcagaatgggttgtctcggcatggaggacccaaaagcagagctccctggtgctttgggggagagtgaagcccttcattccactcctcattgcagaccagctttcctggtattcatgcactgctttttgtaacgcctcaaatgaaggccacagctcagccaagtagaagagagctcctaataaatgaagtctggttgcctttgaatttataaaataatcaaagttgctatttcctgctaaggagacagatacagaacaggtgataggccacagtcattactgtcccctgcttgttccctgagcccctggccttctaccttttctaactgctgtcagaaccctggttggggacttccttttgcctggttctcctgggcttgaatggcaacctatattgacagatttcatgccacagttctttttcaaacaagatgattcacaatggaataattgggtttgggaagaaggcctttttaaagcaaactatggaaaataattgatgagtagcgcagttttataaaacttttttttctattaccctttaaaaactatgttgctaactgcacatcacactgcattcatatcctgggactaataccccttgacctctgccatatgaattaaggtgaaagaagggtcataagtaacaaagtttcaaagttgaatgaaccttttttttcctgtaattttactgaccatttccctttctgtttgagagatctgtgcggtcctgttgctgaggttctgtggttcaggggtgttatcggcgacagagtgctgatttcacttgggtctgttctggtttgtcttaatttctcttttagagcttaattttcatttccaacgaattaggcaagacagaaagtgacatttggaaaagagtgaatggatgactaaacattcaccagacgtcattcttgtaacagttaaatggtagtgattcatgtctccatctcttgataaaatataaagcattaaatcttgatggctaaacacactgacaaaactaccgaaccatgttcctggttgaggatacctgaaggtcgacatttatctgggatcttttgctgctgctttggtatgacttctatcaagatagctttcgacgaggtagaacgtttgctttcactctgggttttccttggtttcgacaatttttaagtgttaactgaaggaaatcccgtcttgtcagaatgttcttttcaatacaaatcgcagtgaaataacgggctagaaagatgtggatccttcttgattttaggaagcacacacctatcggcaactctctctgcctggcctgtgttcacggcggtatttttgcctctgtcaccatccttgggactaggtacaaaaataggcttatgttccacgtgtcacccaccacttcacttcctttttaatagatcatgggtaaggaggtgagaggacatgagaaggattggtatgaagtaaataacagttaaatcttttcagccaggggtggtggctcaagcctgtaatcccagcactttgggaggccgaggcgggcggatcacctgaggtcaggagtgcgagaccaccctagccaacgtggtgagaccccgtctctactaaaaaatacaaaaattagccgggcgtggtggtggatgcctgtaatcccagctactcaggaggctgagacaggagaattgcttgaacctgggaggcagaggttgcggtgagccgagatcgcgctattgcactccagcctgggcgacagagtgagactccgtctcaaaaaaaaaaaaaaaaagagttaaatcttttcagatttctaggctggaaatcaacagaacaagatctgctagcagaagttgttacatctcaactaagtatagactggagatgaatctgacaacctgtgacatctttaaatgtcaaacccaccgcacatcacagatgacatcgtacctaatgatcaaactccctttaaaatatacttcatgtaaatacatttttgcgaaaccacaagctgtttctctcagttttgttttcagctggctttgataaggagattggttggcagcctacagctaattaagcagctttcaagccaacatcaatgaaaggttttaggtgactatcagaaatccattccactctccatggtccaccggtgtcgactatgcctttcaattgtgccgacagaccctgtcagaagagaatggtttcgcactaatccaagtttacaaccaaaatcatcctgttttcagtggtgtagatccagtgtctgtatctgtcttgtcaactcacaatagcattagcacagggggctggatttatgctctaagaaatgcaatttacctttctaagctcacttatatatatttgtatctaacatattgtaaatttcttaaacttgttacacatttaattttataactagaaatcaatttttatttatttatttatttatttagtggaaaacagaaaatgaagtgcaagagaccctcatttccggggcaagaattctgagttccttggcttctttcattcttgtctgactttcccccctccagttgcagttatttctagattttggtaaattattcattgcttttaaaagagaaaaagctcgattttctaaatctacagttgagctagccctaacctctaaagccagattgctttaacaaaattgtcatcattttatacatgacagattggcttcaaataaaatggtaaatgggaggaaaagtatattttgcttacacttaggaatgcctgtaaacgtaacagagtttaaaaaaaaatcttggtgttttaacaaatgcatattgtgaaaaagaggaagaaaaaattagctggttgcctgtgaagtaattgtgctaaaaacattcatttttaatatataagagttcacattttaattcatatacttgcaaaagaaaagtgggattttttttcttaaggctttgactatttaaggaaagcttttgtgctgtgccagtctgcttttaagaaattccagagttacagatacaattgagggtgaacttgaatttgttccgtgggcacggccttttctgttgtggtaaaacaaagttaaaatgacaacggttctgaagaaagtgcttcaagaccatgtcctgtttcactctttccagatgactaaaatcaccctcatttcccaagtcttacatcgggggaagaggatatgtggtttaaaagagtggcaagtactagttaaggtcaggctttttctgaatgtgaacattcagttatgctgcatgaagataggggcaggtattgcagagtaaaattctcatacagaaaatgtctgaaagtaacaaattaggtgattaccacggtctccttatccactgtcatctttaatcgtcgtgtttttttttcaaggctgttttgtctgtttttaaatgctgttgtcttatataaatcaggctacttgctttaaagtaccagaagaatcctataatactgaaaaaattgaaatataaaaaagtgaagtaagaattctgagtcacatgttttagatacggtgttaaacaacataacacattatcttgaatggaagatgttattaccttggtgctctcatcagttcagcttgcccagaagcaatgccaacctttcactgagaatcttttaaactgaccacaaatgtccctattcttctcaatgatttaaaatgtcctgtgctaacttttctatcagtcaatatgtatttttcagtgttcttactgagttttgttatttgcttttagttcttttcactgtttatttgctggtttatgttttatgaagaaatccactttcagaagaaatgatgacttattttctgtgggtgtttcctttcttcactactttaagaattttcaagtataaataaattgtgagaatacatatgtgtgcaaggagtgtggggaagagttaactaatttttaaattgaaatgagggaaatactgggctgactctactggtgtttttcagagtgttcctcaatttaacaaagcaaagcactgagtagtatttctttctaatatagatgtttaaaaacatcttccaaagtaagtagcaagaactaatgctcaaagtgttgtctgaaaaatctagaaatatctgcatgctgttatgaacaattctgtttctttatggagagttgtttgggctttttagaaactcattaatttgattgtaagcacctcactgttatcaggaaaagaagctttagaaaatggtttcagaatgtgtcattttctccttgttttaatctgagacagtgtgtgggcatgctggtattttaaaaggctaaaaatgttgtacatattgctgtgtcttcaaatatgagggaagattacaaacagaagttttcttcaagcctctgtctgaaattctgcttttcttctcagtagtgattcttaaatttttacggagagatctttcattcttttttttttcattttcaatctgttgttgaaattcagcaaaacaaatattttaaaagccaagtcagctttctaccgttttgatctgaatatttaatgctttataaaataaaaccctgtgttttaattttaactagtttcattctttttttatgaaatgatttgcggtattagactgtcatttggtttcaatattaatatataacatgaactacgtgggtgtcacttattttcagtagtaaataactgcttaaccgattactttactttaacatagttctactgttctccttgagcctcgtgatctgcatcttcaaacaatatttggtgtgtgtttttgcaaaatagcatttacatactgtgtcattaaaaactagtttcatggtgtcatggtggtcggaatcagggaatgtcgtgtagttggtttcaaaatccatcagtaggttaatcattaattattctttttccaggaaaaaactgatgaggttgtttcagaatttgaatttactagaattccttttttttttttgcattaaaaaaaaacttttgcattttaagcttaaagggggttaatttggtaagaaaaggtaccttttctgtttgtattgtggcttgttcattttctcataaactgtatttggtagctaaaatgttgaaagcagtttgggaacaaaatgtctgctcaaaccatgacaaaattggccacaatttgccgattgggctgataacaaaagccagcaacacaaaataggtagaaaaacagtttgttcggtgatgtgagaccactgaagctcttttttgcatgttttttttttttttttttcattctgatgcttatgttgtgatggaaatacatgaagtctctgcttacccattgtttctgattaactatttcatctttggatttcttttaaaacttcagaaaacaagctgccccctgggcatctgagacaaatttgaaataagagccagctctgcacctaaacattgtgttttctctagaccccacttggttgtaaatgtcccaaaactcttgttttgatcgtttaaagcagcatttaaattccatttcccccaccaccccaatgttcaacattgaattgtatggcttttactacacttttgcaagtgtaaaacaaaaattctagtttgcagtttaaaagaaaagttctccacctgggtatatagttgacaaaaatgtcaacagctaaaagtacatattgactctcatattatcttcgcagactgtaagcaactattaatgttttacatgagacaatacatttttttcaaatgatagaacgagataacagcctcctctcccttgcctctgctgttgtaacttctcataccttgtgttgcctctgtgtgtgtgatggtcttatttttttggtcttaaaaatcagatcctccaggacaataattaggatgaggtttatgtttctacttatctaatctttgttttcacaaataaatacaaataactcaaactgaaacttgatggctttggtgataatataatagcagccacggggaaattttcttcattttaatgttctttcacaacccacattcagtttcggtaggaaaattattaaccttttcaaaagcatgctgaaatatgggttcacaatagactcctgagtatgatttgcaggttttggttctattttgagattttggtgtacagtttttctctttttttctctctttctttcgttcgttcattctctcataccaattgctttctttgacaccaatcgcaatgacttaaaatccttcagttgatatctttttaatgtgtgcacgttatacagtgtttgcatttatttttttattatgagaagggagaattcctatttccttctctcctactgattggttctatgaaagaggacatactctttattctcactgtttttctccactctaatcctcatgtggaggttgtgagtcctccagccccatttaaaaaaatccagttgagccacatttccccgagggcacctggctccatgtcaggcatcagatctgactcctgtctgcctccagtggcctcgtgtctgtgtccatcacaccaaagcaagtccgcccgtttgggcttgctgtcctgaaggtctgcacggcctcaggcttccaaggaaggcctgggtggcggtgtctccatagctgactgctgctggggctgcaggtctggaagggctattggagggaggtgatcatgattttgtaactctggcttcttcacctgaaacacacacgagggcaggacctggggccagagaggcaggtgagtaggaggatctcggataacagtttctgttttaggcatccccttctccaagtctggctgggacagccacacctgcagagagggccctgattggggtcgtggtcctgccccacatctggcaagcctgtgcctcatgtactcacagtcaccttttttatttgatccccatccatcctaagtccccaccccaccgcagtgccctaccctacctgttcccaccgtccctgcaaagttgaatatggaaactgagaaacacatattttatctgtaacaaatgtggacatttccagtattttagcctgggtttttttcttcttcttcttctgcttctcatacttcctgtatgaggttagtttttttaaaatgataaacaaactattttttttttcaacttttttgggaggcctggttgtctagtgcctcctacctgtgttgttgtgagccttttgctggtgctctctacctgggcacagaggtcggtgtgagcagagcctgaaagtgggagtgggggatgtggtgttttgcatagggttgcagtgaggagggttgagctggtgaaaacacttctgttctcctatttgagagagatgcagcagaattcatggctgtcgtgttctgtgcaggcaaaatgagctgaaggatggaaggcaagggggataggagcaggggtggagcatggctagaagagacatttgatgtttagggagagaacactggtgcagattgaatatcccacagtgctcagtcccacgctgtgcagatgagcaacatctggaaaagaagattaagggatgaagcatgccaacatttctccccaggtcaccccaaaaatgagttgaaaattctggatggcttctgagctgcttgctctttccgcccccagtcgggatctcaggagagagcgtccggcaagtagcttgggtacagttgactaagtgtgaacatcagtagccagccgcatagccaacctgcagtcacccatggccctgcatacaagagtgtcactaggagcagatatcacttgccactggtggttgtgtgtatctgaatcacctgggcactgtgaaacacacattcctaggccccagccccagggtttccttcttagaatatgtgaggtgaggccggagaatttgcatttctaacaactctcaggtaatgagatgctgccagtgctgagactcccattgagaactgcagcctagagccagggtgctggaaatgcctaaaaaccgtgtctactggagtctgcaagttgtctccacttttttcctaatgtccctttgtgtgtcctaccacagacttaaaatccacaccagcctctcagaaggccttttgcatttctcagtaactgcacagcaaggttacctgtcatcttggccttttaccatgtccatcagactataaaatggctaaaatgtttttgaggtttggttctctgaaaaatgggttgtattttacagatagtgaaagggtcaagctgtagtgtatggtatcactagactaggaaacaatctaccaagggccaacccttgggttgctgccccttgacaatttccgcctttattataaactaagggagctgtcataggttcttccctatatagagcactcttgacgtaagtgacaccatcttagaaaaagactccatcttacatgtcaaaaggcatcatgccaacagggaacagatggccacctaatcaataaagaccacacccaaccagacagggacatcaccagccctcttctactatcagtccttgccagaggtctcagggctataagaagagcaggatttcaccggcttgagatggtcgtcttaacagagccttgctctgttgttgctcgtgatcagcacctggcatctgctgccaaagactctgcccacatcagagactcttgatgtctgtccggaacaggccaggacactctcatccacgttgctctcattggattggctcattaaccctttcttctatccccttctcactctttttttttcaaagccacacttatgctctgttatcccctttctctcgatgttaaatgttactgttccatgtggaatgtttaatatagcatttatatattgattaagttaaggacactgctgtgtatggtttgcaatattgactgacttgcagagtggcttgagcctgagtgctcacagctctgactaccagttgaacaggacgtactaaggagaatcacttccttgggaactccatgtaacttgtggcttttgtgattgaaatagcatcagtaaaagtctgaccctgtggaaagacacaaatgtgcgtggacctggctatgtctgactttgtgctgctcaggacactctctgtaaccaaaagtgagagagcctggaagacctcagggggtcagatgtttgaaggagctgctgagtatcctggcaggcagcagagcctcaccatcagtttgctgcatggaaggctgtgtgcctctatttccctgctatttgttgaactcccttgagctccggtccttcctaagtgagagagatgataccaatagcaccaacctgagagggctggggagatgtttgaaggaaagcttggctggggagctgtagctggcctgtggtacatgcttggtaactggtggccaggagacccgggtgtgtgtcctgggactgtcacactctgctgacgagggtattgaaagtccccactcaaagacacagaatcttcctgaccaagtgtaggtctgtaatgacgtgtggagcactttgcagaaactgcttctcagcgggggtccccttgaaaaggtgctaagtctgctcagagatacgtggctgaagctctagacgcgggagcctctgtcagagacaagggcagggggactcaagtgctgctgcctggctcccctgccctgacagctctagcagcacacgagtctgatttatacaaagaacccatctcatatctccctaaaattagtctgtgataagcaatatacatttcctgagtgtgcggtctaggttttaatattctgaaaaataaaaacagtggtctcttgagagctgaacagtttggtagttactgagcaggctccatcctccttggcaattcttttgaaatctcaaaaagttggcttcctatactgttagaatctgatgtgagtcaagaatggacaggctgtgagttcctcactcgtcccttttctatgcattgaggaagacctcggtgctgccaatggggcagaggaagctcaagtgtgtttttgcatgaggctggctggaagctctggcttgggctctcagcagtgaggtactggcagttccttggatgtcacagcaaatcgaagctcgtggtcttcacttcctcctaccttgagacttactgcgcagaaagtagaggcttggatggttcaacttcaggggcaaaacagcctgccttgggggtgggactgggggtatgcatctgtgccactgcttctctccctttgtcagtttaccatgccagcagccttctgtctgttatcgggaacagaaagagcacgatttgggagctagctggggagcttcccgaaggttgcctgagctgcatttggggcccctgatgagggcttctattcagggtgatgtgtgtgaccctgaggccatctctcagatctggggggaagtgaggttgtgtacccacagtggggagacctacctggcggctcatcaatattagacacctgcaggaacagcaggtcagccaagccaaagagtaagagtggccctgtctgtgactagacgcttcttcagggttgcctcaacaccggagtggcgctggtggtctccacccactcccagtgtacgctggcgtctaggaagccatgtgtgtgatcggccctgaattaggggcaaaacttttagttctcagatgaactgtcgtgggtttattcagtgataactagacagccaggccaacatggagttgattcatccatgcaaaacctcccagacaaggcctttcagtggagaactggaattcagggtcttctcagctttggccagaagccaaaggtaggagaggtaggagagacccaggtcctggtcccagctgtgtcccatccagagtgaccttgggaaggttgccaacttcctttttcggtgagccttgctttcttcacctgcaaggtgaagggttggttggatgatccgtaagggccggccacctctcactctgtgactttggcccaaggtccacatggttgggtgttccatactgtagccctcctgggctattacattttggtttttcattgcactcaaaagtgggggtaactggtgaggggcacgggttggtaaaccacctctctatttcagtgatgaaactaaagaaaccaggtttccccttccacccctacaggccactgatgcattacttagttcctgtttctctttgcccacccaggaagacactgcgtatgaaatcctgggcccagatgctggactttaagccacattagaaaatgctagctcataggactcaaaacgggaagctggctttcccaacagattcatctgggcagtgttcttcccagaatgtgtaggaatcatggggccaggttcgccaaggctcaggaagctcgatttttcactgtcactagccaatgaggcctttaaggaaaaaacagataagactgtaggagtttatatggatccgttaactcacttgtacaagacattgggaaagatactgggggtgggggggaaacaatacagagtttcaaaagataaatagagactgtcataatcaccacatgtcctggcagccagggctacggggtcaggagaagctttattccctggcctgcagcactgcaagagaccctaggaggaggagagctccgccaggccctgcaggctgggcagcctgcctttggccacatttcctaacaccactcagcagagccctgccagcaaaggtcattgtgcaaaaaatgttatgccccatatatgtttgggaagtgcacaataatttaaacagctttcttatttcttaacttctctgggtattttgtgtgctactgtatcttgtgaatgaatctcaagaggaaggatgaagcttttccaaaatcacatgccttcatctcattttacagaaaaatttgtgcctaatattaaccaaaggaaatggggagcggcagggccagtgggttttcatggtgaactgagggttgcatcttggacaggttgcatgtggaagggacagcagggttcccaaggaagctttgcacggtcatgggtagagccatcccttcttcatccatagtgaatatggctggaaatagcgggtagtcttggatttgacctccctcccatggaagtgctgtctccagctcgctcctggaaaaactgctttctccccaaagtgtgtctgagcagcagatttaagcatgaagttggttttgtggggctacagtatggactttgggaagatggtgccatctgtatttctgattctaccgtccctctgtctgtctttggaagtatcctttcacttgtttgggagactgagaatgattttctgcaaacagtgagccagaccatgctggtctcaagcggcagagcagttattaacagaatcacagtctttctggagctgctgtcagtcctgtgctgtcctcagggcctttgcttggtcaggggccccacttcttatccacccttccctctacctcaccgaggctgctaggcccaggtgtattgtgattatttgatgtacctgggaggccatgtctcccggggaggctcaggacctcattgggctggaattccacagggatctctcattgggtctctttgggcctttggagaggggagtgcagggcaccacctgggcgaacacctgtgccatcctgtaagtccttgtgtgactcttcatccaagtcaacaggggcatgtaggggaagagcctcagggcccatcaggagtcagaccctgaccaggaagtcagaactgaatcaacttttcaataaacacacaggctggccccaaacaaagcagcaggcttttgggaacatctgccttttcagtctcttctgaattctgtttatgtggacaccccatgtcccgcaccaccattgccgccagcaatgtttgttgcttgccaatatttgaatagatgctgataaatttgattctctggcttattgtggcattcatgatatgtctttcccttttcagtttccatgtactagagcgactgtcagtgtggttggcagtgacctgtgtttttcatgcatgtttttgtttcagaataactgggagatgaaacaggaagctctatgacacacttgatcgaatatgacagacaccgaaaatcacgactcagccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaacagaattgtttgcttattagctatctttaaacgctgtttgaaaggatatcgaatagtgtttgagggaaccctggcacgtccacacagctcatctgacatgtttaaatgtgtgttgggcttgactctctcataactcagccacgcttgccttgctgcttctcatacctctccagattgctgtagagtcagtgtgggcagactgacatttgagagaaacgtcgggcttcatctggaagcctctttccacacccaccctgatcgtggcctgtaaactgtggccccaagatctccattaaccttgggctttccactagagacatctgccatctctgctgcctccctcccctcacacatcctttactgcttcacttattcatcccataaggatttcttaggggcctgctgtgtgctggttctggagacaaaacagtggatgggaccaactcagccccggtccccacccagcacctctagccaagtctgagtgggctctgctgaagaagtgttgggtgcagtgcacagttcatcatggtcgatggctccatcccatttcacttagatgccccgatttcctaaatgctttcttgaactctgacactctgggactggcacctgaacagtctataaaacggtgaaatgtcgaagcattcctgctgtgtaatcccactctcttccccaacctcaagcaggacaatttgaccccctcctgaggacatggccagacaggccattagtagaagccttccagaactttctggcaatcttcacttttaagcttagcaaacatctaagaataattttaaatggccatgtttactcttttgtacttgttggaattagtttaccaataggccatgatggtgatcacaaaaccccctatgtacatgcacagtgttcattgcaatgcatatccaggtctcaacccaatgtccctttctcaaggagaattccctgagcaccatgtcgtgagagaaccctccttcctccccaccatttctctctatcttgtgattttattttattttattcatagacttatcattatcagcacttatcctgaatgttcaattatcatctgtctgtctctcactccactcccaaaaggcagactgtggtctgtcttatttcccggtctgtccccagcgtttgagatccgagcctcatcaacaactatgtgctgactgggttcatcctcttattacttctcaggcacaccgagatgctgagcagcccagtgctctgaccatgtttggtggataaggaaactgatctgagtctggtgaatggcctcactagggtgaggacccaggctttcctctgggacatcacccagcagaaaagggtgattgtgaactctctactgtctggacagtcaggttctcatcagaaaccaagctttgccctgctgatgaacttcctaaagtttatgtaatttgcccccatcctggaagataaagaccactgtgttgtggagggaaatagcctcagctgggcgtctctggatgctactttctccagcagaacactaagaagatcagatgagatgaacacaaagattccaccctgccctgagtttctgctggttctacctggctaggttctagcagaagagaaggaagtatacaagggtaacatgtgcaagggccgtgtacaagggtaacatgggcatcagggacagtcctcctgaggatgtgaggagccaggcccaactgtgggctggcaacctgccccaggggttgctcacactcacctaactccggcccctctggacacaccccttgcccaggtgcaaggggctccactgggaagaacatctccacccaagtgatcactcttcctctgcgtttttgagcaggatgaaaccacattctctacccatttcgcagtcttacccccaggattatttatgacctcaaaaagatggaagtcacaggtgcagggaggaccagacgtaacccatatgatgcctgcaggatagttagttcacaaggatattaggagaaagagcaaaagagaagtgaccacacaattctagatggttaaggcaatagttctgaccctggccagacattagaattacccagaggttataaaaaatccagacacccaggatccacttggaccaatcacatcagaatctggggattgagggggtgtagacatcagtattttttacaactctgcaggtaatttcaatgcatagccaagactgagaaacattggtctctcaacgtaccatccaatgtggtagctgttagccacagatatctatggaacctttaaaatgtggcttgtacaaccaagggactgaatttttaaattcctttttattttaaatttaaatatccacatgtgacttgtggctgccatattggactgtgcaggtacagaacatgtctacggtcacaggaagttctactggctagtgtggtccaggggaacctggagtcctataactgccgagtgaaatcctgctgatcctgaagggactttaaggtaattctgtctgttaacttcactaacaagccctcctgtcttgggtttgctgtatatttttcatctatgtttcaagccagggcttgtgcagcagcaagggtgacaaactttcaaagcactgcactgtaggattgaaaagcattgaaaatacagttatgcactcactaatgtctcagtcaacaatggactgcatatacaatagtggtcccataagattataatggagctgaaaaattcctatcacctagtgatgttgcaactgtcataatgttgtagcacaatgcattatcttttctgtgtgaagacatgtttagatgcacatattcttaccgttgtgttacaattgcctacagtatttagtgcactgaaatgccgtacaagtgtgtagcctagaagcaataggccataccatatagcctaggcaggtagtaggctatgccatctaggattgtgtaagtataccctgtgatattcgcatcacaaagaaattgcctaacgatgcatttctcagactgtatccctctcattagcaatgcatgattgtatctgtaaaaatctaaggcccagacctcagtcttttggtgttcattctgctggtttactcagtttgcatcgttgaagacccagtcctagaaaggagctttctaaattattgtttaattagtgtaatccaagaatttatgagacttttggaaaagcagagcgctagaagtgccacctttcggaggtcacggatttagtcaggtgacccagcaaactccactcgttggggttagagatggagaattagaaccaaagctgaatcactttctgcttatcactcatagactgccagattttcttttttttgttggagggaaagcaccttacaacaaataataatactattttgaatttcagagctttccctttttcaaagcactttaccacctatgacttattttgtcctcctaacaaggccataagataaggaagggagggctttttagagcctgtctaacaccctaagacagagcttaatattgctgaaggcattgaaaagtataggttttgttctctcatccctggccacactcaagtacttagtggcacaacttgaagcaaattgacatagatgtttaatcctacagtggactgtgtttttaatagacactagagcttcacatttgttccctttggttccatcccaggtttctaaccttgtgcctaaatttttgggggccctttcttcctcagagctttgtgtgatctgcaaatttggtaaatatgccttcatttaccatgtctctttccaaggtgggtttcaccatgttggccaggatggtcttgatctcttgacctcgtgatccacccgcctcagcctcccaaagtgctaggattataggcgtgagccaccgcacccaacctccaaggtgttttttaaatggtgaatgggacagaacgcaggacagagtcccatggctctccatgaagaaagtcctgtgtcacttcaaaggatgtcccctgtgcagaaccaaccacgctaggctgacatcctcacttttgggtccccaaccttctcatgggtagagctgcagagagtcatttcaaaccacacttgcctgtgggcagaaagcacggaattgtctgtccaactagggactcaggagcagcctggctgtctgcagcagctgcaaagggagcaaaggcaagcaggacttccatgagctaggaggtggccttctttggagatgagtgtcctgccaattgcaagtcctcctggtcacaccatcatctggcccatcttttgtatcttagatcggatagggtgagaggttttcaaaggctttactgaaatcaagacacactttctggggcattcccctaatcgactgttctggtgaagctcgtcaaaacaggaaatgaggttagcatggagtgactttctcttagagaacttatgttgcttccttgagaccaccaatttcttcccaaaagcttgtgagccttatttcgtgtctcttttgggttttcttggaacttggaggaagtctgttcttctgtagtttttagaatccattcctctggaaaatggtggtggtgtttgcttattcccagctttccagactctctccctttttctccagtatctctaagatgtttgcaagtttgtctgaagtgagatctgcacatacttgaactacagcaagaatgggattgacccacatgctctgtgcccacgaccaggctgacagggccgcatgtgggctctctggcatgggctttaggcagctccttcccctgagaagctgttggatccacatgttctcacggtatcaaaaatggcaggaagagaaaactaacctggtggagatgaaacttagtgggaacactccgctttcctcccctgctccgtgtgtgagcacttggctcagaaatgcactgtggctgagacagccctatctggcttcacctaagcctacccccgtgttgagttctttaacttagttatcaaagcggcaagggtttcagatctagacaagctgcatcatgcttatttttgctgaggttttctgacaaatggctctacttgaaatttccagatttaaatgtctgttttattaaaactaaagtacttttgagtcatatttgcttttatgtagtagaagcaagtagaagagagtccatgggaaggaatagctggctttgcctcacaggtgtttagggaggactgctgtctccaatgcaagacctggattaccgtttagagatccacctacccctcatgatgctcttgttgctggaatcatggtctgtttcatgctttacgtgacttagcaggaccttgaaagctgtcctgagtgcccatgctggaatggggtagatttcagttccctctccctcactcccgcatgaacctcagcctcactctactcaggtctagggtacttagtgtgttcagtgatgattgtctacatagatggattaatacatatgcacctttataatcatcccagctaccatctaaggttctagctttctctggagacatttttggtggtttacaatgttattttccagtgcgcatagcaggccccagaggcaaggtgatcacccctttgtttcagttaagaaaactgagttttagtgaggacaatcaatttttcccatatcacaaaactggtcatgtgatgctgcatcccatatttaagtccagagcagtgagcttctccctatccctctattatgctgccattttgtattttgtaggtgtgtaaaatcaaatgtcattcttccttaaaaaggactgtgaatggtaagcaacagttgggaagggtgacaccagacaatggctgaaaacagggcgactggaagttgactgatgggtgctgagcacttggcatcccttcctgctgcagaccccactggaatctcctcagaaggggacactggtggcttccattggccctgcctcccgccagggctgtgtgaggatccacatgggctgggatgagggtggatgttgttctctgaaaactgtccactactcaaaagtgatgttgtggccgggcacggtggctcacaactataatcccagcactttgggaggctgaggccggtggatcacgaggtcaggagttcaagaccagcctggccaacatggtgaaaccctgtctctactaaagatacaaaaaattagccaggcgtggtggtgtgtgcctgtaatcccagctacttgggaggctaaggcaggagaatcacttgaacccaggaggtggaggttgcagtgagccgagattatgccattgcactccagcctgggtgacaggggagactccatctcaaaaaaatttaaataaataaataaataaatagatgttgctgggtcaaaaagggagaggccccaccctggccccctagcaccagaatctgcatttcagcaagatcccagggggctgtcacagttgctagctctgctctttatgcttgcctcagctaggtgctgagtacctgctagaggtgtgaattcggtctttattcttcagaggcactggtcagagggtggaaacatcagacagggactcctgggcccccaggcaggactccatggggatggagcgggggatggaacatttgagaatcaccaacatgcagcaaggacattagtgagaaatgagttccacctgccagaagggaagctgagaagggaatgcacaaatcaggaaaatataccatcaaaaactacgactcttctacctccagccctcgccaccaattcctatcccattattttatatccgagagggttgataggcagcagacacactgattctgtaagcattgtccctagtccctgtaggcgaggtgaccatgtacccaagttcactcaaggtggtcctgtccatgcctattagaaatgagttcataattcctttcagctccgcctttcactctcgagcgtgcccttgcttgacgattcctatctggcttggataccctcacttatattaccttatatctgctattatatttccccaagaagttgctttacaaacactgactcctcaacacacggtcatctctaaaagaaagggtgtttggcagttcctcgacagttctggaaaggctgccttactagaagcagagtcagccatgggggggtgagaacgaaagtgtgcactcaagcatgtgtgtttggggtgtgtgggtatgggtgtgagacatggtcttatgggttctgtgtacctgcatgtgtgacacaggtgtgggtgcagaagaggacacggggtgtctggtgcatgggtgcctgtatgcacgtggggtggttgcgtgcatctgtgagtgcacatctatggtatgtgtgtatgcttgtgcatacatgcctgtgtgtttgcatgtgtggtgtggtatggtgtgcgggaatgcatgggcggatataagtgtgggtgtcttagtggatgtgtgcatggatgtagtatgtgatgtggctggatgtgggtatgacgtgtgcagtatgagagtagggttctgtagcacgtgtgtgtatgcagtatgtatgtttgtggtacatgtgcattgtgtgtggctgggggtgggttgcatatgttgcatatggagtgaggtgtttgtgatgtgtgtgggtgtgtgcggtgggtatatgctggtacctgtgtgcatgtgtgttggtgtgtggagtggctataggtgacatgtgatgccatgtgtgcttcctgagcttgtttgtggttgttcccagacccactgcagactcaagcatggctccacatggcaccaccacaggataagcctctgtgtgtatgcagtatgtatgtttgtggtatgtctgtgccttgggagctggtggggaggagggtctcacccttgtctgtccctgggcatccactatggctgcactgggaagccactgggtgcaatggtgttgctgtgtgggacggggcctcaggcccacaggcagcaagcatagaccagatccacccagcaccctgactgttgaggatgggccctggctgtgtctctctagcccagctagctcctactgcatagtcaggctttgggaggcaggaatctctgaatggatttccttcctcctgccctgcttggataggggcacttgtggatgcttctggctccaacttttgtgtgcagtgactatgatggagaagcaatgagctccctctacagccttctgggctgctggcatccccagtatgtttctccctggagacactctcagtgaggccaattccaggctgctgggggcttttccttctgtcactgtcgggcctccgcagggatctgcctggctgcaagatgctgatgggtggaggggtggcccacctggcctccagaagcaggagctccctgcccactgcccgcatggccctcagccctggccctcacctgttgcccctctggaagaacgttgctcttgttagctaacaaccacctgactttcctcgatctgtctctccctgaggcaagaatgacctaggtctgaagactgaagaccagtgctggggcccctcttggaaggccaaggaagtggagaagtgcccaggtctggtctgcttagcctcctgctagttgttggagctctttgagccttggtttccaaagccataaactgggagaatgacacctaccccagcagcacagagggatctttgcaataatgtgcaaacccactcagcatgatgcgtggcacaaagcacaaacccaataaatggtggctattatcactattattttatttcatagattcaaatattgagaatgaaataaatatatcagaaagtagtagcatcgtgccatcagaaaaatactctgatggggtcctagcgatcttatccatgaaaataaaatatcaaaagaaagacaagacgatctagaaagaagggatgccggcagtcttagaaaaaacaaataaacaaaaacaaacaaacaacaaaaaacaaaactggtggcagagagtgagacaacaggagcaaatatagggccagccagacaggcactgcttcctctccctttgacaggcaggacagcggcccgctcccaaatctgcagggtcagacgtggtagatgaacagtgatttgcctgagtgtaaatattgtgatgtctttcttttcttgaacttttaaccttgctggtaaacagggtgcatccagaattgtttttctgagaactgagttttgaggaaataggggggaaaagggtttttattagctaattttcagtcttgtgcgtgactcaaaaccttcttattctgtttcttaactttgcttcaggagacacttggccaaaaaatagctttgtttttaattgatgaaagaaaaatcattacaatgtgtaagtatgccaattcaaacatggcaaaactttcaaagacaaagcaggggtggggaggtcattctgaagaagatttctgagacaagaaaaacaaccaatccaaatccccatttgtgttttctaatgagaaactcctcacacgccattgccctgctgaccccggtcttaccttgaccacctcgccccatcttcatctgttataacttctgagatattgtaatggaagtatagagtaagcctgagatacactctcagcattcaaggtgctgccttcctttctccaggcaggaggctgacacagccgcctttatttacaaatgccgtaaattgactgcaggatcctttcgtgagaaaggagaataacggcagggaaccatcccagcaaaatgaagttctgggctccaccgccagcttttccctcgaaggtcatatttcacctctgccctgtaatttcatgaattgttcaatgaagatgtgacttattggcttccaagcttcatggaggtgttgtccaaatacaaggtccataaagtgctttggaaggcttggaggaacaaagaaacactcttgatctgaggttgtgatggagtctcctcaacattgtagccgatgatggcgagtgctggagggttcatcagacctgacagcaaccccagccttcaaaccactctctcccctcactattcatacctgcatttgtgtctgttcagttgaatgctggcagaccgtctttcaaataatgctccagttggaaagtaaactgagtacattgagaataaatatctccagtcttctaagctatacggcagtgttgctgggacctgtaagaaagtttctctctgccatcttagaagaaggaggaagaggagaaggaagcaggaaaatggaacaaattgccgtacctttgtaaaagatgagattgaaataaatcacaaagagtgttaaaacaggcagcttgcgggaagccaattgctaacattctcaggccccatcctttcctcctcctcttcctttcagaataaattaaagaatgggcccaagtccaagttgtgtgtatggtatctttatctgattgacctcgtactcctaataatatcttatcttcgcttgtaaatcattagcacccttttccgttctcccggcatgttacttctttaaatgtgatgaacactcacaggagtccgctctgcagacagacaaagctactgcaaggatcctctgtcattcatttggcgatttggtcccgaaggcctcagctggctttactagcaaagtgtttcacaaattcccatagccctgcaaacagccactcccccaaagcaaacaacctgagacatcaggtaaacactgaagaatggaaatttcattcattttcctgcctgcatcctctctagttgacagagaatgtcagtcaatgcaagatttgttgagagtggtacatttgaggatttatttgtaggctgtgttaatatactttcgagaaattcagttgtatctaattaatgcttttttccctttgattcattccaaactatttaaattggaaaattgtgtgctatttgaagatgcacttcaaaactccttttgttgtcatggtgcctgttgtcactgctttttgttggttggttcttgtttctatagggcccctcctctttgggatcgtgtgggtacagatgagactcacagttccctagccagatgatctatagaagtttttcaaagactgcataggtagtgttactgaacatagttcatatgtggtgtgtgtttctaaccttgcaagctccttgcaaaactacataaatacttgtatttaagttgtgctgtgcatatgaacataccttattatgagaaaggtagattttaaagtattccttccatgggtaaataagtcttccctgatgataaatcattacagttgctttcacctcccaaactcctttagctctcctctcccattcagcccctgtagaaaagggctccctttatttactgccccacttgttgcaagttgggggctatttctttaagtctaacttaatattccttgtatttagttcaaactgaaaaattctcatgtgtaaccgccgggcagggcagagggaagtagtgtctactttaaatctgttgcagcacatgaacttaaatgacaaaacaaacacagaagactgaaaagtcagagaccctcttaaagaaaagcttacaaaattatagtgtccactctaggcaggactttcatatcctttatctaactgtcacatgatggggtgacatgttgatccccccacagcctggatgatagaaatatttgtggtttgatatgcgtcagcgcttatgactttggcataaaatacaatctcctttgtttcttccccaaattcaagaagtgcatctttccataatattgagaatagaacctaacatttattgaaaatctactagcatattttgtctttaaaaaaaaaaaaaagcacttccacatactcagcaatggcccagtgaggcagataatagcttcatcccatctcacaatggtgaaataaagatcagagggagccagtaacttacccaaaatgactcccttaggaggtggcagagcccatactcaaagtcagtttgtttaaccaaactgcttaaaatgtcaacttagtttgcaaaacagccctatgtggttggtggtattatctgcaattcatcaccaacacactaggcccagggcaaagctaaaagcaaagctaaaaacaaagctaacagccagagtgaccagaactgggtctcacctctgctacacctgtgccagggagaggagatgaacactctaaagtgctttcatgcacttgggggccttcctgtccaagtgcagtataaatgttctttgtgccacatcttaaaggaatcctcttacagaaagggcttcccatctgagtggcaagacccaaggctaggctgatgcctcttcctttgctatgtgagacctgaaggcaaagtctgcctggactgacagagatggatgtggcctccatctgtctgtgtgtcatgacagaaaggaggtgggaaaacttggaaaatgggaaccctcactttcctgaaattcccagcaatcagttccaagaattgtaaccttgaagcacaggaaagcaagaccctcagccgggaacatgaaagcttttgtcgggaattctttgaggtcctgatgaggtgacacagtgaccagatgttccagattcaacatcaaggccggtgggggtggcactgcaccggtcacgtcaggaagagcagtgtagtcagagagcgtggcaaccaccattcgcctggtagacagctcattccatctgccttgcatattttccgctgagctcagaatggagaagatcgaatacagtctgctcttatcaccctgaagacttttaaaaaggctctgcatactcacacaaaaatcgggaacttgatcactgtggcctgacaatgtgttttgaaaaggcgggggttgggggcggtcagtctttccctgaaagttcccatccattgttgagtaaacatcataaatctatcgcagagagacaggctgcctgtactcaaattaccgcctgctacaattttagcttcaagttttaatgccctaaacatgaataacgtcgtatcccagcacaggtctgattaatgaggcaactttgccaacttcagggtcggagagtggctccccacctccttccttttttccccctgtggcttagtaaccatttcagcaaatttcctcattaaatatacaaggcgactgagtgcaataaaaactaaaggatgtggcagataaacaccagcgtctctctgagcagacctcgctgcccaacagagcaggccagctcaggtttgctgggaggaatccagaatgttccatcatgaattccagcataaaaatcatgcacgcattgccctttgccatgggtcattttcagtctgtgggttacacttacaggaccgtctgctttccgagctgtcacatggtttatacatggaatgccactcatgccctacttgcacgtaaggtgaccaatggctggctgaaggtcacactcaggagatgacccaaattagcacgtaatgtccaaccttgaaaggaaagagggaagttttatcttgcccagatattgtctgttccccaaataagattgtgtgtcgcttgagtaattcccgaataggagcccgtttgttgagcacttaatgcaccctgggcactgaagaagaaatgcggaggagtccccaggacttgctgagtctcctagagacagcagaggtgctctgctcacaggagctcattttctgcccacaacaaccctgtgccatcagctacattatctccaggtttctcatacaaccaaagctgaggcttatagggtggcacaacttcccctgctctggctccgaattcaatattcctaagccataaagcatttctctttcctccccatcctgttcccattcccagtctctccatgaacacacacacacacacacacacacacacacacccttgtctacacttgagctgtagtctgggcccgttacatcaacaacacaaccacggcagaacgtggattggtccaaattgcagagattttaaatctaaatttcccatgctattgagactttacagaaccagtccttcaggtgagttttgattttctgtttaagccagggttcagcaaacattttttctaaagaccagagagtaaacattttaggctttgctgggctgcatggtctctatcacaatggctcaactctgccattgtagcatgaagcagccaccggtaatacatagaggaatggcagaaggtgtgttttaatacaactttatttttaaaaacaggcagagggccagatttggcctacgggccatagtttgagaccccatagtttgagatctaagtcatcactaaaagtgttatcagtaattgagggttttagacattgcatctgtctaacctatcagaagtaagattgggggccagggccattgcagtgaggctgtggaagttcacagctgcttaagaagcactgtgaccaacatcgctccttaccccagatgggccaggccagcagtcacaacatgtgctccatggggagacagcaataggcatttcgctagaaaagaattctctggactagtaagtttagaaaaccttgggctattattatcgttattattatattattccatgactgcaggacttctcagggctttcataatgctgatgaacatgaatcttcctagatattctggatctctaggaagggaaggtttgtgtgcagagcatgtctgcacgatattctttgggaagactgcgctggctcccgtcctagagattctcatgctgtcttttctttctacctgttttcccaactgttcccacttgagagtactggcctgagttgctgccaaccttacaatatccagctccgtcctcagagccacactgcggtcccactggggactttggtggccctgcctccctgcaaccccaggtactcagtttggagggtgtggagagggcagggttgaaatgcaggctgctgtgtctctttccttcaattttatcaccagctgctgaccatgcttgcttaaaggtctggtatttatggtctcctagaatctcccagaacctcacaaatacccccgggctcctggtttgagggactagatgggaagcccccctccctgggagaacacaggcctagagcttcctggaacttaggcagcttggtcagagagtgtgaggactctgacaggagcacgggtgtgggacattcatgcctggaaggccctcgacacctgagacctcggtgtggaggcgggacttggaggaaaggagtccctgctatagtggaaaaaccagccagggtaggtagttttgtataagactcttaactctgtggagacttctgttcattatctgcaaaatagaaatgtgtatcccagcagcctaggcttagattgtggaggactagctgaggggtgtgtgagaaagttttgcaaacatggctgggcacagaaggctgagctattgtctggaggaaaactctcagggcaattcagacctttctgggcccttctgaggcaagaggcattgaggcaaagtttgagatttgacttcagggacactgttctctaagcatatgcttcagtcacgagcgctgaacccactctcaaaagctaagtagtagcaatgaaatgcttaaaaagttcgacccagactgcaaagacccacagaaaatagagcacagtggctggcttggggagggaccctcggtccagacagcagccaaggagttcttgagccttatttatcacgttgtagtattttacaaggagggctatgcattatttctctaattgaacgttacttttaaaaacagacaaagagaatcaggaaaaatgatgtgaggactttaggcccagatcagtttccgtttcaacaagatgtgtcaggatgatgaaaatgtcgtttggttgagccgtggtcatcaccccgcattgttgttctttcatgtgtttgtgtgtgtgtgtgtgtgtgtgtgtatgtgtttccctctgagtttcccagtagtcattactaaaaaaaaactcctaaactgactcaaaacaacaatgacaaaaacaaaagcaaacaaaaagacccaatcaccacaggcgccattcaggccctcttgtctgacggtgttcacagactgtgcttgtgtttttggatgtacccgcttccttttctctcttactcaccagatatcactgggaatccctccttcttgctccaggaccctaaaggagacactggggtaagactcatgtgggtcttggggcagcccatttccaggagagcatgacccccaccccccaagccccaggaggacggacccttcccagctgaggtctcctctgcatccggaccagggccctgggcctgaagccaggttttagtgaaggccttttgtgggtgcctctcttgcccaggaaacacaaggtctttaagctaagcctgtttgtggggagagcaacccatttcttagagggactcaatccatagggaggacactagtccatcagggggcccttgtattttcatcctggaaagcacagtcccctgtttccttctgggacatgagaagttgcttctaatggttcatccccacaacctcacttccccatccttgatttgcaaatgggtccatagagaggtcccaggcagctacttgacccaggcagcgaaggtgagcgtgggtctcctcactgccatgagccaggcagaagagcaagcaaaacagctaagaaccagacaggccagagttcaggttgcagctctgaacctgactaagctgtgtgacccaaggcaactcacccaacctctctgagcctcagtttccccacttaaagtggaaacaagaccagcccctgcctcatggaattgtcatgaggaagagtgaagtggtgctcgtgcagagctggtgcccagggaaggggctccggtgccaggcctgacagctcgtcagggaagcctgctgccggccatcccagggagacagtgccagatcagagggaagctcagcaagccacttaaaagggaccttgactcattttgtggtaaccgaatgtgcagttcaggaagtgcttcgcaaaagcgaactgggctccagccgccccctcgtccccctgccctctgctcaggattcactgtgcgaggacccacctgacaccacctgatgcataccagcagcgtggatggcaggccccacgtgttctcaagcccaccaaaggctggtgggtgtcggctctcggaaagacagcctgacctcctggactgaaattccactcctctctttagtcgaggtgctcaatctccctgagcctctgtttcctcctctgtaactggcactaccgcatactagggccggtgcaaagcccttggcaactaggtatcatttaatccccacaagcagctctaaaggcaagtacgaaaccttgccatttaaggatggggaagctgagggcaccttgagttatgcaagggcacacgcagggtgagtcttggagctggaatttgaacctggggaatggcactcctgggccttccctcctaactcatagtatctacaacctggattgtagacctagctagtaggtcttgggggttcttccctcctaacccctggtatctagaacctggatcgtaaacctagctagtaggtcttggtggttcctcacatggatggaagagatgccaatttccattaaccatgcacactgctgcttggtgggcaggtgaggaagtggtctgagtgtggaggaagcccaggacaggaccctctttgcctccccgtgggatgtcctggctgccctgggaggatatgtgtggtgttctctacacccacctgaacctctagctccccagagcctctgactgcatgttctgagggcagtggcatcgggaacgcatgggcgcagtgtgcagagactggccgaggagagctgtaggggttacctattaaggaggcaggtcccagcaggtactagggactgaagagggtggagggagacccgaggggggaagaggctgccctcgtcattagcccagatccatcccacccacttcttcccatctccctgtacttgccccatagggattcccaaagagagggaagtagagggggagaggagtacatggacacaggagagcgagtgagcaccccaccccacaacagtgtcctgaggaaggcccctcttttgtcccctgcttcacaagccttgggaacggggaactctgcaggctgagcggcatccctgctgggaaatgagggcctgtcttagttcctcatttaaggcacccaccctcattcccaaggcagttaaaagccccaagttgcccaactcggtcagaggaagcctgtcccatcagtctcacacacccagaacttgattctctggcctccgagactgggcagggaccagctctgtgtccccgagcccacatgtagaggagggagccgcgaagctgatagcccaggaacatctattccccacttgtcattgtcaaactctgatgtcttctgggactaaatttgaaggacagtttttactgttgtaaccaaaaaagcaaaaggaagcaaacaattaacaggcccccttcttttcgggacttttttctttgtcagtagaaagccatctcagtaaacaagagctgttacgaaatgtacctcaccccacactatgcctgtaaagcatctcccttccccccgctgcacaacccattgtacaagaaatattgtgatagatacctttgggttgaggctggaacaaaatgagccatcaggaagcattccattttcagctggacttgtttctgcatcttttggaggatttctgcaaacccacagcccagtatggcatttcccatactctgtgataagaacctccaggataacgttggtggctcagggatcatctgagccttgagcagcttccattctgatctggatgtctctgatgtgtgcttgttcaagcaatcgatgagccagtcatgggccccagactcatgggaactgggggagtgcccaagtcaaccctgcttgcttttacagctttcctataaaagcttctccactctttgcctgggcaagcccatgcccagatctccagcacacactccagctgccagagggggtgggggggctccctcctgcgtctggaacctattcagccagcctgagattcagaagggcctacctgctggagctgagggtgggtgaacccacccacttggggctagcgaaagattgcatcttgtcccaaggctctgctggacctcggaggattcccaccattgtctttttgggatttgagggaggtgtttcagactgggagactgggagaatgtttcccagcaaaaggcagaggttggggttcctgggatgtggctccccacagaccaggaggctgacacagttcctctctctgtcttcctgcttttctcatgcaaacagcacccctttcccatggctgctctaacatccttggtagcttaacacaaaacacaaatgtattctctcacagttcccaaaggccagaagcctgaaatctgtttcaatgggctaaagtcaaggtttcggcagggctttggggagatcagcttccttgtctgttccggcttttagacatggccaacgttccttggcttgtggacccctcctccacttaaagtccatcactccagtgtctgccccatcgtcacatggctatcccttctttaaccttcttgcctccttcatataaggaccccagtggttacgttaagggcccactcagataatccaggactacctctctatctcaagatcttcaacttaatcacatctgcaaagtcccttttgccgtgtaaggtaacattctcaggttccagggatttgtggatgtctttgggagccattattcagactcagatagttatagttaagacctatgagacagtcttctacatccctgagtgatacttgaagcagcctagcaacaaaaaaagccacaaaactttgtcaggagagctgtttttggggccaccccacattgacccttacctctgcagcccctggtttcctctggcccctgcacttgtgtgataccttgagaaggggtggatccacatgccagcctacgcaggagcaagaggaccagtgctgcctctcctttcttggtacatgccagcatggtctgtggctgggatgctgctctctgagacttgggagcttacttgttcacctcagcaatgaactctgaccacattttgccattcctattctcaggcccctagcaatctcattcccaaactcgatgacccagtcttttgcatggctcagagaactgccagaactgttagcacctaggccctctgctggagttcacagatgcaaattctgttgcttgcactccaaatctgtgatgcaggattgtctgctatgtggaattaattcaggacttgaggaatccttgtagtgccaccttacaaatgggttggtgccttggaaacccagtcctggcatcaaggccttggcatctgtcaagcagaagtgtgcctggggtgtattggggggggggcagtgttggagccgatttcaccgatttctgtccctggctctctattgtgcaacaacaggctcttctattccttaagacggcagcattattgccaggtccttctatttgctcataaaactcccatttacacagcagtttgcaggacacatcaaatacaaaaatggatgtgaggtttagtacagggagaccacagccataatgaatcctggcagggtttttattttggttgcatctcagaagcactttgccaagcaatgtatatgtgttgaatgaatgaatgaataaatgaatgaatgaatgccggtggactgacatggccgtatagaactgtagtcacccttcagagagaagcctctgcaatgcacctgaaaagcaatgaccatctacatgttcttccttttcttgttactatgttttaccccaccaggatgcccactgaccagaaactaaacaaaaaaactcatgttcctgaattcatcttttacttgagggtaaaagcttggggtagtgaagtgaatgttggtgccatatcatgttcaagcattttggaattatatagctctaatttagacaacagcaacaacaaagaaaagagactccatcatcagaattgataggttagtaaatttacagatcactcaaagatgttaaaacaaaaaaacaaaaaactttctaaactctcggtgttcttgggaagtagcctgctgtcgttgggctagagataccaagaagagccaaggcagcagattgtggttgaaatttaacacggtgtgggggtggtaggctggcggcacaggggctgctgtcagagataacacacagcccggagaaccagggtgtagatcagtgcatcagagccctttccaacggtcaggagaggaggcagctgccctgggggcagggaggacctctgacccacaagtcctgacctactggcaggagaaccattcctggtttgcttgctgggtctgagacatttctggagatgtgggactttcagtgttaacacccaaatagccctggggaaactaggatggttgctcacccaagctccaacttgtctatagaattatctggctttgaaagaatgtcacgtgcttttatcttgaatctaaggtcactggcatgcccctctcatccactggttattcttgatggtaagggggcggggtgggtagggtgaggggagggtgaaggggaggttcctcctgccattccttcctggagaagagaccagggcctttccaggattttggactctgacatggaaggaaaacacttaaagaccttcaggatttcgtgagaataacaagattttattttaaccataaattgtaatatttgagaaaatgcagacatattgtttctcagagcccatactaagtcagtgtggaaaacagcctttctctggaggcaaaattgcactgattaacttgaattacaaagggagcattgcttaccttaagctaagacagctcaatgagacctgctgtagcatttttattacatgtgcaattgtgcacatgtaccctagaacttaaaagtattataataataataataggaacctgaaaatctagacgtggagtgcttgcggtctctggacactcaggtctctcctcttacctcctttcacctcctctcagagcccatcgctgacatttagttcctctagaaacacaagcatagctcagctgcatgtcagaagtgcaaaaatatttaactttaatttttttatgtatatgtctaaacttgtcttacacttaaggtccctgtattagtctgttttcacactgctaataaagacatacctgagaatgggtaatttataaaggataggggtttattggactcacagttccacatggctggggaggcctcacaatcatggcagaagacgaaggaagagcaaagggacttcttacatggcagcaggcaagaggcatgtacaggggaactccccttcataaaaccatcagatctcatgagacttattcactactacaagaatgccatggtgaaaacctgcccccaagattcagttacctcccactgggtccctcctatgacacatggggattatcacaattcaaggtgagatttgggtggggacacagaaccaaaccatatcagcccctttctattggtggcaacaaaatatttcattttactaactaaagattagtaatctctactgtattaaaacttacgttcattaaggttctaagtttctgatgccactcaaggattccccactcccctcctttcccaaaatgcagcccaggtgccaggagaagtgggtgtgtgtgccctgtggcatctggggagaaggggctggcctcccaaggaagaagagcttctccctcctggtctttaggtgccaccctcatggggtccctgcctaggtgtctatggctggggttgctcatgacctgttctcaccacaggcacagcattaaggtccgaggtgacttgtatgtgtccccagattggctgagaagtaattcattgtatgattatagcacagtttgtttagtcattcacctgctgatggccatttgggctatttccaattttgtagtacagtagtccccctcctatccacaggataggttccaagactccccagtagatgcctaaaactgtggacagtactgacccctatatacactgactgtggatagtattgacactatccgtggatttgataactgagagggctactaagtgacaaatgggtgggaagtgtatatggcgtggagacactggaaagagggagtatcactgtccctggtggaataaaacaggacatcacgagatttcatcatgatactgagaagaaggcacaatttaaaacttatgaattgtttacttctggaattttccatttaataattttggaccatgattaaccacaggtagcaaaaaccatggaaaacaaaactgtggaaaagcagggactactgtatcatgaataaagctggtaagaacaagtacaggtcattttgtggacaagtgtttttacttctctttggaaagtagaagtattgctaaaccatacataagtggatgtttaatgtataagtaactactaaataattttccaaagtggcgtatgttcccactaacaaagtatgagaattgcttcatgtcctcaccaacagtttgtgtctttaatctctataatttgagctgttctagtacatgggaaacggcatttagttctggttttaatttgcatttccccaattactcattatgttgactacctttgcaagtgcttattgaccatttgcaaagtgtctgttttaggccttttattagacctatctctaggctgttccaggcctatttttatatttggccatgtattttttattatggatttatagaaattcttcatgtatacttgatataagtcctttgccaaataaatatattgtgaatattttctcctagtctttggcttatctctttttcattttctttctttcaaagagaagaatttcatgaaaataaatttattactaaaataaatgtataattaatgtatgagtagtgttttttgtatcctaagaaatctttgcctaacccaaggtagcagagatcgtttatgctttcttccacaagttttatagttttaggcttttatttttaagtctatattgataaacctaaaagtgtgttacttaatttttgcatgaaaatttttaagatattatatggttgttgatttctaatacccacttagttagagaatacactttgcataacatgacatagacaacagggataagcaatgggcaattattttttaaagaaattagagaaagacaaagagagtagtcttttatggttacacacatattttacctatccatggttgttaacatcttggtatctgctttccattctcaatacccaagtttccatctgatgtcatttctcttcaacctgaagaactttctttcatatatcctggtgatgaattctctcagcttcacttaactgaaaatgtctatattaccttcattttttgaatgatatattttactggacatagaatttcagcatttattatttcgttaccacaaaattttgtcatctctgacctcattgcttctgataaaaaaaccgatatgatttatatcattggccccacacaggtaatgtgcctctggctgctcaagatttttctctttctcttaatttttcaacagtttgactgtgttgtgcatgtgtgtgtgagtgtgtgtgtgccctctgtgtgtgtgtgttcatcttctttggagtgttttgagatccttgggtttataagttagtgcttttcatcaaatataagacattttcaattacattttctctctattcctcttctgaaattataattacacatatgttaaactatgtgatattatgccagatgtcgctgatactcttttattaaaaaatattttctatatgttcttaagattggatagcgtatattgagctctctgccagttcactgaccttttcttctgttgcctccaatctaatgttaggcttatccactgaaattttcatttctgagttctagaagctctatttgtttttgttttttgttttaccccaagttgttgctattttcttctctgattttctatctgttccttcattattaaaatattttcctttatgtccttgaacatatttataatagctactcaaaaattcttgtctactaattccaacacctagagtaccttggagtttgttgctattaactttttttttctttcgagtatgagtcacttttttctgtttctttgcatgtttataagtttttattatatactgtgttttgtggataatagatttagagattctggattctattgttttcctttggcaacatcaatcagttaattatggaatgtcaccttaaagttgcagaaccttggttttatactctttagggtaggcctatttagatttttccttagtcttagggaggatctttaatcctgggggcatagttattactcttaggtatgaccccttcctaggattttagtgaaatgcccaagatgtttccaaacagctcttttggaaaaattgataggatttaaactccaaaatctgtctcccaatcattgagcaatgggcaattggttgaaatcattattcagctttaaaaactttagctctttccaggatttatccccctcaatttccagtcactctggcagccccaaactctgtcctctgacacctcaagcaataagatcacagctttctgcctggcggactagagagagcccttagataaaaacagggtaagcataggaagcacgggtgcagttccttatttcaaaggtcaaactccagtttctctctgccagtgctttcaatttttaaaaaatattttgttcagagtttataaatcttatctgcaggaggattgggccagtggaggatactccatcatcattaaaactagaacttcttctatacccactttatggttcttaaaatgtattccaaaattgaccttcacaaagattagacattctcactggcaagaaatgagagtccctgatatcctttccccttggcagccagaatttcttagaccaaattgcatagaatgccagaaccttagaaaacaccagacccagtacttcccagctcaaggctcctgaatcccaaaagcgtttatgagggtagcacagggtcaaatggcagcttctataaattataagcactatgtatttttccaagcataaaatatacagttattcataacacaaatcttaaatgtcattacttttggttggaattacatcatagttttcctgcagacataggttttctcttgctcatcagaagcactgctttatagttaagtacatttttggtcaacctcaaatggcaaggtgtattattattattgataagtgacatgtggcttttaggacataggaacctcagaaagaaagtttattagaagaattcttggtggccctgggcactttgaatagtaatgagtgtttctggttgatgaatttagatttaatcattggatctatctttgtttataagagctgctatagctttagcttcattatttgctgaggccccaagacatgaaagcacttgcctggagtgacacagactgacaccccttgtgggttcagagatcagaaactaagatcagactttgttctgaacacagcagcatttataactgtgaaggactaattctgatacctaccatgtttcagagacaaaatataaaagggtaaacttagagaagagcactttagagaggcatccagagagaatgttgatgattggatggacatgaccttttgaaatgcctgtgatttctgttccatttcttaccccggcaagaataaaccaattggaattcaggtgaatgaattttgattgagcacagattcatcatatcttgccaggtttgtcctttatttgtctccaatgctgatgcatctggattcacatcaactccatccactacacttacaaaggcaaatgcttccccaccttctgtaatcatggaggaaatgtatggtatagggcaagcacataggtggctttttctttataactcctgtaatatccaggccaatgttacatattccttaatatatatttactgcagcaaaatttagatttatttcaccatatttttccccagaaaagccagcatccccatttacagaagcaatcacagaaacatggagaaattcattacagtcttagtgcctcagaaggacataaatcaacttttaattacctctacctggagatgcttggtgcaatgtgctgtgtgtgtgagactgaatgtgtgtgtgtgtgtcggagattgagtgtgtgagtgtctgagaagtgtgtgagggtgtgaggtgggtgtatgtgagattgtgtgtgagagttagctacgcatctcctctgtctcctcagagccatttcttttctaattgtgctctcagacaaccagccagctaagcagggtctggcgagtctgagacattcatgctggggtttgcatgaagcttgtctccaggaatccaggacacagtttagatttgctcagacccgtctcagcagcctggagttaggatgaccagatcctttgaaaggtaaagaagctgctgcataggaaacagaaatgagtcaatttctgggaagttgctagagtttgaatatttgtcccctccaaaacatgtgttgaaatttaattctcggtatgtcagtattgagagacagtgcctttaacaggtaactgagtcatgaaggttcttcccttatgaatcacagggttatcataggagtgggactgatgtcttcataaaaaaggaagcgagacctgagctagcaggtgagcatgctcagcccccttgccatttgatgctctgtgctgcctcaggactctatagagagtccccaccagcaagacagccccactagatgtggcccctccaccttggatttcttggcctccagaagaaaataataaatgcctggtttcgagtgctctgttatatgccacagaaaaagacaggagtggagaggcttataacccccaggatggccacaggcttatatcccttttatcctcaggggtgaacccttgcctacctgtttttccatccagccaggccagcactgtagcagagggaaaacccaagggccccatatcctggcaatgcagccaggactagtgtccaaaaatatactgggaatggtgctgtgactacatgctgtgaatggaaacagcctgactgcagagggaggagtcaggaggggcttcccagaggacagggtggggtggggttcacccctagtgcagcctcagcaggagaatggggggttgttctctctccactgtgaacctggtgttcttcccttctctggggtctggctcttctactgagagaacaaggtgggcaacagaagtcaccaaaacctcctccagttgtgcaatgctaaccttgagagcagggccaggctgagacaaacacagaacccagcttcttgcagataagatgtgaaaagagtctgttactcattccaggtcctgtggcacttttagcagagatggatgtttccagctggggcttgccttagtttactagagacactgtaacaaaacaccttagactgggtaatttgtaggtaatagacatttatttctcagttttggaggctggaagtccaagatcaaggcgcaggcagatttggcgtctggtgagggcccactctgtacttcatagatggtgccccttgctgtgtcctcacaaggtggaaggggcaagcaagctctgctgcagctgttttataagggcactaatcccatctaggaggcctccaccctcatgacttaatcatctcctaaaggcccacctcttaatactattacactggtagttgtctcaacatatacatttcaaggggacacattcaggccttgcagggctttagatcccaccacttcatcttatcctctttcttgtcccttctcccttctcctgaagcttgaactgaaagatgcttgattttggcctctactttgtcctcattgccatttgtgacaaatgaagaaattctatgtatggtgaggacagcaccatggagccccttagactttagacttgtccatttggctctgtggatatgggttgtattttctctacttttctttgagctctccaaataaaaacagttgataatctgaatacattgaccatgtattctagaggtatacagaaacatgtgtggactctgaagccaaactttctggtttagtcctaacttcaacacatattagaagtatgacttgggcataaattatctgggtctcagttttctcgtctgttaaaaaagacagtgatacagccaggtgcggtggctcacgcctgtaatcccagcactttgggaggctgaggagggcagatcacttgaggtcaggagtttgagaccagcctggccaacatggcaaaaccccgtctctactaaaaatacaaaaattagcccggcgtggtggctggtgcctgtaatcccagatactctggaggctgaggtgggaggcggaggttgcagtgagctgagattgccgccactgcacccaagcctgggcgacagagcaagacttcatctcaaaaaaaaaaaagaaaagaaaagaaaagaaaagaaaaaaaagacagttatataatagcaaagacatggaatcaacttaaatgcccatcaatgatagactggacaaagaaaatgtggtacatatacaccatggaatactatgaagccataaaaagaatgagatcatttcctttgcaggcacatggatggagctagaggccctcgtccttagcaaactaatgcaggaacagaaaaccaagtatcacatgttcttacttacaagtgggaacaaaatgatgacaacatatggatacttagggggaacaacacatattggggtctgttgggtgagtaggggatggaaggagggagaagatcaggaaaaataactaatgggtactagtcttaatatctgggtgataaaataatctgtacaacaaacccccatgacataagtttacctatgtaacaaacctgcacatgtacccgtgaacttaaaataaaaatgaaaaaaaacagtgatagtacctacctcatagtattgttcttggaattatgttagccattatataattcttaaagagttcttggcatgtagaaagtactatgtaagtgacagccatcgttgcttttgtaatgattattttgcttcctttctttttgttcattgcacatttaaatttctaaaagagattccaatgtctttattattaaggtgagaggaaagcctgaatttaccttccccctcttcccagctctgcccctcacagcccccagacctttgctttgcttgctggacccaaagacacacaattcttgtccctgtgcctgggaaggggtgttgggattcagggcagatgtatttaccagactgtggtttgggcccctgtgttgtcttttaacttataaaatatctgtataattatttttcattactagccaccacattcctttgttataactgcttttttgaaaatgaatatatgcacattgtaaacaatttcaagtgaaaccgcctccccatcccttgtctgatggctagtctccctcccctgagggccgacgccactgcttgccaattttgacataaggcttgaaaccaatgagtgtccagtgactgggtgagtttggttcctcctacttgtcttggcaatctcaaacagttccaggagaagattgtttcttggagagtgggtggcaatgaaataatagcaatggtggtcaacctttattgagcaggaattgtctgccaggcacccttccaggagctttgcctgagggatctcgtgatctttgtgatgagctatcgaggcggctactgctgcgacctgggatggagatgcccaggtggaggcccagagaacggaagtgtccttctaaggcctaactaacagataggggacttccatctgctccaaggatatctagttccagagtccacactcttggaatctagaaaactccatcaggactaatttatgagcatcttagaaccactttccctgaaatttcctttctacaaacctaggaagggttttttctcccttcttcctagcaagttcttagctttttatggaataagaaaatgcacagagtggccttcatcctggacaggctcctttgatgtgagccacgaggcacctagggctgggtcatctgtggtctctgcaggtggccaccacgtgtccttgggcttccccatctgctccaggctttggtcttttaatttcaaaagcagggaaagagcaggctcacctgaaccttctccagagttctttctattactcagagtccatctagctaaacatgtttttaaaaatatttatttgcactggtgagcccatggccatggtggaagtggggacatgggtaagcaagagtccaccctgccccacggagctcacgttccgcaggagtggaacacacagcagccctgggcaaggcacctctggcctgtccctcacctgctttgcacctggttatgcttcccttactcccagtagcaagtgccccaggaaccccgtgggtgacctactcagtggtaggctgtgcctgcttgcaggagggaccagaaggctacctggggttacttctcaggcatgagccaagggtcacattataaaagctatgccagattccccatagatgatcctctatccaaaaattaggagctcttaagtcataagatgagtcaaatctacccccttagaactcaacatagctatgttcagttttactggaaaataagtcactggaaagcactttttatggttttctaaatctctcttatgcccaaagaagtggttcagccctggtctaaggcactgctcacttactctgattgccatcttcagcatcatcgtgatgatgataatgatgatgatgatgatgatgatataacaagatagtagcaataacaagagctgcctcctcccagttgtgaaattatgtttatggatatctggggctcactgttctctttaggaatgacccctgagggctcatggctcccagcccccagtaccgcaggtaaagcagtgaccctatctccagaaacgtgggtaccaccaccacagtcatagcttagatggggcaaagagtgctgactccagaagccgccatcatcaccgactgtgtcgaatttggaaatggggacagaaatgtacacatacccatgggctttgcagagaggccatcaaatcgactgtttctttttggttgtaaaaccctgaggatctctctgcatttcttcccttcccacccccattgtttaagcctcagtttctcctttgagctacctgggattctgatgggcaggattgctcggtaagcgctaagctctgtccacaactcagccattttgtgtctctggtttgctttggatggcagttttccccttatcctgcccagatttccagtatccaagcccgttattttcttatattcttctttatgacctgtatttttccaaagattgggaagcaaaaatgtcaaggtgatagatgcatatagataggtaaaaagatgacagtcagttttaatcctcattttgcttttctgtatttccaaaatttctacaaggaacatctattgtatttgtaataagaaaaatagtctaatgaggccgggcgcggtggctcacacctgtaatcacagcactttgggaggccgagggggcggatcacgaggtcaggagattgagaccatcctggctaacacggtgaaaccccgcctctactaaaaatacaaaaaaattagccaggcgtggtggtgggcgcctgtagtcccagctactcgggaggctgaggcaggagaatggcgtgaaccctggaggcagagcttgcagtgagctgagatcgcgccactgcactccagcctgggcaacagagcgagactccgtctcaaaaaaaaaaaaaaaaaaaaaaaagagaaaatagtctaatgaaaagcaagttggtgccttgaagttgagtgttttggttgaatgttggctaaggatccagtcccccagaggttagttaaaagcttttcctccagccctatgaccacaggggtaacaactcaactcctcaggccatgaaatttcagagggttatctttgtcctgagcctcagacttctgtggatccaacaagggaagggctgtccggcagtggagacttgacatctcactggctcccaatacttgcagctgcagtgtttcttgagcactactgtgtcacacacggcctgagtgcctgcccccatcttcagagaatggcacccgggtctggttggctcacctcactcaaagtggcaggaccgtctctactgcatgcattttctgtgtggtatgtttttctttctttggtagctcataaaatttccctatctgtgctgggcctcttggtctttaatcttcaacctctgctggagctgtccctatttctttttaattatgcctctttttttatggaagtttcctattaaatttttatgactatatagagctgtggatagactccaacaaaaatgaaatctttatggaatagtcatttctctccaggagcccctgatagatgttcctctgtggatagacacacatgtgtggtgggggtggggaaagtccctctggtcttggctgcagctgggcaggatgcgggagaggcagctgagctgcttattcctcagtgtgagggctgctgggagcgtggggtgcagctcagcttggggggtgggggtgacgtgggatgcagaggataagaagtaaatcttccctaggtgtaatttctttgccttggtgtctgctgaattagcactgctccctaatcccaagccatcaagctacatggctgcatatgagcggagacatgccccgttactccttattcagaaccttcatggccaggcacgttggctcatgcctgtaatcccatcactttgggaggccaagtggcagatcgcttgagcccaggagttcgagaccagcctgggcaacatagtgagacccttctctatataacataaaaatttaaaaaaaaaaaaaaaaggagaagaaaagaaaagaatctcctgcccaggtctgccagctgagcttgcaaaaatgttatccttggggctaacattctgtattagttcattttctcgctgctgataaagacatacctgaaactgggaacaaaaagaggtttaattggacttacagttccacatggctgtggaggcctcagaatcatggcaggagatgaagggcacttcttacatggcagcggcaagagaataatgaggaaaaagcaaaagtggaaacccctgataaacccatcagatctcgtgagacttataaactatcatgagaataacacaggaaagactggcccccgtgattcaattgcctcacccctgggtccctcccacaacacgtgggaattctgggagatacaattcaagttgagatttggatggggacacagccaaaccatatcacatcctaagtgactgtctggggtcactggaccctggcatgcttccccctgtgccagctaccagctatgtggtctgggaatggcttgggatccacagatagctctccaggggggtcacggaccagagttgctgttgcagggtgtgagtccccttgccagggagggaagggacagtcattcacttataaacagatgttgggactcacccaaattgagtgctgggcctagatcagggcaccagggatttctcattcttagtcccgtggagctgatgttcctgaaggaggaaatggagaaaactcaagaaagcttgtaaacgagtgaggtggttttagattgtggtgaatgctggggggcaaacggagatattaagagggctgccaagggaggaggagggaggggttctcatttcaacaatgttcagggaaggctgcctgctggggcgatcctggagctgggacaggatgatgaggggcttgcatactcagatcaggggcagagccttccaggcagcaggaccaacaagtgcaaaggccctgaggtggaatgagtttgtcaagttgagaaacttgtcaagatgagcgtggctgggacagtgtaagccatggggagagtggagagacaggaggctgggtcaggcatgggagatttttaatccttgctaacttactttaaatgtctaaagacaccattttgactgctggacaaagaatggactatggaattgcattaaagtccagaggtccagtttttggaaccaccaggaaggcaacacaatgcgcctactctcaaagggatttggggaatggaagaaggtggggttattgtttcatcaggctgcttggatttagacctgttttcttaagctgcaagatctcctacaaaactggatcctcacctaagtttggaggacaactgagaagtgatagttatgtttgcctccctgcagagaataaactctcaggagaggatggagcactgcagctcttacctatgaaagttgataaggaagggagtctccaatgtgagtgtggcaactgtctactcactggaaggaacagtgatacatatcataatagggaaggaaatgaacagcatccattatgtgatggcgtctatcccatgtgttaggtcctgtaactgacaacagccgccctgaaaagtattattgcatatgagactggagaccagagaggttaagtaaattgcccaagatcacatagctactaagaggcagagctggggtttggactcacgtcggcctgactccaatgcccttgcatctgtcactcgtgcccatagccctagtcaacacccacatgctaaaggcgtcagtggtcccctctaacaaaagctgttatggcttctcagagagactggagtccatggctgggagaggcaggggtaccctgggagaaccatgtgtcatcagggttctttccaggcccttccagccacccacccatgggcataaggcctaccccagctctgcaaggtttcaaaaaaacatgcttgacacttgaacaaaaattggctccaaaacataagaagaaagctgcaaaaccataattagtaatttagatcaataaagaataaggactataaagaagagagtaggggaagtagggaaaaaaaggaacatgatgtatttattaccattgaacaatacacttaaaatggtaaagatggtaaatcatatatgtatattttacctcaataaaaaagaattaaattaaaaaaataagcaaaacaaacgatcttattttaccttcatttatgctttctctgccctgcatctctgcctgatgctgaccccagtttctgactaataaggttttccttctgcctgaagagcttctgcaaagctgtccttaggacagatctactcgctaggaattccctcagtttttgtttgagaaaaatatttatttctgtctcacttttttaaaaattaagctttgttttgttttgttttactataattatctttttgtttgtttgtttgttttgagatacggtttgactctcccacccaggctgaagttcagtggctcaaacatggctcactgcagcctcaaccatctgggcttaagcaatcctcccaactcagcctctcaagttgctggaaccagaggcacacgccaatacatcatgctatttttttttttttacttttgtagaggtaatgtcttgctatgttgcccaggcttgtctcaaactcctgggctcaagcgatcctcctgccttggcctcccaaagtgctgggattacaggcgtgagccaccacgcccaggccaaaattaagcttttttatctggagatcattgtaaattattctgcagttttaggaaataaatcagaaaatatactgtgtgacctttatccagtttcccctaaagataacatcttatatgatagtataatagcactgccagaatattggcattgatatacttttacttgtcctcattgtgtgtatgtgcacacatgcatgtgtatttagttccatgcaatcttatcccacatgtagggtctgtgtatccatcaccacagggttcctcttgctgcctttttatagccatacctccttccatactcttctccttaacccctggcaaccaataatctgttcttcatttttataatgttgtcatttcaggaataatagactcgtggtgtgcatgtcttttttgctcagcacaattctctggagatttttccacactgttgggcacatcattatccaatgcccccttttcttgctgagtaggactctatggagtggatgctccacagtttatttaatcagtcaccgaccacacagagtgaggctggagagaatggcagatgagagaggggaggggtcgggacagggaaagaaaaccctctcagagatgtctcacgatatctgcagtaaaacctatactctcaaacaaaaactttcttggtggactcttttcttcttctgggaaaagaggcaacataaatggacgcagatcacctgccacatacacatgtgcatactgatatgtcccctcgtgtgctcatgtgtacacatttttgcacatgcatacacacacacacacacacagacatgcctgtgaagaggccaaccccagtgtgcagcagctgtgagggggctctgcccctcctctcctagaatggaacatacgttcttgtgaacatagagagtggcattttcttatgtcgatgtaatgtgaacaactcctggtcaccagcccccttgaccactgatgcctcttcatgggtcggtgagtgagggagacacagccatttattcctggcatcttgaattaaacttgaaattactgcccactagaaataaggcctggggcatagagtcttattattaaaatcttttgtggaaagtcacagggctccaatcaccccaaaaacattgtgtctatgggaaaatgcaccttgagttccatcttacaaatggatttgtaacagtttaggtttcatgtaagctgttcacagtatcctagtgatacatgtttatggtaaaaaatcttggagggtaaagaacaaacactgcccataattttttactgtatacacttttttttcttataaaaatgttactctattgcacatagtgttttgaatcatgccaatttttatttggcaattatataaaggcagaactttaaatatcacccccaacattctgtgcctatgcctcagagcctatgcttaaaaagagcaatcatattcatgactacgtatttaatgcaacattagaaaactaatgcagtcataacccacaagcgttttccatgccaatgacctttttgccatctggtttagtgactgcagagtatcccattacatggttgtctcacaccttggcaagcatcccttaaggatggacactaaatcatcatggggtttaatactctcatccacagaagagactcccaagccagtcctcacatatcttgctctcattactagggcagagggttctaagaattttcctcttatgggccaccaccagagcagaccagactcactgtttccatgcctgctggctcttgctgccaccatgccctgatttcaaataaccactccatccatgagctaactgaccttagaaagatatacttttaaaatgcatatcctcccaattttcaattaaggccaaaaggagtagtagagaccaaatatatcctctttcatgaaacaaacaaaaaatggcaaaaatatgtgaatctacgaaaagatactagaactcttaagtgaatttagaaaggatacaagctgttatatcaatatttaaaaagtcaatttcatttatatgattaacaatgaacaatcagaaagtgaaatagagagtgtcatttataatagtatcagaaatataaaatacttagaataaacctgacaaaggatggggaagacctgtatactgaaaactacaaagtattcctgagaggaattaaataaaacttaaataacataccacattcatgtgttcagtctgaattacaatgtctaaagttaaacatactgaccacaccaagtgttggtgtggatgtggaggaactggaactcttatatgttgctggtaagaatgcaacatggtacctccactttggagaacagataggcagtttcttaaaagttaaacatacatttactatattactcagccattccactcctaagtatttactcaagagaaatgaaagcatttgtccacacaaacattcttacatgattgttaataacagctttattttcaatcacttgaaactgaaaatgatccaaaggtatagcaacagataaatggactgtggcatatccatataatggagtactatcaagcaataagaagaaacagacagctgggcagtggctcacatctgtaataccagcactttgggaggttgaggcagatcacttgagctcaggagtttgagaccagtctgggcaacatggtgaaaccccatctctactaaaaatacaaaaaattacccaggtgtggtggcgcacacttgtaatcccagctactgggaaggctgaggcaggaaaattgcttgaacccaggaggtggaggtttcagtgagccgagatcacgccactgctctccagcccgggcaggcgacagagagagactgtgtctcaaaaaaaaaaaaaaaaaagagaaagaaagaaagaaaagaaaagaaaattagcagggtgtggaggtgcacacctgtagtcccagctactcaggaggccaaggtgggaggattacttgagcacaggaggtcaaggctgcaatgagttgtgattacattgctgcactccagcttgggtgacagagtgagactctgtctaaaaaagaaagaaaagaaagactattgatacgtgcaaggatatggatgaatctgagaacaattttgctgagcgaaagaaagcagaggaaaaaacatacaagcagcatgatttcatttacataaaatttttaaaaatgcaaactaacctatagtgacaaaaagcagaacaatgggaatttataatgttaaacacatatgtttattagaaaaaaaaagatctacagtcaatcattcaggtttccatcttaggaaactaaagaaagaggcctaatttaatttaagcctgaagcaaggaaaataagataagtaattaaaaattagaacagaaattaataaaattgtaaacaggaaaacagtagagaaaaatcataaaacaaaagctggttcttggaaaagatcaataaaattgataaacatttagtcaggccaatgaagagagaaaagacacaaattattaacattagaaacaaaagagaggtcatcacaactgatcccatagacatgaaaaggttaattaagtaatacaacaaacaactttatgctcataaatataattaaggtgaagtgcaacaattccttgaaagacacaaactattaaaaccccccaaagagagtagtcttatattcgaagagattgaataatttaaaaccttccagaaaagagagcactaggctcagatagtttcactggtactttcaacagaatacttaaagaggaaataataacaattctccacaatatcttccaaaaaatagaggcagaggcattgcttccaaactcattttatgaggccagttatcttagtctgtttaggctgctgtaacagaacaccacacaaactgggtggctcataaacaatagaaatttatttttcacaattctgaaggttgggaagtccatgagcaaggcactggcagatttggtatccagtgagggcctgctctctgcttcataaatggttccttctagctgtgtcctcacatggtggaggggatgaggagtctcccttaggcctctactataagggcatttaggtctcttctacaagggatcacccattcatgagggctccgccctcatgatctaattacttcccaaaggccccacttcttaatacaatcaccttggaagttagaattccaacatatgaatttgggggaacacaaacattcagaccatagcacagtatattaccctaacaccaaaacctgctaatgacattttaagaaaggaaaaactacagaccaatatctctcataatcatagatacaaaaaaatctttgaaaaaattattgaatcatattcagtaatattatataacataaccaagtgggattcattccatgtatacaaagctggtttgacattcaaaaatcaacgtaatttaccatatcaatgggctaaagaagataaatcacatgactatatcaactgctagagaaagtatttgaaaaaaatcaatacctatctacaataaaatctctcggcaaactagaaacagagggtatctcttcaacttgataaagaacatgcacaaaaagcctgcactaaacgtcatacttattggtgagaggctgggcattttccccctaaaatcaagaataaggcaaggatgtcctctctcaccactcctatcgaacatcatactggaagtcccagctacagcaataagaaaaagaattaaaagaaagatatacagactggacaaaaagaaacaaaaatggtctttattagtagatacactgtctatgtaggaaatgccaaataatctgtgcacacaaaaaaaggtgaaaacctcattggaaaaggtgagtataacaaggacacagcatacaaagaaaatataccaaagtcaattgctttcccatatacaatgaacaattagaattttaaatgaaatttacattaccatttacaatagcatccccccaaatcagtatttagttacaaatttgacacaatctatggaaactgtaggcaaaaagctagaaaatactggcaaaataaaataatctaaataaatggcaagatagtccctgcttatctgttggaagacttggtattgttaagatgtgaagtatttataacttgatcagagcagtccaattcaaaatcccagcaggttattttttagatattgataaactgattctaaaattaatataaacaagcagaaggcctagaatagctaacacaatactaaagaagatcaaagttggagtactcagagtccttcatttcaagaattactataaagctataataatcaagatggtgtggtattggcaaaaaaaggacacataaatcaacaaatggagatgccagaaatagacccccccacacaatataataacctgacttttgacagaagcgcaaaggcaactcaatggagcaagtgaagtcttttcaccaagtggtgctggaacaattggatgttcataggctaaatgaatctggacacagaacttgcaacttacacaaaaaataactctaaatggatcataaacctaaatttaaaatgcaaatttataaaacttttagaagaaaacataagaaaaaaatttatgtgaccttgggtttggtgaggaatttttagatacacgaccaaaagcatgaaccatgaaagaaaaaaaaatagagaagttggactttattaaaattaaaaacttctgctctacgaacaattctgttaagataatgaaaacacaagctgcagactgaaaagaaatatttgcaaaacatgaacctgataagaaacttgtatccaaaatattttaagaaatcttaaaagtcaacaaaaagaccataagtaatccaattgaaaaaatgaataaatctgaacagacacctccaaatcaccaccaaagatgatatttgtgtgtgtgtatacatatgacatatacatatgtacatatatgtatatatatatatcttacaaatgggaaataagcatgtgaaacatcatctgtcattaaagaaatgcaaatgaatacaacaatgagctttcaccacacacctattagaatggctagtatacaaaaaaccaacaataccaattgctatgagaatttagaagaataagaacccacatgcgtttctggtgggaaggcaaaatagtacagctactttaaaagatgtttggaagtttcttaaaaagttaaatattattttactgtatgaaccagcaagcatactcctagatgtttacccaactgattgaaaactacgtccacaaaatacctgcatgcaaatgtgtgtagcaacgttattcataaccaccaatatctggaaaaccaggatgtctttcagtaggtgaatagattaataaactgtagtacatgcatataaaggaatactattcagagatataaataaatgaactatcaggctatgtaaaaacatagataaaacttaaatggatattgtttactgaaaaaagcttatccatttatattatgttctagaaaaggtagaattatcgagatggtaaacggatcagtggtttccaggggcctgtagagatggaagagtagagtaggcaaagcacaagagatttttttttagaatggtaaaattattgtgtatgatactgtggtggtgaatacataacactgcatttttcaaaacccatggaattttacatcacaaagagtgaaccttaacatatgcaaattaaaaaaataattaaagatgttgggggattccaagatgggatgctgagtatgacagaagactaactgtattacaaatgtataaaataattccactgaaggggtgggaggaaagcgtgctgaccaagtggcattggaagtgagtggagactgtaagactaaaaacataaggaactgtccacaaccctgtattctagtagataaagctctttcccaaaaggatataaattctgaagccactagtcacacactctgaaatgtgaagtcactggatggaggatggtgggagccaggtttatctttgttggaggggaggctaccaacaagcaagcaggaaaggttgcagtgattcatatggcagtggttagtgttggggacatcaacgtggaatcgagttcagctcaaaatagatgcagacggatatgtacaatacacttacagatatgggttggtatatatttccttgttctgtctcctgacagggcctgaataagtgtcatcccagtagcaatgagcacacctactgtttacgtcttagtttttgatgctgttcttttttttttctttgtaacatttaataagctcaatctacatccagaataatttacatgaaaggacaatatttatttaaacagagctcagtggggtagccatggtatcatcagagtgcatccagaggaaaagagggaggaagggccgaagaagacacaatcaacggcactcccacacttttactgtttgagccacgctgccagtgaccacatagggtgctgtcttgtggaaatccaatgaggtaacaaagtgttcatacgcattgagggtcttcatgcattgcctgttcttgtaatcccatacgtgtagggtcttgtcatcagcacaactcaaaataaatttccccccagaactgaacagaacttcacgtacccagttaccatgacccacgagggtcatgaggcacatgccggtactgacatcccacatcttaatagtcttgtccctggatccagacagcaagaatggcccagatttaccactattttttagtctcagagcctgttgcttcagagatggaggaatatgagctttctggagcccaggaaatgcattctaccacatgctcatgttctcggagctcacccttgcattgcattgttgctacaacccatacacgcacagtctggtcattggaacagctggctatcagagtgccatcttgatttggttgtacaatatgtacccattctctctgtcctgtgaacatcttcacacagtagccagtttgcacttcccacatttttatagttttatcccttgaggcggacactatatgatctccactggccatgatgactactgaggaaacattatggtcatggggaaccatgactatgcatggttctgatgcattcaaagtcctgaaaatcccatggtttaatggtcatagctgcagaacaggaagccagaaacttgccactgtggtcaaatgaaatgtcctgtacagagtctctatgtccttcctttaagagttctttcaaaatctccagtctcataatcccacaccttaactgtagcatcctctgaagcagagaccataacactgaacacaggatggaaaatgactcgaatgattggactcctgtgaccactcaatgtgtattttttctggcagaaaatacccattcttttgggtcttgtttctgaccaagaggtccacctgacgtaaattcttcttttgcttcatttagcgttgattctaattccataaacttcttttgtaatctaataacagatgtccattttttccccaaaacaccagcctactttatttcttcattcatatctaattcagcttcctttttaaaaactgaatatgcctcttcgtagccatttgaacgaagataatctgctttagcttgatttagttcatctcgttgtctctgggacagcaccatcttggctgtaatgtcaagcttatctcatatagtggtatgtccctcctttgggaaatgaaaaagctttttgatccgtggacgtataatataaatatgacactaagtgtcttccactcagcggaaaatgattcttttacaaatgaatccaactagtaaccagaagatattcaacaagtaagattcattctactctcccggccgctggattctgccactgccccgccgctccagctctgtctgtcacaggagctgccccaacaccctgacgtcactgtgccaccaccgccactgcccccaccaccgcccccactgttcttaataccatttaataaaaggaagtaagccttcctggagaaatggctgattctaggacaggcggggaatgtacaaaatgagcctggaggagcattttacagggccagaaagtaagaacgtgttcagaagaacaaacaataacacacaggtcaaggagacacagtgaccacttgaaaaagctttcaatggcctaagctggaacaatttgagcaataaagtagtattggattataaataacccaagtataaaataaatatgcatgattccatactgatttacatttatatatttagttaatcacatacatatgaataagtaaatggcagagaataggcacatctccagagtggtggaatttcaggtaatttatgtaatagtgcacccccaaggaggtggagcataattctcccctccttaaatatgggctgcacacagtgacttcctttcaaagtgtacagtgtggaaagggggcaggggagaaacttcacagtggagacgtccaacaaacactgcctcagccagatgatcatggtcaacatcacgagtgacgtcatgttgataggatgtgctcctgatagaatgtgatgaaagtagcactttacttctgtggtcttctcccaataatcataggagaaaacaccaggcaaatcccaatgttgggacattctacgaaatacctgactagtgttcctcaaaactgtcaaggtcatcaaaaacaaggaaagtctaagaaattgtcacagccaagagaagcctaaggagatgggacaactcagtgtaacatggtgttctatggtggaaggacagctgggtcaactaaggatatctgaatgaagggtgactttagttaatatgcatcaacattggccattaattgtgacaaaggtacctcattaatgtaagatagtaacaatgagagaaactgggtgtgatatctagggaaactctctggactattctcaacttttctggaaatttaaaactattctaaaataaaaagtttatttttttaaaaaggaaggcaatcccctttctctctcctccctctttctcctttccctctctttcctcatttctcccttttccttcctcctcttcctcctgccccctcctcttttcctttaacaataacaataatgtgtagtccattctcacactgtgataaagaactacctgcaactgggtaatttatgaaggaaagaggtttaattgacttgcagttccacaggctttacaggatgcatggctgggaggtctcaggaaacttgcaatcatggcggaaggtgaaggggaagctaacacatcttcacgccggagagagagagagataagggggaagtgctacacactttcaaacagccagatctcgtgaactctatcaagagcacagcaaggcggaagtccacccccgtgattcacttacctcccactaggcccctcctccaacactgggaattgtaattcaacatgagatttgaggggggacacagagccaaaccacatcaaatggcatcacacatgtgaccagtacgttgtcgtttccagctctcttcccttgcattattctgcaggagcccttgccacagtgcagtgctggatgtggtattcttgaattcacagttgggccagggaggtgaaatgacccacctaggaggtagcagaggtgctagcagcactcccaagactcatagtgaattctcctgggcctgtccgtcaccctgttatgccacttttcatttccctctgatcacaaatgactcagcacacagtgtaagtgctacaattttactccagaatttgacttgtattgtcctacagactgcaggtaccctcttgttgctcctttcccttgaaaaaaaatacatcatctcaaaagaacgcaaccaggagctggcaatggcactggaatcccttcctggtcacagaattgatgctcatctgcccagtgcatggcacttttacaagaaatcttatttggtcaaccccccaaatatcacagaaggacattattattatctccagtctgcagttgagaatgctgaggctagaaagtggttaccactaaaagcaaaccttttctctctttcccattgcctatccaccctgactctgggctctgacccatacccacctgctcaaggtcccaggtaggagttgcccattcttttaagtatgagttcattcatacacatcaccatgtgaggcttgatgtgacctcagtaacaagcaggtctcatctgccctgtgcatgtgaatgtgccttaggaagcttatcaaatcccaaaggagaaattacatcctctaggaaaagtacagtgaggtgactgtcccgtttcctttactggctctggaccacagctgagttcccatgcacgcactgtggcacacgagagtgtgggcagaggcacttctgctgagtgggatgaaacatcttaagtgctctgagggttgaaactttgaagaggttgagatctgtgagagctgaagaacctttgaatctcccttcagctctccctaccccaaccacagcccttctcttgatgtaaaacatgtgttcagatagaaaacaaatgaggcttacttctatgccagtaggactgtttggctttaagcttccccagtggttgaaaacagcaatctccgagatttgcccaaaactttaaatggaagtcactcccatgggtcacatccatggatttgtgagatagggcaggaggctgtgtctctgctacccagcggtgggagcaggggtctgtgcagcctgattgtattggggatgggcccctcgtccagttgcctatgaggataacctgcggagaagatcagatggagatacctggacttatgcagaggcgtgttcgggttaaatagaaatgcccagggtccaatagagggaaccttccaacaagtgtatgagttggcctctcacccgacgctggccacccagatgacagcttcttggacatgatgaatggcctcacttccaccagaacatcttcctgccaggccctgctgctgcttccccagctgtgtggccttggatgagtaacatggcctcttattaaagaaatggatgaaatactttctaaagaatcttccaactctgaagatctgtgacatcttgtcactgaattaataggaaatcagctccttatagatttggtctatgttaggagacaacctctgttgatgggctgaccgaatgtctgaagtgggaaggatttggggaccaaaacaggtaacaagagtagacgaacacaagaaattcaggttgaattaaccttcaacagatatttattgagtaacttctacatgtaagtcaccaaaatctgggaaggggaaatggataaaagtacgattctctctctggaaagcctatagtctaattaattgatgtattaagtaatgctgggtggaggaacaataacccaggacttgtataaacaataggaaactctgggggaagagcaaggctagaagagacattatctgggaggcaattctagagcaggtagatttcaggaacaggacaatcaaagaaaaggagagtggcattcacacatcaagtctaataatatggccttattttatggtccacctgagtactgcagaatttagccctaggtactaccaggtccaaagctgcttctttaagctacactttaagctcctgtcactagaaggggctgtcagggtgccagggattttggtaggttccgtgcggacttccctagtcctagaggacgttggagtcactggggtgtgaggacattggagagacaggaatagagttccacgctgcgatgaggagatggagcctgatgcaaagccacagggaggctggcgttgttggggtgggaggaattcccacccagtgggagagttttacattgaggactacatacctggtcagggtataaggcaaagtgggctcccactcctgacatgttcctctttaccgatgttccttgtgaacttattccccacctaggacagctaacactttaagctcttgactgtcatttatactttattcatgtgaatgagtttttagttttctcttgaaagcaagttgggatactaggaaagttgacaagagtttgagtttctatgttggttgggaaagagtgatgtctccacatgtaatttgtagagggtcccatcagtttccaaaagaggaagtgggtgtttgtcttgcttttgagacattttgggagacttagacacaatataatttctattgagaacaaagtagggttaggatttggagaaggaagacagatatttccttctctctgctaaagagatggtctggagtagaaaacttgtggactgtgtttacaattgtggagtactactcttggttaaaacaataaagcagaatcgatgtctgtagaacagagctggaaggggcctcatggttggttttcaaggtaaactaaccacagacatcagttttccactcctctgcctttttagcatctgggttcatcttccaggaaggccataacaaaactccacaatctgaggatcttaacaactgaaattgattgcctggaagttctggaggatgaaagttcaaggtcagcttgggcagcgtaggtttcttccgggtgccatgagggagaatcattcgtgcttctggtgtttgctggcagccgctggtgttccttggctggcagaagcaccaccccaacctgtctctgcatcttcacagggcattctccctgtccgtgtgtgtgtctgaatttcccccttttataaggacaccagtcatgttggattaggggcccaccctactctagtataatctcatcttaactaattataccggcaatggtactagttccagataaggtcacatcctgaggaactgaaggttcagacttaaacacatgaatgtgggggaggagacgcaactcagcccataaccacattctttctacacagggagttcaagttagagagcccatcaaatcatgcagggaaaggagatgaaatcctctgggtccgtcactgtttgaggcagccctagacacatgctgagctattgtccccactttgccaatgcagactaagcttgtgtccatggaaaagcccagtgtgaactaagatcactggatgcccaccttggtgctgggggccggggcccacacagaagtcccaggcccaacctgaggggagcaggctataccaggccgaggatggcccccttgatttgggtgcacactcaaatgtacaaactactgcctgcaccacagagactggcccggaggtgttatcttcccagagggctgggcaaagggctatctttgaaccagctgttcccactcaggcaagagtggctttgctgggcctccacttcctccactgtaaaacgagggtgatgctctgccctgcccgacccatctagggtcaggtgaagatcaaatgggataataagatagaatgtcttttgaaagacccacacacgaaggtggcatgagggattgtctttatgactatcatgttctatgcagccctgactgttacgtgctagctggctgtctcatctcctcgaggtgtcctgcgtgcctgctgatggggatgattccaatgactaaaaggtacctggccttctccatgcccagctttacatccagtagaggctcaggccaccctcgatggcagcctgcccgctgcgggcctgcttgtctgctcaaagcagaggttgacttgcgcccaggttgcattccagaagtcctggcctgctttctccacatggttagcttcgagcagtgagcttgggagcagcctttctgcgagttctgccaggtgagccagcccgcaggagtagggggtatcccaggcacgcacctgtggctcaggtttctcccttgtggcccgctctctccccactgctgttttccagagcacctccatcctgcaagattgacagctcactcttggtagggaacagagtgtaggaagtgatcgtttcaaacttctcttgcagctccatctgccaaaagcccctctaccagttgccgtatttaccctggctgccaggcctctctcagctgccctaagaaaacagattaccgtccagagcaaagtcctcgtgtgtttcctttctggagatgaatcaagttctgaaagaaaggtttcctgtagcccattacaccatttcagtttgttttatctgtctccacctgcagagcagggaattaacctgctgcccagggccgggccagcgaatgcttggaaggaaagcaaagcgcacgggtgtgcattttttgacaacagaccatggccttgttctcctcagcagagcattgtccccatgaggcccaggcccaaatctgaataggactttgtgtaactcgatctgttttccttcttggctatagtctctgtgccaaatttaactgtggtctgtatatatagtgttgtgggagggtgggggtagaccagggaaggttgggggaggggagtatatccatgcagtttttttcctgtcttcctttttttgtgcttgcctgctttgctcactgtttgctatatataactcaacatgactgtcctcgcatctccagtcattaaccctttagggataactaatgcacctctttatgtaggcccctggctgggaagcgctggcactgttggagttaacgactggcccctggaaagtgaacttccccagaagtgcttgtgaagcaattaacagggccccactcagatagtaaaaatatcccctggcttacaaacaagcagagaagcgcctccaagccaagagtcaccgctgtgccccaggcatgtagtgggcgctccctctttgaaagtcttgtatcttagactttgcagaaatgctacgaaagctggtgatgcagcaacgatttcaggggagactgaaatctattgtccaactgaaagcctgtcagggctgggcctctctcaggaggtgaaccatcccaagggtcatggaaagagctactcattgtgggcctggggtgacagtgacccatcctgggtgaacagaagcctcacttcactttgccggagggagacagtaggctgacaaactattgtggaatctcctaaaattggttgctaaagggagcttctcaccagggccagcttgcctgggctcttctttcaaagggtggagtgttgtctgccagtccccaggctcaggggatgcaagtgaaagggcttcgggctttactgttcatttcctcagaatcatagaagtgccgaaaattacaaaactgcggtctccctgcaagggactcaagatgtcttgggtcatcttaggctatatttagaatggaaaatgtgttggctctgaggaaacagggtatgtgtccttctccaagcaggatgctatgaaccttgccccataggccctcctacccatcctcacagagccctgaaactcctcctccaggaacccttccagccagtgggaagaccccacagataggacccagtttcccctgtgaatcaacttctctagcacgtcccactgcccagggctgggaaggtccagtgtgcccagtgtggcactgttttccagggctggatgcatgtttggtcctccagtgggaactctgctatcgtccctgcttcaccaggagtgatgatggggacaggcacggcagagagtggacacagggatcctggccttagggggcagtcactcatccagctcacacttgtacatacgtcaccatggacacagaggttttcagtatgttaacgatttgcacagtccacatcagcatcccgttaactttctttttgtaaccctcagcatggttttaagaacctggaagtttattgcgtaactgttttgcttgtgaagttgcacatgatttctcagaaagatcaactcaaacccaccttgtcacccctctccacccaggccccacttcctgctttgctggggctggggggtcagaagtaacatagctagagacagatgtccatcatctgtgcttgtgatgacaaaaggaggtaacaggagtacagtcagaccctcactccttggagccctgttgtgagccgctcatggcatgcaccattctctgtcctcacaacagctcagacgggtaggaattattggattctttctctaaacgggaaaccaggggttttaggtgccttatccatggaccctgccctcacctccctcacccagtgcccccctgtgccttgctggctctatctgtgaaatttatccatggaccctgccctcaccttcctcacccagtgcctccctgtgccttgctggctctatctgtgaaatgtctcaagagtccatcctgttgtctcccatcccatgtctcccacttggcccacagtccagactcttacctgtccagactcctactccagagagagccggcaagatctttgggaaaggcacattgagccatgtccttctcccccttggaactcaacagtggcttcctgtcactctgagaacagaatgcagcctcctccctgtgcatgacaagcacctccctgaggtcacagctgtgtctccctgactctgcactggtccagtccagcctcaaggccttaaatttgccactccagacccctggtttggaccctggactctgaatacattctggtcttttcctcagggaggtcgaggcactgtcctagcttgtgacctgctcccatacctattttctcagggtggaagcagacgctccaactcccacactgtgaggctggtaccattacctccaagacccaaagcctgtaggaagtatagcaggcctcacccaataccctgcagttccctcacttgctccaagtgggaggtgggtcttcacgggtccccaagatgagggtcagtggctttcctctttcacaggctacagtgggagcgagtcttccaccatgggacctctggccagatctcagggctctgtggttgggggaaaatggctctctttcatggggctttaagacatgaactgacatgacatgtcctagagactatccagagagcatgtggatcactttttgctgctttagatcaccttctttaaaatcaatgcattgacatactttcagcacttaaattttcgtattctattatcgcatcatctcagaagaaaagtctttcataattaatgaatctcaggttgggttaaatattcagtggctgcccacacaccacttactctattgcttcaaaataattggctttcacttatcaggtctactagaatgactgtcttaaaccagtcacgtggtggaagcgtcaccatgtttcttgctcagaaaataccctttcaagggcttttctaggggagccggaacagtagccaattctagtgggacctttaagaaacaactttgcccaggatgatatttgagccccctaaagggccaataggggtccctctattcaactttccctccgagtcccaccaacctccccactttggttccatacagcttggattattgccctactagttcaaaactgaaagtttcaaataaaaaccaaaagacaaatgttaagtcacattgaattgataactgagacaatctgtcaagcatattttgctttcctgatttttcaaaaaaaccctaatgttgcaccttccttgttgtcagtttagtacgttaacatttttttaattaaacttcagtatcattgaacaggtcatagagtgtgagcaatattgtctttgttccaaaactccaaatgtaatgaagctgccattcacaattgttttccgctgggctgcttattttaaaaaaatgattttgatgaataaaaataggtgcattttcacagcgtggggtccagcaagaatgaaaaccttacggatcacagcccggcccctgggggtgcgggaggaggtgttgtcagatgtcaattttggctgattgtttttgaggtcatgagactgccattcctgtgtcctgtggtgcattttagagactgatgtcacttttttgagataaattattagagaaatgtttatagatgaatatacatttcacagtgtgccagagttgaggagtctaatgaagtttagaagggacactgggatgagggtgctgagctgcggtgcctgtggcctgtgacagacacctcctgcaccaggaggcaaggatcctgatggtcagatgctcagtccccaacaagagggggttcaaagccagtgcagccccttcctcccaccgctgggggcagcaaaggacccacagtggagattgcaaactatagcaggggctgtgctttgtgtttgttttcaatatttgagccatcatacaaaaatctagtgatttctcattctctatacaaaaaccagaagatctgggccacaaggtctgcattttccccagtatcagtctgctatggccccatattagctgcctagggcccctcactcctgctcctgctagaccctgtggatatttgagtcatgaccttgcctcaaggcttattcatgtattatttgtttatttattgttaacataggaagggtcttgctctgttgcccaggctggagtgcagtggcacaatcataactcactgcagccttgaactcctgggctcaagtgatgctcctgttaaggcatatttagatgggaggaaacatctttcttcctttagagcatctaattattggcatggccctggacaaattatcctagagcctggagcctcaatttgctcatctctgtaaggggggtgacaatgcaacctcatagggtggttgtgagtactacatagaaaaagactccagaaggagcacagggcctccattgggagcccctcagccaacactccctccttgctgcctgcacagcctcaagagaacatggagtcctttgggatgctgaaaactgtaaggaagacaactgtgcattctctgtgtaagcagtgtgcacactgtcttcctcctaaatggctagttggaggagtgaagacagactcactcagaaatgggtgattccctggctgcagtctcctctctgataacaaaggactgggcccagattagagacgaggcaggaattatgtgctgcagaaaggcggtggggacatcttgagtttgtttgtagctaatctcaaataattcaggtcttttccatttgcagcaaatctgattccctcaacacatctgtggtaaaatgttatgagtgcatgcggagaccaagtgtggaggggatttttttttccaccaccaaatccatagttaccctccaagttgtaatcttatcatatttaactggttccacataaacagatctatgtatattttcagtagtttcagctgaaacctgttaagaacagatgtgccaatggttccctggcactgatccatttaaatatattttttccacgaacaggtttttctctctccctttccttagaggggagaaaaaatatgaaagtggaaccaccattaaagtggatattacatgcttctgtgttctctgcaaccagtgtttgccattggttttccaacagcaatttggcacatgaggctatgaacacagagtgtgcatttgatggacagtatttgctctgagactgtgtggctgggagaatgggctgagagctctgtagttgctacctaagctagggtcagccagggttagtttttccctgctgctgctgctaagcagcccctgggcaaaggcttcagcaggccgtctgcctctttgagcctttagtttttcagttgcaaacaaaaaaaaaaaggtccagggagtgggaagataaagaactcctataactcagcaacaacaacctgattagaaaatgggcaaaggacttagatagatatttctacaaagatgatatatattaataaatggccaaaaagcatgtgaaaagatgactggcatcactaatgattagagaaaagcaaataaaaactaaaatgagacatcacccccacaccattagaatggctaatagcaataaaacggaaaatatcaagtgttggcaaggttgtggggaaattggaacccttctgcacttttggtgggaatatgaaatgctacagccactgtggaaaacaggatggcagttcttcaaaaaatcacaaatagaacaaccatatgacccagaagttccacttctaggtgtgtattaaaaaaaattgaaagcaagatctcaaataaatatttgcacatccttattccaatatagcagcattgtttgccatatccaaaaggtagaaacaacccgagtgtttacagatggatgaataaacaaaatgtggtctatacatacagtggaatattattcagccttaaaaggaaaagaaacagtgctatatgctacagtatggaagaacctggaaggctttatgctaagcgactgaagccagacaaaaaaggacaaatacactatagttccacttatatgaggtacctagagtagtccactgcatagagatggaaagcagaatggtgcgctaggcacggtggctcacgcctataatcctagccctttgggaggccgaggcaggcagatcacttgaggtcaagagttcgagaccagcctggccaacatagtgaaacccctctctactaaaaatacaaaaattagccaggtgtggtggtgtgcacctataatcccagctactcgggaggctgaggtataagaatcggttgaacccaggaggcagaagtggtggtgagctgagatcgcaccactgcactccagcctgggtgatagagactctgtctcaaaaaagaatggtggcttccaggactggggaatggagagttgtttaatgcctaagaatttcagttttgggggatgaaatgagttttggagattggtcacataacaatgtgaatgtacataacactactgaactgtacacttaaaatggttaagattgttgaaaagaagaaaataggggagagggtctaatttgtgacaccaacctcatcgatgggggaaggattcaaaagagaggtgcacattcagccagacactgagcctgttgcccgtggggattatgcctaagaggaatgagataggaggggttatgttttctcagctttgaatttctttctcaagaacactcctctgtccaccttcccattgcccacacgacagagttcaccaggcctcctagctctctaccagcctatagccatctgcaggaatgtcctcactgggccctttgggccatgccctgtgtctgtgactctggggcctagcactctgacccactggcctgtgttcctctctggttggaagacagtgcaaaagggacctattccaccttcagtggcctccgagtaacccacctgctccagtctgcagatttccatctcactgactttgccctggcactgggaggggggacgtgagggctgcaggtaggagtttgatggcagatgagcctcaggggttcaatgtcagctgggagaagcaaggccacttccagactcagttctgccactgtctggcagtgaggctctgggcaaaccattttgttttgtctctggtaaaagaaggctgtgggcaggattgggctttgtaattgccaaagattccagatctttgaggggctctgtcttcctaaattctgtgcagcctgctagcctctgcaggacagtatcagggaaacttaacatgcctgtgtttcgtagtgaacaggatatctagggttgagaattactgcgaacactgttatgttgtcacgtgagctggggctccatggtgatgcaccctgggctcccagaacaatgtgaagcactgagatgccctgcacctgggcctgggtcagaatcctggtagaggggtctttggcaaggacaggagaggacctccttgggattggactcagctgagcagcaggatgcctggttggcttgggaggtgagattagcttcctgggggcaaaaaggagccatatttgtcttaatgaggagaaaagagcaaaatcaaagcattcaaagaggataaaagaacacttcaaagaggataaaagaacatgttcagttcacaattactgcctccctaaccaggcaagtgtatgatggagaatcctgttatcctaattcaagaggacaatgccaaaggcttctcttgctggctgagaattgttggggagctccctgcccacggagggcctgtttgccagatccccagccccctgcagacctctgatctgtgaggagctggttctagtgattcacacttgcttgtgaaaaccttgatcttcatcaagcttttaaaaaaatctcatccgtattttttcccaattattttcctgcctgctcttttttttttcaaaagtaaacactcaaaagccttcatttctataactaattctggagtttacagaagcaaaaatcaataggctcaaaactccattcctttattcacttggctcagactggcttggggcagcacctctgagcccaagccagaaattgccaaaagggggttcctgtcggaatcttggagctcatcccccaaacttgagattactgagcaagtgagcaagatgtctctgtctggtccaggaagatgtcagccccacactgcccctcccagataaagagatcaacacgggacaggtcagtctctcccattctgtctccacctttgccagtctgcttctagatccccttcatgtactcatgttgctgccctccattcactagattttcaggatctatttatatccatccaccacatccaccactctgttttccaaatattatcacaatcagcgcagtagtgcttccccccgaaagactggcagctctctgacctttcttttcagctacaaatgaaaggggacttaaaagctgtgtgtgcatgtgtgtgcacacgcctgactaatggacacactcctcatgaaaaacaggataaattacagagaatggcaaagtaatgattacagaaaggtatatgaggcagaacccattagtgagctgcattttgttcaaaaccgagatactggcaggcagaataacatgcctttgtaccagaacgcattcagctgtagcaatgactaataaagtagcgaggatctgtgcacattttcccccttttgtgcctattttcataagttaataactcaagcatgaaaattgttttaaggctgaagactggtggtaagatctggtcaaactgtgtgggaaacaacttttgttgttgttgttacttaatttagtttggctgtttttaagttagaggagtggaaatgtcaatgtcaatgtgagtcttgcaatgtgtttttgttaagcccaagagcatttgggattgcatcatacaaagcacatttttaatgactagagatcatagtttctcttcctacaggtgtatgttcctatttggtacaggttgggattgttggggagggaggaggagatggaagcaaaatcttataaatgacatcatcctgggcttacccttcttcagctagaaaattcctattccaccagcaaatcagcctggtgagcaaacagctgccttagacaaatggggttgagtgtaggggtgaaacctgctgcaggattttagtaaattctcagagcaatggaaggaacagaaatatcatgaataattgtcatacctctcattcctacaggactcaggttttgtgagcattttcctgtccatagaaccagagaaagtctaagttaagggtaccagattttgcataactcctctttcttcttgccttttattttctttttattggatgagaagactttgaaagacacagaaaaacacagagaataacataaatacctgtgtagccacattctaggagtaacaactgtaatattttataatgcttactgcaatttattttttaaaaataaaataactgaagcattactgataaagatgtatcatctcctttatctcacagacaagcaaagtggatcagcaaaggctgcagtcaccagcatcttttccaaccttaatgaactgtatcctcaaaagaacactatcagactggtaagacaagcattattgtcccacttcacagatgaagagcttgggggccctgtggatgtgtaggagagtcggccttcctttttataggccttttgctgagctcagaggacagagcagaagacaaagccgaaagcagccctaagcagacactatcccagcccaaggagctatgcagacagctcctgcctagaggagaaacaattctctccttcagccaggcatgtggcacagaggtgaacaggaaatgcttagggagacagttcacagatatatatgtacttcacagggcacaatttaatccataaatcaatcatggatcactgctaaagaaaacaaaatatgctgccactaatttgccaccaccctgtgagcatgattggatgatgtttattttgattaggagattgctccatttataaatcttcaatacatcctgtccccctaaaacggcatctggatcttttgagggttaaaaaaaaaaaaagtgaaattggatgagggatgagagctggacttctgtgtgtcccggggtctctggatccacagcctggtgcctagcatcagttaagcccacgctggggtcgcatcacatcccgcaaagccacgtgctctgtgaggccaacaggagccccgccgggtggaccagctggaatctcagagagcgccgactctgaaaatacccggctctgcagaagcacgctgggcccagggggcttctagactgacagctccatttatcaactacctattggttttaaaaattggagtgtcttttccgcgttgactgattttggctctaagagatgtcgctggtcatttcagagtgactgaacctcccctctaacagatcccgggaattgttttcaggaaaggtaaaaggcagccttttctgtcacaacacaacgctgagccggcagcctggctctgtcaggatctggggctccagcgcccgagaagcccagcctcgccggcggccaagttcaccgcgaggccacgcgctgcctgcgctgcgctcccggacccgcaccgaccgcagcgcgcgccgccggtgcttctcccaccccagcctggaagctgcctccctccgcctatccctgcaggataagaagcccgaggaggcggagcatggaactcgacagttaaaacatttaagagagaaaacctagtgtcttgctggcctgaaatcgagtacgcagcccggggtgatcagggtctcccggcccggatgtgtgagacttgcttcccctgggcaataggcgatacgatgctttaggaggaaggtatctctccctcctaagccccggaggggagaacttccaaagacagaaaaccacagggttcctggcacagagctttccctttatcagctaaagcagaatcttttctggccttaacctggccccttcctctaactgtaggcagagaggcagacagaaaagcacttgctgaaacacaaagttttgttctgtcctcaacgaactgtctagagttgattgctgatagtcgtggtgcattatgccttcctggttttcatttaattgggcaccacgctgcctttcaagacgccttaaaggaaccaacaaccaaatccaagagagctggacagaccattgaacacacagtaggctgtgtctcgtggctttcgttgtctggtgcctcaaagaaaacaccagaaagattgtttctaagctagagccaccccagattgcttaaagtgcaaagctcactgctgttgggggtacccttgtgagacactggaaagctggttttaccgtggccctatgaagaggaagactgaaatttagacagtaatacctttactaggattggaaaagatttggttaatgacagccctgttatttctaaaacccattatcactgtatgagagattcctttgcgctgcatcctcgacagtgcttcctaaggtccgtcttttctattgtattcattttaatgggtgcatagccgtatctcgttgtgattttaatgtgcatctccctagtgactaataatgatgggacgcttttcatatacttgtttgtcattcataactcttccttggtgaaatgtctgtttagatattttgtccattttttttatttggattgtttgatttcttattattgagttttgggagttctttatgtattgtggatacaagttccttattaggtgtatgatttgcaaatattttcttcaagcctgtagcttgttctttcattttcttaacaatgtcttttgtttttaatttcaaagaaatccaatttgtcaatattttcttttacagattatgcttttgatgtaagaaatctttgcctaacctaagtcacaacaatattctcctagaagctgtagaaatttcaatctgtaatgatcaattttgaactcgtttttatatttatttatttatttattctttgagatggagtctcactctgtcgcccaggctggagtgcaatggcactatcttggctcactgcaacttccacttcccaggttcaagcgattctcctgtctcagcttcctgagtagctgggattacaggtgtgtgccatcacgcccggctaattttttgtattttagtagagacagagttccaccatgttgcccaggctggtttcgaattcctgagctcaggccatccacccgcctcggcctcccaaggtgctaggattgcaggcgtgagccaccatgcccgacccagaacttatttttaaatatggtgtgaggcatggagcaaagtttacttttttacatgtgtttacccaattgttccctcaacatttgttgaaaagacatttctccactgcattgttttatgtctttgtcgaaaatcagtgtatttttggactcttgattctaacgttccattgatgtttgtcttgatttatttttttggccttgaaacaacaatttattttcatctctcatgatattggaggttggccaggttcagctgggcaattcttacttgggttctctcatgcatttgcagttggatgatggctggagcagcaatctggaggctcaaggaggctgaaggccacatatgactccttcatttccatatctagcacctcagtggagtaggctggaacagctggggaatgattgagcttctaattctctccctacctcctatctatgtgtctagttttcacttcttcacagtacggcattctcaggaaagtcagacttcttagtagtggcttaccctagaatgacttttccaaaagcacatgtttcaagagacccaggcagaagctgcaaagtttcctgtgacctagcttacacatcctatagtttcttttgccatattctgtaaggaaagcaagttgctatggccagaccaggttgaaggagaagggtatgagactctacctctcgatttcaggagcattattacggagagggaaggattgttggttgcttctgtataagcaatgccaataatagaaggctccactgtcctgattaatgtagctttataacaagtctcaaaatcaagcaatgttagtccttcaactttgttcttcctttacaaagttgttttgactgtgctaggtcccttccatttacattcgaattttagaatcagtttgtcaatttctaccaaaaagaaagcccttatgaaattttgatcaagattgcattgaatttatggatcaatttaatgagaacttacaattcaaattattttaagatcaatttggtgaaaatttacaccttaaaaatattgagtcttttgacctatgaacctacttaggttttctttaatttattttagcaattacattataattctcaatgtatagatctttctatcttttatcacatttgccctattttatacgttttgacccattataaatggtatttttaaaatttcaatttccggttgttctttgcaagtatatagaaacataattgatttctgtacattagccttatattctatatttttgctaaagtcacatttttagttctagtagtctttttttcataggattttctgcatacacactcatgtcatctacaaataaagatggcttttcttctttatttccaatctcaatctcttttgtttccatttcttgctgttgcactggatagcaccttcagtacaatgttgaatttgtgagagtttctgatcttaagaggaaaacactcagtctttcaccattaagaatgatgttacctataggcttttcatagatgttcccttagcaggttgaagaagtttccatctattcttagtttgctagactttttatcaggaacgtttgctgagttttatcaaatttttttctgcatctattgagacatgcaatcttctagtgccatcattttacaagctcaagtgaagtgtagggcacttacctttctttacgtcctactatcctctctgtttataatataattgcttaaatattttctctgcatatatttaggatcacattagatagttataatttttacttcaactgtcaacataatttagaaaagtccagtgaagaaggaaagtctattatacataccaatatttttgcttactattatgttaatatgttctttcttccttactgatgctccaatattccttcctttactgtttgctttttgtttagaaaacttttttttagctgttcatttatagtatgtctgctggtgacagatacttttagttttccctctcctgagaatgcctttatttccattttattcctgaaggacctgtgattggggtggggctgtggtattttaagtggtgtttggctagagtggagcggttattgcccaaagcttttctgtcttgctgggctgccactgtccagctccttaggctggagagagcaggcttttgttggggccttcttggtctcatttggaatttctgagttcagtttcttcaactatatatctgggatatacaagacagaaagaaaccagggcactctccaccatgttgttcctccagtctcaagatctctagacagtctgtcttctctccatctttcagagtcttcttgtgcatgttttttatataacatctacactttttagtggcgcttagcagaagcaatgggacaagtatgtctactgcagctttctggaagagaagctcctcatttctttttttggatacatttcaaaagaagttgcaaatatatgaccctacacatttcagtatgcatatcattaactacagctcaacattagtttatatttttctttttcttgtgtgagatgaaaactatacatacattgccatcaggctttgcccaggcatcagaactcactagacagcagaatatacatctttgagaggaaccacagaaatgtaatgtgcatgctaaggcttttacctgaacatcaaaatggaaacatcagagtattcatattagagagcaaccttacaattataatggatgtggtaaggctttttaaaaaatcaatgttcaaagacatagaatcaaccaaaatggccatcagtgatagactggataaagaaaacgtggtacatatacaccatgggatactatgcagccgtagaaaggaacgagatcatgtccgttgcagggacatggatggagctggaagccattatcctcagaaaactaacccaggaacagaaaagcaaacaccacatgttctcactcataagtgggagctgaacactgagaacacatggaaccagggagaggaacaacacacactgaggcctgccactgcaggtgggggttcaggggagggagagcatcaggaaaatagctaatgcatgtcaggcttaataagtaggtgattggctgataggtgcagcaaactgccatggcacacgtttacctatgtaacaaacctacaaatactacacatgtaccccagaactaaaagtaaaataaaagaaaacaaatttcaaaaaataaaaagaaaattctaggtacattgaaatatgcaattcttacgtgcaccatttgatgagtaccacccacccctctgtcaagatacagaactcatccatcaccccacaagttccttcttcctccttcacagtctaatcccttccccagccacctcgcggggacaaacattgttttgttttgtttttttacacctcctagattagtttcatcttttctagaatgcagtatgaatagaagggatatcatgcactcttttctgtctggcttctttgtttcagcctaatgtttttcatatttagcaagttttataagtcatttgtttctgttgctgagtagtattccgttgtgtgcatataccacagcttgttgatccattcttctattgatggatatctgagctgtttccaggttttggctagtatgaataaagccaaagagagccattttaatttggggcatttaaaaaatggtgtgaataaactttcatctgaacacagggttccgtggtaataatgtttgaaaatatcacctccagctctgacgtgccgagtttgtaattttcgtaaatgatataaaaagtcatttcttcatccattcatttgttcactcaacccttatttagtgggcctattccctgtgccaggaatcattcaaggctcagtggggaagagaacaaatgtaagtaagtcggcctggtgcagttgacatgctagtgagggaaaagacaaaaacatcagttagtgaatacctgttatgacggaaaagaagccaggtaagtgggtagggcattacagttggtccagaggtagtcagggtgtcattttagctctggaagtagggagaggaacttagggagatggtcaggggagggacttatatgatttggatctgtgtccccactcaaatctcacaccaaattataatccccaatgctggaggtggggcctggtgggaggtgattggatcatgggggcagtttcttatgctttaacaacatcccccttggtgttgtcacagtgacagtaagttatcacaagatctggttgtttaaaagtgtgtagcatgtccctctgtctctcttcctcctgctctggtcatgtgaagatgcctgctctggctttgcattctgccatgagaaaaagtttcctgaggactccccagccatgcttcctgtacagcctgtaaaactgtgagccaattaaacctattttctttataaattacccagtctcaggcatttccttatagcaatgtgagaataaactaatacagaaaattggtaccaagagtggggtattaccataatgatactgaaaatgtggaagcagctttagaactgggtaatgggcagaggttggaggagtttggaggactcagaagaagaagggaagatgaaggaaaatttggaactttctagagacttgttaaattgttatgaccaaaatgctggtagtgatatgaagagtaaagtctaggctgatgaagtctcagatggaaatgagggacttattggaaactggagcaaggtcacttttgttatgcattagcaagaggttggctgcattgtgcccctgctttagggatctgtggaactttgaacttgagagtcatgatttagggtatctggcagaagaaatttctaagcagcaaagcattcaagatgtagcctggctgtttctaataacctatgcttatttgcatgaacaaagaaatgatctgaaattggaacttacatttaaaagggaagcagagcatagaagtttggaaacttgcagcctggccatgtggtagaaaagaaaaacccattttcagggggaggaattcatgcaggttgcagaaatttacataactaaaaagaaggcaagtactaatagccaagacaatgggaaaaaggccctgaagtcatttcagagagcttcatggcagcccgtcccatcataggcccagaggcccaggagggaagaatagtttcaggggccagaaccagggtctctactcccctgcacagctttgggacactgtttcctgcatcccagctgctacagctccagctgtggccaagagagcccaaggtacagctctggatgctgttccagtgggtgcaagccataagccttgatgactttcatgaggtgttaagcctgtgggtgcacatagtttaaaagttgaggcttagaagcctccacctagatttcagagaatgtatggaaaaacctggatgtccaggcagaagcatgctacagggttggagccctcatggagatcctctactagagcagtgcagaggggaaatgtagggttggaccccccacacagagtcttctttagggcactacgtagtagtgctgtgagaagagggccaccattctccagaccccagaatggtagagccacaagcagcttgcaccctgtgcctggaagagccataggcactcaatgccagtccatgagagcagctgtgggggttgaaccttgcaaagtcacagtggccaagctgcccatggctttgggagcccaccccttgcaccagcatattctggatgtgggacatggagccaaaggataatattttggagctttaaggtttaatgactaccctgctgggttttggacttgcatggggcctgtagcctctttcttttggctgatttctcccttttggaaagggtatatttacccaatgcttataccgccattgtatcttggaagtaactaacttcttttttattttacaggctcataggtagaaaggacttgctttgtctcagatgagactttggactttaaacttttgagttaatgctgaaatgagttaaaagactttgagggactgttgggaaggcatgattgtattttgcaatgtgagaaggacatgagatttggggaggagccagggtcagaatgatatggtttggatatgtgtccccacccaaatcttatgttgaactgtaatccctagtgttggaggtgggacctggtgggaggtgattggatcatgggggtggtttcttatggcttaacaccagcccccttggtattgccatagtaagagtaagttatcacaagatctggttgtttaaaagtgtgtagcaccttccccctctctctcttcctcctgctctggctatgtgaagatacctgctctggctttgtcttctgtcatgagtaagtttcctgaggcctccctagccatgcttcttgtatagcctgtagaactgtgagccaattaaatctcttttctttacaaattactcagtctcaggcatttctttacagcaatgtgagagtggactaatacagggaccttttaagaggaagtcataggagagtttttggagaaggtaaggttggaagaaggtacaaagaaaaaagcttatgtctttaaatcatcttcattcctgataattcagcacactttagaggcaacttccaagtcagctgttgatggtagtgaagacccaaggcccagagagggagcaactggccctagagttgcatgatgagtcttcagtggcaaggccgagattagaggtctgtactcagcattcagctattggtggacagaactcgtcctttgcttcctaagtgcggcttcagtcctgtcatggccctgcacttccccgattccctgcccactccgtccccacttcttcaggtgcttccccatgggaactggtagaatagtgttagaaagccacatccatagtatggcctcttgaggatttctggtttgtgtgactttgagcaagtcctcccctgatgttggaggattcttacccctgaagttggggaaggagtgaaatcttgatggtaggacatccgctcacatgtcctttgagacttaccacgtttgtcaccatgtatttagcacagctgcctttcatctgcgaatacagcctgggagctctttatgttttatctaatttaattcttataacaatcccatggagttgttaggtagtaaagtgctctctctgtttttacagatggaaatctggagactgagtgaggttgagtaatttgcccgaggttggcaagaggctaaagtagaattctaaaccagatctgtttgattctgatgctcttgcttttagccacaatgttttagcatctgttcaattctgaacagacggacagaatttgcagaggtcagagggaggttctagaataaagctgttctctagtttacaggacagaaatggtggtagtgatatgcctgtgccagttctgggatgtgcagctgggagggaagccttctgtggaccaccatgtaggagggagagcatagcagggtatgatgggaggagcatgggttctggaattgaaaaatcctgtgttcaaatccacactctaccacaaatcccacgaatggaggacatttggacaaattgttgaagccctctaagcttccattttcatgtctgtaaaacgggataataatggtatctccctagagggttgctgggtaggtacaatgagatgatgcaaataaagtacttagacaataccaggctcacagtaaatgcctaataaatgctggctgttgtttttattcgctattgttttgaaaaatggcaggcactacagacatacaaagtgcagagagtggaaagacaacaatgtgttttagggccaggcagcccagagctgcccaggctggcaccctgcccagaagtgggagtgatctagcagaggccagggccttgcaggaggatttttgcagacacccaacttcctgcatcagtggggtcgagtgatctctggagtgccttccgacctggagaggtcatttcaagtctctgcaacggtagcgatggtagctccagcaagggagggagaaggggcttccactggctcttggacactccagctgtcatttttgggaatgtgcttatctgccccagagggaaatagatgattgagaaaggaggcaaccaggggacttaggctttaccagcagtgacctactagctccggtgtgtctgcctcagacagcaggccaaggctagtgtcacggcagtttagggggtcctgcacattcactgtgccaacgagcggtattttgcaaacttattataaacagattatatttcttatcctaatgtggctgttggctacctgcccatgaattttagcctccaggagaaaaacaattgcttgagctgagtgttctgtgcttttactttccatacattactcagggctccttccagttcccccaacccttaatctctctctttctctctctctctcgctttcattctctctctctctccatctttttccttcttttcagaaagtcctctttcatcttgggcataactagaaaatctgtaagctgtgctttctgccatgcattagccaacagggtcctttcctcccaagccagggaagaaagcacaaaaaccaatgtccaggctgggcctctcagggtccacagcatcacaggcaaaggaagtaactgtctccatgcctaccaacggatccacacacatctcgctgggcagcatctctgccccaggaagcagcgcgcttactacactgggcacccagatgtctggtcttgcgtggcaggcagccactttctcctggccttttcttgtcccaaaagtcagaggggcaggccagttccagaatgggattccaggcagaccaggagactaggagtgcatgtgaacaactgcaaggggatgcgtctgtctgcctggtgtccgtgtgttcatgtgcacacctgtgcacgcgctcccccagacttacacactcgtgaacacatgctcacacaagttcatgcacgggagtagctccaagcctctcactcagcactttgctattaatagctcacttttctaaaaaagtctgcttagccgtttgtaagaataaccaccactgcctgtgtgacagcccaggcccccgcagggaggacagggccggccctctgctaggactgcctgactgcctgcctcatgttagaatccagagggagggccaagaggggagatgaaaacccctcctgagtggccagggcagcctccagtgcctgtgcccagggacaaggcaactcactggtaatgtctgcgggcaattggccaggcccctgagagccaagatgccaccttcttcatggtgacagcagggagcatgctccatgaaaccagaatgagcctgttctccactctggggtcctgctgtaaaagccaagaagcagagagccaagctgagcccaccaagagcttggcacgaggctgtcacccacaacttctcgctgatccaaaagacaggctctgaggctggaaattcaagtgtggtggtgctgtgacacagcacacagccaccgtgcacttgtgtccctggcagccgcaatccgggcctgagagggcccagtgtctgtgggtgtttgtatttaattgcagtggggtgagaaaggccaatggttgggttttatttcaaacctgctttgaggagaagtaacattaggtggcccagagctgtgaaatgtgtcctggtcataaatgcctcaccatcaattaacacctccagaatacctaagagttgccagcaacttcccattcaaataacctcttaaaccttcctccacaccacactgcccattccctcgcaggcagacctgcatggtttgatgacgactggtcacactgctggccctatctgtataaaagtccagacagttgggctgtgaggggaaatgcctacctcagagtagcttaagaaagaaagatattggtttacttctgaaaagctcaagaccagctgagtttaatggcatcattaaactcattagacatggggctgggaagtggctgccagcagtttggtgcacagcctgtcctctcagcagcccaggtggcaggtgtcttgggagtggcaatgatgagaccagctgctcatcctgggctggtcattgtgactcagatgtggagtgggctggttagtggttctgggccacttgtccatctctggatctggcagctccatctacacagtgtcgggctaggcatgggagcattctgggccaggagaaaggggattggatcctggatggtgggaaccgcaggtgtccccctccacgtgcctgggtccaagactgctctgctctggaccttctacgccttcagaggtacaagttgcagtgctacccttgctgaacctacaaccctgttcaagtgacaacttctctgagtctcatacgaggatattgaaagaaccttctgcacagggctgttgtgaggattaaccgtaataatacaagaatatctggcacttgcattcagcaactcaccgcttacttgttcaaccaggtaaaaaggttctgatcccagtgttgcaggacagaaagacctccccctctgtagctgcagatgtgacccagcacagaaaaaatggcaggtgaaagacaggcaggaagagcaactaagaaggtgggaggcacctccataagatgcctgaggccatggggatgaccgttcacagagctagtccctcgagcaatgtgttaaatctactgaactgtgataaagcaacttctgggtgaattttgtcctgctacaagttgtcatggaatggcaaggtggcagatctcagaagtggatccaatggtttttttttagttaaagcagaacattcctggggatggtgtcaaactcccttccatactgttgagtctgctgatgattacactggcttctcctctttgccccatcatttcacaggttcccatcttaaagaggaagagaaaggaaggagggaacgaaggaagggagggagggagggagggaggaaggaaggaaggaaggaaggaaggaaggaaggatggaaggaaggaaggaaggaaagggagagagggagggaagaagagagggaaggaagttatcaaacccaagctctgtgcagagcaggagacgtttccatgggacccctagaatagataggttcttgctgctctcctggtggatggagatgcccaccagtagctgtgagagtctccccgaaggcctgattgtggctccaagttccgtaggactcactagtctttttttccctagagggtcttgccattgagaggcaggtgatgtgctgtttcagaaaacaaaattgggacatgtcctgatatgacatccatcaaatatatacagataggtgtcacagcccccgaaaaagcttatctcttctaggccacacatagctatttcctccaactgtgtcagacattacaaagtttctagcaatcaaaacaagtcaaatgccattctcaggacccgttggaggattttttgctttgttttggctttgtacggtatccataccattttccaaattcttttgtccttacatattttgtttttcttaaaaaaaaaaaaatcacctataatcccatcaccagacaaaaccactagaaagaaaccaacattttagccatgtttttctgtatataaaaaaagtgtgtgtggaatttttcataacaatattgggaccatgacatctatcacattttttattaggaaatggccttcaacaatatgcatttaacaatatgcttgatgtctgtgtaatatttcatctaacaaatatatcatgatttatttaagtattccctgattgcttgcttctaactagaaaaaacaatttttctaagtgtcaccactgggttagagtaatctcagccaatcctcctaatagcactgtgagaccagagttatgataatcttcagttaatggacaagggacatgatggtgtggaaggataaataaactacccaaagacaactagctagtgagaccagcatggacagtcaagcccagtgcatgtaatctgtgctcccctgcactgttgctcatatacttggacccttgcatacatgattttcttattcatcttgaaagagaaatgttagcttactgtttttatttgcatttatttcgttgcttttgagtttgagcatctttccatttcttatagaccatttgcatttgttttcctacaaaatgcctgttcatggcttttgcccatttttctgttagccttgtcctatgtatacacacatgtatattattagttcactatctgtcaggtaaattccccagttttcttcttgccttttaatgttgttatggtcatttaggactagaaagttttaaatcttgtatgcctatcagtattttactgtgtgactattcccattatttttatgcttagaaagttttcattcctatcaagtatagataaatgttcagttctactattttattttaactgtgcagtgggttcatttttggcattgaattaattaatctatctggatgttatcattagtttccttctgaaaaagtcagtccaggctgggtgtggtgactcacacctgtaatcccagcactttggaaggcctgagtccaggagttcaagaaccagcctgagcaacatggcaaaactgtgtctctatcaaaaatacaaaaattagctgggagtggtggcacatgcctgtgttcttagctactcaggaggataaagtgggaggattgctggggcctaggaagttgaggctgcagtgagccatgattgcacccctgcactccagcctcggtgacagagcaagaccctgtctcaaaaaaaaaaaaaaatgcagtccagatgtactggaacaagcttgtgtgggatggctacactcctttcctgttccaacacacctgttacctggatgagctcctatatccttatccaggtaccagatctgccacacctggtaccggcatgagccctgtggggaacataccagcagagacattatacttccaccgagacaaaataaagccacattgacttttagtactcatattattgactgacattaaacccatggcaactaaaatctcgttgttgttttttttttattctgggggtgagggtacaacttttagagaaagtatctctccctaagactgccaatcactctaaatttgcatctaacacttctacataactttatctaccgagtaggcagtatttaccgtctgctgtttcatcttgtagcataattttcttttatatttccaggtgtgaaaatattcaaactgacccctaattctcagctttcagagctatctgctacttcccaggtcactttggtttttaagcgctttcacatgctgttgttggacatctgggttattcccaaatcttgttttcacgtaggcagctgtcaagtcaagatagccatggccctgcctgacatgttctttaagattgcattttatttttattattttattttatttttcttggagacaagagtttcactctgttgcccaggctggagtacagtggcatgatcttggcttactgcaacagatcttgacttactgtaacctccgagtcccaagttcaaatgattctcctgcctcagcctcctgagtagctgggattacaggcaccagccactatgcctggctaatttttgtatttttagtagagatggggtttcaccatgttggccaggctggtcttgaactgctgacctcaggggatccacccagcttggcctcccaaagtgctgggattacagatgtaagccactgtgccaggctgcatttttaatactgtgtttttcttgacatatattccaactaaattcttctgggtgttgttggtttgacctcatattcggtcctattgaaatgaatttgaatcattcatgatttggttatttattgcattcattgtccttctcagcttctggttacccacacattagacacaagtgcctttggcatcttttttcaaatctacagatgaggaaactgaatcccagaatggtggagtgatttgacgaatattgcaaaactataatggggagatgagatggggatccaagtcttgtgcccccaaagacagggcaccaggcagcgtagaggtggccagtaccagagcaacagcctaacaatggtatgtatgtcacacacccagctcactcaatcctgaccacaaccccccactgctctgattcctgccccatcagtagcgtctgaaaggacatctccaagttcaccttcaaggacactgttaaggctgggccagtagaaggaatatgacccctggcactgtcccccttcataagacttcaaagttcatcatttcatttgggcatcattttacaatttgctaggaatccctcttatcttattttcatctggtccatattcctccgtttcaaaaacaagactatcctgaaaaactgtcagctgcttgctgaggttatttttggtatacagtacttaccagagtcacctggtcagcattaatcaccccatcatgaaagatttatggttgtttggggggtactgaacccatgttgtaccctatgttttttctgaaatattttcaatctagatggtcagtagttctagaatattccctcagggattgccatcgacaattgaccatttttataaatgttagaaatggaccgtttgcccaggagagggcttccctgtgttgagtttctgtgttgctgccaggtcatcgaagagttttcattgttaaacttgtgtagggcatccaagcaccaccttgctgtcttctcaccaggccaggggtccaccttttggaagagcatctttctaactagaagagagagacgtgaagttgaaattacttggctctgcctccttttttttttttttctcaagtttctacattttagcatctttcctgtgtaatccctttcttgtcccactcttcaaatagctttgaaaacccttctgagatcacgggcctattttcagcctctgcttggtgtgggcttttggtttcccagtgtggttctcacaggttcaggcccccccaaccccggtattgactccatgtcaacttctcatcttctgggtatgcctttctgaaagtctgagatcaccagtggtaccctgtgtggcccacactggatttttctaactatttcctctttttggtcctcactgggcttattcaggattattgacgatacatatgcagaatttggggttttctcctaatctcttttctcacttgggatctgtgtgtgttcagactccctagccccagccctccaggttaatattgtgtggcactaggacattagcctcagtttcttcaatttgatataattgtgtatgataacagaatttacctcctggagttgttatgaggattgaaggaaatagtgcttagttgtggttagtattaatattattatctacctattactgacacactttgtggttataagtgacagaaaactacctcaaactggcttaaacacgaaaagagaatctgttgctcagagaagtttcccctaggaattaccatcaagcaacatccaaaggtagacctggctttcggcacagctgggttcacagccctggtaatgtcctcaggactcagttgtgtccatctggttcctctgacgctctgtgtggaaggaggaggtggcgcagcagcagcctccagcttggcatagccatggtggggagcaggaccccagcgcttaggtttggctcctatctcagcaaactggtgctctgccaaactgaatttggaagacttgctttcccagagaagagagcacatgagccttcctgactgcgagtgatattgctgacacaaactggacacttcctccactctgtagctaaggggcagctgggcctttcaatgcagctcttttctagcaagggagaccccaccagaattgagatgggtaaccccgagccctgtgcacaggtgcctgcttttattccctcattcatctcggtctgaacattcctgaccttgactcttgcctgcgacatcctctgcactcctccacatgctccactcagctcgctcctgagagctggtaattaatcggccttgtctttaccctctgaccccactgagcctcccagatgggtttccacacctggcaaatgaccttggagttactcctaactttgtcccacaggcctgctggattggatttaatgtttgcttgctaacttctctgactcttgacctggtctggtcacttgctgtggttgtgtgtgacacctctgtgttatacacagtgccgggcattgctttttcagcagcctggaatccactgcctcttctttccccaattcgatgtccttttgtggcactactctctcactgggcgccgtcttcatggtaaatccaggtgcttttccccctgcgtggaagtggaaagttgtccacagtgtctcctcccttgccccagggtggtcctgagctgagctgagctgagtggtctcagggggagggacagcaggctgtttgttccctgtagaggcgcttgatggtggagcgctcttgtcccagttgaacctggttctccagctcagaatccagcacccctgttgacctcacaagctccttcatagcttccaattcattcccctccctgcttgagtcagcaagggtcgttccttctgctttcaagagtcctagctcatattcctgtgctgtgctctatcttccctggctttatagatttacttgggctcttttcactcctccctctgaagttaccaattgcactttttctggtctcatgggctggcctcctgcagcatgctctgctcttcccagctttgggccagcacttcctgcttcctgccaggcccccgctgttctgaggtggatctgggctgcagtccaggagacaaaattctccactgtgacaccatctacatgcccagatgttccctccatgtacttcctctttctccttttcttttccaaactcacaaccttccagtgagagaaggaatgaaaacaccacctgtaacaccaattcctccaatttcctccccagaacttcaaagtaaacagaaatgtattgggcttagactgggacttatggatggtcagagttggaagaagccttagaaaccatcacaagcctttgctcccagggctgtctctgatcgtttggttgtggctgactgggttgtcacatctggacacaggaagaaaagtgctgggagtgattcccaatgtctgagtggatgagggaagggggagtgacagcatatgagctagttatttgcccgtcctttaacaatctgctctgtactttacaaaatggggaaactgagtcacacatctatcaagctgtctaaggccacacaggaagtcagggcagatttgggggtagaatccaggttgtccagccttctctatcaacaacaatgacttctctttcccattggaattcactgtcataggatgtcatctaagtccacttcctgacagcatgtgtgtctcccagtctgtgatgtcatgctatactcggccacctctgtacaggacagtgtggcacgaaagggatcctgctggtgcctgtggggctggggctaatactctgggacaactttcagaatcacagttcttctaccctaggacaagagggtggtatacagccaaggaaaggtggtcctgggctctgcagccatggagctccagggtttggaaggtgccgtggaatcttactccttagtttggacttttgtcaaactgcagctggaaaaaaattagaaattgctgctccaaatggaacatactccatttcattccaaatgagaagtaaacaaatagacgggtgagcctccccaaaatgataaaactcttcacacttaagatgagaagtcagttcaagtgcagtcctggcgtgactcactggggtttgctgcaggaagataggggcgaaatgtcctcatcctgcctatagaagccagctccttattttaaatcccatcctgcttgactatcaaagtcagacagagccttcctaaaagctgaaacacacgcacagaatgagaagtccctgcgggagcaagttcactgtggtgagaaccttgcagagcagacagctccaggggccagcggctgcctgcaaacacttgctgagcaagtccctgggagaggggcctttctcccaggccaggaacgccaaagtggggtttcctgataaggaacacagaactgctgtttcttggagagggagttcacacggactgggatccattctcaggctgggccttagtagtgggacagcatcctgttttattaaaagcctgttgctggcagggaaagccatctgcctgctgagtgggcaggggcccaagatcgctgtgggcaattccaagccagtactgggagctgacatcaaaccaggaaagaacacgactgtttttagctgatgtagcagtacattttctttctttccttctttcttttttttttttttaatagttctattgcccggtttcactgtgtacattttgtgtgtgcaggcatgcgtgtgacatcctgtacccagctacagccgaggttcactctgagatgagcccaccccacttattctccccttctccctcctttccccacctccccctcttccccatccttcccccactgacctccccagctctaaaacccctgatagacataaagaacagagggaaacccaggctgtaacctggggttattcacagggttggggtgggtgagagaagaaaaacagacttctttgtttatcttttgagtcttgaaattctaaaaaattcattcatttccaaggaagccttaatttgtaggattccaagaaatttaaaaaaagtaaagggagattcacttcaaaagaaactaggggaaaagctgttttcttttttagctgatttgttcattattcttattttatttaaagttaggtttgttgaaggcaggcaaaggtagtcactttttcatatttgtattacattcttactttcttcctccattgccttatcagttaagagggcaaataatatttcaagagactgatagaatatgttctgcactctgctcatttcatagctctctggggaattggggtttttataaacttttataatcacattttctgctgaggttatagatgactccaagaatcttccattcatgctgtaaattaaagtgactcaaattgcttccacttttacaaattaaaaaaaaatgtacttctatacagatttttaacaattaacaaaaggccattttaacgctctggttggttgcctgtacgtgatttttctggcttttcttaaaatttggagtgaacagctcccatgtcaaatataacatgttaacttattggcttctctttaaccctgcacacaaacaataaacttttcatgtagagccagaaaatggtatatgttgtgaacttttttttttttttaaagatagagtttgtggtgataaagggatttcagaaaaaaaaatgtacttgaaaatatgttacttcacattggaacattcaattttatcttaaggatataaatattcaattttaccacattaatctttgtactgagataagccaaaaataacgtaaactgacaattgtttgctatacattctaatattttacatatttataggagttttccaagtcatgagatatcatataaggcacacaaaaaaagaatgacataaatcatgttaagtgcagtctactttttcctgagctatatctttaagacaaaagatatttaacaaattgaacttgttttttgtgggagggtccactctctggttacttaagagaaaaccagaggattatcttcgtggtgaaggaaagtgtatagaaggcagtattttttttttctgttataaagggccagggctctatccgttggtgcagtgttctgccttttgtgtttttttctggttaatttaaaacattagctccaagtttttaatgtagtagtttcccgtgagtcactgggctgaaagcccatcctatctgtgtcaggcaagggtccaagacaagaaacaaggagaacacagatataagaaagctttattagtgcagctaaacattgataattaggaaagttccagttcttctatggtagtttatttgtagataaatgtagttgtaaccttttggtgccaaaggaaaaactcctcattcaagacaagggatacggaataggaagagctcaaagaaaacacagttttctgtgttacagacaagtatttacattactaatcaacttttggttcaggaaagaagtgataatctgtttagatttttaaaaggaattcaatatcctgttgactaaatgcagagcaggttcagaggaagacgactgttgaataatgcaattgattccttccaagaaagcatagggtgtagtttttattataggaagtgccatcgatagtactttttctgctttctggaaaatcacccaggaaataaaatttgttttaaacattatttttaaaacaggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatggtaagttttctaagttttcttttcgtctcccatatacgctgggctgtgctggaatcaccaacaggcacagaaaaaatgacaacaaaacaacaacaaaacccccaagaatatcctgttgtctttggccaaagttcaggaaaggggagccccaacagagacccagtaggaagctctagcccctgttttgtacaacccagggtccttgcagagagattgatctgccagcagtggcatcagcagcaatagtagcagcagcaaagccctggacagtcctggcccccagtccacaacttagacacagcacatggcctaattcacccacagaagcagccactgtgaagccctgtgtctccccagactccatccagtggcataaggagacccaggccctgcagcttcctccccatcatggaaggctgtccatctacagagtttccaaacataataagcactaaggaaacaacataacatgatatgccgaaaaaaaaaatcacaattaaatcaaaatgaaacatcaaaaaatgtccaagtaaaccacaggaaggcaagaaaaaagaaacaaaagtgtaataaacaaaaggatcaatcagagaacaaataataataaaatatcagacttagtcctaatatatcaataattatcttaaatgtaaatgttctaaatgcatccattaaaatgcagagattggcagagtgtattacaaaacatgacccagctatgtgttgtttacaagaaactcacttcaaattcaatgatataggtagactgacagcaaattgatggaaaaagttataacgtgtaaacattagtcagaaggaagcacaagtggctatgttaacatcagaaaaagcagacttcagagcaaagaaagttactataggcaaagagggaaattacataataacaaaaagaattaattcaccaagaagatgtagctctcctgttgtgatgttatgatatatgtcggttttcatccgtgggtcctggctcataactcccacatcccgtgttagagtcttttgttatattgttgggggtgttaggcctcagggacaggcctctgaccttctcctgccttcctttcactctaatgttctcccacctttctgcctttctcattgtggatcttaagaccctcccatgagacagtcccaccctatatcctgggggaaggaatgctgacatcatgaagcttccataaaaagccaagaggacaaggttgttaagcttccagatagctgaacatgtggaggttcctggagagtggtgcacccagggagggcatggaagctccgtgaccctttctccatacctcaccctaggcatctcttcatctgtctcctttgcaatattttttaattataaacccgtaaacataggtaaacatttctctgagttctgagagctgctccagcaaattaatcaaacccaaagagggggtcatgggaaccccaccttgaagctggctagtcagaagttgtggaggcccagacttacaactggtgtgtgtatgggggcagtcttgggggctgaaccttcaacctgtgggatctgactctatctctgggtagatagtgtcagaactgcattggaggacacccagctggtgtccgctgctatattctagctgattttctccctagtagtcctagtagtcttgagtgtggggagacagtgggggattgatgccccaaccacaattgtggatttcttctttcagctgtcttagtttttgcttcagatatgtgaaagtctgttgtttggttcataggtatatagagaaaactctccctagctgtgtttttcttctgctgtcacaccatgacaacatcaacacagaagcctttcttcatatcgtataagggcacaaaaaaggaatgacataaatcatgttaagtgcagtctatttttcctgagctgttatctttaagacaaaagatattcaacaaatagaattttatttttttgcggtgtggggtatccactctctggttacttaggagaaaaccagaggattatctttatggtgagggagagtgtatagaaggcaatattttttttcttttataaaggcacagggctctatctgttggtgcagtgttctgacttttgtgttttttctggttaatttaaaacattagctgcaagtttttaatacagtagtttcccatgagtcactgggcctttcttctgtgttgatgattgtggtgtgacagtaaaagaaaaacacagttagtgagcattttctctacatacctatgaaccaaacaacagactttcacatgtctgaagcaaaaactaagacagctgaaagaagaaatccacaattgtggttgaggcatcaatccctgctgtctccctgcactcaggacttctaggactactagcaagaaaatcagcaagaatatagaaaaactcaaccacaccatcaactgacaggatctaattggcattcatagcacaatctgtccaacaacagcagaatacacatttttttaaaggtcccatgagacatttaccaagatagagaatatcctagatcataaaacaaacattaaaaagttcaagagaattgaaattatacagactatgttacctggccataataaaatcaaagtagaaatcaaggcagaaagtcaataggcaaatctccaaacccttggaaactaaacaaaaaacatttaaataatccatgcatcaaagtggtaatctcaaaggaaattttaaaaagacaagaaaagaatgaacatgaaaatatgacatgttaaaatttgtaagattagctaaagcagtgctgagaataaaattgataggagtaaatgcttacattagaaaagaggaatgatctcaaattactaatctaagtttctacttcaagaaattagaaaagttgagcaaaataaactcaaaggaagcagaaaggaggaaataaaaaagagcagaaactaatgaacttgaaaactggaaaaagaaaaaatgaaacagaaagttgtctctttaaaagaattaataagattaataacttttagcaagaatggcaaatataaaaagagagaagacatgaatcaccaacatcagaaatgaaataggggacaccacaatagatgtctttagctataaaaagataatttaaaaactgtaatcaactttatgctcatatattcaacaagtttgaagaaatgggctaattcctcaaaaaccacaaagtactaaaacttagccaaggtgaaacagataatctgaatagctgtgtagatatttctaagaattggatttataataaaaatactccccaaaaagaaatctccaggtccagagggtttcatccaagaattttaccaaacattcaaataaaaattaatgccaattctatgtgtatcttccagaaaataggagagaagagaaaattaggaagttcccaattctctttatgaagccgtcattactctgatacccaaaccatctaaagaaagtatgcaaaaagaaagctacagatcaatatctctcatgaactttggatgtaaaaatcaccaatcaaatgtaattaatcaaaatccaacaatgtataaaaagactaaagcaccatgaccaagtgaaatttatgccaggtagacaaagctgattcaatatttgaaaagaaattaataaaatttatcatagcaacaggctaaagaagagaaaccatataatcatagcagttggcaacaaaaaattatttaacaaaattcaacacccattaatgatgaaaatagaaaatcctctcaaatacactaggaatagagggagacttcctcaacctcataaagaacatctattaaaaaactacatcagacattgtatttcatgataaagacagaatacattgccttatacaatccaaaacaaggcgaagatttctactttcatcagtcttattaaacacagtactagaagttctagccactgcaataaggcaggaaaagggaataaaggtcatgctcattggaaaataagaaatgaaactgtctccttttttaggcagcatgattatttaaatagaaaatcccccaaaaaatctatgaaaaataggttgtcctccttctgttggctacattgatcaggcaagtgctgctagttgttcttaggggttctgcttaagtgctgcaggagatggcagcacagaagctgaggcacagcttgggcatggtagaccagggggacacccaactccattactccctagctctatgcccctgaacaccttccttgatccagctgaactttggtcccctcatctgcaatggtgttgatgatagaacccagaggccataattcttgtgagtattaaatgagagcaagtgtgtagtaaatgtgtcattgtacttgctgcgggtactgctgctgttgctgcagttgtatgtgatactgtgctatttgttctgccactcccaggcactgccactggagcccttgttcagtgatcctatgacttgtcagctcagtcaattgctctgactcttactgctttcatttatgaaatggagacaataacccctctctcataggaagggtaagaccagaagagcctacactatggttggaataatatttgtatacagtgatcaagagaatgttctctgaaaccagactctctttaaatcttacctctatcacttattagttatatggctagctgttaaatgaggtcaaaagagtgtgttcttcataaaactatacagaagattaaattaattaaaacatgtacagtccttttaaaaaagatcaagtgaaacagcatacatgaaagtgctttcagcacgctgagaataacaatagcaatggctagagattatggagcactccccactgccagcaccaggggaactttgtacctacaactttttacttagtccacataaccatgaattcgtctcatttatgtagaccgggaaacaaaagcctagagaagtaatttgcccaaagacctagcttacaaagcaatagaatccaggtctggactctcgggatctgactgtgttctaatgcctcccagagaaagtaggctagagagggcaggaatagcttgacttagagatcacttccactggcacggtgggtacaatctgatgtgggaggctctgggtgcagcctgtgatggcagagtggaggagccaggagtcattcttggcctcattgtcactgccttcaaactaacaagttgcctgagagctaaggttccatttgataggacaccgggtgggatgtgcatcagaatatccatttccttgaaggatccaatgattaggctgaggcaaaatgttttagaccattcccaggtctaaaaataactccatcatcacctctaataaggactcagtctggagtgacatcactccttcaggtgcagaaaaggaaagcatgactgtgtgtcactgacttaaaataggagtgaggtgagaggggcagctgggctcatggacgtcaagtggacagtttctcagctggtatttcctatatttcctgttttggacagcaggttcctgcccttctaagctgggggtaggggtgagggagtgtatgttaaaaagctctgtggacttgctttttctcttctccatgtgtgttctttccatcaataatctgcgttcatctttactggctgttcatgcattatctggagatacgctagttacagaaattcaaacaggcaactcttcctctttctccctagctttacactacagatccatgaagttttcttgactgtccctgcctagggtacaacaaggaaaccactatttggataattcccctgattccatggtactgtggaagtggtgggctctccatatgtcagggtattctatgtctatgaaaaggtatctcttttgagaccaagggtggacgggatcctaagagtctaccaatttttaaaataatttagctatatttaagtcaataaattgtattcaaggctgactttgtagtgatgtattccatgaattatttcattcaaaataattttgaaaggacttctggtccagacaaaatagcatagatccatttctgtcttctctcctctcagttaaatgcaattataaagtctagaaataatgcaagaggtaaccaaaggagaactctgaaagatggaaacagaaagaggaattagttagggaccctaagactggaggaacaatagaggtaggatgtcttaccatcaccgcatccaacaagagaaggtgacctaggcctggtattacctgatcccaacttggcaccaaaagacagccaacatagactcattcctcctgcttcctggtgagcctggtattctcctccacttccactgacagacatgtagggtgactgggtggtatcaacaataggaaccacatcataacaggcagcctagtttgggaagcactcttggtctccgtaggcctgagactccttttgcccatctagaggcaccaggtggcccagcccatggaaattccctcagccccagaaaggggcaccagaaaggaccagtgggagctccagtaggctataatagtatgaaggctctgaaatgaagttgccactggacctacagcccactaaactaggctaggaccttaggtgatagcctgaaaaaaaaaaaaaaaaaaagacccagagtcttttaacataaaaaacaggatgtgcaaatacaatgaaaaaacacacattataccaaggactaggaaaactacctaaatgagaaaagacaagtgacaccaacactgagatgaatcagatagtggaactgtctgacagactttaaaacagccattataaaaatgtttcagaaagcaattacaaattctcttgaaacaaatgaaggaatagaaaaatctcagtgaggaaatagaaattgtgaaagaagaaccaagtggaaattatagaattaaaaaatataacaatagaaattttaaaaaaatcactggattctactcaatagtagaattgatatgacagaggatagaatcagtgaaattgaggaaagaacaatataaatcccccagtctgaataacagagagaaaatagactgaaaagctctaccttgaatgataactttgatcacaaactagtagtattaaccacgtggaagaggagttgctaaatcaacttaagagaacaaatagttttaggtgagtgacaaataattggaaaattaaaaagttaaatgatgtcatgtataataacatcaacatacagagaaataaatctaataaaatgtaattaaaaactataaaatcattgtgaagaggcattaaaagaatccaaaatatatattcatggaataaaagacaatatttttatagtcagttctgtccaaattgacctatagagtcagtacaattttacaacaaattttagtggaattttgtttattttatttgaggaataaagtttatattttatttggaaatttaaaggactgaaacaatcttgagcaagaacatttgttaagacttattctgaagctttagcaaataagacagtgtgagatacacacaagcatagacaaatagaccaatggaacagaaaagagagtactagaaaacagaccacgcatattcagtcagttgatttatgacaaaagcaatactgccatgcaattggaataggacagataatgtttgcataaatgttgcagggtcagttggatcttcatacttaaaaaaaatgaatcttgactctacctcacaccacacacacaaatcaatcagatagaatgtagatctaaaagtgaaaggcaaaataataaaacttctaaaagataacataagagaataatttatgaccttggagtaaaatcttttcaaatgtaatacaaaatatactaagcacaaaggaaaagactgattgatgaattggacttcattaaaactaagaacttctgcccgggtgcgatggctcacacctgtattccaagcgcttggggaggccaggaagggaagatccctacaaaatatttaaaaaattagccaggtgtggtggcatacccttgtggtcccagctactcaagaggctgaggtgcaagaattgcttgagtccaggagtttgaggctgcaatgagccctgtttgcacaactgcactccaaaaataataaaaataaaatacataaaattttaaaacctaagaacttctgtttatcaaaagacaccattaagagagtgaagaagcaagcccttgagtaagagaagatatttgcaaatcataaacccaatacagggtttgtatctagaatatttaaagaatttccatgagtcattaataacccaatagaaaacatgggcaaaagatttgaacaagcacttcacaaaagaggctttgtaattttctaataaatgctagcaaggaagtgcaaattcaagtcataaggagataacctctacagagccaccagggttgtccaaaatgacagactaataatactaagtgccagagagaatatacagcaactacagctgccatcctctggctggtgtgagtgtaaattagtataaccacattggaaaactggcaggatctactacagctgagcatttgtgtatcttatgacccagaaattctacaaaaatgttcatgactctctagttatagtaaccaaagactggaaacaatccaaatttccatcaacagtggaatggataagatgtactgagcaatgaaattaaaggacctaatgcaacagacagtaacatggatgaatgtaataaacatcatgttcagtgaaagaagccagaaaaccaagagggtaccctgatgactccatttacatgaagttcaagaacagacaaagctaatcaatggggtcaggagtcaaaggtgatagttattttgggtatgtgactggtaggggtacaagtgagacttctgtggtgttggcaatgtcctacttcttgacctagtcagtgatttctctggtttgcctcctttgtgaaaattcatcagtgtgttctggttattatttgtgtgcttttctctatgtatcttctacttcagtaaagagtttactgaaaagaacatacttgggtttgcagagttgaaaacacccgcaacatcttcattgcctcacaaagactattttacatgatgtttaaaaactttagaagctaaaatgctgttctttcattctgagctgattacagattacagattagtaagaaagtaagtgggctacttgtttaaagatggtctatgttaagtaccctgatatcttcttttgaaagagaggtcagtcttcctttcagcagagcattctgttcacctgcctgcccacctacctcatggaccttacagagcttggttaccctgactctaggcctctcagctcttgtactgatcctcccagctgctctattctgatgccatgaccctgtctggagactagagaggctaggccacattcagctcttccttgtcactgtacaactcacctggtgacttggtttttttttttttttttttttaattccatgccgatgtaccctgacatggagaactaaagacagaattatttagggatttcctctctctcattctgaaaacgtataaatagcctttgctgagttactttgttaaaataaccctgacatttttttaaatgagcaaaggggctctaacatggaaggtagatatactgaaggaaagagcccttaaagacaaagggctagtttatttcattatgagatgtccagggctttccagtcccttaattctatcaatgaaccgagtgagaggtaacaatgagctgtacattttttacaaaacctctctgcgtagtcccagtagtaggttgctgaaattatgttaaagtcaggtggggacttctagaaaacccactgtaaccctcttgtttggatgacattgaggccagggaggggaaaagaacttgcaagttgagcagtaataacacagatcccacaggacagctggcagtgaccccacaacagggatttgaaaacaaagtaaggtcttgttgtacccttggttcctcttctttacttcctactatcaaagtcaggttctagaaacttccctaggaggcggcaagaggcagtctctgcctcctcccagtagcaaattggccacaggaagtcctcatttgggatggactggaggagagaggcagctgtgtggaaagggcaaaccttgaaaacacccaagtccttgattgggcttgcagaaggatgtggcaaagagtaaagatcttgagttctggaggcacaactcataggttcgaatcttttttttttcttttttttttttaaatggagtctggctttgtcgcccaggctggagtgcagtggcacgaccttggctcactacaagctccgcctcccaggttcatgccattctcctgcctcaacctcccaagtagctgggactacagcgccactacgcccggctaattttttgtattttttagtagagacgggatttcactgtgttagccaggatggtctcaatctcctgacctcgtgatctgcccgcctcggcctcccagagtgcagggattacaggcataagccaccgcacacagcccgtaggttcaaatcttacctgcacctcttaacctctcagggcctcagtgtcctctacttgtgaagtagggataacagtcatattcacttcctggttttgctgtgcaaaatgaatagcatgtgatgctgaggcactgtaagtcgtgagggcagatgatcacccgctttaggagccattcttccaaaatcttaagtgagtgaaaaagaagcagagatagctttttgtatttgcgcatggaggcagagttcatctgttgcctgagctaacagtatactattcagcccctagtgaaactctggccccagggcaggaccaactaactaggtagggcagtgatgaaaaagggagagtcttctcagtggagtctggtctgggtagagatgtcaaaggcaaaccatcacctccttgacttgttggctctaggtgatgatgctaacctgacctggagggatagcccttctatggggtgggcaggggcagccagaggtgttctgaaaaccagagaagtctcctcactggaaaacatttattcctgggatctgtcagttgatggcagaaatgttcattgttaaagagccgtttctttggcttattaattggtcctctgttagccagtcaacaatactgtacccagcacagatatccttgagaaatgaaggagaaataaagtctttcctagataagcaaaaactgatggaatttatcatcactagactgaccctacaataaatgcttaagagagtcctacatctggaagcaaaagggctatattcaccatcatgaaaaccctaaagtataaaactcattggtaaagcagacacacaaataagaaagagaatggaaccacatgttatcattacagaaaaccaccaaactgcaaagataaacaaaggaaagaaagaaagaaagaaaggaaggaagaaaggaaggaagaaaaaggattatttaaaattatcagaaaacaattgaaatgacaggaataagacctcacctatcaataacaacttttttaaatggcttaaatttcccagttaaaagatatagactggctgaatggattttaaaagtgacctaactctatgctacctacaagaaactaatttcacctgtggagacacacatagacagaaactgaagggatgaaaaaagatattgcatgcaaaaaaaaaaaaaaaaccaaaagtgtgcaggagtagcaatacttacagcagacaaaatagattttaagtcataaaacatagagaaaaagaggtaattatataatgataaagggatcatttgagtaagaggataaaacaattataaatatacatatactcaacactggagcacccagatataaaaagaaaatataattagagctaaagagagatagatgcttatacaatcatagtttgggactttaaaactcaattttcagctttggagagatcatctagacagaaaatcaacaaggaaacattagacttatactgcactagagactaaatgaagctaatagacatttacagaacatttcatccagtagctgcagaatcacatgcttccctcttcagtacatgaaacattctctaagatagaccatatgttaggccacaaaacaagcctcaacaaatttttaataattgaaatcatatcaaatatgttctcagaccacaatcgaataaaaccagaaatcgatgacaaaaggaactttgaaaactgtacaaatccatggaaattaaacaacgtgctcctgaatggtcaatgggtgaatgaagaaattaagaaggaggtcaaaaaagttctcaaaacaagtgaaaatagagctgcaacataccaaaaccaccagcattttttttttagcaataatctatttttaaatcaggtgtgtatattttttagacataatgctattacatgcttatgggctacagtatggtataagcataacttttatagtcactaggaaaccaaaaaatttatgtgactcactttattgcaatattcactttattgcagtggtgtggaaccaaactggcaatatctcagaggtatgcctatagttaacaagaatatattgcatatgttcacaaagctggaagagaagattttgaatattctcagcatgaaaaaatgatatatctttaggtgatgtatttcctaattatcctgatttgatcattatatgcatgtactgaaatatcactctgtgcaccataaatatgcgcaattattttgtgtcaactaaaaataaaaggaaaaataaaaggcagagccctctgggaggagaagactaattaggcttagtgattgctaattctgggagctgcatgcaagcaggttttaaagaaggcagaaaacttaaggatgtggatgtaaaaggaagttacaatgacaacacaatttacagaaatcacttagtcacctggaggactccaatttcaaatgtgccatgcttggatatttgcttacattttgcacaatgacttttctgccatctcctgtgaacctctgagcaatcctgtaaagcagggatcatgcccattttccagatgaggaaacagagtgcccatgccctgcccatggttccagaatgcagaacagtcatccttgggagatgggggtgtctggtccgagtacctccagtctcacctctgctttgtgtcgcaggtggggaggggtcactgaagacaaaggctccttgtggctataggaagggtctgcccaccaggagaggtgggaggggaggagtcttattcaggctgccaaggttaagcctggttaaccacttagacccagagttaactagcaaggggcacaggtacctgcctcagagcatttgtctctgcctggagtgtttgactagaggtcctgagagcctggaccctccgacgctcaggtctcagctgccacattcccaaaggtcatgatcatcctagaccactcaggtgctctttgttcttcaccctgcttaatttttgttaggagtgcttctgatggcttctggtccatagcctgcctctgtctctgccctgccaactccgtgctctgtctcaacgttgcacctgaaactgtgcctgccatggggtgggtattcagtagccaactgatgaatgaatcaatgaataaatgagcagataaatgaatgggcaggaaagctcctcctgtcactctctacactaacatgtaggaagtgttggagggacacacgttagtggatgtcggtcacttagtcctgataaaacagagtagatggttttcttagtaggagatcttgagggctcttctgtgaagcctcttgtggaaccagtgaagtacctgaaaggcaaggattgggcaaatcaattccttctggttgtggaggagaagcccttctagggttgatgttaatgctgcattttaatgaaagtgacttttcaggcttataattggatgacatcagctctatttctgcttttgcttctagaatttagtgtgattctattttaagagactaagaagaaaaagcaatttttagactctcataagaatactagcaacaatggcaatagctaatgtctctgcagcacttagaaaagactgtgccccctgccaagagcttgacctgggctatctcgttgaatccttgcaacacacagccccttgtatagatgagaaaactaaggcctgagccagctggccactcatccgtcacagcctcctttcctttccagtgttggggacagctcacagtgggctgtaggatgccactgggcatcagcctggcaaggtagcaggtcatctcatttttcttttttctggagggtgaggttatcctgcaaaatggaggtcatggggcctcctgccctggaatttctgcctcatccctgacatcttggatgttatcccaggctgctctggtccagttctggcttcattttctcaacatatcagatgcaagagaggcctggcctgctagctcctgtctccctgctctgctgcattccctccccacgcggtgcaggtactgactcgttctcaaaactgtcagatgggctgccacctacctgggagtttcatgacatgtcctgggatcctactacgccagaggctcaatgcctggcagagtgaacacttagtaagctgcagttgccctgaaatattttcctgttgctgattcatttcctcatctgtggataccatattccaaacttgctgtgccaccctctgaaggggcaagttctttcctaggagtagataccaagagagaggaagcccatgtcatggggacaaccacacaggccaaacacaggtgtcactgcctgcagggacagcctgcaggcatcaggcctcccaggagatagcaggcaggacaggaccatttcagactcatttcagcagtgtgtggacagaaccccactgagaaatgcaagcatgagacctggagtctattcctgtcttgtcctggggttccttccactggatgctcatcaggggaaatcctccctctggatgctgatgtggggaaaatggccaactagttttaaccttaaactcatccaaaacttattttctctccacttgagatagttgtcaggagatctgagttctcaccttccttctgctcttcccttgtatgtgaccttaggcaagttgcttaatccctctgagactcagtttcctctcttgtagctgcaggatgatggctgggctctattctagatcagtgagactcaaacctgccctgtggcatcagtcaggaacagttttgccgagtaggctccagtccagaccaatacatcacgatctgtgggagtgaggcccaggcgattcccaagcactggaagggttggaaattcaggcatatggtttctgccttaaattccatctatgaaagccgaagcgctctctttaccaccaccacctctccttcccacccttgtcttgtttgctgctgatttctcgcctgactcaagaacaaatgtgtttaagccccaagcccctaaaaatgggaagctgtctatttcccttctgtaccagctcccacatgtgtctggacacagactctgccagggaagtcccctcccatagggaccgtgtgcctccagagttgtgtggacaggacttgaagacatccaaagcccccacaagagatgatgacaacaaaactctgtgttaaagagtttccaagatggagaactcctgcctgtcaattatccttctcagacactgattttgtttgtttgttttctggctagagacgattattccacacaggaatgacagacagtccctctgttctttgtctgctggtcctgggggcctcttgcgtcagtgggaatggaaagtatcaactttcttatttctccatgttccctcttgccttgcatctttcttcctgctttcatttctaatttcttgggccctttgactttctcttcatctccctcttcattcttcacacaataatgtttatttaattttggatgttctcttctggccaaaagttgacttggtccagaccaaatggaaatatatgtgattaaatctgttctctgcggagagggactaaaacaaagatcaatgccagatattgtcgtgatgatgaaatgtcagggcagagggcaccaggaaggacagaccaggctcacagaagcgtgccattctttcacagcacatgcagcacacaatatgcagaggcatgacattccaaccttctccaacccaccgtttatcagtgtgtcccctggactggtagtatcagcatcacctgagacttattagaaacacaaattctcaggctccatcccagaccaactgaatcagaaacactgggggtggggtccagaaatctgttttcacaagccccagaagactctgatgcatgtggaagtttgagcaccactgcttctagtgcgtagacgttttgcttgctatcattgaaaactcgcttgacctctttggagaggggcatggcggcccccagatatctgaggaaggctgagcaggaggataaggtgagctgaggaaaagggagggagcaatggggtattcacggcaggggagcctgagatggtcccttaaggatttgcattggttaatgggcagactggtgcaaaagaggctgaattgaataattaggaaactgggagaattcaattcaaagaagaattcttgttcgcaaggtcaatttttatactatttaagtaaaataactctggtaggttctatagcaaatgctaagtaaagtaaccgctggtttctaaattattacgataatctgagaaaattatttctttgaaaaaattatagaactttcaaatatgcaaaaaactctagagagtaatataacaaatgcacttaatagggacaacctttaacattcagcagagaacattttactctattggcttcagatcttgttttgactgcagcttgattcccacagtcctctctcatccccacccatcgtgggtcctcagcctcatctcaccaccctgagttgggtatagaatttcctgtccaggtgtttagaattctatacatttatctaaaagcaatatagggtatcgtgtgttgggttttatatgctgatgtaaaaggagttgttctgcaatttgctttcttctctccatgttattgagctctatcctgttgctacctgtggacgtaactcgttctcattgctgggtggtatctatcttatggtccctttctcatcatcatgagcatttaagtgaagatcgtcttcaggatttccatgtgctcatgtgggagagtaagtcctgaaagtggaacatcacctgtaaatatattaaagacagggttttccaatttaactgggaaagtctccagactcagctggagctacattatctgtttctctaagaaagaacttttctgtccataaactcattgtattagtccattcttgcaccgctataaagaaatacctgagactgggtcatttacaaagaaaagaggtttacttggctcacggttctgcaggctgtacagcgagcgtagtggattctgcttctggggaggcctcagaaagcttccaatcatggcagaaagcaagggggaacaggtgtcttacatagcaggagcaggagcaagagagagtgagaggggagatgcttcacacttttaaagaccagatcttgagagaactcagtaccacgataacaacaccaagagggtagtgctaaactattcatgagaaatccacccccatgatccaaccacctcccaccaggccccacctccaacactagggactacggtttgacaagagatttggtggggacgcaaatccaaaccctatcactcatttttttctcccttcaatcattcaaccaacaattgctgagcaactcctgtaggtcaggcactgtgctgggggctgggaaccagtgggaataaatcctatgggtctctgcccttgtggagattccagagtagggctgcccggatgttcttgcattgtgcacagtgcagagacaggaggctcccggatattctggcctaggcaactctaaccctgaaaaatgaacaagcccatcacattctattcatgtggttatagtttacctgaaacctcaactgctccacagaatcagatctctccgcagctcccaaaagtgtcccaagggttagcactgaccagcttgctgggtttgaaggaaccacaatgcatcgggtgtggctctcttcctgctagctgctccgaagtgagctcctactgattctattcagttggacgctcacattcagcgagtccagggggtttttcatgctttgagcatttttaagagtctgctatttgcccagttcagtgaggggcactcaggatgtatcagtggttcaggctgacttggttcctgcctaggggaagacccacaagaccagtacccaatgcagggatggcatggatggtaggggaggcttggaggccctaacccactcttgaagggatgacagaagcctcccaggctgggattggaaggatgaaaggagcagacaggccagggtagagggcattgagtcccagtttgagcgaagggctggagcaagagagagcctggtctctgcaaagatctgaaagaacctcagagcaggggccaaagggtaagggtgtcagggcagaggctgtgccaaaagaggtgagcctcatcctaaactctgttcttgatttggggtggaagtgtccctggaaaggcagatcaacaaaggaaggagcatgagccaattctcaccacacctcttgtgcttcaagtcctctcttgggttgggtgatgtcatacagggacccacacttgattggactgccctccccaccttttaaacctctcctgtcactgagggggtacaccactggagcctggcaaaggtagccagtactcagggggtgtgcacaaacctcacacccatgtttataaggccattacaaatgctggcccagttggtgaccagacaccaatccttgtccttccacgtagccaacagtgggctagttggcaggtgcatggcaggcgctcagggctatagacaatgcaggctttaatcccatgagtggagtcggtgccaagtctagaattcaaggatgactcttcacccaactgaccctcttacccaacaaaccaatgagaacagcttgaggtctggaggacccgtgcttgatatctgtccactcttgtatttgagtaaggtagtggaggtcacaggctcacatcataaactttgtactttatttgaaacacttttctggctctgttagtggctccaacaccatacttaagcttacttcaaaatgacttatacatctctattttccttaaagtatgcgcacagataagaaaagatggggtgaattttttttttttttgagaaggggtcttgctctgtcacccaggctagagtgcagtggtgcgatctcagttcactgcaacttccgcctcccgggttcaagcaattctcccacctcagcctccgaagtagccaggattacaggggcgtgccaccacacctggctattttttgcatttttagtagagatggggtttcactgtgttggccaggctggtcctgaactcctgacctcaggtgatccacctgcctcagcctcccaaagtgctgggattacaggcgtgagccacggcgcccggccaagatggggtaattttgatgtccagacacaagttgtcatttaagatgaagcttcgattgtaactctatgaagccctgctgaatattaaaagcttatagaaagcagcttttctcccccaggcaaaaagagcccttcgatctgtggtgggactttgcaaaaagctgagctgccactcaaagaaataattccccgctaactgcaagtttctgtcttgtttatggagggcctgttgagaaggccctccaaacctttggttccagggtctggcaaggggaatctgtcatcattcattgcaaactacacctccacccactgggctgaagacctgtgcaaggatagaccaagaacttcctctggggtggctgtgctcatggatgctgatttgacaatttccaacctccctcattaccaagatccccttccttcacctgtgaaaccaaaattccatcttcttctcttccctcctttgtgacagagtggggaaagatggggactgagggaaaggagagtagaaactcagtcccttgagagatgggagctgatgggaaggaggtagaaacttggtcctttagccaggaggctctgcaggcattcaggcctgatctaccatgtaaggtgatttctttctttttggaaagctcccatttcatggggtggacaggtccaaggactgctctggaccacttggtgatcacatgggccgaagtaggggtagaggaccccaaattgaatgtgtggaggggactctgaagcaggtgtgaatgccaggagaggtgggaggaaggacaagggtggtgcatcaagaccacagaagccggcccggccagccttcccacaaagttacttgaactgagctctccataagtacacatgcgcacacacccaagaataaactggacaaatggcagcagaaagagaaagaacagaaaagagagctgatgaatacatccataatcagcactaacacagccctggaaagaaaagcaaaaagaaaaggcaagcgctgtggtgtgcagctcttattgtctaataaaagaaaatataccaattctttggggaatttaattttttctggaaataaattcttggaagaatttatgtgacagaacaccccaggggaacatccttgcgttgggaaggaggccacctcgtctggcggcctcgggcattccagtgatgcaggggaggggcccaggcagctgtgctggtccaaggggctccaggtagaatgagctgtatccttggccagaggatgttgcgcatcctctggggggatatgacgggagaatgatggggggagttggggagatgtccccaggtattacaagtggaggctggggactaccactgtcagttcattgtcaactatgtccgcctcatagacagggcacaagcctatccttagggacacacgtgaagaggggaggcaggaagattcaggcgcgctctccggcctagactggctgaaggagggagattttaatgcttggcataggtggtgaggggtccaccaaaggtaggaacacatccctggggctctgggaggaagaagcgtcaggactgcagctccagcctcttcaggcccagggtcctagggcggaacaaggctggaaaactggtgcatggaggaaagaaaaaaaatgggaagggagaatggacaggtaggaaggaaggaaaggaggaaagggaaacggaggaagaaagacatggaaagctgggaggacagagggcaaggcagaaggtaaaggaggcaaggccaaggctgtgaggaggaattccgcttttattctgctgtctggcttcatgccattgcatggggccctgtaaaataaaaaatgatacctcccagggctattggtttttatcttagaggactctgtggggagatgtggaaagctgttcaagtggcaagccttgggagctgagtttcatgacgatggccgtctagggctgttcaaagttaagatgacagattggcagagtgcagggaggtgagagagtattggggaagttttccatacaggggaccatgtagtgttttgctgggaagatagacctgggtggaggtgagactggtgggtgccacagatgattctaactcctgctccttctcttgtccttccaacaaaccaaccacacatgtaacatagtcataagagcttgcagggaggagaaaagagagatatcaacagaccaagggagacagagggtggagggccatgctgtggacagtgaggggaggaggtccttcctctccgccactgccctcaaggctgcttgaggctcccacgctgaggtgtccacctggctgagaggctgctgcttatctgttccccaacttctccacctgctggtgcagctctcccttgctgtgctaggagagaacccactgggagggtcttggcatctccaagtggggccctcctgctgagacactgggtggctgtggagggagctcagccctcattcctccccgagctcatatctacagagcagcaagtctccccactccaccagaggagagcacaggagagctaggcagctgcctccaccaagacttcacccaaccacggtccttcactcccaccaggacaggacaacccagcctcccgggtcccaggaggacttggcatggctgaggacacccaagaggaaccaccagcctatccctgaaaaagcaaagacactttggggaacagaagaacgtcttaaaagatatcaactttgactcagagatttcaagaagacgctctatccgaaaaccaaagaagaagtgtcaaagctgttgtaaatgtttaaaagaatagccaccttgattgcattttgagtgaattgtgaattccctctccctgggtcttcctcattcttctacatcctccccatttctgtactgaatttatagcagactgaatttggaagttgatttgaatgtttaaatatatgagacactctttgttactttggaatgagtaaggcattaattcttttacgttttgatttttaaaggttttatagaaaattgcatgtttcatcaggaaaaaagttatctagttctactcaaaataacatcttatggaaactttcagagtttcaccagacaaaatgccccaggctttggctttgcagctggtgtctacagctgagcctagtccttgaagtaatcatgactcagcttattcaaaataaactcttcaagaattgcaaactctcctctcagcgcatgccctgtgacctccatgtccctccattacatctcctcagagtaaggcccaatgccactgactcatgggggaaccacaggcagcaaatggccagagctcacacagagggatgagtgcacttcacctgcagtgtgactcagcaggccaacagatgctatcagggaagagcactaaaaaccaaagggtggctggctgcgtctcagcatctgtccgcgagaaacacgatgccatggttattttgtgattttggtggtaggctgctggtcaggtgtctccaagcaagttggtcaaaatgggaacagttgtttctctgggcgggcaggggtcaaggctggtctggaaaaggccgaggcagctgcaccctcttgagccactggccagcacctgtgccctgtctggggctttcctctgcccacaggagacccttctccatgcaggtgctgcgtggcaccaggcatgagtctgaagttccttctgccacaagcaccctcgttatttgtgattgtgcaaaaaaggaagtctctgccaagaaactaactgaatgttagtgcctgttctcaggactttccataaccctgctctactaggattcctttcaccctctttgaaagcagccaaagggttaagtcatcccaggtgcatctcaaagcagggctgcgagcagcaggagtttgagctttgttgcaattagaagttgagtgtgagaaaggacattcaggcacagcttatctttgaatacacatgcaggagtatcaggagcagttagagataaacagctggctaataaacacatgaaaagatgctcagcatcattggtcattagggacaggcaaatcaaaaccacaatgagactctacttgactcccattaggatggcgacaacacaaacaaacaaacaaaaaagaaggtaatcagtgtggatgaggatgtggaaaagttggaaacttcagacattgccgttgagaatggaaaatgatacagctgttttggaaaacagtttaatgtttccttaaaaagttgaatagagaattagcatatgacccagcaattccatttttatgtttgtaccccaaagaattgaaagcaaggactccaatagagactagtataccaatatttattgcagcattattcacaatagcttaaaaaaagtgtaaacaacccaagtttctgttggcagataaacaaaatgtggtatgtacacacaatggaatactattcagccataaaaaggaatcaagttcttatatatgctacaacgtggatgaaccttgaaaacatgctaagtgaaataagccaggtacaaaaggacgaatattgtataaaaacacgtatataaggtacctagattagtcaaactgattgagacagaaactagaatcgaggttgccaggggctggggagaggggagaatggggagttattggttaacaggtacggagtttcagtttgaggtgatgaaaaatgttttggaaacagtggtgctggttgtacaacattgtgaatgtacttaatgccactgcattgtatacttaaaataactgggttaggggcatttatggattttcctctcattgtaggtcactaagaacatggtgggaggaggagccactgcctttataggccccgactgccccagagcttcattcctcaccaggatgaatgacaggattctggactagagggctcttgcctgagccaccagggcatccgggggatccctgtgagcagggtgagggtgagcacccaggttccacagggctctgtcctgggcaggccagcagatgcagtgattgcaaatcctccttgtacaaatggaacaggcacgtgcatttgtggcacactcagagctgctggccactagtgtgctttggagaatcagttgtctcccaggcagggaaggtccctcagacataaaatactcacccatttagaggaatgacaacagcaaacgaaactatattctgctaatttactggtaagagaggaaaaactctgtcatgcatacacagacagaggctctgccaaaagagagaggcagcagatacagatattagcaaatgactcctctccagaagaaacacaccagccaggaacggcactcacacctgtaatcccagcactttcggaggccaggcggtaggatggcttcagaccaggagtttgagactagcctgggcaacatggcagactccgtctctacaaaaaatgaaaaaaacaaacaaacaaacaaaagatcagtgtggtgacacacacctgtagtcccagatattccagaggctaggcaggaggatctcttgagcccaggagatggaggctgcagtgagctatgatcctaccactacactccagccggggcaacaaagcaagaccccatctcttttttaaaaaaagaaagagaaaacgaaaagaaaaaaaacacacacgatttcacctgcttgaaggcctgtgcttctctttgttgtccccatgacactatacccaggccactgtcagggaccctggggggcttacagtggcttactgaaggctagacagtatccccttgcagtatcagttaggattctatcatcatgagaaagaggctccagctcgctcaacggagcaaactggaaggtaatgaggggctcagggaatttgtcctgggaaggcaggaagcacaaccctgtcttatggcagaggccatcagtccagggtcccagctggacctgctgatcctctgtccctgtctcactcattgcagatgccacctcttcggtgagggcctgtgagctagggttaggtcacctaccctaccctgtgtgaccacaggcagggagagacaggatttcacttcctagacttccacggtggaggccaggcacctaagattattctcccacccacaccaaacacagtgggggaaaactcatccccaaaaggaaactggggccaataggcaggggtggatgtggggcagcccaaaaaccaacacacagccaccgaccccatcagccatgatttatatccatgcctttcctggacaaaaaaccaaatcccactgccctgggcatcagcgggcagggcccacacaggcttcatagatgtctcctctccgggaagtggagggtgtgtttgtgcattcggagtagctggtgcctggtagaaaatcagtgcggttttggctttggcagagcagcccaggctccctttgcattcccacaaatcgaggcagctctgctgtgctactatcacagttttggcggctttgaccgcaggtcctcctgaggccgggagactgctggggcgtggtatatcagttgttgggggccgtgcttccccagggcagatgcatgcaggggctctggggcagagtgaccgtggaagttcgatgatgtcaccccttctcatgcagctgatcgttgggtcaggaaacgactctcctggcatgaacctgttcctggtctcagcaacccgcacattgtgctggtgccaggtcaaaggcagggcaggaagccaagggatggggcaggcccagggggcagagaagggcaggtgggtgggatgtcgggggcaggtgagggtagagcatgtgtatttacccaggcaagggtccggccaggctcgcaatcagaagagagagagaagaccctgactccaagccaaacccttcaccgagggaaatgcaccaacactcagagggttcttgtttagtaggtgagcaagcagccaagcattggccttccccagggcaggggcataaggccggtgagcagctgagccaggatttgaacagcagtcacccttggtgaggcagaagcagatgaggatatgaatggggatggctaaggaaaggtgggcttgcttgcactggggagaggccttactggggattcagaattgagggctggggtttgcttccccggagggtaatggtttcagctgcctgagtttttatctcaccccttcttacctcctcctgcaatgactgaccaacttccacttcaaagagatctttgattatgactccatgacatcagtaagctttcaagtcagtgaatttaccttctaatggtgattggaactcaaagccagttcacagcttgacctgcatacatcaagcagctgggtgactgtcagatgtgtcatctcatgtgggaggagaatttgttaaagtagggagagaggacctcaggaagaggcctcttgaaagtctgtgggtgcctgaggctggaggccacacctggcctctggccttcaggacaatcctcaaaaagggattaggattagcccacctggttctcagttggctgattggttaaaaacgtgaacaccaaatattaatttgcttttgtttttatcaagcgattctatttggggtgggatgggggagaacgagaaacattttaaaagttagagtaaaaacccagcgctacattgccaatttcaagatgaagtaataaagaactacctgggagggagaatcatttctaatgaagttaactttgcaaactgagcattatgcatttttcactcttggtggttaatattgggaaagtgtctggtggtccttggggtttagggtgctgtctaaaacctagagctgcctggttgtggccagtttttgtttttaaccacgaattaagcttggatcattcagaacagactgacttactcatcagggatgcaaactccacacgcccaaagcagtctcgagtcttcagtcctgggtctcggcttctttctgtgtttcgcaggcactcacacccccgtgggcttggttctccaaacaagcccttatggaaaccaggccagatgtagggattaaagttcccgaatttcagcaaagttaaataataatagtagacacaaaacaaccaaccaacaccaaaagacataggtgcaaactatgctaatcccagcagtggagaggaacaggcctttgatgatgatggccctgatggatggaggacgatggaatgctctaaacacgaggcctcaggggacagccccggtcctccttgtcagagcctgctctagtttgggatccagcaggaacctcaggagcctccttcactttggtggagaggactgagactcagagcccccaagcgcaccttgggacggtccccacgcttccctagggtgggtctggggcaggcctggggcatttctatactgctgtttgggagagcgccccagacctagtgtcctggctggggcagatgaagccagggcgctctggctggtagaggcaggaggggaggccagccaggccccgcttgaccccgcattgacaggaaggagaacggacactttctttcaaggtgctcaaatgtcccacatcacttctgtgaaaacccaaacacagaagccacccctctcagctgctacaggccagaaatgaaaattactgcaatccccaggagcctgggaagacctctgctgacattccctatgaccactgtgacggtgcccccttcggctgcctcccccctccgtatggagagcgttccagccccaggctcccagcgcctgctcccagtgcctgctccccggcctccatcactccacgccccagggacctaaagtagaaagcttagttttctccttgtttgagtgcagttgggataatttttaatacattcctttttgctcttcatcaacttcaaatgtctcaagatgtcctgagggcaaaagagctgatttagctctcagattaaaagagagtggcctaacgcctcactcattttgaaatactgacattaacggggaaaattactcaagctctcctgttacttcctgtgcttaattaagtggctctgcaggtgactcactcccttatttttcagaatgacatcagacttattttccattttaatagcctggttacttcattgattttttaaaaaatccaatttcactttctagtgcaatttctttatctgattttttttctccacactaggaaatgctaactctcgtagtggtaaaacttcgacttacgaatgcctcaatttttttttgagtctagggccccaaatcagaatttaaagaagaaattagaggtgtaatctttatttgctaattacctaaataatttcacgaagtgttggagttgttaatattattaactattcctgagaaggggcccccggggccaccaaatgaatactttgtcttggaggcaggtctgtgtccctgcaagaagccacatctggctctcggcaccctccacacccacagaaatgcctccacttttgtcactttctccatcaatttgagaaggatgattccaaattcagaagcttgttttgagctcattcaatatgcatcaggtggcggtaacatctggaggtcagtttttcttgcagtttggtaaattctgttgtctaaagagagatgtgagaattgctcatcttcatataccacacttggcactcgtaggtttgtgaagcagcagatgcaaatgtttcacgtggtgcttggcatttatttattgtttatttgtttatattttgtttttggtttgtttgttgggtgtctgggctggccaggtgaacttcattttctgccctcactgagaggttttcctccattcagctctgactctgtttccccataggagccacaccggtgagggcagggagagggtgctggttctgagccaactttgcatggaaggcccagcagaccacgctcattacttacagccagcatcatcggggaactccggcacagacctgtagtcagtgccccacagcgccccagccttctctcccgacaggagtggccaggacagggagcagaaggtgactgctgtgctgcctggagctcttctgtccggaggcttagtgaaactagagaaactcagtggacacactacaagacttcagagatactttttgtaaacccaggaagaatcaaagatatgaaacatgcagtaggcactcactaaatgttaattttcttcctttttaaatatatgcattatgatagttaaattaatgactgcacgactggaagaatacacactctaatgattcttttccctaaaataaatgtgtccactatttgctgtctaccttcttgaacatcctgcttcctctaaataactaaggagattgattctacactaacatccagttgaagcaaagttgcgtcatgataaaatctggcatgggctatcccttcaaaaagttctttctgaaccatcatgaccataaattgcactaggcaggaggtggtgctggagggacaaagaaatgccagccagtccctgcactggagttgccagcaatcacacgggaaggcctctagtctagagagacgggtaggagagagacgggagcacatcagaggagcgcagatgctagtgcacgggttaaatagtctcttacacatctggttaagatcacctcaaattgctgtggggttccatagctctctacagcccaattccaagcttctgctctcactggattagttccacggatacatggtcctctgcattagctgggttctctatcttgggtgacatcaaacctagagatgaactctagcccctcactgatacctcacaactcagtctcagaagacatttttgcatggaacagactttaatgaatggtgggtgagggggtgcctgctattgaatgaataagtatggggggaattagtcacaggacttcatactgagcattagagtccggcgtctttgttcttggaagtcttcagctcccgcccggtccctgaggatcttcccccgactgcttgatcttgcatcattgccctccctccccgagggagcaacacagagcggccctagtccactctcatgatgcctccattaatcccccggtcagggaccttccagccctgcccacagcagtcgatgccttcagtgcatctcagtcttccacccccaaaagccgtggggggtctctgtgcgggatcacccctctcctaatacccctggtcccaggagatggggaggatggagacaaggccggtgtgggaatgaggtggcaggcttctcaggacatgagctgccttgctctgcccccttgggcctcatggaccccattctccctgctggagttgatgttctggcagactgggctgccccttggcccagttcctggaataccaagtaattaggtcatcatcggggcagcggaggccagcctctgatattctgcggcatgttacttgctcttggggcctctgtttattggggctacattgccctttctttgcacagctggctttgtgcttgctactaatttttttttaaactgaagaatccattgtttagagatcacacataaatggtaaattataaagaaaaacaagtggatgaccgacataaaaatcaggaggtttgctagccctggtgagggagggaggaagacaccatgtgagagaaacacaggaccgttttgtaagatgctgcttttttgttttgttgttttgttttgttttgtttagcattgggtgtggatactcaaatgttcatcttatgattattctttaaatcgttcaggtacattttgtacagtcttctgtatgtgtgatgcattttataatatgagtggtatatttcacaatcaaaaacacttttaagaagctcttttgccttggctaactctcgtttgccgtttccccagggccagccagcccggcggagcatggggaggacctgaatctgccccggcactgtcctaccctccacaacatgctcaagtcacatcctgtcctgctttccattgcctctggtcactgtcacttgccaacattctgaacatcccactgccttcaaccctccccacttgttcggcacaatatggaaagtgaaaaaaaaaatgagttgcagagagccttgcttccgggtttggaatccagctccatcttgagtctgtttagagaggtatgagtgctttctgacgtagggcacttatcactttagcacacagggggctgtgtgatggcccagtaagagcctgagctttggagttacagagcctgggccttctcaactccatccctcatgggtggtatagatggttcttccctccctgctttccctgactaggattaacttccccctgagcccaggacacttgttactcttgtgccctaaccttcacgtcatctttccaccatcttccatctgcagctttctcaggtcatccgctccatggaggtccccgttcctaccttggccttgcctttccccctgcatgtaaccttggtgaacttttcacaagagtctgcgcagtcttcttgtaagcagattaatgccgaggaaaagccttggtgaatgcacaccccacctaccacctccaaccttgcacagctggccggggcagtcggtgccaaggatgcctcatggcccttcggactctgaacctgctatgggtcccactggccagacacgtgctttccttttggaagtgcttgtctcaaacatagacgcattgaaccaaaccattgtgtgtgggctattggaaggggtgcacagattcatttgttggttgcagcaaatgcttggtttggcaaatgcttgagggccttgtggctggaatagctccactgcatgtctgcagatctgtcacgaggatcccagctcaggtgggagaggataggggctattggtcagactttctcaggccaccctattcccttcctccatgcaaggcagcgcggtatgaatgctttagatgggcctgggtgcaaatcactgtgtgatcttggggaagttgctcagcctgtctgagcctcagtttcttgaagcatcaaatgaggatgataatctctgtttctcagggtcagcaagggacttaagtgagaaaattgaggtaacccatgggcagagcacagggcactttgtgagcactcagtaggtgcaggctcctttctcctcccctctgcctttctctccccacttactcctgtcaagtaacttcacctctcagaaagcagcaaaaattgtccagtgtctccctcattcccaagacccccactggcccctcacccagtggcctctcagggcactcccccgtcctcagaagtcctatcccagcggagatggaatccacatagctggccctttcctccacacgaccctgccagctcaacccttccccgtatgattacgatttgtttctggttgtttaccatgagaagctcactgaagcaacgaaggcttcctaggtgcctctaaagaagcaaggtaaattttagaaccttggtttaaaaaaatgctgcgctgtgcagagaagcccgtggagagagccccgctggtgaggaagcacggggaccctgctgcagggctggtggagggctccttctgcagacttctgagcttggagcacagatgggcagcacacaggtgaaatgtgatcctctgtggggctgtgttttctgccccaggaagaaagaagagtcaacaacttaattatttcgtcatggttttgtacaaagcttgagaggaggaaaaaggttcccttttttgaataatagacaggagttacagcctgaagggagcctgctcagggcgggcagggctgctgctgtaccattggcatcagagacgtgctgctgtcccgaaggctccgccctcctctgactggctgctggccctggctcctgcactactatggccttttggctcaggtgcatccttcctggaggctggaactcatcccccgcccccggcatcacctccatagccagggggccacccaggaaacgcaagccaacatctggggaggccagccatctccaggcaagttggagaccaagagaattgtgtgaatttagactcttggtagatgctgcctgaccctgggctgcctggagcactgcatccctgttgcctggcacacagtagggttattgtctctgagtagctgggtgaatgtaggtcagagctgggaggcgctgtgggctttcatagtcaaggtcacatggctcattagggacagtgctcgaaacatttcagtagggactcaccattcagtcaacaaattttggttgagcatgtattatgtgcccgccactgcattaggagctaagagtacagtcaggaacaaaagagcattcagtgtactccagacagatgttaaacaaatacatagaagccaaattatgtacagtgctaagaggaatggcatccaggccagggcagggttctcccaggtggtggcatttcaggatgagtgacattgaccacgtggagaagtgagaagagggtctcaggtgagggagcagcttgtgcaaaggccctggggaggcccacactgcaggagctggggaaagggaaatgtggtaagaggtgaggaggagaaggacctgatggtgaggatatcacagtctgatttttattttttaaaggacaccttggttcctgcaaaggtgggaggggaggagaggggcattggtgagtccataggtgatgattgcagggggtggtggcttgtggtgccctgtcactcaccagatcagtgactgtggcaagcaactggcctccccaggctcagcttcctccatgtgacttggggacgcatgcttcacagcactgttgtggggcatatattattgcaaggggctggtgctgggagggagccaacactgccactcttcccatgcataccatcctatgcttccagggggaatgattcacaacctgggaaacctagactttacacactggcttttcttcttgttttaaggtagagagaaattcttaattgtaatgtggtcaagtgtgtcagccttttgtcgcttggtttgtgctttttgagtcttccccaagaagtccctccttctcaccatgaggtcataaaggtgttctctcgtgactggaaattttcacgtttccacttaggtccttgagccatctggaatttgtgtctgatttggtgcaatccagctctcctacagcctggctgggagacttggagcaagtcgggctccctgagtccccagctaacagatgagaagattaattaggccatctctgtggcatcttcatcacctacagttgcaaacattcagtcttccttgctgcagcctgtgaccagggtgatagtccagtcagcgtgataataaaataatcccgccgacttccatgctgcaaaaatgcagccacgctgacatagcattggctgtcctccccagctctcttccagaaacaaaacaaagcacctcaaagcaggtttcccaaggcccactcacggccagaactttgctttaaatcattccccttcgacagtttagttttaactatactgtatgtacccaagccaaggatgggaggagaagcctcagtaactagaattgttattaaaaccatatatccaactccactggcttttctggaaacctctacctaaaggacgtttaagtcgtctattaaaatatttcagacttgccctgaaggaggcaccaagaagtgccacaactttgcaggctagtgaccacacagatggaaatgtgtctctggaagcaagtggctggtgttagaaacacacacacacacacacacacatacacacacacactcccacaaataaaaatctagtcttccgtgttcactcgaattattgtaataatcactgaggatgtgagactctgtatttagtcagttctctaagtatgacccagcccagccgtaagaaaacatgggagggatgggtgaagaccccacagaggagggagagcctgactgaggggagccagccttcacaggggtcccggtggggatgcaggcaagaaactcagcccaagctcatctaaggtggaaggtatgcgtctgatcaagatacaggggcagggaggggtggtgtcctacaattctcaagggcctgagaaggaggccaggagcaaagttgtctgcccatcaggtccccaggtcctaccaaggcagagaccagctggtctctctgtcccagtagaaaattcctctggagagagaatctgattggcttgagatctgtgattaattttatgtgtcaacttaactgggccacaaagtccccagatatttggttaaacattattctaaataggaggctgggtacggtggctcacgcctgtcatcccaggactttgggaggccgagatgggcagaccacaaggtcaagagtttgagaccagcctggccaacatggtgaaaccctgtctctactaaaaatacaagaattagctgggtatggtggcgggtgcctgtaatcccagctactagggaggctgaggcaggagaattgcttgaactcgggaggcagagattgcagtgagccgagattgtgccactgcactccagcctgggtgacagagcaagactccatctcaataattaattaattaattaattaattaattaataggggttttctggatgagattaccatttagatcaatagactgggtcaagcagattgctactgtggtgggcctcatccgatcagtagagtcttgggtagaacaaaaaggctgaccttctgagggcaagagggaactccccctgcctgagtacctttgaacagggacactggttcttcctgggttgggagcctgctggccttggaacaggagctacaccattgggccttctgggctcaggcctttggactccaacaaaggcctgtgtgagaaatgatgtcgagaactggtcagttctcctgggtctccagctcgctggctgcaggtcttggaacttgtcagcctctgtaatcacatgagccaattaatgcacatcctactcttctctcggctctgtttctctgggggaccctgactaatccaaggtcccacagaacacaggtgactcctcgaggctcatctctgtggatgggagaggcagttcccagacaagggaacatcatgagtggggcagacacccacagaggcctacagtggccacttcactccaggagccgcacacctagctgcaggaacccgagccccagtgactagcgctcatgggaagggcctgcatcccagatatgtgatgacagcccatcccaaaggccagctcagaaaatgctaggatttgccttcacccccagtggggtcatgtgtatgaggggggcaagtgggaagggagactttggaccccaggccctgcccatcagccaccccatggctgaggggtcacccccataagctcttgaatgccagcacaaggcagtctggggaaacttggtgacgtggacagagcccctccttcagggaagtttctagactgggctgtgtgcttggagccactgtgctgggcacagcctcccccagttgaccatgggctctccaccatgtgctcctgccttagaatcagcctccttctctgtaagtggagatggccctggcggcccaggtatgagaggccccaatcaatggcacttctcccatccacctctgagctagcggggaaataagacacaagagtgaggcaggaaaagaccaaagcagcaacagccagggcctcttcccagtccccagggagcccctcggcccctacccactttcaaggccagcgatataataagtttgtttttgttttccaaataaaggtttatttctttctgcttaactctttttcaaaaaatttgattttattgtgctaagaacacttaccgtgcaatctcccctcttagctggtttctaggggcacaatacagtcttgttaactctaggcaggtgccatgcttcatggccggtccccagggcttattcatctcactgcactgaaacttgaggctctttgagcagcagctcttcagtcccctcccccagcccctggcaggaccatgctcctgtctgtttctgcgagtttcactattttatatacggcacgttagtggaatcaaacagtgttttgtgtctgccttcttcacttagcatcatgtcctccagattgatcaatgttgcagcatgtgtcagagtttccttccttttttttgaggctgaataatattccattattccattgcgtgaatacaacacattttctttatccattcatctgtcggtggacatttaggttgcttccacttcttggctattgtaaataggcttctaggagcataaggatgctgactgttttggataaatacccagaaatggggttgctggatcatatggtagtcctctttttaatttgtgatacgtttcatctctcactctggcgatgtctgagcttctcccttgatagaggtagaaagttccagagaggcacaggcaggcccgcagtgagaaggcctgagcctccttaccagggtatttctcccccacgggctgcctctcgctaactgcacagctcaatcacacgtcccttcccagggctgctgtgtgtcacacgctcacacccacactcgctccatctgtgctgggtcgaagagtgaccctgtatccacatccatccaggacctcagagtgtgaccctacttggaaatagggtctttgcgggtgtaactcattaagatgaggtcatactcttcatgttggatggtcatagtacatcaatgcctgttgttcttatgaaaggagaaaacagcagggccaggtagctcatacctgcaaccccagcaacttgggaggctgaggtgggaggcttgcttgaggtcaagaatgtgagaccagcctgggaaacatagcaagactccatctctaaaacaattttaaaaattaaaaaattagctggtggcacatgcgtataatcccagctactggggaggctgaggcaggaggattgctggagcccagctggagctgcagtgagtcgtgatcacactgctgccctctagcctgggccacagagcaagaccacgtctctacaaataaataaataaataaatgttttaaaaagagagccagggtctctctcttctctctctctctctctttctctctctctctctctctctctctctctctctctcacacacacacacacacacacacacacacacacacacacacacacacacacacgagggaatgtggtatggagacagaggcagagattggagtgactcagcccctccaaagagtgccaggaattgcaggcaaccaccagattcaggaggaggcaagtaaggacccgcccctgcaagtttcagtgggaccatgaccctgcccccacctcgatcttgcacttggagcctccatagctgagacagagtaaattgctgttgttgttagccactcagttggtgggcatttgttactgcagtcctgggaaacaaatgagccgtccactcactcatatacagcctacttctattttactggtgctttctgctaactcctctcctttccatctacatatttcctccttccagatctccctcacctccctcaagaggggctctgtggccaggaaacttttaatgagatctggaaaaagtgttacttgcacattaaatccattattttatgaatatcatggcttaagacaagctgaagtttaaaagtgagtgatttcaagttgatcagaagaaaaatatcaagtaaatggggtgcatggtgacacatgagttgctgaaatttggggagcactggaatgcaagaaacagcactgattcagggtctgtctgtaattctgggtccaaattctgctttccctactggcactgggacacacaggcattgttgaagtgctggaccccagatttctcttctgtaaaatggaatcacagggtctaaattggaggctttctctgaaggatgagaataaagttagaatgagaatgttcctagcatggtgcctggcatgagcagattctcagcagatgggccctcctgtaatccgctgagggctctcctgcagtgccagcagggatcctagtcattgtccccaccactcctgtctgtcttcacccagaaccttgtctggatcctgggaggaagcaaacatctcctggtgggaatgtgaggccctgccaggttgtaggagtaactggaaaagggcaggtggccctgcccactatgtgggcacctcatgataaatgatggctctcattagccctaactcctcaggcaccttcctacctggcaccattatgctgggactaccctctcactctgggagcttcacgataaacccatcttggcttaccctggacgcctgtcagctcctggcagggtgcaggccagagggataccttttgcatcatgagattgtgcaacttgggaggctgaggcgggaggcttggttgaggccaggagtgttctggcaagttcacggaaagttctggcaagtaggcaggccagcctcttgcttagacagtgctaaaaggattctttttcactatctgccagtaaggaaagtggccatcttgttcagaggacggagtgcagcatccacatacctaccagcatgaacttggtgagcagaggccacctgcatcccagagccacagggtccctggagctattggcttcttgcctggatacttccaggattcccagtttctggaagctctggttgcagtgtgccctggttctgtggcacccagcaggtctgcaagggcagccagtgggtgtgagtctggagagtgaacatccctatgagaactgactcgtgaccctgagtttatcaccaaggggcctctgcagagacaggtcctcaaattaagagccaggcaaacctgtagagagagaggctctgggggtagactgggaggagtggaggatggtcaactgtccccacgcacttcacgaggattctccacctcccatgtcccctggcatggggagtgcaagataacaaaaaaaaaaaaaaagagaaggcagtgagcaggacccactcttcctgcagcttcttcacactcttcctacagccccagctgggccacctgcaccagtctgtctgcatctggggttggggtaggtgggttctggctggtttatggagagcctgctcctccatgaggtccatatctgttatttttccgcggcatcagcataagaggtttctggttttatgtatgtattttctggctctggctcctggtctgcatttgtatgcacaagaaggcataagagagatagagcactggatttccagagacatgtgtctggcagcattcgggaaaataacattatagcctaggaatcccatcacacatatgtgcacacatgcccacatgcaggatcatggtatgttggtggtggtgcagtttgtgcccatgaaggaaattgaaaacacttgttggagagaaaacccagtcgctggcatactattcccatcacagaagaggcagagcctatgattggtgcctcactgaatcacaggaagtgttttattttatccccacatcatgatggagggccacagctgccagctatgtctatttcttatgcacaatatagaccacaagagagaataaaacaacctcaaaactacagtgtggaaaaaaacctgtcagctagaaagggggagaaggtatctccaggagccaagaaaatctcttcaaggaaaaataaaaaaagtaacccactttactttttccccaaactgacaaatttgacttgtcagatgtaagtttaacttgtggacaatccactcaagactgataatcgccatagtaactgctgtgtcacatgatcacacagaagcctagagacggggaaagtggctttccaggccacttttcttctggtaaattctgtgatgtcagcctaattagcaggagtggaatcaggaccttggttgaagtaattggcagcccttctttaaaaagaacaaaggtattttagcaccttctcttcctgtttatgggggcctgtgccaggaccaacagggctctggtgcggagtcttcctcacccttcttcctaactggccaagctccaagcagtgcctctaaatgtgattctttgtagagccatgtctggagaaaaactcgaatttatctcctgaagttttcaaaatatcagaaactggtgagagagggggccgggaatacatttcagggctatcccgtttctttttaattagtattgtacatttcaacttctttcatttccaactgcttctccctgcaaaataaaggtatcatgtctttaaagctctccgtccatgacaacattttgttcttatactagaaaatgccattcccttcccaaggcacatctcttttagttgggtttaatttgagatgcctcttgcctgctaaaaacattggtgacttgccccagcaaggaggtgacagggccacttgtccatgttggccccctccagtgggactgagtggccaccacccccagtggctgcctttcacaggaagagaactgccttcttcaccgccgggcatcggcctgtggaaatctgtgcccagacagctcaggtggcagcttatccaagtccccagcactctgctttgtctgccccaggacaattgccccattgtcttcaggctaatgaagtttctggtcaaaacacaatgatttcaaacatctcttgagcctctctgccctccatctggaacagatgagtacatcaatcccttcaaacctgcctcctccaagtgcattctgcagagttagtgtgtgggggtgcattttaatcaaccacgttggccaatgctgcctacctggagtgaccccaacccccaactaaactgtgagctgtggaaatgaacagaagccagccaaatgaggagcaaaggctatttattcagagcttgtgctagcgagggagtcagccaccatcccttgtgttttggcagaaactcagaggcaggtaggggagtgggaaagcctcaaagaagaaagaaaggaagccttcgggttgccctgagtggagggtgttggcctggggaaaatgaaggtggctataagaaatgagactcccatgtgattggttagggagcatgtttggctttctttcattggtcctaagttggaagtggggacaaaaacctagggaatcaggctgggcatggtggctcatgcctgtaatcccagcactttgggaggctgaagtgggcagatcacttgaggtcaggagtttgagaccagcctggccaacatgttgaaaccccgtctctactaaatatacaaaaagttagctgggcatggtggtgtgcacctgtaatcccagctactcaggatactgaggtggcagaatcgctcgaacccgggaggcggaggttgcagtgagctgagatcatgctgctgcactccagcctgggggacagagcaagactccatctcaaaacaaaaacaaaacaaaacaaaaaaacctaaggaatcggtcagttattaatcgagtcctagaattttggggctgattgctataggagctgttgtttggcttctgggatgattgctacagattgtgggtcagagtcctgtctttctatatggtcttgacattgtctgtatattgactctctcagtgtgtacaggctgtcttctcccagcctgcttaaaattaatgagagtttgaacagacgagtgtgtggagggcacatcatcattagtacaaatagccacagatggaaattctgcatgcctttgacagaactgagtttgagaggctctacctcaacagcttcctcagcccagctgaagtctctctccctgaaggcccatgcacctttctcagccattgctgggaattcaggattgtgtgttggaggccaacattgggtaccatgagtggaaaccatgaactggggcaagtcctcctggtacacacacccagctactttttccttcctcttctgccccatcccagggaaccctctttgtaccatcccacccactggccaaacttcagggtcttgtcttcatacttactgcttttttctaagggaaaagttattgagaaggcagtcaaggttcatttatttttaaccaggagacagtgcccccaaacaagaactgagtccctagttatggaatgtcagacacctcgcagcaggtggtggttctgaaacacccggatccagatggcagccaactccacccacatgtcaggcgggcgacagcatttccggacatattccttgtttagatgaggagattctgcccccagtaacattccttcaagcagcaaaatgatgctagatctttccagaggtcacagactgaaggcttgggggctacagtctggaatgtgttttgcttggcacacatgcattttaagttgtttaatgacctatcaagatttaaagatcaggagctgacctttcatgttaaaaagaaaatctatattttccaacttgtcttggaaaatgggatgctctggcaacacttggccatcttcccaccttcagatgctcagcagaatggcagctgccctgtggagaggaagcacctgttcccttccttgccactctccctggctggcctgcagttttctcctgtgtgtcacagttatggactgactgcttgtgtcctgccaaattcatatgttgaaatcctaacccccaaggtgatcatattaggagatgaggcctttgggaagtgatgaggtcacgagggtggagccctcatgaatgggattagcgcccttatgaaagagaccccagagagctctctcactgtctttccaccatgcatgaaaatgagatgttaaagtcttcaacctggaagagggtccctgccagaatccggccatgctgggacctgatcttggacttttgagaactgtgagaagtaattttcagttgtttacaagtcatcccatcaatggtattccactatggcagtccaaactgactaggtgactcaccttcttggcccagtgggcatttgatccagaataactcattactgtctgaggaaattcccactgtctcttttcccagaagtttttgtttctggtggcttcttgggggattccaggcacagtagggccaagcaatgggtatagagtgaccctacacctttgacttggcctcctgtggacttagatggatgggtgtgtttcctaggagccctctttcctgtcctcaacccttttcccatgagaaatgcctcttcttgcctcagaaacaaacgaaggggtcagtgtctgccaatgtctgctcagcccagagtgaatgtctgagagattcagtgtgaatgtgctggttgcctgctacagatcaggcttggcaggtggtggtaggtggttaaggttccagtttcagcatcaagtatgagttgttactgctcagagtctcagttttctcatctgtaaaatgggaagattcctagctctcaaatttataaggctccactggccgtgtgtaaaatgtggcaattagggaatactgttggctgttaactatatccaccaggacaggctggttatgctctggtaaaaaataaacccaaactcaatgtctgcgcccagcacacatttatctcttgtgcatgctatatggccatcttgactcagcagggttctattctctgtcacctttacttaggagtgttggttggaagaatcccccaaagtagtgccatcagtctctatggcaggggaaaggggacatggtgtatcaagccttgggcttgaaggtctattcccagaagagacatcattaccgcaactcacgtttcattggccaaagtgagtcacaagccaagtttaacttcaaggagcatgcccccaagcctctgattctaagtgctaccgccttaacacatttgagctcctgtaacaaaatgccataagctgggtgacttataaacaagagaaattatttctcccagttctggaggctggaaagtccaagaccaaggcactggcagatttggtgtctaatgagaacctatttcctggttaatagatggtgccttcttgctgtatcattacacggtggaaggggcaaacaaactctctggggcctcttttataagggcactgatcccattaacgacagctctgcctttatgacctaatcaccttccagagcccccacctcctaatgccctcactgggggctaggtttctccatatgaattctggggggacacaaacattcagaccatggcagcgctctcttccctcaccgcgtggctggctctccaactacaacaccatgccccatggctcacttccaaggagactttctggagaggtttgtcctaagagacagaagaatgcatcctgcctcaagttttagttgcataggttcaccctacagtgaggtaatagttacacattcttaatgaaaagatccaaaagcccaatacatcctgttctgcagcatataaagcatcttcttcagacctggtccaagactactctgggatttttgagtcagaagagagccagagcctattcagtatgctgtttgactctgatcccagcagccaccaccatgttaacaggatgagcagggctttcttcaactcagggttcctgtgaaattaaaaagaattctcatcttgactcaggattgttgaacactattgatacttcttccaaggtctcacaagagtttgcctcctctcattgccatgtgaagacctctgtgggggaacaatgcatgggttcttggggtattataggggactacagagaagtgtcacctccacccaacagcctgattcagtctactcctcaggaggaacacaaagtggtctctctagtgccatgaaaccccaaaaagtgtcaaccagtattaaaggcctgcctgatatacaaccctcgaatgcaacacagtgtccttctgaggccactctaaaggccaggaaaggtttgctaagaagtctgtgctgttaaaaacagaagaaaaagacccttatcccattgctctgtgtctggtggctatagggacagtatttcataaaaaaagaaaggcaaaaataattttcaaaaatgattcaagaaatgctgtcaaagatagcaaagaacagagtcctcagagaacagtgcccaggacaggataagcactcaataacatataacactgtgtagtgctgttgagtgctggctgttgttgagtgctagctattgttgagtgcttgttgttgagtgctagctgctgagtgctagctgttgttgagtgcttgttgttgagtgctagctgttgttgggtgcttgttgttgagtgctagctgttgttgagtgcttgttgttgagtgctagctgttgttgagtgattgttgttgagtgctagctgttgttgagtgctagctgttgttgaatgctagctgttgctgagtgcttgttgttgagtgctagctgttgttgagtgcttgtcctgcctgggccctgtttttagcctttgatgtacatttctccatttaacttccacaatagccctattaggcagctagtattattatttctgttttacagataaagattggttttagctcagagtagttctgaatcttataaaaagaaaaaaatatccccaggaactgaatcggctccaaaatagccccatcttgggctaaatatgggatgtgacaaagccaccatgaagctaggcccccctgtcctgacagctttccaccccttccctgcccctctcaccctgctttccaggggcaatgcacctccccacttctcctgggaggggtgggcatcctctcagtcccataatctgtgccaggcccacatatgaggacttgacaggattcagcagagatgcaggcctctgctctgctctgctcatctctttgcatatagtaatttaatgaggacaaaaactgcatagagctagtaatggcacgaccaagcagcagcttaagctttgagccgctaaactatgctgcctcctattgtaatacgattatattataacacaagttcaagagaccacccactgctttctttattggatcttccaataaagtggccatgctagtagcacaattccccacggaaatagataatgactattctaaaataaatccgaggacacacccagccacaaagtgggaggtgtattatacaaatgcaaccagggcctctggatctggcatttagacccacagcaacagcttgtgtttgctcagggctaagaatgcaggactcagacaccgagagcctctgagctgctgcaaactcatcaacccctccctattaaaggccattctgactaccctcagttttcctcaaagagcagttgagagctaaggtagggtagggagccaagaggaggcagggagagccagagatggcagccggcaacaggacacagaaagaaaagggacttcaaaggcagatctaataactcacagggctttttggtgcagagtctggagataatgcacagaaatgacaccttgaaaggggaaggaaaagaaggaagaacacatcatcagccccggacttcaggtggctgaaggagagaatgtatttggcatctaccatatctttgcatccttcaatgacacatttgtccatgtcactgatctttctggcaaaaaaaaaaaaaaaaaatgtgctgtgtgactggtgggatgaaggtaaagggtggccagatgaatcctctccacatgctgccacgctggccacccaggatgtggcctagaggtgcaaggaaccagacaccactggcctacatcaaactccaggccacagatggaaataggactgagatccctggacctggggcccgctcaggtatgaagatcaggtggattgaggatgtcactgccatcccctccaaaagcacctgcaggaagggggttgccatggtcaccatctgtgaacaggactcctcaaaatgttttctgttaataaattgccttcaagtaaactgaaaaaaaaaaaaaaagagggagagaattcacacaaaatgatgcccagtcttggtctgcatggtgaagggcccaggactgatgggcgggggctcatttgcataccacaacaccagggagagtcctgtcacctgccctcctgagtcctgaagaaaacccttcactccaattccctgtacactgcttctaaaggcaggaaatgtgtacagttctagaattacagtcacataaaatgctagaagaataacgtgatttatttaagtgcttagaggtacccccttgaagtttgtgttacctggaagttggcctcagggaaacacctcattgaccttctctcaaggataaatgagatgcagggacagggaagggagaaaggttattttaacatttcattcacagtccctgggattctttggagagcaccttaggaatgttcttaacctgagtcctcttactaagtattatcacatagtctgccaggctggcattattaaccctactttgcagctgaggcaactacaagagatgaccctatcgggctagtgaagtggaattcgccatgtactgcatgcagtcatgtactgcagtgaccaatccgggtctaatttctttgatgatatcattgacggggtagcaggggagaggcaagtgcaagagaagaaatggggtgaaacccactgcagggaagcttgggctggggcaggatcggggagccagggtatggggcatggttgggactgaaacccttgttaacactggctttagcaaaagaaatgggcaccacaatcccagaggacttccagaagcttcctccctcccccgcacctgggcacagagccttacctcccctgcaccctggccctgtctctctatttggcaagactcccatgtcatctgctcctctttacttcgggtccctcttggcactggaaatactaagtgaacccagcagttgcacaggattctaggaatttctcctttccaacttcctgaactggttttctaattcacctcagaggtaccttaacaaatcatgttccaaggccaggcacagtggctcacgcctgtaatcccagcactttgggaggtcgaggcaggaggacctcctgagcccaggagttcaagaccagcctgggcaacatagtgagaccgtgtctctacaaaaaataaaagaattatcctggtgtggtggtgtgtgccactacactccagcctggatgaaagtgagagatctctttcgaaaaactcacgctccacacaatcaggaggtctgccatccacagactccagacagatagttccatcagccagcaggagcggcatgggcaacgtcagtagcatgcacatcaggttagcttctctgaggtcacaaagttgcctggaagtggggaatccatgagggccaggccctccacaggaggaggacttccctctccagtcaccggcctccctgatgtggttccctcctctcagcccacatgctcctgccgaggtaacatgtccccccactctatgttagaaaaccataaagcccccaagagacgtttctaccaatcatctaaatattgagtttcaccttataaaatttataaaacgtaaagaacacttggaacagcccagttttaatgcctccagcttttgttttccaaagaacaattggtagacttggccccgaggggagcagagcccggctctcagacaacgagcctcaccagcaattctgtatcttcgaggcggcagaggtttttgtgatcttgtgtcatttctaaacacgacggtgtagatgggatcctcttcattttgcaaatgagaaaatggaaaaacccgagggacaaagggcctctctcaaggtgccatggtgagaaggaggcagaaggaagaggacctcgcccctgccttgattccactgactgctgtttatcacaccatgagtgtcttcagggagcagtcgttctcccgctggaatgtttacatgaggagcaaatgtgatgccatcacataattccagtgagggctggtcatcccctgcaaggctgaaatgaccctgtctgttttaatgctaaggaagcagcagcttttctcccactcccacacaggatgtgtgcagcatcttcaagtctctgcctcgcgtttctagatctgtagtgagctctccatggtcagggagtggatctttcagttgggtatttttctgaagcaactgtcattctttgctttttgtaacaagacatgtttttaaaatcctctgagagagaaagagtgttgccagaaaaggaatgaagagtgggagaaaggtgcattgtggagctgtctgagcgttggagtatgtcccaataacgaagagactgcggagaagcatcccctgtccccctccgtgttctaaatgtatgaaacctaacaaggtaattgcatgggaataacacactgtgaatgttatgtgggatttgaaattgtcatcccaagagtgaccaggtggagagaggaagggtgaactctttcagtctaaaagctatgttttaaaaggcagggttagactatgtttgtttctgcagtgtattttctctgcataaagggatttttttcctactttttctgctggtggacgtttcccttgggggagcctggccaatgaaaggtcacacagagaccagtcactctcaggaacaccagcagagccgggcagacacatgtcctaattttcccaggagcagactgattgaaccataggagggtctgtctgatgtttatcttggcagaattctcagatgagttagcaaatagtggctggagataaactgaaactttgagcaacctctggactgactctgattaccctccacaccctacctgcacagggaggagagaccacaaagccagcagcaaacagtaaacttttccaagaatcagagaggaaggagttcctgacaccctgcagcaaaaacaacctcaaaattcccctgaagacagacccatgggagctggggtcaaggtggccttgcgcttcaccgaggaggtgtcattaccaaacgtgctggacattggctacctacggaagaaagattaaggactgaaagaaaatagtggagaacatgcttttgacatgggggtaggacagggaaggccttgagcaagacacaaatcacaaaagcaaatagagaaagagtgatgtctaccttcaatgaaatgtgaaacttctgattcaaaatcggaaacctctataagctgagataaaagacaagcaacagagttggagaagatatttctaacatttgtatgtgtgcaaatgtatgtgtgtaatgtgcttatacatatacatatagataaatgcgtgcgtatacacatgaattctggattgttatctaggctctatgaagaattcctatctgttaataagaaaaaagaccaagatcaacaacctcatagacaagtggataaagaagatgaccagttagtccacagaaaagaaaatgcaaatggaagtgggagggcccagaggaactcttgctttatctaaattgtgttgattacgggagcatatgcttatattaattttataggtaaaaaaacagaaaaagtacctgaagattaaacctaagcaatgcgatgtgtcagttttgacaacacacaggaaggggctctcagcctgtaaaataggagcccttttgtgtgaagctgaccagatgcggagaagtttcaacagtcctagagaagaggaccgcaggggacagagagccagggaacagggcagggaggatctaagagggcacccggccaagcggttcactgcagctggtgcagggctcagctataccctggggctgggcgcttagcacagtgtggtcagatgaaggcaagcaagcagtggcagggactctccatttgagtcaaagtgacaagcagtgcccccagtccctgggaaggatgaaatccaaatttaattcccttctgaacaacattctacaatctatgcttcatttaggtatctgtaagcctaaaagagctgaaaaatcattttatttccccttccaatgtacaatttctaagacatttgaattatcgatgttgaagtttcattgagaatgagctgagtgtcctgctttcggcctgaaaacaaagcctcagccacagtcttcgtctcaccctctttctctctgtttattttcttttaaaaagtttctcccatttctttgttctttaacaaagagttgtgtgcatcttctaagctccaagtgctgcactggcttccagcagacaatggcaaccgtggccctgacctcatggcgtgactgaacggagggtctcggccaggaacgtgagggacgccagaaagaggacattggtgggcaatgaggggtcttccttgcgggggggtgttggggggtgtgctgtgcttccctagcagtccacgaccactggcaggggacaccccgggcagaccagtggtccaaatttataccagcgaaaagcaaatgctgatgccttcccaatcacggttccttcaaaggcttcagggttccttgggaagggaaaagaacattagttcagctcctgcgatgtgctgggactgtgctaggaagtttcacagatgctagttcatttagattggatatgcctcctggaccagtgtgctgtccattatggaaaatcaaaacagccattgcatttccatagtgttcacaaggagcctcatttctgggctcaggcaggctgaggcgttccagggttgagaatcagacttggtgactgagcaggaactgttgtcctttttctcttttgagatatgaaatttgcttcacatctcagaagagtgtgtgcctccatcccacacttgggacaagcgccgttattccttttttaaaacatctgtagaacatattaaatgctctgctttcttcacgggttaaatcatgctggggcgggaggcttgtggtgtaagagcggtgcactgtgcatccactagggctctcccgtcattccagttggtctccttgccacgccccagctcgctgcccccaggctgtcttggacagacacatttgtgttttgtaatagagcacatcatgcactattatatggggatattttataaaggagcccacgtgacacaaggaaactaggagaaaacaatcctagaaatccccaaagcttggaagcagggacatgcaagcgaggtacagcatatgctatcaagtggcaatgtccttccagtaggaaagccgctgttgtcatcagtttaggcaggtgctgggattaagcacatctaccactcagaaaataataccaataagaaccacggtccacatccaacatgggtctcccaaattctctaaaatgtggaagtgtgcagatcttagcatctctgtcctttctctcgcttcgaggaagttgggctcctgggcactgcctcatcagtcatgcccagtacctgtgtacaggtgcctcccctgctctctggagcatcgggactggaaggattgggaacagaacggagctttgattgatcctcttgtccgcacttgtgcctttcaactccctgtggtggagggtgacagtttagtctccctgtcttctcctggggtcccaccggctcctgaatcaaatcctgctcttcccctgcatgttctgagtggcctgtacactctgggctctctctctccttgacccctggaacaccacctctttggttcttagtaaaccggagccttcctacctggtagtagcactgacatcctcttcatccactggaagcttccagatcctggcccccacaacccattctctccccatagggcttccacagaaacacaacgtgtactgtgtgccaaatgactggcccagaggatgagtgagtgggggaccaatgtaggctaggggaggggtcagaagagaaaagttccaagagagtgggaacccaaggaaggcttcttagaggagctgggacacattggggcctgaaggaagtggacatttagacgatcataaagactgcagggatgtccaaccttttggtttcactgggccacattggaagaagaagtgtcttgagccacacgtaaaatacactaacactaatgttagctgatgaagaacaacaaaaataatagcaaaaagtctcataatgctttaagaaaatttatgaatttacgttggcccacattcaaagctgtcctgggccacatgcatcctgcgggcttgggttggacaggcttgagctaaagcaagtgtgttctgagctggagagaaggccagccccatggttcatcgttcgtggtatcaccaaccaatgatactaggaacagttggtgggtgcaggccctgggcagggcaataataagaaaaagcttagaaaagaaaaggaggaggaggaggggagttgcgggtcatggagggccttgaaagcgagactgagggtttggaccttaccttttcggcatactaccgagcaggaacccctgtcactgtaatttctgatgattctgccttccatctttgggaataacaatgacatagtcgactactcctctacaaaaagagtcgtcagattctttaaccatgtggggcatcttgttttggcatccacactagttctgttacagccaaagctgggggtgttggggaatgtcgcatgcttcaggggtatctgtgtagtgtgcattttacccagctgagctcacaactttaatgtgtgaaggtgatcctccagttcaggaggacagagttggtgcccctgcctgtaccatcctaagagaggtttctgcttcctgtgtcctgctctgtgggctccccaggtacccctgtagtttttgcctaatactttggaaccaacaataataacttatgaaatctttatttcaaacacagcttgaatttcatccattttcatcttacccaaagagatagattctctagtccgcaatctggatggtcagaatggagaaatccccttacctgcaaacacaggtcttttattttgtaaccactgtctgtctggttttctgttttggagtctcccagggtgatggtgccgccagataaaagttctaatgagagagggagggtgggagggaggttccggtggcaaggcagggcggaaggtaagcggagaccttctccaatcagaagtctagaaggcagggcacgcagtaggtctgcagaatgactcagaacccgcgtatgaatgctgtctattcatgggtccaggcttttgttaaagcctgggcctgcattttaaagagggagtcagggaactggctggactggtctgacaactaaggagtggtgaacacttcccccaggctagtactcaggtggatgaagtcatcaatattttctgggcagtcctaatctgtgattaacttttatctctgctgtgaaataacagcctccttttcagcctgctaacaataagttaacctggctgcccggctgggggatattttatgctgggctccagcagaggcacacttgagaagccatgtgggactcctgccctggagagagcccagagtagagggaggggtctgtatggtggtgggagtcctctcagcaatggtccttgtgattccggtatactctgatgtcctgacttcaaactcagcttacccaaagcaaatgtccactttcttccgtactcctttcttgtttaaagcctcaccactgaccaggaagtcttgatagagccatctagtaattcttaagtcctacctcatccaaccttgttttgactcctgcagtgagcacagctgccctcaccctcccctctctatgccctcacctttgcaggagactctcaatttctcagtccacatcagctctcagaccaccaaagcaagggttatttttctaaaagacatttgttcccattgctcctctgactaaagttcctactatgggacatttgcccttggcactcaaggaccttgcaatcaggctgagaacctcaggttctcaaactcaagaccatggggaatgtaataggtgaatcaggcaggtgaagtccaggactctttttggtttatattttgtttactcagttttgatggagacaagcataccagaaaattcacattcctcttaactctagcagtagacaaacaacagagcaagcaggatgtgaccatttatacatggcctcactgttggggaggcagtagggagtgttggagaccagggtcaggactagggctagggcaaggctaggaaggtgcccaggatgcatgttttaaggaagcactcactcttggggctttgcaagtacaaggctagcactgggagatgagtgcctccttaaagttggcttcttgggccttgtttgcctgacctagtctggccttggtgaggacagtggagaaatggagcatggacctacccaaagggatggctgctgatcagcttcacctagctgttgccaaaggcaacactgtggccccacttttgccaaatcttttcaaacattctgtgggtgcttccatcatagctattatcacctggcaagggagttgtccccacaggtaaccttctcactaagtgggggtgtctgaggccagggagagctctactcattcccctgtgtgatcccagcagtgagcatagagcaggtgccctgcaatgttaagcaaaaaaaaaaaaaaaaaaaaaaaaagactttggaaatagagttatggagccaggatgggtcttgagttagcctcactctttatttctttattcaaggaatggttgttcagggccagcggctcagccctgggagcactgactgcttcaagacacagactcctctgggatgccaggcagagtctgctcctgaaggcagactccactcttcatggggctccctccattactcattaggtcacagaataatagaaaaaggcaggaaagatgaaaaaagagaatttaagaacaaaacacgtccaggtgtggtggctcacacccgtaatcccagcactttgggaggctgaggcaggcagttcatctgaggtcaggagttcgagaccagtctggccaacatgaagaaaccctatctctactaaaaatacaaaaattagctgggcgtggtggtgggcacttgtaatcccagctactagggaggctgagcccagacaatcacttaaacccgggaggtggaggttgcagtgagctgagattgcaccactgcattccagcctgggtgacagagcaagactctgtctcaaaaaaacccaaaccccacccccccaaaacccaaaacacatggtagcaaaataataacaaattgaagtatgtctgtaatgacagcaaatgggaacttacctactccaagacagaaaatgattagattagatttctaaaaagtccaggtaggtcttgcttccaagataccatctaagatgaaatcacacaggctgaaaataaaggaatggaaaaatatacactatttaaatgctagcaatagcagacagattataataggagagagactatataataatcaaggcaccaaccgactcagaagctgtcacaggcccaaatgtatatgtatgtgtctaacatacacgcacctcaaaatatagtaagcaaattgacagaactacaagtctaagattacaacccatttaacttgatcaaaagttgataaatcaagcaatttaaaaagtactaggttataaaagatttgaaaaacaaaagtaacaagcattatctaatgggtgtgtgtgtgtaaaactttgcggccaaacataaatggtcatcatagatcatttaaaaacagttggtgatatacagattatttaaaaatttgaccacatactaggtcacaaagaactcaacaaatatctagaatcatcaaataacacagatcatattctctaaacacaacccaattaaattagaagtcaatactaaaatacagtctcaaactcatatatgtgggaactaaaaaattcactccctagtaactaataggctgaagaagaaattacaacagaaatttgaggagtttgagaccagcctgggcaacaatgcaaaaccctgtttctacaaaaaattagccaggtgtggtggtgggtgcctgtggtcccagctacttgggagactgagttgggaggactgcttgatcccaggaggtggaggttgcagtgagccattatcatgccattacactccagcctgggccacagagtgagaccttgttgaaaaaagaaagaatatctagaggtaaatttatagtctgacatgaatttatttcaaaatcatgagaggtttaagcgagctgagtgctcaaaatagcaattgtaaggaacttccttaatgtgataaaggttatctatcaaaagtgtatagtaaacattataattaatggtgaaactttggaagcatgcccatcaatatcagtaacaagacaaggatgtccattgtcaatatgtctattcatcagtatcctggaagccgtactgagggcaatgaaacaagcaaaagaaataggagtataagaatttagaatgaagcaagaatatttttatctgcaggaaatatgataatctatatagaaaattcaagagaattttctaataaactattcaaatgaaaatacagtccaacgaatatatatacacaaaattgggtacaatttatatgtattaattataaccaattagaaaatataacaggagaatgagtcttatatttcaactaaagctataagatctttctgcatacattaaacaaaatatgtgcacgttgcttggttttgatttttcttggttcatttggctggttttagaggaaacttggaaatacacctgagggacatgaaagaaaatattagtgagtggagtgattcaccacattcttaaatggaaaaactagtgttgatttaagaaagatgtcaggccgggcgcggtggctcacgcctgtaatcccagcactttgggaggccgaggcaggcggatcacaagatcaggagttcaagaccagcctggccaacatattgaaaccccgtctctattaaaaataaaaaaattagcttggcttggtggcgggcacctgtaatcccagctactcgggaggctgaggcaggagaatcgcttgaacctgggaggcggagtttgcagtgagccaagattgcgccattgcactccagcctgggtgacagtgtgagactccatctcaaaaaaaaaaaaaaaaaaaaggaaggaaagatgtcaatatcatctcctaattattctttaaattcactacaattctatccaaaatcttgaaggggatttttttgtgtgtgaaatttgacaagctgataatcatcaagactaattatacatttataatacttaacatagtacaatatcgatatatagatagtgaatagatcaatagaaaattagagaactcagaaactgacctatgcatctgtggaaatttcatatataacggaagagtcattacagattagtaaaaagaaggggtgggctcgttcaagaaataacttaggaaaaataggttatccatacaagaataataaaattagatccttatatcaacgcacatgtaaaaacaaatccttggttgattacatacctaagtgtaaaaagcaacaacttcaaataatttagaagaagatgtagaagactatctttatgaactcagagtaagaaattattttcttaaactatatacaaaaagacccttaatgcaaaaattaacagactatttggtttagtaagcaggattgtattttaaaatttttaaattattcataaaaaatgttaaatgtcaagccagaaaccagtatttgcaatgcagtcatataattgacaaaggccagaatccagaatacatgaacactggcaagtcaatggaaaaaatgaccaaaagacatgaacaagttatggatgaaggcagctcaaagggcaaatgagcatttgactagatgattacctcttagtaatcagagaaataagcaaacaaaaaagtatgccacctgtgtattagggttctccagtgaaataaaacaaataggatttacatgtatatagaaagagatttgttttaagaaattaacttccatgattatgaaagttaatatctcttccatgattatggaagctggtaagtccaaaatctgcatgctgggctggcaggctggagacccggagagaagacaatgctacagctcaagtcaaaaggccatcaggctgaagaccccaggaagagctgatgttgcaggtgaagtcccaagaacagtttgctggagaatttcctcttgttcagggagctcagccttttactctattcaggccttcaactgactggacgaagcctgcccaggctctggaaggcaatctgctttactgaaagcccaccaatttcaatgtaaatccccatcagaaacaccctcacagaaacattccggccaagttgacactcaaaatcaactacagaacctccaacacatcagactggccaaaacatttgtctgccactaccaagtgttgacacaaaaggcaaacataagaaactcatactgggctggtgaggatgtagagcatggatccagactggagaacctctcacacatgtgcacaaatattcactgcatcattatctgtagtgaaaaattgaaaaggaactgaaaaacaatcagcagaaaatagacaaattaattctgataaggttcatatgactgagtattatacagcagttaaaggagttagagcaacaggtatctgcatggataaatctaaaaacaatcatgagtttcaggaagatagatacaacaggacagatttccataaaatggaaaacttacaaaccaatactttatattacttaggaatgaatactgtaggaaaatctaaaaaacaggcttgagattaatacacagtaaatttaaggttgtggcatctctgaggagtagggaaagggaatgagatcaaggaggccttcatctgtgtctgtaatgttttatgtgtttttttctaaaggcttgaaacaaatatggcaaaatattaagatctgataaagccatgtgggcgtatgacatttgttatatttctctctatccttattcatgtgtttaaataattctccgaaagcagtttactgagagttcagcatgtctcctgagacatgctaggaagttatgtgcaggagtggagaatatgattcattggaagagttaagtgccctaaatgccagccaggctgtgaccccaggacagaagtagggtgggggggccttcttgcttgctagtgacaatctacaccaaccagcaccacaggagccccaggatgacaaggaaggacaaaacacagggggtgacagatgcaatgaacccctatgtggtacattgagtggtggagaccgggtgtaaaacacacgatcggtgcagggagaccagctatggaggctttggggaccatgataatgaccatccagtgtggctgtacttttctctagaagagggttggcctacatccactccagtggatccacattctctcccaagagactgataagagagtgaaagatttaagtcacctgtgtgggtggccctcaagacccctgcaatgaaaacccaaaggggtatcacagtgttttctggcaagaattggccattgcttaattttcttgtctgatttttcctagcaaccttgtatttgacctcgcctggcatcctgtgtggtcatgagccacagaggtggaaaaggcaacatggtagaggcaggaggaggcaggaggtggaaaagaagggttatcaggtgatgagttcagccatctcttgccctgagtttagttgtgctttgtttataaaaagtgcttttctacaaaaagtatttgatggtacaaaatattatcaatatggcttagatgggtttgagaagtaagaaaaggatcgtggtggtagcaggaaataagacagaaattttccatgggggctccaggtctgaaggcactggcaggtactgcagggtgcctcaagcaggcgtcacttgatagggtcaaaaatcagtaatgtctatgctcatctccaacctctgcagatagaggaggaaatgttgtgaagtatttagatgcattttcttaggtgcgttgtttttgttgaattaggacatgaagccagccacagccagctgtctctccccttcggtgagaaggggacgacgtgaagcacccaagatgtgaaccaggactcaattcacatttggggaacctgatagcctcctcagatgcccccacagaaatccagattgacccctgaggctgagctttaccctctgcagggatgacttccatccagcctgggatgggcaggggaaaccgctgctcacccgaagtgtatttaaggggtcccaacagcaacttatcaacattttttgttgtaaagcacagagagagcagtgaattctgtccattttgtgagcagcacatctggataaggcgggtgccccactgcattcagagcagctctgggaatgaggaaggaagagacaacaaaaggaacaggagccttccaataagcccagacattagacctgagccttgtccctgtcataggctagtcattattgattaaaaggtggacatcagataaacccaagagggacagccccgccaacgtccagagcaatgaggccctcactctgccctcacctctgccagtgtaaattctggggaatttctgaaacaccgtgaatacagaggtgtgactcagcgggaatcacaggaatgtcagaggacaaagcagttggtattaataaattgctttgagtctggaaacaaagaagtggccttctttgtttccaggctgaagtacagtgctgtgatcatagctcactgtaacctcgaactcctggcctaaaatgatcctcctgcctcagcctcccaaagcactgggaatacaggcatgagacaccatgcctggcctggccttcagtttctctgctctaactctgcgttgccctagaaatccttttctgaatttctcaggtattagacattcacccatgacatctgcatctttctcatcttcaccagaatcaccctgtcttaattccttaactcttcctgcttcttgccaggctaagaagctgtattagttatctattgctgtgtaacatgtcaccctaaaacgtggcagcttaaaacaaatgtgtgttatctcacactttctgtgagtcaggaatatggacacggcttagctgaatgcttgtaactcaaggctgctcatgaggctgcagtcaagctgtcacctgaggctttggtcttatctgaaggttgactggcatgggggcatctgtttccaagctcactcatgtggttctgtccctccccacctaggcatctccacaggctgccttgtgacatgtggctggttaccctggggtcgtgtgactctagagagagtaggacagaggacccaaaatggaagccacagtgctttttataacctatgaagatgtgacatctcattacttctgccctattctagtcatagaagcaagttacttagaatgatccacaccgacagggaaaggatgacatgagggtgaggatacagggagagtgggggtcactggggcccatcttagaggctgcctaccacagaatccctaattatttctctgaaaataaaaggaggagaaagagacaccatattctacatttctgctcacctctgtggtggggctgatgtgcatggttttcatggcttaaaagcacactccatctcactgggggtttcccaaatggtcatatgaagagaggaattgctccccagaaccgctggggcacctcatttcgttgatgctttttcttcctctccacggagatgctctgggtagaaggaatgaagccttcaaggtggactctggagggctctcccagaggcttctgtctgaaccagtgggcttaaaaatgagcaagggagaaccttcatgaaaatcactgtcaagtactgtctcagtttgctccagctgctgtaacagaataccatagactgggtggcttgtgagcaatagaaattaatttcttgcagttctggagtctgggaagtccaaattgaggtgctggcagattctgtgtctggtgagggcccacttcctggttcatagacagcctactcctcgctgtgtcctcacctgaaggaaggggcaaggcagctctttagtgtctcttttatgatagtactaatcttatttgtgagggctccactgtcatgacccgagcacctcccaaaggtcccacctccaggtatcatcccactggggatcaggcttcaacacatgaacttgaagacaaacatttggtctatagcaaacacccaccatataccaagccccgtgcttctctgggcttgggggtgctgggataccaaggtaaattaagcctgggctccatggcaagctggtgtgatggttgagagaaggtctaaggggtcagtaaggggttcttgcctggcacggtggctcatgcctgtaatcctagcactttgggaggctgaggtgggccgatcacgaggtcaggagttcgagaccaacctggccagcatggtgaaaccccatctctactaaaaatacaaaaaagtagccgggcatggtggcatgcacctgtaatcccagcactttgggaggccaaggcgggtggatcacgaggtcaggagttcgagaccagcctggccaacatagtgaaaccccgtctctactaaaaatacaaaaaagtagccaggcatggtggcacgtgcctgtaatcccagctactcgggaggctgaggcaggagaattgcttgaactcgggaggtggaggttgcagtgagccgatcatgccactgcactccagcctggatgacagaacgagactccgtctcaaaaactaaaataaaataaggggttctcatcctagtgctattctcagctgagtgactttgggagagtgacttgaccttcatgagcctcagtgttcaaaggatctttatgattatgtttgtgaagccctccgagtcacctctgagtctgagcatccatctaggtgctccatcagcagtaggtattcccagtgctattgcagagaaactctctaaacccacctctcaaactgggccagcctggagactggacccagtgggtctggatgctgacttgagcacacatgtacctcggctcctcaggaaactctcatgcaccccagtggctgggagccactggtctagagagtgagctgcatcaaggaatggtggcacgtgggaatgtgagcaggtgcaggtggacactgggccaaggtggggcgtgtctggactcagggcctcgttggccaactctcctaggacttaagaagggagaggagcccagatagaggagccagttttttttttatttccaacttttattttaggttcaaggggtaggtgtgcaggtttgttacatgagtaaattgcatatcatggggttttggtatacaaataattttgtcacccaggtaatcagcgtaatacccaataggtagtttttctgtcttcaccctcctcccatcctcccccaccaggagtccccagtgtcctctgctcccatctttatgtccatgtctactcaatgttgagcccccacttataagtaagaacatgcagtatttagttttctgttcctgcgttaatttgtttagggtaatggcctccagctctatccatgttgctgtaatggacatgatttcattcgtttctgtggctgcacagtattccatgttgtatatgcaccacattttctttatgcaatccaccatcgatgggcatctaggtctttgctattgtaaacagtgctgtgatgaatatatgcctgtgtgtgtctttatggtagaatattttgtattcctttgggcatatacccagtaaatgggattgctaggtcaaatggtagttctagtttaagttatttgagaactctccagacagctttccacagtggctgaactaacttacattctcaccagcagtgtagaagcattgaggggccagttttaaatcctagtcccttcctgatgctttattcatgctttattcctgcctcctgtcacccgtcttagggatgattcacccagtcccttgctcctggctggaaaaaccttttaaggaaaagtcgctaatctgggtacatctagacttagctttgcccgtggaaagtctcttgcttttcacagccatttgctacccaccctgcacctccccacacccctcagacttcatgcttgagtcctgtttaccaaatgatgggatcctgttttgtcacctcagtcccctctgaggggcagtcagctggctggagcaggaggctgctcaatcccacgctgcaggctcctgcacaaggtcagatgtgcaggccatcatgaagtgagtgtcgagggtggtgtcatcctgaaggttaacactgtagcggggagagcatggggttgcgtgtccctctccctccttgtgcaataactatcgtgggtaattcttttatcgtcttttagataatttttacatccacaaatcagaaaaggaatgagaatcaaacaaagtaatacatgtggaagaactcagagaacagtgtcattctatagcaacaatcaacacagagcctctgctaagtgtcaggccacattctgagcacagcggagacaggattgagcaaagccaccacagagttcacattataaaaatgaaacaaatgaatgacaagtgtcacacggggtaacaagcacgataggggagacagaatgaggagagcatgtttaacagtaagaggttcgggaaggaagccggcccagacctgagtgaaattagccatgcctgtgcccgggggaagcaggtgccagcaggaggaacaccgagcccagcctcctgaggtggagggcatggggcatggtaacaggctgcacaggagctctgctctggagcacgcgatccgggcacaaccaagagcattggtggcaccacttgaacacttgcagccagctcatgacagcatttaaagtgtctttgctgatttgttgaaaacaagatgtaaaaatcactcagtgagaaggtggtatagaccatcagcctaactccaatcctgctcgggcttcacctcccacctcccggctcacgtgccctcgcagcaaacttctcattgctcctcaatttatctccagccccagttcctctgttgaatatcttctgccccatcattgcccctgttttctaagaaccagctcaaacatcaccacctcggtggagattccctcctcctggggttcacccaggaaactccaaccaggaagcaggaggtgggattccttggatgaagaagaggtgagtgagtccccctatgatgtgagctagtgaagggttgtcatcagctcagagtcattccaaaatactcttaatacatttctgttttcattgtatctttaggaattagtggcgatgtttatgccattgcagaaaaaaaaagaatgatgctccatttcacagcttacagagctggtttcacatacacttgaatggtccagctatttctgacagctacaaaacacaggcgcacacaccaccttgccttctgggaagctgtaggagacacattacctcttgacaggataaacagccacacattagagggtaaaggcagggcaagcttcaccccagcacctcctaacctggcacaggcttgaccacatgctacttcaatgacttctttttgagatcaaacacctgcccagcaccccagtctcctgacttcttgcttggagcctgcatctcagcttcctcagcagcaatgaaaaaggaagccaaccccgacctgtagaaatagtgtatttcctcaattccaaggcacacaattgttcaaattttaattattctgaaatcaggatgtgtcttacaattagtcggtacactacatgtggggtttcttttttctttcgtttttgttcaccccctacaagctgttcttaaaacaatggtgtgtcatacaattgatgacatcttagaatcaaataaaataatagttaaaatcatggggtggcaatttaaggtccacccgtgtcagacttctcgaagtcattgtgaaactgtgttttgttctgctttgaatgtctggtggtgtgaacccagagagactggattcctagatccctgaggcctcctggccgagccaggagcatggggcagacaaagggcaaagcatggtccctaccgacttgtcaggcctgccagccctgccactggctttgtgattttcattcctgaattcatagagatggctgccagcaacgagaggtaatctcaggacacacaggcctgggctaggccttggaatattccggaagtcggtggccagagttgtatcaagccagacgggacacatatgggaatacaattacagcaaagcctgcaaggctcagtgaggggcagagggcctggccacatgaggagccagtgctgtgggcaggcctgggtctgagtgccagctgtgtgtcctgcacaaccacatctcccagagtgcattcgtcaccatccactccagatgccccttgaacaaatgaatttcacagttgcaaaaggctgaaaaatgctctgtgacctggcacccccttggggaaccacagtgcattaaaggctctgagaagtcctgcagtaaagaaacctgatgaacttttgtttaagttaatgttttccaaacttctttgatcacagaatccttttattccagtaacaccttttacaatcttaagatgtgaattttctgcagaacagccacctgggaacaggcctgtcttgtgcagaagcctgagggactgggagccaatctcatcactccctcacttgattatggaaagatgaaaacagagagtggagaaatgaagggtaagaccagggaagagattctctctggggtcccaaaacatggccctggctatggacatacttgggggtggggggatccacttgcctgctggcctcttttgggcagttggtattggttgcccgggtatccccggggcagtagctgcagcagtggcctgatgggtgtgcaagcagctagctggtgtgtccagcacggtcttggcacacctggttgttttggaaaggtcttttcttgaacaggaacttgcatactcaaaaacaacagcaaaacacaaggccacactcaccccccaagggtaagtccgtggctcctcctgcacacccaggaaagatcccgtggaaacacagcaccggaggatatgggataagagacaacagagaggagtggtgcttcctgaatttaggaaacatagctgctactttgggccctctagatacttgaaagaaaaaatgatggaaatcactaggtgagaattaagttcttggtgaccactggctgtatgcaggacaaatagtactacaaagtactacaaagaatgcaaatctgtctgctgcacccagcaacttccagttggtaaaaggctatgtccctggagaggtaataactgccactgtaagaaattcctagggtccaatcctgaatccttctctcaacagcaggattctgggaaagggaagccaggttgttcatggacattcagtggaagaattaaggcaattaaatgttaagttttgcagggctggtcgacaagagaagaagggaatcataggtaatgagcacaactaaaatgaaggcacagaagcaagacggtcaggctttgctcagagaataacttcaatgagagcagtgagcaggtgctccagggtcctgggagacagtgggaggtgggtcacagagagcaggctgaggagtttggatctgctcatagagaaatatcttaaactaacagattccacgtcaggcaaggtctcttggcttcaaggagctggcagtcaggagggagcgatctaatgctgggtgggggttgagagcatctggtggaaagagggaggatgtgggcaaagagtttttccataggtggtgtggttgtccgaggggaggccatgaacagagagaactgaggcagggagagggaagcccacaggccttggggttgggtcagaggaggtggtcaaggagggaaaggaaggagagaagacaaggagaaaggaggggaagagggaggcacctcccctctcactggtgtcaggattcagattgtgactgggctttgcatagagcaggtgggcagctgtgacccacacatgatattccacccgaagatgtgtttttctgacatgcacagtaattttcaaaagcaggaaaactttatatagatatctagatttctctagataagtggaaaggcctggccttcctggacctgcacctggcagtgccacctggagctggtcacagctgctcccacaactcctggactgggcgcttcagttggctgtagtccccacccttcctactgcctcacacccaggtgacttcactcacgtccactgacaccgtctgcctgtccccaaggacactgaagtttgcaacctaggtgcagattatgtgcacacagggctgccattcacaggagggagatggtcagtggggtaggagggcgctgaaatccagcttgcatgcatgcccatgttctctgtatgtcccagggaaggaggtcccttctgtatttgcacaaagacatcgtactggctgaaaatggccctgcccgcaaattctcccaaaggtgtgtattctccattggtcacaatgcactatgtagcccatgagaaggagaccaactccggggagctgagagtgagaggagactgcattctcagacacaattgtccagacacttcctttaaaaactacacgccaatgcccaataatgctcagccttggaaaacagtgagtgtctaatcaagccatttaaagcagggagaagattttaattggttgcaagggctggtgtaattatttacagcatacagaggttttccttttgaacctcacagcaatcaagtgcagcagcaatttttctttccctattttgcagatgaggaaatggaagcttatggaggttaagtgattggcctcaggccattgcatttaatactactaataatattaacagccatagtccatcctgggcaggcctgagcatctcacacacatttgctcatttcctcctcaccccatgagagcactgatgctactttttcctctctcccagaagaagacagaggcctagaagagtctgggcagactccaaagcccacccttctagtcccaatgtgagacacccccattaataacaccaaagggcccacacctaaaggcaaatcagtcaactaaaatccaggtctttggtctagaatctgtcactcttattcctgcataatttttaacactggactcatggtgccttgagctgaaatggttcatgcaggatatatcaaaaatctgagcattaaccagagtgtttgtaatgacaaggaatctgtgccttttctatgagacataccagctctgtgtttgactctggtcagtgtaggcgttaacttctgatctgaatcagcaagacctgggttccagccttgccctgcaacccaccagtggtgtggccttggacccatcgcctgcctgtcaaggcctcatcttcttcctctgggacaagggcacagccacagcccccgtgttatggcaacacatgggtcaggctcaggtctggcgcttggcaatcagctgatgatggcagggaggctctgcttcctgtcccaggcagaggggatggcacggcctgtgagtaatgcaggtttgagtggtgagccagttcagagcaaggctgggaggacctttgggcacagtcaggctccagggatgcaaggcgtggctccttcaacttgtctccagcacagccacacacgccaccagtgtggggagggagcccctggtcattttctgctggggagcagaatcgctgatgaagggcccagcgccagtggggaagaggcctccccaacaaccctgggcctcctgcccgctcaagccacttaaaaatccgtaccgtgcccacaaggctttccagtctccatgtctcaggaaggtccaagacagtaggtggaggtgggcacatgacagggctttctcattgcctccaaacaatgccatgtgctaggccatattttctgctcttctagaagcttctgtgtcctgggccaggtgggtgctcattgtgttccctctgtctctgggatcccctcctgctcaggatttagggggattgggtgccctgtgcccacctgccagctcccatttactcacaccaccctgcaggctggaggcttagccacttctcaggaggagcctagaaaggatattggtcgcccagctgctgaacctgccccagcatccttgagggtcttgaaaaatctattttatgctgggcacctgtaatcccagaaatttgggaggccgagacgggtggatcacctgagatcaggagttcgagactagcctggccaaaatggtgaaaccccatctctactaaaaatacaaaactagccaggcatgttggagcatgcctataatcccagctactcaagaggctgaggcaggagaattgcttgaacctgggaggcagaggttgcagtgagcgtgagccgagattgcgccgttgcactccagcccgggcaacagagcaagactccatctcaagaaaaagaaaatcttaaaaaaagaatgccactgtcatgtggaaacacctctaacaaacatgaggccagctaagctggggtgggggccaggtggcagcctctgaggaggcctctgcagtcctgggtggatggttcgggtacagcctgtgaatatgagaagctcttggccactgcacatggctcagttcccatcatcgtgcatcagacactggaagacagtagttggagctgctggacagggctgttttttctcaaccagacagtatccaggtgcctgtccctcagcagagggagaggtgccacaaccggctaccatgataaggagtcagctcagagcacctttgttggggggcctgaggagatgaggtggtatggggataggattctggaggaccctgctggaacaggtagaaggacaagaataactccccactgggactggaggagaggaaggcacatgggggcccttggcagggtggagtagggccataggtaaaaggaaagaggagaaaaggacagatactggggagagtgagagggaagggaggggaggagaagggaggcggacacctccagatctggcatggcagaagtctcctcggaaaagatgagtgcaagatgtgggaggaagagtaggacgtgagggtctccaaagtctgctcgaattttcaggtacaaatgacctcccatcagaatagccccaatctgagttctgcagaggctgagagccaactcaagggcatggagtttctgaagccagaagggaccttgataaacaagaaagcctgaggcccaaggaagttaaagtgatgtgctgaagataacccagccaaaagggggcgcagcctggatccacacacttcatggtgctctacccactacaccataaaaggagagtccaaacatggtaaagatggatggcagactggcagccagtgctgtctccatgacagcactgtcatggagattgacattgacattgacattgacattgtcatggagatttacactgtcatttacaacctggcatgctttagatggtaaagtaataaagcagaattgatgtgtctaaacaaagacctccagtaccttggaaaactgcacacctttgtttagcaattgcgttcacatttagtaattgttttctgagtaatccattcatcattcatttattcctatgtctggtattggcaatttaaaaataaacacaacagaactcccactgtataattgctaaacacaatgacagctataattgaggcactgaaggaaggtcaggggagcccaggagggcggggctgctgctgcctgctgagctgggagggttggtggcaccccttgccctgggttgccatagcagatatcataatcaattacggccgtctttcatgaggaacctggatctttcccaaggaatcagtgagaagtttcagctcacataccatctctgatttgccatccctgggatgttagctgaatcctctcattttacatggaggagactgagggccacagagttcaatgcagggcctagtttagactccagaccagctgccaagagagatgaagggctggtggagaccagccagcaagtggccatgccgcccgctgcagaccccacttcacactctcatgccacccccttgggttcactgacaaaattatgctcacaaaagcagtgctctgatttctatgagatactgtagaaaataacttgttttttctttttgtattactttttattgtatgatacatattcatttcagaaaaactagaaaatacagctaaattggaagggaaaattaaagtcactcataatctaaccactgctatttacatttataccttattggatatattttcaatatctttctaggcatttttctctctgcttatgtgcctgtggtgttatgatacatatgcataggttttcattcatggttcctggctcatcactctcatagtccttgttataatgttgggagcgttaggcctcaggagacaacgtccctctctctgagtttttcctgttctcctttctcctgcccaaggcgggactctaatccgattgtgggtcaaaagaccttcatttcagagcaggtcctgccccagcccctaaaggaagaaatgctgcacagagaggctaggaaaagtctgaacgggcaggtcttgctgggtttagattgtgttctttttgcccaatcacatttctacatggttgtcagtcatgccatgtaatgaaggctccataaaaacccaagacgggccaggtatgttggctcacaccagtaatcccggcactttgggaggccaaggtgggtggatcactttagcccaggagttcaagaccaacctgggcaacatggcaaaaccccatctccaccaaaagaaatacaaaaattagctgggcatgatggcttgtgcctgtggtcccagctgctcaggaggatcgcttgaacctgggaggtgggggttgcagtgagctgagattgtgccactgcactccagcctgagtgacagagcaagagagagagagagaaataaagaaagaaagagagaaagagaaagagaaagaaaaggaaaggaaaataaaaggaaagaaaggacaggaaaagaaaggaggaaggaaagaaagaaggaaagaaaagaaaaagaaagagaaaggaaaagaaaaaagaaaaggaaacgaaaggaagggaaaaggaaagaagaaggaaagaggaaggaaggaaggaaggcaggaaggaagggagagaaaacccaagaggacagtgttcagagagctgagcacgtggagacagactggaaggtggagtagtcatccatgtgccgagtgggtggctgccccagctccacgaggaccagactcttccagaccttgccctgtgtatctcttcatctggctgtttatttgtatcctttaaaatatctttctaacaaacctataattgttaagtgtttacccaagttctgtgagctactctagcaaatggaatccaaagagggggtcttgggaaccccagcttgaagtgggtcagtcagaagttccaaagacctggacttgagactggtggaaagtgggaggcagtcttgtgggactgagctcttaagttgtgggatctgatgctatctcctggtaggcagtgatggaagggaattggaggacacccagctggtgtccactgcttggtgtgtggggaaaatccccacacatttggtcacagaagccttcttctgttgttgattgctgttgcagtgtgagagcagaggaaaaacatgatttgagaggtttttccaaaatggttcctgagtggtaatcacagtaatccatccaccttgtgagtgtgcatgcatgcttatgtatgtgtatatgggattacataaatatggctcacatgtgtatgatcgtatttgcacactcccttgtccacttacttatatatcaaagtttccctcataatgtctgttctgtgtcactatgtaccctcccctgtcctccattccccacaccaagagtattatgagtattaaatgccacgtgggcaggttccccaggcaatgagggggtgggcctgtcaaatgcaggccatgcagaatgccacagggcgggagacgggtgagccaagggagccgagagttccagataacagagtgcacagcaaatgccatggcccgcgtccagcaaccaggagaaacagaactgctgagctcagaataggccaaggccgtgtctgctagcagggagcaagggcacagcctgctgtctggcctcttctgccccatccctccactgggacatggcccagatgagaaagagctgccagacggcaagtcaagtgtggggcgggagaggacaacgttttatgcaagagtggattctcggagcctctgcactctccatcagggctgctggcatggaaaacacagagaaaccatcacctaggacttgattgaactactggacttcccagaagagtccaatttaaagcaaagaggtccagagaaaaaagcattctagtgacatttttatatatttaaaaactggaaaaaagaaaaaataattagaacactgagttcccactgtctatgaaaaatgggcccagccccactgacaaccaacacgcctcacctcacaccttcccctccgccttcgttctggccgtgagccctgagccgaccatgcacatcttaccacctggagaacctcaaactctcctcttgcccacccccaccaagccccacattcaaaaggcttgcctgagaggcctgcccacttccttggcagttctggcctccagtgccctggcaggtgagtgacttctctgtcctgtgtagcatttggtacaggtatgtactgcatttataacacttaccatactggcttggggttgtgacacatcttcaagggagtccctggagagcagaaagcttgtcctattcatgttttgcccatcttgttcctgaataatacctgcacattgcaagggatcagcaatatttccaaccaaaccataaacttctccatctccccttgaagtcttctcgataactttcccagaaactcccagaaacaacaatggctgtcactcactgagaccctcctatgcgttaggccctaggccctgtgccaagccttggcattcacgtgtcacttaaacttcaggtagattgtcagatttagcaaaaacaataataaataataatttaggatatccagttagatttgaatctcagataagcaacaaataatattttagtataagtatgtcccatacaacttttataccaggcatcctatattttatctggaaatcctggccccagggcaaccctacgtgagaaacttgtaggtccattttacatgtgaaggaactgaggctcggagaggttaaacaactttcccacggtaacacctgagatggaatggcaggcagctgacttcagagtcccccaacacggcctttgcttgtctgggagagggagctccaggtggaactggtaaagggggtgaatccattggctgggagatgtcatgagtttgagactatattgggagcacccggcacatggtggccatcaagcaatttttagtctctctctcccttccttcccttgcgccaaattggaaattcccttgagaccctcacacggagtcctctacaaacacattgaatttcagccctcataggaaagcagaaggaagaaggatgatgttgcagaagatcgctgccatttgatttattacaacagtctgaggcctcagagagcgcagagcaaagagaccctggaatgcagccccagatccctggaagagactttacaggtgtcacgttggagagtggagagtgagggggatggtctcaaagaacaggagcagagattatcagagacaccacaaacttgaaaagtcaggatgggtaggacttgaggagaaaaaaaaatcttacctttacaatagcttcaaggaccacaaatttaagggctctccagaggctttaggacagagtcaaggaagtgcttcctggtcgaccctttcaacaaaaactgtgcccctggtctcactgctgcaggcagtgatggtggtgtcaacatctgctcttctcgggctccctccacgcctctgaaaacatggaagtgcttttacccatccagaaagaggggcagctgaaggaaggaggaaagggggtggtccagcgcaggcgcagcctgttgggaaccttctgctctgtctgagcatttgtgatggttgaatgggctggcacgggcgtctaaggcaaggaactgcaagggaggctgcagcctgccctcgtgacccagcactcgtcagatggccggagtgggaatgcgtcagagatttgcctttggacagaactgaaaggatatgaagcagggatgagagaagttctttccataaaaatctgaaaaccaaagggccaaactgatcaacttgcagaacgggaaggactgacaaaaatctcaggaaatcaccaaggtcacaggggaagatcatgaggaaaatgtatgtgaggctcccagcccagccctgccaccacacagtgttggccctgactgccactcacctgggtgccccctggactgcaagcacctggcaggggctgggctttattcctgaaacagtagggggtcctatagcacagcaccaggagaatatatagcaatggatgtccaccccatcctgcaaagtcctgctcaagggccagcccccacatccccagctagaagccgcctctccttctgcaacgttctactgcggctctccacctctcttgggactggaagtgagaagcatttttcacggtggttcacaaggtctcagtgcagatggaaaacagagagtaggtgagttggagagggtggcacagactgaaccccagacaagaaggctgcctggggactcagccctggtctgttagcagttacgggtacccagagcaggaaagcaatgcagaagggtcactttaccccaggccccacctggagcccagctggggctgtccacctgcttcttcatttgtctttcctcccagatccacatcctcgcctcacatcaggaaggcccagtgctcacttttacccaccatccgcctcctcccagttgggcgagtagccctggctgctgcacagggtgcctcccgtatgccaggcactctgctggctgcagggcagcttaacctgcagggcggtcaggacagacagaatctttgctttttcttttcatctgatcagggacttctgtctgatcagaattaggtgtctgggctgtcccaggcaatgcacgacagtcactgggctctcctctcgaagattaaccctttccagatggccacaatggtggcggcagccaagcgcccacctccacataagtcttccctcttctgtccaagccaaatccactcacaggaaaggatctggaactacatggagctaaggagtaataactagagacagttcactaggatctcgtgtggagcaggaaatcaaagttggggactgcatcacactgctgcaatccctattaaacatttgttgttcaaagttctttctcaatggcctgctggaattttttttcattcttcctctttggcctgtcttccagcagtagcaccagcctccccagcttctcccgtctcctcctggacttcctcatagctgtaggcttccatgttctcaactctattattcagaggagttcagctcagtcacgtctgcgccagagctttgatgacccacctgtcagccacactaagggccctgccatgaataaggcctccgtcactgaggatcctgtacccctctgccataaactcagtgacctgactgccagccaccaggcagaacctactagacttctctaaaatagataccgtggcctccttcctcaatcatagtcaaggtctaagcttccttatcaaaggcaggcagtcctgggttttacggcaagaagtgtgcttcctatgtgcaaggtgctgtggggaagggctgagtgtggaggccatgtgtgcaggtctttaggattttagctgagctgccttttcttgcagtttaagaaaaaaacagccagccgttccctccttgtaataaatgcctctgcatatttgaagacagtagttaggtcattcttgagctttctcatcttcaaactaaacaacagtggcccctgtaacctttccttggcaaattgtaaggcccatatgcagaggaaaagcaaaacaaaaccatctgatggggaaggcctcctatctctaaccaagtgtctgttttgaaatgcggtctgcactcagtctttaattacatgtaaattcagtagcttcaagtgtctgagccagtgggagaccaggtgctgctcatcaggccccttggatatgttcatgctgcaaggctgggtgatagcacttggcagacgctaggatttcttctcttcagattcattttggggcaggaaaaggggcttccgtgagtgacccaggagcagtcagctgacacttcctccccaggttccctgagggtaggatgggccccaagagcctccagagagcctgtggcctgctggaaaggctgccctctgcctccacagaagccagcaagagtggcttccagatgtccctggtggaggctggcagcctcatcctgcagccagcgtctcccaggggaggcttcctgctgctgctaactcagagacaggggatctgctaagcgcctgccctcggtgggggtgttctgatcacatcaacttctttcccatggttctttccaggctcctttcccacatttgcagtgtgttatcttgggagaccccatgtgttagtctgtttgtgttgctgggaatacctgaatctgggtaattcttttttttttttttttttttttttttttttttttttttagacggagtctcgctctgtcacccaggctggagtgcagtggtgccatcttggctcactgcaagcgccaactcccgggttcacaccattctcctgcctcagcctcctgagtagctgggactacaggtgcccgccactacgccaggctaatttgagtctgtgtaattcttaaagaaaagaggtttatttggctcatagttctgtaggctatagaagaagcatggtgctgggcacagtggctcatgcttgtaatcccagcactttgggaagctaaggtgggtggataacgaggccagtagttcaagaccaacctggccaagatgacgaaacgccatctctactaaaaatacaaaaaattagctgggcttggcggcaggcacctgtaatcccagctactcgggaggctgaggcagagaattgcttgaacccagaaggtggagcttgcagtgagccaggatcgtgccactgcactccagcctgggcaacagagcgagactccataaaaaaaaaaaaaaaaaaaaaaaagaagaagaagaagaagcatggccaccggcatctgcttctggtaaggactcaggaagatttcactcatgaccagtcatggtcaaaggggagcaggcatgttacatgtgagagagagagcaacagagagaaggatggaggtgccagattaaaaaaatccaatcttgcagaaataagtagagcaagactccgtaccgtggggacggcaccaggcccctcatgagggatcctcctccatgacccaaacacctcccactagggcccacctccaggacccactggagatcccatttcaatatgagatttggggtgaatgaacatccaaactgtatcatccaaggtcagtgcgtttctctgtcctccagttttgcctgccatgagcagctttcctgtgagccagctgtccttttcgtctccagggtcattttcttccttcagtgcccagtgtttggactttaggctgaccttcaggattgtggagtcacagaacaagctcatataagtgtgtaagcaggcagcaaattttttaaaataaagaaaaagttatttagactgtgccagtcagtctgtgtgccatcctagctacaacccagggtggatgctgagtggagggtagaggagtgcatccctcactcttatctgtgcttgtccttcttgcatactgctgaggccaggagcacctagatttgccccagtgggactcacctttttatttatttttatttttatttttatttttatttttatttgagatggagtctcactctgtcacccaggctggagtgcagtggtgcgatcttggctcactgcaacctccacctcccgggttcaagcaattctcctggctcagccccctgagtagctgagattacaggcgtgcatcaccacgcccagctaatttttgtatttttagtagagacggggtttcaccatgttggtcaggctggtctcgaactcctgacctcgtgatccacccacctcggcctcccaaagtgctgggattacaggcatgagccgccatgcctgacctggactcacctttgaggagacacggttttggccaaaatagctgttaagtacaagtgttcaactggtgcccaaccaaagggaaagcaatcttttccaacagtgaagaagaaattggttgtgtctgcttttcaacagcaagggggtgagtctcaaatatggtgcctccattaaggtgttcaataatttcaactacatgaaaaatgtgccttgggaatgacttcagaacttaaccctccagggagaaatgcctctactgtatggcccctggcctggtctcagattggatcataagctccctcattcttgtatccccatgcccaaaactgtgcctggcacttaagggcccataatacatatttttggctttgttgaatagtttaactcattagtgatgcaaagtcccaactgcatatttagagatatttatgtgtgcactacattatggatcgtatgggtgagaagtaggaactcaaagagaataaatcatactttccctccccaaaatgtttataaagccaccaagaagacaggacatagacacatcaaatataaataaaatacaaaaggatgcaccctgacatgccaaatatgtgttcacagaaacaaagttcctcttgccaaattcctgttgtctaaagcagtttttcctaaaacatattcttcagaataccagtttctcagagtgccaatgtgaggaaaagctttggtggtcagatgagtgcagggctgggttaggctgatttctttaccagagggcttcctgaagacttaaagaaatctgtattgagatataatttgtatagcataaagttcacccactttaagtaaacaactcattggcttttagtatagagttgtgtatccatcaccacaatgtcactgcagaatgtttccatcaccacccaaaacacctcatgctgtttgcagccatttcccatccacttccttcctagcccctgacaaccactaatttaccttctgcctctatagatttgcctattctggacatttcatacagatggactcatttactgtgtgatcttttgcgaccagcttctttcatttaacttaatgttttcaaggttcatccacattgttgcatgtatgcactgatggacatttgggttgtttccactttttggctatcataaataacgtcattataaacattcatgagcaagttgtatttgaccatatgttttcagttctcttgggtctatacagaggagtggaattgctgggtcatatggtaattctacattgagcttttagaggaactcccagactcttttccaaagcaggtgcactattttgcattcccaccagcagtgtacacgagttccagtttccctacattctcaccaacacttattattgtctgtccttttttattatagccatcccagtgggtatgaagtaggtatgaagtagtacctaattgtgattgtgattttgatttttgtttccctaatgactagttgttttgagcatttttcatgggttcagggcctttgatatgttgattttttcacaaatcttcaaaaggggacacagtcggcagcagttcctaaatgcgttggaccatggagccaaacttgcaaaagcagctcctggaatgcaagcgcgtacccaaaagctgggaaacattggctggaaaccagcctgtgctggaaatgtgagtttggtgaatgtccttaggtcattacttctgcaaattttgctcaaagaaagggaatctgaactctccacttttgtacattaagataataataataataataattttatcccaagatatggcaccctggcatgatgaatattttgaattaaaggcccttggagacaagcagatgctggaaaaggcttttggttatctgtataaagattggacccaccaaggacagcaattgctttccatctgttccctgaaatctcgtacctggatggaccttttcacaagataatgtctgtttctcaggctcattaaaattcaaaagagaataattaacaggttagtttctgtcccccctcccccaccatctattcattctcactaatactcatttgttgcccctaacaagaattacctacattccccacctcctctctttcctatgaggccttgctgaaggtcaccactgtgcctttacactcaccccccttcctttccctactgcttacctgccccacaagccagtcatggcctctcctctgagccctgtgagaattcttagaggttttatcctcagtataattcaaatgtgttcccttctccaatacccaaaaacatggtatgggattattttttcagtaaggagacaaatagaaaggaggccattcaggtcttctatattttaagaccacaatcttgactgaacctataggtgacccagtgtgcataagctgctatttcctgtcctcctagtcatctttgtgtagaatcaaagacacccacctccttggtacctctcatttgtcacttttcaacacttcctggcaggcaggcagcataactggtcctgctgggtgatccagaccacactctgcaactctttcttctgagccaggctcccctactgtcttttcatttatgtcaaggcaggggaagacctcaaagggctcttgcatcccagtcccacttcccagagaggcacgaggccctccaggatgtggggacaggaactttggggcaagccggggttgtccagaagatcaccaggagggctaaatagtagaaaggagagtcttattggtgatatgtttgcaaactgggaaaagatagcctccagtgtggagcaaagatgctccctcttcaaagagggcaagggcagcttggattttgtgccttacagggtcggtattatataatagagtcatgcatattcagtaggtttggggggaaagctatatatatttatgaggggagccaactacatgggcaatggataaacatacatgtaacacatcccatgttcacttaggggcaggattttagcattaaaatgaggtggaatttggctctttacatcaaaaggtgagctatcagacacaaaggcagtttgtgcacaagctctccaaagggacttgagggctacagctgctcatctggaaagaatccttgtaagaccagtcctctgtccaaccagagttaggaggcgtctgacaatttgcctgattagctctactgttgggagtttaacaagggtgtggtttttcttgtaaccataggaatttagggagttgccacgccagccaagccctaaaccctgggcttataggtaactttttccctaaccttaagatctgtcttagttggtaaaggggtgtctattttggtctctcagatcacactagaaacctctcaagtcctgtattcttattataaagctgattataaagctttacaatttactttgtgattactgtagcttatcgtaaagcaactgtaatcagtaggattggtgtcaagatgggtacacagatgggtagaaaagaattgagaatccagaaatagactcatatttacatggtcaatttatttttgacaaaggcaccaaagaaatttagcatagaaagtataatcttcatcaaatgatgctggaaaaattgagtaactatatgcaaaaaagaaagaaaagaaagaaaaaagtgaaaacctccacctccgtcattacttcataccatataaaaaattaactcagaatagatcatagacataaatgtaatagctaaaactataaaactcctaaaagaaaacaggagaaaatagagaaaaccttggtgatcttggttttggcagtgatctgttaaattcaatagataaaacacaaattagaaataaggtattgactgaacctcataaaaataaaacataaacttttgttcttcaaaagacatttaggaaaatgaaaaggaaagccccagactgaggtaaaatatttgcaaaacatatatataataaaggttttgtatccagaatgtataaagaagttaagaagaaaagcaacatactttttttttagttgacaaaagatctgaaaaagacatctcaccaagtcgtttgtaggactggcaaataagtaaacaagaagaggcccaacacctttagtcattagagaaatgaaaactacaaccacagtgagataataacacccactagaatggatgaaattgaaaagtctgaccatatcaagtgtttgcaaggatgtggaaccaacaggaactccattcacagctagtgggaatggaaaatggtttgaccatgctgaagagcattttgttgtttttttaaaagttaaaaatatatctaccatatgactcagtcattccacacttggttatttacaccccacaaaaaatgaaagcatatattcacacaaaggcttttaaacaagtgttcataatagctttatttgtaattgccaaaaaccgaaaatcacccagttgtaccccagcaggtgaatggataaaccaattgtgacgtagtcatataatggaatgctaaccaataatttaaaaaaggaacaattgatacctataacagcattattgaatccaatagaatgatgctgaataaaagaacatggacaaagaaagagcacatactatatgattttagttacataaaattctaggaagtgtactaatctatagtaacagcaagcagatcagtatttgcctattgggggaaggagtcggacagcagcaggggaagggttaaagtcacattttagttttaaaatattcagcatgtattttgggctacaaaatagcacaaggaaactcttgggtgtgatggacatgttcattatttaattgttatgatagtttcagagacataaacataaaaaacttctcaaatacacacttccattatgtacaatttattatgtggccattatacttcaataaaactgtcacggaagaacgacccttatcttctggaggtacatgctgaatgtcttacaaataaaattatctaagaactgaaattggcttcaaggtaaagcaggaatggggtgagaagtgtgtgtgacgtggacacaagggtgatatagaagattggcatcaagtgacagaagtagacggtagattcatttttatatatgtttgaaatactacattacaaaatgccagtagaaaatctgagtctaaccctaagaatgcagtacatcctgctgccatgtttctttctttagagctgaggagaggcctctttactttggtcggaaacctcattaggtttgatttagttcaataaaaatgtgtataggtgaaatagtccatacgaattcattacaattgatgtgaaacaaaattaattaataattaatccatgcaagtcttttggtagcctgcattttatcaaagaagggacccatggcaaaggctgggaagggacctttaacaggggagcatgagttccacggcagagttgccctcaagtaatgctttgtagattggtacagcacatgtgcatcaaagtagtgaaaggattatgaaatgtgaataaggagttagaaggtggaccttgaagtcctcctgggtacccatttccccaagagtgagcatcattattcttcattcccatacttctacaggatcaatgttgcagccacagtaggtggaaaattccaactctgctaacagttgggagcgtgtccctctaatgagaggacctgttcatgcaattttcttgatgtctggtgaacgctcccacattatatcttcaaaagactttactacctgagagggtttcatgctaactgctgagtaaaaccacccagtgctgagcacgcagagaagggagtggggatacaggtccaccacagcccaggctttggagtctgccaaagcagtcagacaacggtggtcagaaaaggtgtatgagtcactcgactgactacttaaatccaaaggaatttgtttacatggaccaatcgttttagtaagatggtttgttatgtgcctttataatttaacatattaattttatttagacaatattggaaaagataatgcaatccggtgatctcagcaaaattctctcctctataaaaataatgagaaaagtgacaaaaataatcagaatcaactttttagaactctggaaatttaccaaagtgttgcagccatccaaggattgtttgctcaagcaaaacaactgaatttcacctagaatagtgaggtttgtgacattttaacttgccccattcgcatcaccctttctccagcttcatggcagcctcgaaaaccagcagcccccagtcacagagaaaacccgtctagtggttctctgaaagaccccacttgcaaggctgtctttatttaatctgacttggagtttgcccagtgtgaaaagccatttcttcaggggcatttgttaaaaacatttagaggcaattgtttaacttcacagatgcttgagatagtggataatagttgcaacaaacaataggctaattaaaaagcttaaagtgaaaactggagaatggatgttcataggggctttgaaaagctctgacatattctgggaaatctggaaggccatgagcaggagtaagataggctttgcacatgcacagagctgtgtgcaggcttggaaaagatcttagaaggtcctaaaccctcgtcaatggctcccttaaagttctggacaagaagatattgtcaaaatctaagtttaaggtggaattgtcaactgcttggatgagtgtggaagacattccccaacatgcatgtagagcacctcagcaaaaacttggagatgtaaaccaaaaagaaaaatctaaggtcgtcctaccccaaccatctgaatggaaccctcctctctgtcaagggcattccaaagtttacctgaaaaagaagttcaggccatgatgggaaggcagagctggacaaacctggtaataccctcctcctttctggagttactaacagaacagactctaaatctgataagaaacatttacaatctagtctgtctgaagcctgctacctggaggcttcatttgcatgacaaaatcttggtttccacaacctcttatcataacccagatattcctttctattgatagtaactctttcaaccaattaccaatcagaaaacctttgaatccgcctatgatatggaaacccccacttccacttgtcccaccttcctggactgaaccaatatacatcttccatgtattgattgatgccttatgtctccctaaaatatgtcacaccaagttgttacccaaccactttgggcccatgttctcaggatctcctaaatgctgtgtcatgggccattggccactcatatttggctcagaataaatctcttcaaatattttacatagtataactctttttcattgacagagacttactagttcctgatccttaaagaaatttctctccaatcattagatgaccattaaactaacaaagcagagacgtcagtggctacacaagacaaagaatacagacttataacacaattacatcagaaaagttactaaaaaacaaaaacaccaacaaactgtaaaaacaacataacctgaggagtagagaaagaatctgattttttaaagttgccacattgcatttttaatgtccagttttaacagaaaattacaagacatgtaaggaaacaagaaaatatgtctcatacacaggacaaaatcgattaatagaaactgttccagaggaagcccagacataaaacttattagaaaaagtctttaaatttagttcaaagggttaaagaaaaccatatctaaataactaaaggaaaggatgaaaatggtgtttatctaacacagaatatcagtaaagagatagaaatgataaaaaaaaaaaagaatcaaataggaatgctagagttaaaaagataactaaaaggaaaattttaagaggagctcaacagcagatttgatcaggtggaagatataatcagcaatcttgaacattgttcatttgagattttccagactgagaaacagaaagaaaaaaaaattatgaagaaaaatgaacagaacctcagaaacctgtagatctctatgcttgtttttctcaggtttgtcaaagatcagatagttgtaggtaagcggcgttatttctgagggctctgttctgttccattgatctatatctctgttttggtaccagtaccatgctgttttggttactgtagccttgtagtgtagtttgaagtcagatagtgtgatgcctccagctttgttcttttggcttaggattgacttggcgatgcaggctcttttttggttccatatgaactttaaagtagttttttccaattctgtgaagaaagtcattggtagcttgacggggatggcattgaatctgtaaattaccttaggcagtatggccattttcacgatattgattcttccaacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgctcttggtgtataggaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgcaagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctgggagaacagaacagagccctcagaaataacgccgcttacctacaactatctgatctttgacaaacctgagaaaaacaagcaatggggaaaggattccctatttaataaatggtgctgggaaaactggctagccatatgtagaaagctgaaactggatcccttccttacactttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatcaacaatgaactcaaacaaatttacaagaaaaaaacaaacaaccccatcaaaaagtgggcgaaggacatgaacagacacttctcaaaagaagacacttatgcagccaaaaaacacatgaaaaaatgctcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaaggacaaaaaaccaaacaccgcatattctcactcataggtgggaattgaacaatgagatcgcatggacacaggaaggggaatatcacactctggggactgtggtggggaggggggaggggggagggatagcattgggagatatacctaatgctagatgacgagttagtgggtgcagcgcaccagcatggcacatgtatgcatatgtaactaacctgcacaatgtgcacatgtaccctaaaacttaaagtataattaaaaaaaaaaaatttttcaaaaaaaaaaaaattttgtctctaaaacaggtaacaatttgaatgaagaaaacaaaaatttaatgaatggcataaaaataaatttcaagaaaatgaaaggtgtgtatgatgacttaattaaaagaatgtaaaggaaaaaaaaaaaaaaagattttccagagtagctacttgtctctgccatagaattgttagatagtttactgtaggtggactgtaaataaatgtttgcttagttctaacatttgactgatattgggttgatcctttgagacttggtatattgtggatatgcctaaagtttctttttctaccaaagatgtgttgtaatctatgtcattacagaagtaggagagggaaggaaactaccattaaaatcagtacttaggagcccaggcactgttctagatgtttgcatatattaatatgatttcatttcatctttacagtaacctagaagaaagatatttaaataatgactttccagatcaaaaaatgagttttgatggcttttctcagttttcataattggcagaactgatttctgaatcctttaagttgatcagttgacaggaatgcatttatgatttttatcttttcttttggggttacttttcagtttgactttgaaggatcactttcccctgtcattgcgcccaaaaaagccttccgagactggatctgatgatgtaagcattattatttcttgctaatataaattaatttatggatattcatactattcttccacttctgtggtattcctatcaattcctctatctttccaacacctttcactttatttattttaatactgaatagcaattattttgaagagtaggatctgttacattttctatggtctttaatgattatccaaaaattaatgtatgtattactgcatgatttcagtttgggtttgtagacattttattatcaactgatcacctgaaatgacagcatttaccttttttatgcagtgttttttaaattaaggttctcaatcgtatcaggttccatggtatattcctttttttttttttttttttttttgagacggagtatcgctcttgttgcccgggatggagtgcagtggcacgatctgagctcactgcaatctccgcctcccaggttcaagcagttctgtctcagcctcctgaatagctgggattacaggcgcccgccaccatgcctggctaatttttgtagttttggtagagacagggtttcaccatgttggccaggctggtctcgaactcctgacctcaagtgaccttcctgaccttggcgtcccaaagtgctgggattacaggcatgagccactgcacctggcctccatggtattattcttaagtggtccaaatatgtttttttaaattgtggtgtaatttacaaaaatgaaatacatcttgagtttacagtttgatcagttttaatatatgcacactcatgtaacctacactcctataaagacacagaatatttttataactccgtaaaatttccccgtgcggttttttttttttttttttgagacggagtcttgccttattgcccaggctggagtgcagtggcacgatgtcggctcttcacctcctgggttgaagctattctcctgcctcaacctcctgaatagctgggattataggcatgcgccaccacgcctggccaatttttgtatttttagtagagatagggtttcaccatgttggtcaggctggtcttgaactcctgacctcgtgatctgcccacctcggcctcccaaagttctgggattacaggcatgagccactgggcctggcccctcttgctgtttttaatcagctttattctcttcttctagcaatcactgatctgaattctgtcaccatatcttagttatgcctgttctagaacttgatgtaaataaaataatatagtatgtaatctttggtataagatttattcagcataatgcttttgagattcattcatgttgttacagatacccgtagtttgtgcttttttattgctgagtagtatgaatataccatagtttgtttatccatccttcttctgctggtagatatctaggctatttccattttttttttaagtcttatgaataaagcaagctactgccaaaattcactggcaagtctttgtggatatatattttctttttttggggggggggaggacagagtcttgctgtgtcatccaggctggaatgcagtggcacgatctcggctcactgcaacctctgactcctgagttcaggcagttctcatgcctcagcctccccagtagctagaattacaggtatgcgccaccatgcctggctaatttttgtattttcagtagagactggattttgccatgttggccagcctggtctcaaactcctggcctcaataatccacccatgttggcctcccaaagtgctgagattacaggtgtgagccaccatgcctggcccgtggacatacattttcatttcttttttttttttttttttttaagagacagggtgtcactcttttgcctacgctggactgcagtgatgctatcgtggttgactgtaatctcgaactcctaggctcaagccatcctcctacctcagcctccaagtggctaggactaccggtatgctccatcatgcctggctaatttttaagtaagaccagttgtctaccaaaaaaatttgaaaattagccaggcatgatggcacataacctgtagtcctagctacttggaggctgagtttggaggatgttaaacactctttcatgtgctcattagctgcttatgtatctttttgtgaagtttctgttcaaatctttatcaacttgtaaattagattttaaaaaatatgtaagctggtgaagttcttacatgttctagacatgaattcttgaccatattttcccttagaatgtggctttaacagtgtctttgatgagcagaattttttattttagttatccaatatatcagttttttattttattttattttatttttgagatggagtctcgctctgttgcccaggctggagtgcagtggcatgatctcagctcactgcaagctccgcctcccaggttcatgccattctcctgcctaagcctccccaatagctgggactaacaggtgcccgccaccacacccagctaatttttttgtattttttttagaagagatggggttccaccgtgttagccaggatggtctcgatctcctgacctcgtgatccacccgcctcggcatcccaaagtgctgggattacaggcatgagccactgcacccggcccagttttttcttttatggttagttctttctgtatctagtccaagaatttttaatttagaataacacactgtattaagccttataaaaacaccagtaaattccaagacctggaaatagcataaaccacattctctgaaccaaatgcagtaaatcacaagtagaaccaaaatagactgaacatttggaaaatgtagtccaatcagtctgaatataaaaatcagttgattattagattatattagtagccctggcatcttatacatgtggaaagatgaatacaccagatgaatgcaggtggaccttccttcttaccaaaacacagttcagtgtagtggccactaacttgccatctacttttcctataaaacctagcctgagataatcttaaattttctctctcaatctctacctaaattgtataattcttctcccaatgtctttcctaaaagggcatgaaaagattttttttaatggtttttaaaggtggcttgccttaacgtttataactggcttgctattttatagttacttcattcttagcattgtcttttttttaacatactcttagatcaacttaatgtgaaaatgaaacttgaattgttttaagtgaattaattttcttatgatattataaggaggtattatttttaaaaattaatattctttttattcttctcaggactgggaatatttactaaattcagactaccaccagagtgttgagtctcatcttttgaacagatctttatgtctgagtccttcagaagcttcacagatgaaggatgaggatttttcacagaatctcagtctggattcttctacacttctctttactcacatacctgcaatttttttcgttcttcgccttgtgtatgaggagcttaagttgaatactctaatgggagaaggaatttgttcactcttgaacttctcgttcagttggcaaggtaaatttgtttgtaggttagaaactgccaggaagtcctgagatgactgtcttttccatgatatcatatagggaccttgtaaatacgtttctgaaatctgccttctctgaaaactatggcatctctgtaaaccacagagttgtttgaagatactggttttgtaagggcctgtgagccatgcagggatttttagtctttgtcctgagattagtggaaggtcacgaaaaaatggagatgacctgctcagattttcattttgacaggatgactgactgactatactgtggtgggagttctagaataacatctgctgttttgtaatatccacattcaaatagtgctttatagttgacaaaatcatagtttacatataaagtctcaaacaaggtaagtttcctattttagtgatgaggaaacttgcctaaatttgtttcctgggatatgagtgtttgatagttgtggactcattttgctatgctatccttgttgcagtctgaggttgtccctgtctttgaggcactcatagtagatccacaataagatagttctaataatacgtttcaacacctttcaagagctttgaagcaccttgtgtatggctcagaattctagggtcatacttgtgtgttgtttgacctttatgacctttggtgataaagaagttgaatttgaattgaaatgtcagcctctgagttaagacatagtacattttctaatttctgttgtcttttttgagatcttgaaattcaatcctgagacatggcagttttaatcaatggtaaatatctcttaggatgtcattactatcatcaaaattattttgtaattaaataatttccaaaccataatcatggctgtctgaaataagtaatgtgtatgatgttttacattttatcaggttttttttttttttacatattttatcttatttactctttaaaacttcagagtaagtgagctgatattgccccatttcctagaagaaaatactgaggtttatagacatgacttatggaagatcacacagctaatgaatagcagaggaggaactagatcatggtgcttttactgtagttttacttccacaaaatttagcaaaaagaggttgggttccatttgtcacactgggcactttaaagtccaaaaatacaatagagagactctagatttggttatctttctcataagtaagtttttaaatttaaagattcaactaattaatccttccaattctgttgggagaaagtgctgtaataccttcttttttgcatgccttacttacttaaaattggggccttatgtagatcattactatagagactacccaacgcttgtcagaactactggacaagtgtgcacaattgatccaggtaagtagtcgtgcttttaaatattttctaaacagtgtagtgatatttccttgtatttttctcaatgaatagcagaggatgtatttcttaccattagcttctaagtcaggggcaatgcctttccaccaggcagattttagttcgtagtgcttgttttctgacacgtagtaagccataatatcttcagtgtatagggaaaattttacccatccctaaggttctgacttgcaaaagtcagagaaagagcttccagtgtcaaggatgcttttttttttttttttttttgagacggagtcttgctctgtcacccaggctggggtgcagtggcgcgatctcggctcactgcaaactctgcctcctgggttcacgccattctcctgcctcagcctcctgagtagctgggactacaggtgcccgccaccatgcctggctaatttttctgtatttttattagagacgaggtttaatcgtgttacataggatggtcttgatctcctgacctcatgatccacccacctcggcctcccaaagtgctgggattacggcgtgagccactgcgccaggccgccaaggatgcttttaacttagacttgtagagtacagttagtaccactaaccatatgctacttaaattcaattaaaataaaacatatatttcctcagtgtactagccgcattttgagaactcagtagccacatggggctagtgctaccatattggacagtgcagatacagacacagaacatttccatcactactgtactgtcctagaccctgagctaaaggtactgaaatttgggacccagttgttggaacagagctgaatcctggatgtttcttttgtttttttcacctttagggttagggcaaaatttttggttagattcttcttcttcttctttttttttttttttttttttgagacagggtctcactctgtcacccagatgggagtgcagtggtacgatcttggctcactgcatcctctgccttccaggctcaagcgattctcctgcctcagcctcccaagtgcctgggattgcctgggcttataggtgtgtgccaccacgcctggctaatttttgtatttttagtagtgatggggtttcaccatgttggccaggctggccttgaactcctgacctcaagtgatccacctgactcagcctcccaaggggctgggattacaggtgttagccaccacatccagcctttggttagattctttatatgccttgggaacaagaatttgctaaatttccatccagggtgggataaaatagaagtcatttaaattctacatttaataacatagttccttatgtactgtggcagaaaacatgaagcattttggagaatatggaaaaacgttattccttttttttttttttttttttgagacacagtctcgctctgtctcttaggcatgatcttggctcactgcaacctccacctcctgggttcaagtgattcttctgcctcagtctcccaagtaggtgggactacgggtgcgcaccaccaggcccagctaattttttttcgtatttttagtagagacggggtttcaccatattggccaggctgttctttaactcctgacctcatgatccacctgcttgggcctcccaaagtactggggttacaggcgtgagccactgcacccggctggaaaaatattattctagttgtttcaaaatgacaagtaactgttgatcatcttccgtttaaaataaaataatgttgtcttaatgtattttcgtgtctttttgaatatttatctaattttaaaggtcaaacaggatttatgcatcatccatcattttttacgtctgagccaccaagtatttatcagtgggtgagttcttgtctgaagggcgaaggaatgccgccttatccttacctccctggaatctgtgaaagaagcagacttgtagtcttggtatgtatgtggagtgttactacctatctcctttttcttttaaaatttagttttaaaaagtacacctaatattaagtttttcttctgtgtatagttctgtgaatttcagtacgtgtatagattcatgtaattactacaatgaggatatagaacatttacatcaccctcaaaaatttctctcatgattttgagactcatccaagttgtttcctgtatcgacagttcattgcattctatggctaattagtagtttattgcatgaatgtgtcatagttggtttttcattcaagataattgggttgatttcagttgttagcaattgtaaatatagatgctgtcagcattcatgcttagcgttttatgtgaacataagttttgctttctctaggacaggtacctaggagtaggattgatgggtcatacagttaagtttatattttgtttttaaagaaactgtcatctgttttccagagtggctcttccattttacatttttaccagcaatatttaagagatcatttacctgcattcttgttggtatttggtattgtcactcttttttatttttgtctttctgagagatgtgtagttatacctcattgtggttttaatttgcattttcctaatggctaatgatgttttcagcgttctaggtatgaggttttgtcagatatgtggtttgcagatattttcttctggtttctaccttgtcttgtctcgtcattctcttaatacatcaaagagcaaaagtgtttaattttgatgaagctagtttatctgtatttttctttaatggatgttgcttttagtgtcatgtctaataattctttgtttaacttcaggttttgaagattttctcctgggtttctttgcatgttttacatttagatctctaatccattttgttaatcttttataacatgtcaggttttaagtcaaggtttttattatttcatttggatatccagttctttcagcactgttttttgaaaagactatccttcctctattgcatttgcacttttgtcaaaagttaatttggccacattcttgtgtgtctgtttctggactttctattctggttcattgatctttgtggctgtctacgctgtcattactgtagctttatagtaagtctttaaaattgattagcgttactcctcccttcattactcttcttgccttttcatattgattttatttttatttttatttttgagacagagtctcactctgttgcctaggctagagtgcagtggagtgatctcagctcactgcaacctccaccttctgggttcaggcgattctcctgcctcagcctcccaaatagctgggattacaggatcccaccaccacgcccggctaattttttgtatttttagtagagacgggatttcaccatattggccaggctggtcttgaactttcaacctcaagtgatccgcctggctcagcctcccaaagtgctgggattaccggtgtgagccaccgcgcccgtcccctactgattttataatccgcttgtctatagctacaaagaaaaatcctgctgaaatttttttcaaagaaacacttctttatttatttttattattttttatttacctctagctgcaaatctcatgatttatttatttttagaaattagtttgttattactggttaatacatgtccaagatcaaaccttcatatagaaccatagggctgtaacggtgaatgaggtaagtttcttggcatacctgttcctcagtccccccatcctggagcagcctgctcataggccccttgtgggccttttcaggtggggtcttcccaggcttgcaggagaaccatatgcttttgtcccttctctcaaatgttggcagactgcaaatgtctttgccccctgcccttctttttctttactctacgttttgctctgcttcatggtgagaagtgcttcagagtccccccatggctccaaaacagacatacagaatgatgattctgtttaaaaaacacagatttttttaatgatagcaaaatatatataacataatatttgtcattgaaattgttattattattatttcttgagatggagtcactctgttgcccaggctggagtgcagtggcacgatctcggctcactgcaacctccgccacctaggttcaagcgattctcctgcctcagcctcccgagtagctgggattacaggcatgagtcaccaagtctggctaatttttgtatttttagtagagatggggttcaccatgttggccaggctggtcttgaactcctgacatcaagtgatctgcccaccttggcctcccaaagtgcaggggttacaggcgtgagccactgcgcccggcctgaagttatttttgagtgtacaatccagtggcattgaatacgttcacattgttatgttgccatcaccactgtccgtacccaagactttttcatcatccccaacataaactctgtacctattagagtgactccccattccccttccttccaggccctggtaattccgttctctttcttatgaatttgtctcttgtaagtacctcatattatgggaatcaagcaatatttatctctgtgtctggcttatttcacttagcataatgtttccaatgttcacccatattgtaacatgtatcaaaattacattgttttaaaggcagtattctatatagtattccattgtatggatataccacaatttatcatttcacctgatgatgggcatttgggttgtttccaccttttgactgtggaatagtgctgctgtgaaccatgggtatgcaaatatctgttcaagtctctgctttcagttctttttaatatatacctggtggtggaattgttgggtcatatggtaggtaattcgatgtttaactttttgagaaactgctaaactcattttcatagtggctataccattttacatccttatcagcaatgcaagaggaagggttccaatttctccacagtcttgccaacacatattattattttctatttgtttttttaaaaattatagccatcctagtatttatgaagtgatatctcattgttttgatttgcctccttaatgattagtgatattgagcatattttcatgtgtttattggccatttacgtatcttctttgaagaaatatctatgcagatcttttgtgtatttgaaaattggatttttatttttgagtttaggcatttttatgctctagatattaatgtgtcagatacatgatttgcaaatattttctcccattctataggtttttctgtgaatgtcttttcagtaaaactggcatgagtgctcagtttacctctctggcctttcatcttagttttatcctcttggtattcctttataacttgtcagctcagagatctatttataaaaatatgaatttatttttatttataaaaatattctgaaaaatatcaacagaagcccttattgataggtttttggtttcgtcattataagttttattggactttttttacttttattttttttatttgagacaaggtcttactctgtcacccaggctggtgtgcagtggtgcaatcatggctcactgcagcctcaacctcccggggctcaagcagtccttccacctcagcctcctgagtagctgggaccacaggtgcacaccatcacacccggctaatttttgtatttttagtagagatggggttttgccatgttgcccaggttggtcttgaactcctgaccgcaagtgataaattttttttatgtgatgttagctaatgagacatttgtagtaaccttctagcttatggtggctctttttctattgactcacttgtatatgcggagatggcattgtctgtgtaccatttgttgaaatgagggaaaggaaggaagtgagataacatttattgggagcctgttgtcttcaaggaacttcatgtatgttttctcatttaatacagagatcttatgtacttttgtgtttgtgttatatgttgaatattttaactcttttgagagactttttccttggtcttatctttttcttttcctcctcaaagcaaataccactacagctctgtactactagatacttcttagatagtgagagagcactattcgatacctgttggaatgactgaaaataacttttggtgaggatgtggagcaaccgaaactctcatacattactggtgggactgcaaaagtggcacagcactttggaaaactgtttggcagtttcttgtgaagttaaacatacacttatataagacaaattccaactccttggtatttacttaagagaaatgaaaacatatgcctacataaagacccgcatgtatgtgaatgtctttggggccaggcgcggtggcataatctcagcactttgggaggccgaggagggcggatcacgaggtcaggagatcgagaccaacctggccaacatggtgaaaccctgtctctactaaaaatacaaaaattagctgggcgtggtggcgcatgcctgtaatcccagccactctggaggctgaggtgggagaatcgcttgaacccaggaggtggaggttgcagtgagccaagattgtgccactgcactccagcctggcaacatagcgagactccgtctcaaaaaaaataaacaaataaaaaataaagcagctttggtcatagtgaccacaaactggaaccaaatgttcatcagtttttgagtaggtaaacaaagtttggtatgtctgtataatggaatactactcagcatgaaaaggaagaaactagtgatccttggagagatgtgaatgaatctcaaagacttatgctaagttaaagaagtagcacaaaaaagactacgtatcatatgattcatttacatgatattgtaggatagacaaaactgtagagcaagaaaacagatgaattgtttccagtgctgggtgtaggaggaaaggattgactacaaaaggaacgagggagctttttggtatgatgaaagtatactatattgtgagtgtggtagtggttatgtgatataacatttgtcgaaactcacagagctgtacacctaaaatggacgaattattctatgttataattattttctagttacacttcaattatgtagctaggtgtggtggctcatacctataatcccagcagtttgggaggctgaggcagaaggattgctcgaggtcatgagtttgagcccagcctgggcaacacagcaagactctgtctttacaaaaaataaaaataatataaaagaattagctgggcatggtggtgtgtgcttgtagtcctagctactctggagactgaagcaggaagattgcttgagccaaggagtttgaggctgcagtgagctgtgattgtgtcactgcactccatcctgggtgacaaagtgagatgctgtctctggaaagagaaaaataatgttaattttcttcttttgcagagtattgcactgtacatacttggtgatgagagctcagtttctgatgaatcctcacagtatttaaccagaataactgtaggtaagttggtgcaatgttgcctctggaatcaaatttttgtagatgtcagtatcagaattgaaaaaagaattgaatttttcttgtttgctttggcggccatgtcttacctttttagtactgttctggtctgttgcggtctgttgtccacaactaattttcaggtatcaggattacttaaaatctaataaatcttgtattttcagtgcgggtaaaaaggactattttagcctgaaggaaattattgtaccattgactcttgaacaacatgagtttgagttgtgtgggtccacttacaatgaaattcttttcagccaaatgcagatagaaaatgcagtattctctgatgtgaaatgcatatgcaggttctgcagggccaattgcaggacttgagcatgcacggatttgggtacacatggggtgtcctaaccagtcccctgagtattctgagggccttgactgtacttttcagcctgccacagtattgcttattttattatttttttagatgttgtttgctaatggattcttattttcaaatgtcttctacatgttacatgttttctttaccaggatgactatcaaaattaagtttcattttgttgccttttagccccccagaagttgcaagcagaacaagaggaaaacaggtgacttttatttagactgtgcttttatgtcagacacttaaaacaatattatttactgttctgcttaattactttatgttttattctcttataggtttagtttcaggcattctacgtctgtttctagtctagctgaaagattggttggctggatgactaatgtaggtgagagcttctttgttacctcctaactaggccgtgcttcctccagactagctagaagtggaaggcatgaggagagaggggctctggctttgtgaaaaggcctcacaagattgagattatggttcatcaagccatattcttttttctcgacaatctcacaactttcatataataatatgtgggataccagctttttatcttggtgcataaggaatctttatttgccattacattggaacatttgaggctatggctatgtaagctggtctctgagaatggagaactctaattaccctacatatacacctgaaatcattgtgatactcagatatcagaaatgggtggttttggcaaagtctaaaagcaataatataaacatttcagggtatacttttgaaggataaatgcacttttgaagggatttcaggcaccaagatgaacattgaactgggaagaggaagaggaaggaaaagcgttctatattccctattccccaaacctatgctcctaggttttaaattaagtaaaataccaaagaaattttttttcacaaagaactgaaaaacaaaattaaaaattactgccacgaagacatgattttaaagatgaggatattatatgggatgtatgttaaaaagtaaagttttaatgaatattaaaagatgtttttgaagtcttatctaaagtatgttctaaatgaagtttctgacaggttttttttttttgcattttaccttaaaaatgacaataactgttgcgtagtatacatacaggatacctatgctgaaaaatattggattagttctatccatttgtatattgcataatatttaataagtgttattctcatataaggaaacattttttgcctcaatagttaatcgactttttatattataaataatgcatagtattataaaatttagaaaatcatgataagaaaaacatgatttaattaacctgaggataaaaaaatttaaatatgaaatatggtatacttacaaaataatatgtcaaacgtatatgtttagtttagagaatggtactaaagtgagtattgatgtactggtcacccacccctagaaatagaacattacccgcatagtagaaggcccttacatatctgttcttggatggtcccctcctgtcacacaccccaatgttatagtgaaccactgccctacctacatttgtgttaccttactcttgtttttctttatagttttacatctttataaattgctaggttttatgtagttttgaaaatatatagatgtaaatatatgttcctttttcttcactcaactttgttttttaaagattcatccatgtcgactcacgtagcagtagcagtgggtcattcattttctctgatatagagattactttgtttgaacatatcacaatttaattacccattctgttaatgatagacaatcggacttacccctttctccatctcttttttttttttccatagcaaaccagtattgctaatgaatatttttatacctgtgtcttggtgtacctgggtgtaagtttctatatggctgttgatggatcaaatgggtggactgacctatacataccaactgttttccaaagtggttgtaccagtttacactaccattggctatggataagaattattgttgctcgggccgggcacggtggctcatgcctgtaatcccagcactttgggaggccaaggcgggtggatcacgaggtcaggagatcaagaccatcctggctaacacggtgaaaccctgtctctactaaaaaaaaactacaaaaaaaattagccgggcatggtggtgggcgcctgtagtcccagctactcgggaagctgaggcaggagaatggcatgaacccgggaggaggagcttgcagtgagccgagattacaccactgcagtccatcctgggtgacagagcaagactccatctcaaaaaaaaaaaaaaagaataaaaagaattattatcgctctacatagttgccaacacttggtattgattggctttgacatttacatttctcagtggctttaatttgcattttcctgatcactaattaggtagagcatcttttcatatgcatattgcccatttatgtttccccttctaggaaatgtctttttgtcttttatatttttctattagattgtctttttttcttcaggtttttacaagttctttcaaagagacttcctatactagtccctgatgttaagacattagtctggtactaagaggaataaaatgaatttatttgtcaggatagatattgttgccaacttcagctaggataattgggacagtggcaagtctaaattaaaatgtttctctcttcctttaaccattaggattcactttaagagatttggaaactcttccctttggaattgctcttcccatcagagatgcaatttatcactgtcgtgagcagcctgcctcagactggccagaagctgtctgtctcttgactggacgtcaggatctttccaagcaggcctgcgaaggaaacttacccaaagggaagtctgtgagtatcaacatagaaagttcagagttccaattttagccttaaataaaatcataaagtagaaatgttcttcattttcctttaaggctttttctaagtatatatattagcttgtcttttatattatatgccagacggggtttgtaattgtatgcgtcttattaattgttaagttgagcataggagcaggagattttgtgaatgttctgtcttgtgcctggatctttctttgccttgaatcaggacaagtcctgagtgtagtcatggaaactaccatggctatttccctacttgtaccatattagtaattaaccactttgtaattattacataggaaaagggagagcacatatatcctgaatttggatgagtaattatatataaatattttctactgcatatttttcgatgtgttgaattttttgaatttaaccttttaaataggtgtaaacatatttatttaatcacataaaactgcagccccagggaaaaaatgtgtttttttagtagagttgtttaaaaagatgtcttaagctatccctcccgaaatactgtctttcatcaatcatcaagtctgtttttttttttttaaatgagttctaggaatcctgcaagtagaaagtaaaattatttcattactctccaattatctttttatatcatcctctcttaaaacttgaaaatgaaacttttaaaacttattctagaattctaggtaactttaaaaaatgaacagtagaatctcatcaaggaggattcaggaataataattccactcctggtgactcttttatgttcatgtcccgagaagacagtgggaatttggtcttacctcttagtagcttttgaatcaatacataataatcagtgcattgtaactatgagtcaccttaggtcttattactacttcttcagagcctatatcaaaacttattcctaacctcagagttgcctaatgtgtacccatgccggagtcagtttccatgggcatctgatctccagcacggtcatcccagcacgtctctcctttaatctgcgcctcaatcacagctcttcgttgaattagtatttacatcctgttttaaacagaaaacaaatctttttgcttataaaatgattttcctgtgagagagagcagttcagcaccattagcattaaaacattaatctgtatttgaatgtgattttaagtaattatgtctaaatacagtttgttcagttgaggctacattttataactaatcccatctaaatttattttgtcactgtttgagactatgttttatagctaactcacccattagaatatagtttttttttttaaattagatattttataggagctaaaaatgaatttttaggaactaaaagtgattatttggtcgtatctacttttttttcaggctgaccttgttggtttcacattaaatgttgcaaaactttaacatttcaacttggagttattcttttgttaaaagagtataatactgtttttgagagaatatgatatgattccacgcaattcacatctgtgttgcagttagatttaattatttggactgggaagccccatattaaagcacatgctgggcttagaacatgatgacaatcaaggaatttaccctcttacttgttttgctgtagttcagtacttttccttctaagaaatttttattggaaacacattttttaaaaaatagtgaaaactggctgggtgtggtggcgcatgcctgtaatctcagcactttggggtggccaaggcggaggactgcttgagcccaggagtttgagaccagcctaggcaacatagtgagacctcatctctacttaaacaattttttaaaaaatttagccaggtgtggtggtatgtgcctgtagtcctagctatttgggaggctgaggtgggtggatctccttgaggtcaggagttcaagaccagcctggtcaacagggcaagactctgtctctacaaaaaataaaaaaaattatctgggtgggcggtgcacatatgtagtcccagctactcgggaggctaaggttgaaagcctgcttgagcccaagaggtggaggttgcagggagccaggatcacaccactgcactccagcctgagtgacagagtaagaccctgtctcaaaaaaaaaaaacaaaaaaaagcttaataatggaatccaaccatgatcctgtctatttaaagtagtaaagtaaaaggtatttcattgtgtgacttcccccaacccttggggtatatcctttcaggcttttttccttctccttctattaatgaacagacaatatttaaattagcattattagcagtgactagtattcatattctacttgcaataatttttttttaagaaatgatcaggatgtagttagattttttttatagtttattcagaatatttctctgttcgtatccagccccttgactgttgccctaaatttaaactctccccgtcatttccaaatatttccaagtaggcaatgtagtacttttgtttgtttgtttgtttggtttgtttggttgtttgagacagaatctcactctgtcacccaggctggagtacagtggcacgatctcggctcactgcaacctctgcctcccgcattcaagtgattctccagcctcagcctccccagtagctgggactacaggtgtgcaccactgcgtctggctagctaatttttgtatttttagtagagaccgggtttcaccatgttggccaggctggtctggaacccctggcctcgggtgatccacccacctcggcctcccaaagtgctgggattacagagtgtgagccaccacacccagccagcaatatagtactttttagaaagatttgtagattagagtcccagtatacattgcggccccaacccatgcctgctttggaaaacatattttctctgtgctagtatagtcatggcacatcagcctatatatcctcatgttcagcaagtgcacgttaactgcttttgaaattattattataataaatctgttactcaggtgctctcatcagatgttccttcaggtacagaaactgaggaggaagatgacggcatgaatgacatgaatcacgaggtcatgtcattaatatggagtgaagatttaagggtgcaggatgtgcgaaggcttcttcagagtgcgcatcctgtccgtgtcaacgtagtgcagtacccagagctcagtgaccacgagttcatcgaggaaaaggaaaacaggtgaaagaaaacacgtgtactatctcttgtcacgtttcattgttacatttgtgtcttgtttatatttgtttttccttcaagtttttagcatttaaaaccctaaagagatttaaaagatactttcaagtgaaaatatgccctgtgttttaagttttcatccaactttaacaaaccacgtgtgttagcaaaatgtctttggcttttgaggacataattgttgtatttcataccgtcctcctcttgaaatacatataacagtttactctttagaaaaggtgaatgtaaaactattttgcctgatagttaccttaagaatttacaaacaaagaaaacactggacttgtttttctgtgtcttgatcaggaatagattttgaggttagtggggtttttagtgtagtttaaacttatatcagtattttttttttggatatgatagataatactccaaataaaaatagataagcctttcttctgccactcccctgcacaggatacatcccttgatacattataagactcacgtgcctatgacattccagagctattctcttgggacacttctgttttaaaattctctcctgttcttttatctgcttgtctctatcatctatcattcatctgtcactgttttctagttctctttactttttttatggtactgttttgaggggaaccatcacccacacttagccacaggctgctgaagatctgaattagttgtgatttccctattaactgtttcctctccacatgtacccagttattagtcacctgtgaataaaaagatggagtgacagaagttgagtttagagcataggatttatgagcatggcctctagagccaggcatggccatgctgtgctgggtgactttggttaaattactttacctcttgttgcctcagtttcttcatttgtaaaagtaggcatacttcatgggatggtgctgtgtatcaagtgaattatttttacatagcacttagaatactgctcaatacatagtaaagctcagtgcagtcagccattattattagtagagttcattgattctaagatgcaagttttttcactttttaatatctctgaaatcagttgtgtattttagtgaacaggcgtcatagtttaattggcagtgctttttctttcttagtttctcatgaaataatgatacatcttatcagtggcatcttatattcaggggatataatattgttctcattataattttgttacttgcgcaaagttgaagtgaattatgtgtaagatttcctctaaaaaaattctatgggttgcaacagactcttggctttgaattttcctgatcccaaattaatgttgcggttgtgttcccagagaatctttaagacagcaaaatttttctttccagttagctagaaaagcagttatgtgtgtccagttaaggagggagtatgcttatgaatagctttgtctgcagagaaaatgtttgtcagttgtcagcctctgaagggatatttctgtgtcttcagatatagcttgtataggtgtttcttagttataaatgccctacttccaaaatttctgttagttttttttaagtggctatatggaatgttaagctattttaacataggaagaagttgaagagtggtgtatgaatttcacagtagagccaacagaaaccattttaaccttgaacatacctgatacataatggtattagtcctataaatctagccatcatgtaagtgaaaccaatctgtatttcccttggagacaccatgaaatccattcacctctaacacaaggaccttgtttcttttcttgtgtacaggccacagaaatggtacttctgaggctgtattggcaaaagggatgggaggaggatcccacatgtactgaggacagctagactgaaattaacacagtgataaaaaccccaaaagtactgtattttcctttgagaaggttagcatccatcggagtggaattttaaatttcttttttttttttgaatgcctagagagagtcggcttggtttataggccaggtggttttcattcaatgtaaatatgaaacaaaacagaggaaatatgtctctccctaagagtgtaataggaacaagaatattaaaatgaaaataatcatgtttgggtagttcactcacatctgtgtatgaatttactttgagacaacttcatcttatacagtacaccttcttttgaaatacttacagatgatatttcaattgctctttgctttaaacattttcacatgttggtttttactttaattacagattgctccaattgtgtcagcgaactatggctcttcctgtaggacgaggaatgtttaccttgttttcgtaccatcctgttccaacagagccattgcctattcctaaattgaatctgactggtatgttaaattctgggctcaatgagaaaggaaaatgattaagtacatgcattaagtgtagttctttaaattagttaaaacaaaagaaatgctccctctatccccagtgatttaaaattttcctaatagctgctgtagtggttatcaaagctcaaatgccatgtgaaactaaactttgagagaagcagaatatagttcattactcatttttgctttttaatgaggtgatttcaagatctaaaaagtcacttggagaagttcagaaagatattattgataacgatgagacttgaattttaaataatcttaagtttaatatgtaaaaatatttagttttaaaatgtcttacgtcatagtttaaacagatgatcattgtataaatcaagaaatgtactaagcaaaaagagaaacaatggtcacttgcagtactcccactcttctgcatcactccttttaacattttagtatatatgtttactaagtttatttccacatatttataattttatatttgtttaattatcagaaaatttatatctattttagatttttttaaaaatttacagtgaacatccttttatatctagcaaataaatgtatgtgtttataattatgtgtatgtattgtatacatgtgtttttaatcaatacactcatttttatttgcttcagagtatttcattcagcggatataccatagtttatagaagcagcctggtattgttggaaattacagttttttggtattataaacattgttggggcgtattcgtcctgtgtatttaggctaaatgcttagaagtagaactcttaggacagcaagatgaatggttttaaggaacatgtcaaattgcctttctggctggcacaagtttttatttctgccatatataactgtagttatagtcttgattacaatgaattttatagtgcatgtccccctaatgctgatttgaatgtgttctaaaggtgacaattacatagttgaaattatcactgaaactctattatagtatatatggttttgtgaaacctatacaaaatgtatgtataatgtttgttgtagtagtgtatagtatatgtggtagcatataatgtataatttaatatatgataaatagtacataatatatgcaaacataattatacagtattttaaattgcatactttaaaaaatccagagttccactcagatttgtgaaaagcttgtgctttgagcagcatgcaggaaatgagattgactaagtgaaagaacacattcccatctccataccatgcttattctgagccctaatctcactgagggacatagtgagcagagtggcttttaatatttaaattgtctcagaggtaaagcacctatggcaaaattttaacaattattgattcttgatggaaggcatggtatatagatgttcattttagtagtctttccaactgtttatatgaaagatttcatatactaagtgcagattaaaaagaaaatctaatgcaaaattggcaaatgttaaaatgtattcaatctgggtgatttagcactcaagtgatacttgggtgggtttaaaaaatatatacatgcatctttttttctgaatacatttaattgaatttgcatgatttaaaatgtgtttatgacattaatccaacattttattcttttagtcattctggtaggccaaaaagaaaggttatcctcttaatttaggaaagaatattttcttaaatagttgcttaacccacactgatgtggcctgttgtacttttgtatgttgttattctcattgaagaaaatttaccttaccctttgcattttattttctctcgtgtataaatattatgtctcttgcatatgatgaatgaatgtttcagaaaggtcactcagttttttcatattgatatgtctgccttttttgagaaagtacaagtgtaacttatgaacttattactcattgtggtgctaacactagcagttgagttagcttttaggtacaaaaagcatatagtaaagacaaataagtcttactttgtgctttgtgtgtgtatgtgtacatgctacaaataagacactttgcatctacttaaaattattttacataacatcttagaactctttaaaaatggtatttttaaagctgcagtgaaatggataactttatgcagtaattaaaatatttatgttaattattttatccgtgacttaagacaatattcaaaatatatttaaaaagattcaatgtttgctgtgtataatgtagatcaaaaagaaaagaatcaagaaaaaattcgtagggaacatatagcattgtgaacatataatttacattgttcttaaataaatggaccgtaaaagtataatctggtgaatgcccttttgaagttcactgggtgactcaagtctataaaaggatgctttttacaaaactatctctaagcattttaaacaatagcatataattagatatctatatctgtatgtatatatagagagagagagaaaaaaagagagcaaagggggcatatataggtaagacctgtagcagatttattaaggttcttgtttcctttttttttttcttttttgagatgcagtctctgtctgctgcccaggtgggagtgcaatggcatgatcttggctcactgcaacctctgccttccaggttcaagtgattctcttgattctctttagaaagtgataatctttctaaagcataaatcagagtacgtcacttccctggtcaaagccatttaattaatgatctcccattgctttttttttttttttttttttccttgagtaaggcagagtagaatttaatgagtgacaagaaagctctcaacagcgagaggggacccgaaggtgggttgccagccacgaggctgagtctagaggtttttatgggcttgaaatgggggaggtacatgctgattggtctgtgggtatgcttgaaaaagcaccatttagaaataggcacgatagtgtagaggaccaaccttagcctcccaagtagctgggacaggcacgcaccaccaggcctggcttttgtcttttcttaagatgtcatttttccttaatgtctaggggaaaataaaggatagaacatttgaaattaacatcagtgtcatcagatgttgggatttataacttgtatagtttaacagtgatgttagtcttcattttggtttttaagctctctgtttgaaagaaaaaatgagtgattatcccagtcatctctgtataatgttaaattggtatcagttatctcattatatagcctcatacattttaacaaaaaggacaatgaactgtttagacagtgaaggtttttccagttccattaagtttgactcacatgtacaaaagttttaagtggtcatagagacctaacgttccaggcattatggggttaatggttttgaatgtagaaaacgtaactaatcttagtctcaaagatctaaatttaacaatcttggttttgtggatttttattctctcaatgttcttcgtttggctggatagggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttggccaatgagtatgctggctttctcatggctctgggtttgaatgggcaccttaccaagctggcgactctcaatatccatgactacttgaccaaggtgagacctgtgctcccagtgcctggctttgtgccttggctggctattgtagtagctcctaattgctctatttgctcttctttcttcattcttgtacttctaagtccatttgtctcatagtacatggaataatctttctaaagcataaatcagagtatgtcacttccctggtcaaagccatttaattaatgatctcccattgctttttttttttttttttttccctgagtaaggtagagtagaatttaatgagtgacaagaaagctctcaacagcgagaggggacccgaaggtgggttgccagccacgaggctgagtctagaggtttttatgggcttgaaatgggggaggtacatgctgattggtctgtgggtatgcttgaaaaagcaccatttagaaataggcacgatagtgtagaggaccaactggggaagggcaggtatatgtaaagtaggtgaaggataaggaccaatcaggagagagcatgccaaacaggaatgagagctctctagtccatggatttatccagaacttgtagcttggttttcaggctttcgactgtccttggcttgaaggttgagtttcatctgagaatttacctgcctcctaccgccatcaatccccgctctgaagaggtatatctaactgctgttcggataggggtgatgactgttctgcttcatgctgacagagggtgttgctttgggaaacagcagtcaggtctctcttagaggcctatctaagtgtcccctggtaaaagagagccatcaaccgaggttccatttgcatgaccacttggagtttgatggcctctaggcgagaaaaaacaaattttacaaggaggttaagtacacatggaccaaatatgagtattacaatgagaacacaaagaggaactaaaagggggaaaatccatgcccatatattagggacacctagaaaggacaggaagaaaacctctgaaaatggactgttctattccaggattttgcaaaatagggttgtcatgggcatgtccccctagattattagatatgttataattaggcattgcaatgcttttaattagatttctgatccataggctgcagaatccagtaatgcctgataatccctttagttagctgagggtcttggggagaaggaaggagaaaatggatccaattctctcctcgcccagtgtcctggtcccttctgacaagaccaggcataggtacttcactgaagtctgacggagttgagccttggactttgaaactttatgtcctctgtcagttagaaaattaagaagagccttattgcttttctgagaaatttcctcagttggggcacagagtagagtgtaatctacatattaagactaacttgagtttgaaagaactcagagagatcttttgagattgcctgcccaaacaggtgggggctgtcttggaatccctgtggtaacaccatccaggttagctgggtagtctggttggagggatccctgaatgcaaacaagttttgggagttggggtataatggtatgcagaaaaaaagcatcttttaattccaagaatgcaaaccatttagttccttcaggtatctaagttaacaaagtatagggattgggaaccactgggtaaattggttaattacaccagttactcattaaggaggtggagatcctggaccagtctccattccctgttgggtttctttctgtacttccaatattaggatattacaaggactgtcgcagggtttaacaaggccctgcatccttaggttattaatgatggcttctagttgtttcctagcttctggttttaggggatattgtctttaattagggaaggagatgagatccctgagatggatttggactggtgagactgttgtagctcagccagtattttcctgaattgcccaaacatctggattaatatcagtctccaccagagggaggcaaagagtctgtcctggagccataaggatggtggttcccatgtgagctaaaatatccctacctcagaggagtcgggctttcaggtatgattaaaaaggcataggtaaacgaaaggtctccctaggtacagctaagggattgagaaaaatatcgagtcagaggctttcctgagacgcccctcacagttgtgctaagggaggaggggaggcccagaatggagaggagaacaggaatggctgctctggtgttgagtaggaagtctgtcctctgagtcctttgacctccagactcacccgggactcctggatggtaatgcagcctgggctgtcagagctggggaggagagccctgggacccatcagtcctgctggaccatttgagaagccggctctgaaccttgggacgtatgtttctggaggcagtttgtcttccagtagtctcccttacagattggacagggccgtgggggctgcttctgatttcgggggcagactctcttttagtgctcccacactgataacagtcggtcatagaatgagaagctccctgggatcgagaggtttatatgcctgtatggcagctattagtgcctctgcctttttctcgttccttttctccctttttcttgggcttcctcatggtcccgattataaaagaccaaggtggtgactttcaggattttctttagagtactgtctggtgcaatagctaactttttgcagcattcttccaatatttggggctgcttgggttataaacttgtctttcaaaattaactatccttttatagagtcaggagagagatgtgtgtttaattaaagcctctctcagttttttccaggaaaacagaagggttctcttcagacccttggtttatggttgataacttaatgtaattgagagatttgcctctagttttcagatcttccactgtgcatccctaaaaatgttttctcggccactttcctagagcagtgtctgagtcccattgaggattattggtggatgctgcctgcttggctgtcagaaagggctccctaatttcttcccccttttggtaggtgccataataagataaacatttcatctccaaatgtctcagtgacctgtaaagccgcctgcttctctgaagctctaagagtctagttgagaagtaacatgatacccttccatgaaagctcagacatttgattaaggttctgaaaggcttcaatatacctatccaggtcgacacaattgtcctagatttctttttatctgcctcaaatcttgtaaagaaaaggggacttgtactttgataggaccatattcactatgcatttcctgtaaaggaagaagtgatgctggagcgcatccaggtcgaactcttctaacaggatgaggttcaaaagggggcctggataagggggacgagatgatccaagaggagctgggacctgggctggtgcaggggcctctgtctcctcttctaaggaggcagactgttttttcccttctgtctggattaagtctggctggatatcactgctataagtgcaaggtctattatacattgctgacagagcttgcggttattctgcagggcaaaaaaggcctatacatatggaattttggaccattttccttctctgtggttgaagagatctagctataggatagtattatagttgttattttccccagctgactaggtctccccatcttccaacttctagctgggccaagccttgctactgataaataccaggtattttttcttcagagtctgaggatcaaaggagtcccaatgtctcgcacttgagaggagtgcaggctacccatttagaaagagagaggggagaaaaaggcatccttagtctttccctctgctgtgctagagtccaaggcgtctctcaggcttgccttggtcgtggatgtgcgcgcagccaccattcatgaccagggggggatcaagccagcaggagtagttgcgttcacttgcactcagccttgaccctccttgtcaactgcctttgatttctctgaattctatatgagctcaagactaagatgaatccagggggggtccctgcatattatttgtctataattctcatctggctggcagtttatttagcttcatcaagcataacccagcatcctgccctgaaaagaagcaatttctcaaagagacacataactaagtaacatttctcagaagagcagtaggaaaaacatgataggaaagattggaagtctttgtccgacacctgaacaggctgttggggactgggggccggtgtagggtccttcggatgtacccttggccagatacctttagttgccccaggaccttattctgatcccacacgatggctgaacttctgtgaagggaaactggtttagaacaaggccaacattcccaacaccagagggcaaagggggatcgaccattgctcttaatatacattctaggagctggtgtgatcctgttcacttctccagccctaggtggtaccactgttcttcgttttttttttttgttttttttttgatgtggagtctcaccctgtcacctaggctggagtgcagtggtgtgatctcatctcactgcaacctctacctcccaggttcaagcaattctcctgcctcagccttctgagtagctgggattacaggtgcatactaccacacctgcgtaatttttgtatttttgatggaaacagggtttcaccatgttggccaggctggtcttgaactcctgatctcaggtgatctgcccgcttcagcctcccaaagtgctgggattataggcgtgagcctctgcacccagccccactcttcttgctcccccacactctaaccatacagattggctattttagctctctggcaaactaaactctttcacttcacagcgttatttttttttaaggaatctttatttatataaatatataaaattcacataccatacaattcactgtttaaagtgtgtggtacagtggtttttagtacattcacagagttgtgcatccatcaccactgttaattttagaacatcttttcaccccataaaggaaccttgtacccactagtggtgactccccattcctctacctcacccccccaccttcacttcacttcctgccaaccactaatctactttccgtgtctgtgggtttgccttttctggacctttcatatgaacggagtcatacaaaatatggtattttaggatgggcttctttcacttagcctgataattttagggttcatccgtgttgtaccatctatcagcaatacattcctttttattgttgaataaatgttttattttatgaatgtacattttattcataagttgatgaatatttgggttatttgtactttttagctattacgaataatactgctatgaacatttgtatacatgtttttgtgcggatgtatgttttcattactcaagagtaatgaagtaatggtaagtagtggtacatacttaggagtggaattgctgggttatatggtaactctgttaaactttttgaggaactgtaaaccgttttccataatgactgcaccattatacaaccccatcagcaatacatgagagttccaatctctccatatttttgccaacacttgttatattgtgttgagtccagcctcattcttttgaatgtgtccttccacttgtcccagcactgttttttgaagactgccctttacctgttgaattgtcttggcacccttgtggtcagttgatgttaatgtgagggttcatttctgaatcgcctcagagccatttatttacatgctgttttatcacctgaaacagtcttcctcaccttctaaacttgagtgtcctctttcttgccactgttcctggctaatttgttttcatccttcaggtcctaatataaatttctttgtataatctttagagatttcatccctaataatcctctagtccctcccaatctaaattaagctattttaaaatactctttcataatactttgtactttcttattgtactactttttaataatatatttgtttatgttttttaatttaacactttttttcctattaagtcattaggtccatgagagcaaggaccatgtttgtttagtttactgctgtattctcagtgcctctcaccttgcctgtcaacataaaagtacttcttgaaagtggcaggcagtattttattttaaactatgtatttgttttgtttctatcttagggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttggctgagataggtatgggattaatagtgctgaatcttcataggcatgtactctccactccacattaacccaattaaaagtgatagtaaaattataaaaattaaggaaagacaatggtagcttttgtgagcaaagaatgatctagtactaattaaaaaaaacaacaaaactctaagtaatgttatccaaggctaatgtaactgcaggttattaacctccatgtttatttgctagctcattactgaattccagtggtcacatttaatgaggtacctgtggttttaatcagctatgagtatgctgtttatcctgctttaccagcagtgtctagcagtggcctgcacttaaaactcagagtagattgttttggtccctgagagacactaaactaaacacatcacagtgtttactgtgttggataacagcacttccaatagaagtcaagtaatggactcctgctttcctcctttacatgctggtgggtatgttggtgatgaacctggaaatggtaaggtccacacactcactttagtgaacattgtctctgttttttattggctccaaactttttggaaatcttaatgtgttgtcatctttttctgccaaatggaaatgctattggcattattaatatgctcaacaatttagttacatacttatatgtcctattcaagatcttttctatatggatttgtgaatatattgttaaagatgtattattctttagtatcattgtatcagatagctattgccacagtgatgctacatacatacaggcatagcattggcccaggcagctctgctttaggctgtagatgtgtagccggctgttctgctgccgttctgcctcacctgcctcattctgggacccaggctggagggtgtgtttctctcgtggtgttgatagaaacctaggagagaaccagtgaagattgggacccataatttagtctactataatgataaataaaattattcccaaagttgaaatgttttggctatcacaatacatggtagcataagtcagagatctgaaaaacgcttattctgaaaatattcaacactggttgttaaagcatgttcatctgcaaagtagtctacccttctttggctatatcatgatgatgtctaatggtgtcattgcacagtctcacagctgcggcatacctctttcacactgtatatagaagatttcatctttaattcatatgtatatgcctttttatataattactgtcagaatgtacattaaaattttttttttttttttgagagtcttgctctgttgcccagcctggagtacagtggtgcaatcttggctcattgcaagctccgcctcccgggttcacgccattctcctgcctcagccttccgagtagctgggactacaggcgcccgccactacgcctggctaattattttgtatttttagtagagacagggtttcatggtgttagccaggatagtctggatctcctgacctcgtgatccacctgtctcagcctcccaaagtgctgggattacaggcgtgagccaccgtgcccagcctaaaaattgtttttatagatcattgttataaatgggttttaaaacacattttgtataatattcattgagttgatggtctgtaaaatgcctttttttaacttttagaaccttttagattgtttctaataatcctttgttgttatgtataaacattacactgattacctttgtgtgtgatttttttctttaatttttattatttatttatttatttagagacagagtctcgctctgtcacccaggctggagcggagtggcgcgatctcggttcactgcagcctctgcctcccaggttcaagcaattctcctgcctcagcctaccaagtagctgggattacaggtgtctgtcagcatgcctggctaatttttgtagttttagtagagatgggatttctccatgtcagacaggctggtctcgaactcgttgacctcaagtgatccacctgccttggcctcccaaagtgctgggattacaggcaagggccaccacgcccagccttttttctttttttttaaattgcatttttttcctatagggataaaatttcaggaatgtgaacattttttcagagggaagggttttaatacatagtacattttatcgttttcaacaaggtagtgttagagttatagggtgcttttaaaagtatgaattttgtatccagtcagacttctaggatcagtacacagaaattctaccatagtagggctcattattatatacactcgaaataaatgtctaaacatagtatttaacagcttaacaacgtaagtaagtgacctccttattcattatcatcattcgaacatgtttcaccacatgtgatgtgtggatttgaaagtaatgaaaacaaaatgtaagatattttgttgttgttgttgctgagatggtgtctcactctgtcgcccaggctggagtgcagtgacctgattttggctcactgcaacctccgcctcccaggttcaagcgattctcctgcctcagcctcctgagtagctgggattacaggcacctgccaccctggctaatttttgtatttttagtagagacagggtttcaccgtgttggccatctggtctccaactcctgacctcaagtgatccacctgcctcagcctcccaaagtgctgggattacaggcatgagccagcacacctggccgagatgttttaaaaaaaataataaaacttttttttgaatactcttaccttttttcctttaaaatttttttctactacttggtaatttttttgataagactcaaagtttcacagtatttcaatatcattgcttataaagacttaaattggcaatttaaaaagaactattttgggccctttttttttggtaggtaaacctacagttgtggacatcatttattatagtgtcataactttctgaatagttatatcccattcatatctccagtgcaacttgctagaaagttaactctaagatttttatgagatgagattttgagaagctagtttgaactgtgttgcttttctttttacaggacggcctcctggtcctgaaatggaatactgcactgacagaaagtcatactccttagctgctggcttggccctgggcatggtctgcttgggggtaagcatagcctatgccttcccatgcttcagttaggacatctacatgttgagacaaataacgttgacacctaaacctgaatattgtcccttactacgacttaatcttctgcccagctctcttgtctttttggatatttttcaaggtaccagatttgcaaattgagagaaactgtggtcaagagtgagactttaagatttcttttcctccagcttacagtgttcatgaacaaactaaagggaataaagttttttttaaagtgttcaagacatagaatgaataagtgacagcccactatgactgaaaacagagaatagtgaaaatgtatatgatcaggagccttaagagtctatagtagctgcttgaaacaaaccctaacccccttttgccatagtgatgttcactgtgtatcccagaatgttgtcccagtagcatcttccttgtgacaaaatgcagtatcagattgacccatctttaactccatccaagagatgtgtacagaattaccagaaatgtttcattaaatgattgtttcacttgaaatgtggttccccttgaaaaaccaccaatacattcttatggtcaaactaaatgatataaagaaagttataaggccgaggtgatcggatcacctgagatcaggggttcgagaccaacctgaccaacatggagaaaccccatctctactaaaaatacagaattagccaggtgtggtggcgcatgcctgtaatcccagctactcgggaggctgaggcaggacaatcgcttgaacccaggaggcagaggttgtgatgaatcaagatcacaccattgcactccagcctgggcaacaagagtgagactccatcttaaaaaaaaaagttatagtggaaggaattttttctcatgtgtgttctgaaaatccacctcgtggttgaccatctgttagggccttgaattcacattggcacgtgagctaaagaggctggtggtataatggaaaataatcagctgggtgtggtggctcatgcctgtaatcccagcactttgggaggccgagatgggtggatcacgaggtcaggagatccagaccatcctgtctaacacggtgaaaccccgtctctactaaaaatacaaaaaaattagccaggcatggtggtgggcgcttgtagttccagctactcgggaggctgaggcaggagaatggtgtgaacccaggaggcggagcttgcagagagtcgagatcgtgccactgcactccagcctgggcaagaaggcgagactccgtctcaaaaaaaaaaaaaaaagaaaagaatcacacagggaattgcaacttgaattctggtcctaactagtgagtcaagtcatttaactacattattgtctattgcttaatcagcttcatggattgttgaaccagatggccgtgttttatatatagccctgcaacttactataatagctgtataaccttgggcttaatccctctttgccacactttccttatttataaaatagggttttaatagtagctatttgatatggctgttcattcatgttaaacacacagaatagtgcctgacacagagcatgcatttaataaattactattattatcatagttattgttggaaaagttcttaagtacaataatgaaagtattcagatatttacagttcaggtttcaattatataactaatatttttctttattgttaaatgtaactaactctaaagctcttatgtattttaagacagtacttaaagttgaacattcatgtattaaaacttttatgagaattattaatatttattaactcatgattaatgtttgctttaagttggaaataaaaaaaacaaaacccgaaataacctgctttgaagttagttcatttttatatttgttatgggtatgtgttatggatcttcctccataaaatttcttttcactcgtctgttattgtcttttccagcatggcagcaatttgataggtatgtctgatctcaatgtgcctgagcagctctatcagtacatggttggaggacataggcgctttcaaacaggaatgcatagggagaaacataaatcaccaagttatcaaatcaaagtaagtacacagcaaagtaatagatcaaaagtctggaagctgggaagttaattggaaaatactagtgttcatcctgacattggtaaatatgttaattttaagcatacttatcagaggaattttataaaaatttagaactcttttacatgcataaactcttctttcaataggaaggagataccataaatgtggatgtgacttgtccaggtgctactctagctttggctatgatctacttaaaaaccaataacaggtatttctacccactcacccttcctcccacggtgatagtgtgatatcctctctgaccttggttgtaaaattcagttatctcatgtgtttctttcccctgtgctggattaagctgattttcgttctttcaagtactgtaagtttttgaaagaaaactggcagtatttgaagttataaagattttacctagaaataatgtatttggctattttaattgtatttgacaatatagttttcaatttctgttcatttctgttttgtagttgatgtcagtaacacccaaacaatgcccatgtttgttttcattaatttagcatattgctgtgaggactggttaagccagaaatacttatcattagtgtgatcttggctaccatgtaaaacaatggtttttgcctacttcaagagcttttgtaattaccaaaccgtctaccttcctaacttgctatattaatgctgatgcttgaaagtaagatctttggcatttatgcttacacgttgcatgaagagtaagttgagtacaacatgttatgccatgtattaagtctattaattaaaaacaaattctaagattcaaggagcttttcagtgttccacatttctccctttagaaaaagtaaatgtgtgcagaattaacaaagtgtttaaaaatagatatttattattttactatttggatgaatgtgtagggcagtgcttccttggcactggggatatttcattgagcaaaactaaaaatatcttccctcatggagtttatgttatagtaagacatacgtgtacctctataataactattacgttagaaggtataaagtattgtgaaaaatatatagagcagtagtggagtgggaagaaatgttttgaaatagagcttgagattcttgattgtcttgccctctacttgaacagtgtcttctaggaagcccagacacatggagaagttctgagtgttttggccgatagtcccagatgaggttccagcaacagctgggatcacccatgagatgtgagtgaggaaggctttgagatggtttcagccctagccaccactgacctcataagagaccacaagaatgagaatcacctggccaagcccagcagaccttcagaattcagaaataaaataattcatcttattttaagccactgtgttttggtttgattcatcccatagcaaaaggcaacttcagcaggccctttctgaggctctggaggggccctggcaatgtatccatttggtcatttgcttttgacaaaagcagacattttagctgtaattggctaaaattctgatctctttctgccctcatgttgggtggtggtggagtggatgtgggcattttgaggatccagcaaaagaagaattgagttgagtcattgagtttgggttccatgggatttatttatgtggtatggagtcatttctgtgtattttattgctagctgtccctgtgtaaaacagattcagaatagtcttcacctccctcgtgctgatttacctggtggtgtaatgtaaatatgcaagaccatagattacatcacgattgtgtcacatgacatgtgcatttgcaggaacatggatggagctggaggccattattctcagcaaactaacacaagaacagaaaaccaaatatcgcatgttctcacttataagtgggagctaaatgatgagaacacatggacacatcgaggggaacaacacacactggggcccatcagggttggaggatgggaagagagacagcatcaggaaaaataactaatgagtactaggcttaatacctgggtgatgaaataatctgcacaacaaacccccatgacacatgtttacctatgtaacaaccctgcacttttatccctgaacttaaaataaaagttgaataagaaaaatagaaatgtacaaagctagaaaagagtgtagctcatcccatctgggaattattccaaatcttacagttcatacataaaaatagtttgataaagattttcctaagtgtgccaagaatcctgaaaacttatcttccattatcgatcctgagctatgaagccagaagaaaaatttaaatctatcaataataaaatactagagccaaaatagtttattattctcttctctcatagactatgatattacaacattattgaagaggcaatcaaagaatatgcaggcaaaaatgttgggaaaggagtattacagagataggtcaggaatttgtttaattaaaattgctattttactgagttttacatatgtttagtggtagcggtagctagagtagactttgctggagtctgggccattgagattggtattattaaggttatgttggcctcatttgctcttaccttctggcatacacaggatacatctcacttgatttctcacaagtctttggtacccatgaccactcccacctttttacaattttcacttttgctggcttctctggactcacactgtcaattttcccctctggctaactgttctcagtcatctctacagaattctcttcttctgggtccttgtgttgttgagggctttatcctagggcttatttttttctctctgagcaagcttgtccacccccattgcttcagtcccacctatctgctgacaactgctgattccacatctccagctcagacctctttcctaggctctacaccaggaattggcaaactttttctgtaaagcgatgataacaaatattttatcggcttgctggtcattgtactgtctctgtcacatctgctcaactctgctaaggtggtgcaaatatagccacagaaaatagtaaaagaatgggtgtggccatgttccaataaaacttgatttataaaaataagcctgcttcatgggctatagtttgccaactcctgttctaaaccagaatattcaactcccttctggaaatttccacttgggttttctcaagttcctaaacataacattgtccccagccaatttcatcttattccctcctatgcattccttcttaatgaatgatccactgtccaccagatgtccaagccagaaattcaggcagcatacttgatttcattccccacattcaatgagtcacaaaatcatgtcaattctactttctcaacatccccctaatccattcttttttctctttctccactgccttctttcaccccctctcatctctcacctcctatgacctcctcactgtgctgcaatcagagggatcaagccacccttggattttaaaagccttcagtaacagtagtccctgcctttctttggctgaagtctaaacttcttgaaacagagtgagaagcctgcgcaattggaccatttccccatgttagccaaattcctctcatctgtctgctcctcctgcctctgggaccctgcacatatatttcttctgcttaaagaatgtgtagcaggtgaagcaactatctgaggccagtataccatgggcagtaagaagaatttaccaagacagttgtagataaaggcagatttattgaagaaagtatgaaaatatgttgcaaggcagcaacaggcaggccagcaagagaggaactgaatgccaagagacaaaggcttgctgggggttttataggatgttgcttttgctgcgtgctgaagagagctttgtgcagtactgataacaccaaggttgcagtgggataacctgcatttttccatcagctgagggcctgatggtagctgggcacaggaagattgtgagctatttgtgcaggagggctatggtcctggaccatgaagaaaggcaaacttacagcttatctgctttctctttcttttttcctcagtgtcaccagcctgattccttttgcctaattaggactccacagaattattctcctttctcatccttccagctgtcttctaagtctcaacttggatgttacttcctctgggaaatgtctcctcacctctcaagactgtctctctgtgcaccactacaacaaatgggacctgggccacttcacttttacaattccagtttacagacctgcattgccccaaacccatgagaccaaaaactccctgagggcaaagatggcctcttatttactcttgattccccagcacctagcacagcactaaacactgtacccactgaaagaacatctgaaggatgagagtttatagcaaaagtggtttccactgacattcccttctctcttccccaactttggattgaggagcccaggagctggtcaggtggcaagataagatgagaaaggagaagtcattacttggggcctctgttttgctggtgttttgctggtgtgtggagatggtgggtttcccttgaatacctgggaggcaggagcaggcatgaactactccagcctctgggttctggacccacatggagggctgctgctctctggcacccatcagtccttaaccatctggtctccagccagggaaggagtgtggtggtggagaagcctctctgtcccacccactcatcccaggagctcacgagaatcagccaaagtccgagttctgcaccctgagttaggaactctataactttagactttccctgaaatttgggaattctcttaactagtatgaaagcagttacatcatcctaggtcctcctaaaatagacacatgtatccaaatataggcacatgtgttgcaaacataacatgtatacatatataaatatatacatataatttttgttttgaaataagtataaacacaacaagttacaaatatagtactgagagatccttgtgcctatggccccgcctccctcaggcagtatcttacataactatagttcatgattacaactggaaagttgccattggcacaatatcagaaactagtctgcagaccttgctcagatttcaccaggttttttgtgcactcatttgctttcctgaaaatattttaaggtttttctacatgacttatctccctgacatactgtgagataagattttttttttctctgaatgagcttagagaacaatcaatgtgagagatgggaaggatgatttggtgcaactctgttttatccatggtgagtctggacctcagagcagaaggaccctcgtctctcctctggggagtcctggtgccacctcagtgcaggctgctaagttatccgggtctgactttcttcttctctgctaatatttgtcttaagcatgtaacacagccatgcttattaatgatgaggagacagccaatgaaaattaattttttcaaagatgaatagatatctagattttttcaagcacaactcaattaagaaaatatcacctcactgagccccaaatgagttaggtctcactgagaaagtgtctcctagtgccaggcaaagtgcctcatatttgtaatcccagcacttctggagactgagataggaggatctcatgagcccaggagttcaagaccagcctgggtaacatggcaaaaccctgtccctacagaaaatacaaaaaaaaaaaaaaaaaaaatagctgtgcatggtggcgtgcacctgtggtcccagctactctggagtctgaggtgggagaatcgcttgaatccaggaggttaaggctacagtgagctgtgtttgtaccaccgcactccagcctgggtgacagagccagcctctgtttccaaaaaaaaaaaaaaaaagaaagaaagaaagaaaggaaaggaaaatgccccctagtggattacgttttaaccactgtgctaacttgagagatagcctgctatctctttacgggacatgagggctgataagcacctcattgcatggtcctggggactgatgaacaaaggctaacatgtggaaaagagcaactaaagaaagaagagccacctccaggttaattagtagaagtctcctcgctgatatgctctcatacactaaaacagcagtaaaaacaacctgcacattggcatcgagggcacagataaacttgccgaggacccttaccacgacagagggatgctttatatgaatccttagtagattaattaagttcttgctatttccagttggaaatgatactgtcctcttagggctattcagagaagttcatcttgatgaagtgagctgtcctagaatggcagttcccgggcagcagagcctgggctcaaggaaggtggaaagagggggtggcgaggagctgccaggtgcaaatgtcaggccagcaatgcagtccagcttgcatggacgtgcatcacctaggaagttgtgacttggctgcattttccacttcaggtgagatggaagggtgaactctacctcacctcctggtgaggttgatgtttcctggtgtttataactttctttgtaaatacttgcaaggaatttaccattttaatgctggaagagacgtctattccttcataagaggacctgagtggatcttgattgcaggccttatgctgggcagagctaaggaaattcaatttgtctccaatcttatttgaatgttctttttttttttttttttttttttgagacagagtcttgctctctcacccaggctggagtgcaatggcacgatctcggctcactgcaacctctgcctgctgggttcaagcaattctcctgcctcagcctccccagtatctgggactacaggagcatgccaccatgcccggctaattttttgtatttttagtagagatggggtttcaccatgctggccaggctggtctcgaactcctgacctcgtgatccacccgtcttggcctcccaaaatgctgggattacgggcattagccaccgcgcccggcctatttgaacgttcttatgcctgctacaagtgcagcagcagaatctccacacatcttgagtgcgaaagtttcctgtagttcctttagcatggagaggctggggaaggttacagactgatttgtactctttagacatatagttgatcattgaacaacacacgtctgaactgttacacacagatttttttcaataaatgtgttagaaaatgttttggagttttgcaacaatttgaaaaaactcaaagacaaaccatgcagctagaaatatcaacaaaaatagaaaaagttaagtatgtcatgaatgcataaaatgtatgtagatacctagtctattttattatttactaccataaaatataacaaaactattgcaaaagttaaaatttagtaaaacttatgtacacactcacagatcgtatatggtgctattctcagttgagagaagtgtatacaaacatcaagatgcagtattaaattgtaactgcataaatttaaccgtagtgcataccacagtacggtaataagttcatagcctcctcctgttgctgttgcaatgagctcaggtgttgcaagtatccacttaaaacgttctgtgatactcaacattccatcatgagcaggtcatccccagtgaattgcgcatcccagtaaaaagtgccctctccctgttcacgtgtatttttcatcctgtttcgcgctgtactgtaaaccttgaataacaccatgggatccacatgaagtggcactagtgatgctggaagtgctcccaacaagcagagaaaagtcatgacatttgacattacaagaaaaacttgatttgcttgatatgtaacagagactgaggtctgtagctggggttgcttccatttcagacagatgattcatcttgtaaacaggcggtgtaaacttactgtatggataaatacataacagtaccatagatgtattttctccttagaaacgtttccttttctctagcttactttattgtaagaatacagtatataatacatataacatacaaaatacatgttattaactgttgctggtcaacagcaggctatcagtagttaagtttgggggaatcagaattatacctggattttctactgtgtacggtcagtgtgccaagcccccaagttgttcaagggtcaactgtaatcctaaaagaatctaatacaatattgtacacagtaagtggtcagtaaataaggaattgaactaaataagaatacataaatctcagaatatgtgcaacctgatcgtagtacacagagatctctctatatctcttttctcagttcatgccattatttcaggtagaaagcaccttattttgaattagttgtctttagagcaaaaatccgtctaagagtgcagtgtggtttcctatgcacaatctggaatagtccattgcttcatgcctaccctggacatgaagggccgtgccacagtggaagtctctatgcatccacccctgtctatacctgagcaactcattcctctttgctgctctcttacaggctacagagtgcggtggcgccagcacagaactctgctcaatgtccctctgtgctttcacgatgctgatggattatgaaggtagggaagaatgtacagccaggaggccattaggagggcaactaatttataaaatcgcatttgtagaatttaatgcatccaacacctaccaggggaaaggtgggcaaaagctataccaacaccacccaagtcaaaaccaaaacaacaggaaaagaaaattatgtggatgtagaatttctgataacatcattcccaagatgccttatccaagaggaactgctacaataatattttaagtggaaataaatacatgctggaagcattatatattagtagactttgtttttttttttccccaaagtactttctcaagcacatcaacataagccccctaagagacatttcacattaaaaataaaacgtctgcccactgctggtttctcaatttgcctccaccttctgtcccctttaatgaactgggccacgaggtgagtcagagaggataaagggagtggtaagaatttgaggagagaagagagtgaggctagaataggaaatcaggaaatgcgattcggtccccctgttcctcacatggggccaccctcttgttgcccagtgtggtttcttcttgagggttctgcatgattcctcaatcccagggaattccacaggatgttccacccaagaccattgggctcccacctctactcttttgccagttaatgaataggcaggaatttcactgcctggaaagaggaacaatgctttctggtccttatttcacatctaaaatagagaggtcaattgatttattgctaaatatctttgaacactaaaatagaagttttacaacatatatactacctggttgctctagacttaagccagggaaaagtacagattcaacatttaaaattgagatagacgctttccacttagtgctaccagtcttgctttatttcatgagaatgagaatataataatatgccatacgttcatttgggggaaagattgatgtcttataatttataattacagaaaacatgtgagttcactgggaataaagaaattttgaagataataagatactttcacttatgtcgtaatttctatgtcatttggtgtaggatgtggagatattaacatttacacctaacttaagtttgtcatccaggacctgaaagggttttgtctatcagctgcacccctgggtagcgacacaaccttggggaaggcctcagccccatccctcgtacagcaggaatgagaacagcactgcctgttgggaagcttgagggaggctatggacgtgcagcgcttggcagagggtctcgtcatggaaggttccagcaaatgtgagatacttttctgatttcattttctccaaaagaaagggaataaaagaagaggggaggaaataagactaattgtgagagataaagtacaaaggtgagggaaggagtaaggagacatgaaggcagcgtggagcagctgaggggggagattgctttcaccacttcccagcatctattgcagattccaccctcaatcattttgtaaggaccctttattcaaggtcatgtttgaaccctgctgagccagtggcgtgggtgtctgagagaatcattaacttaatttgactatctggtctgtggatgcgtttactctcatgtaagtcaacaacatcctgggattgggacacactttctgggcactgctggccagtcccaaaatggaacataaggaagtggttcttctacttcttttatttctgaaatcaggtaagacatagtttttttaaattataataattattttttctcccacaatgcagtacaaatacatatgccatggctttatgtgcaattcatttaatttttgattcatgaaactcccagttgaaaatcttgtataagattgaggaattcttcaagaaataagtttagttttcctgtgaagattgtcagcgtgctggaatgaatgcgcagagaaaataatgggtggtttttcaaatctaaatgagtgcacccacataatggccagtctaattgaaaaagagccaatgtagctaactatgcaaaggacggctaagctcttcgcctggttctcagtttgactaatttatataatctctcttacggtgtcatgctcccctcacttgcaagttaaaacaatgaaatttctctttgaatatattctgttctctcaccagttcatggtggtggcagcgtcagggattcagcatttctccctttgttatggcctgaggaaggctttccatcagtatacgtttgcctctaatccccggaaaaatcacacgcatccatttgccagatgctgtgtgcagacagtgattcaacaaatactcacttagtgcttgggttaggtcgctacatttttacacatacatacatacctgtgtgtgaatgtgagtgtgagtgtgtgtcctttacaaatactagcttatttagctcgcggtataggtagggtagcatattcaccctcattttataaacaaagaaatctagacaggaaaatcatgttatttgctcagtgaccaaattctcaaatctgggaaataaagaaaactggatttaagccaggtttcccagaaggaatctagggctcttctcacttttcagctttgtttaagcctttgaaataatattctaaacatgtcctagtagttctttttctttttctttttttaaaaaaaagctttatggagatataattaatgtatagaattcacccatttaggcatacaatccaatggatttcaatatattgagagttgtgcagccaccatcagaataaattttaaaactattcatacccccaaaaacgcactccactctccttagctgttacccccgatctgcagcttctggcaaccactaatctactttctgtatttatatctttgccattttgaacatttcatacgaacggaatcatacgatttgctagtagttcttcctgtaaataatgtatacttgaaattcaatctataaattaccagataaaattttacaagttgcactttagagtcaaatacatttgaatttagtggaagccattcaaggagctatcaaacaaaatacagagcaggagaaaattaaagaaatttttgtaagaaattggtgtatgttgggggtgtgaatattatatttcaatgcatggaaactatgacatagatcactgtgaacttattcagtgggctacacccaaaggctagaacaaacttctccgccacaggattaccaatgttttaaccaacctggggggaacattctctcataagctcttttggaaagccaggctttctgtggatgtatcatctttccagtgtgctgcaatgcccggggagaggaaaaagtttcttttacagccatgcttagtgggaagtggagaaacatcttccatttcacaaattaagtcttttacacatgcaaatatgcatacacattcacacaccacagtgaggaagaaattctcacaccattaataaaatacatttgcatcagtagcaatatacatctgcattttgcctataatataaatgtatttttccactaaaagatttgatgtttccttgccagcaaataagccctatcaaatcctattgccatatgagtcctagaggtgaataagagaaaaaaaaaatgggggaaaattatttcaaattaaaaagaaaaaagtttgattctgttttgggatatttcctagggacaggagctggggaggggatctcagcagcgatgcgctatgaagtataataacatgacacagagaacttaattgaagggggaaataaatggaagttttctttttttgaatatcaattgtagcctgctctgctatacttcaaaaaaactcttcagaaagtttaactgaactcaccgtaggacacactttgtggatttattgtgtgttttgaagtcacactgcgagctatagaattaaccaaaacacaactcttcttggaaatgagagttcaagttggcagaaagtgcggggtaaagacatggatatgggcctaaagcatctatttctttgtgatcttttgatacatctctcaagtgcttttcagtggattaggtttagaatgcatcagccaactcctgctcaataatccatttttccagcccggaatgtcttaaattgaggaaggacgaagtcccagaggtggggagcagggggactttggccgaggactttgcatgaattgatgagcgtgcatcctcctccctgtgctctgtgtaccctcaggaggtcaggacgggcctttctgagaatgagaatctgttcatttgccttcctactggatatttgtcatcagcatacaaaccagtgcgctctgcagtgtgtcatctttcagaacctcccctgacctcatcttccctggagggctcgctgtcttcagagccaggcttgtctcccgctgccgcctccactgctctcctcgtcactctataacccactccctctgcctgcagcccccaccacgcccctcaaagtggtcaaggttgtcctgttgtctaattccatggagcttggctatcttcattttattagcctcttttggcctcttacccctgtgaaaatcactagcattctgtgcgaaggatggagctggcatctccaggcttggaatagacctaccaaagctcagccagatgtccggaagagcctcaggacaagggaacaccctgtagccttgtggtgggagcacagctgaggcccccttggccaccctctgccacgaccaggcagaaagcagctttcggacagattcgttgtctcagatttgatctcaaagaaaaaccaagaccagtatttgtcccaggttctgcttttttacaatttcctccgaaatccagatacctgtcaacaccttggaaaaactgatttctccccagttagtagtgttgtgtgactgtcatcagcccagtacaaaaatggccttctttgttggggagcttcttaccctccagtgttttgcccaatttttgtccaagttggcaacataatttagttcagttcttgtttatttccaccatcatctatgcaccaaaatttatgtgtctcaaggagggaccattcagaggatgcttcccaccagttcaagtgacagtgtcagaaccaaagcgcatattgtaggaaatcaaacaatggcctccaagttccatttctacccagggatgaacaaatcaacatcaatcttggtaacacaactgccactgatggtgccttactcttctctcatgacatggcacaattgatagcaaacataaaatttgttcttgtttaaggatttatatccactaatatggtaacatagtagtggttccatagttctaacctgtttatcaatccagttaatcttttactatcttgcaatctgttaatgaaactgtttttctttgttttataatttcaacttttagagtcaggggtacatgtgcaggtttgttacatcactaaattgcgtgacactgagctttggggtacaaatgattcccatcacccaggtagtgagctaaatacctactaaataggtagtttttcagcccttgcctcgctccctctctcccttctctggtagtccccagtgtctttagttgccatctttatttatgtccacatgcccaactgtgtgttcttaactaaacattttgattcatagctacccattctacttccagtaaacagcaagttttatttggttaatgctaaccaaatagattaaaaggaagtcatgacaattagacattggcattgatttactgaccatttattccacttggatctcccacctctaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcaggtattttcatcgtcgttgcacctacccagaaatctgtaattcagatggcaagtaatttactcacaaatttattaacgatttaagaggaaagagaaatttatggagccagagtttggaactatatttgctcatagcatgtgaagccatactaacagcttcttgttaaggtttactggagtcttcattagaaaaataccctaaaaggaagttatttgtttttacaccggacataaacattagcagttattgttctgagctccagtttttaacatcatcatcagtaaatgtttgttgaggatcatatgaatgaaagtgtcctagatagatctgagcaatgacttatagctacaagatccagtgcctgcccttcagtatttaaggtgactggatataatgttaaaaaaaaaaaaagacagcctaagtgagctacaggcataatcaatgcatgttctacccagatccagaagaaagaacagtgcctaaggttgaggcagctagagaaggctcagggaggaggtgggaaccgagctgggtttggagttgagagagctcttgaaaagcaccaggaaggcaggggaagatgcggccctgcactttctgagggggaccattaagagatcaagttgactaaagcagagactttgtgtaggtgatgagcctgggaaagtagctatggatgccagactgagcacccatagcaggaccacgggatggagatgggaggggtcaggggccagggtggggtggaatgtggggcagaggttcaggggaactgatcagagttgggaggtcatggagatggactatcttggggaatgggttcaaagcaaccagagttgcttctttctgacccaaaaacaaaaattaagaagatgagtgaagaagaagtaaaacagttgaaacagaaagaaagagaaaattatgagggagggaaggtaagggcagataagatttactgccacgttggtgtattttgttcagtacttcatcaatgccatgcccaaataactgaaagaggcagcaattctgagctctctggtccctcaagatagtcaatgatctttagcatttctcatttattaataaacatttgttttctttaaataaagaaaaatacttattggatttcctgcttcgttctgcagggcattccaatatcacagtaaagagcaacaatgtgtgataatggctgaaaacaggaagtcctccataatcattaggatgagagatgcagttttatttgaaaagtaaagtgagtacattttcttcctcctcctcctactgtcctccccatcctcccactcttcctctttctctattctatctttaatttatgagaccagaggaggaaggcgctatggtgttgtaaaattgaattctgagttaggacaggatttgattactaactaaccatgtcagcttgagtatattacttcacctcctagatttaatttttttttgttcaaaaaatgaaaggattagatttacaaaatcacttctacctctatgaccctgaaaataagatttttaaaatattattttatatttaacaaggagatgggaagtctaagcattccttttggtcttggcttcttattctgcagggtgaccatggtccttgggccctaacatctggacgaagccttgtaaaacagaaatactgaggtgttttaatcctcagaaacatttagattgggacacaaatcttattttttactcttaaatttttcacattttgggggacatggtctatatttttctcagatttctgatatgttgtcttttaaaaatgtgtaaaagttacagttccttttctatagtttattttaaaatgtgggtcaatagtcccactgcttagaataagaggcacacaggatttcaatagaaattgcatgcctttttagatgtgcgaatgtttcattaagcgtatgaatatttgaagagatgtatgacactttaaaaactgtttcctctactgtgttggtggccaggtattaagactgttaataataacaatttagctctccaaatatcctgcatcacaggtgttaaagaggactggaaacaccttagttcttgtattcttgaggatgatttgccatattgtgtctagtatcacggcaaaactccaagtagcattttaaatagtatttatttgggttggaattatttctatgcattgactcatcttcctgggtttcattagctgtacgcattgtactttcttccttaccactatttatctcgaattcttgagattaaagtacagatgaaatctaaactttatctggtaaagttattagttcttacaagtagcaagcaaacggtaaactaaataggatgacctaattgtaccagatttaaaaaaaaaaacaaaaaaccctgattctcctgattctctctacaaaatgctaacatttaaatatgtcatttgtaaattgttaaccagaaggaacatgggaatgactgtaggttgagtttgaagtgtgaagtttgaaggcttagtttgcttgttttcaaagtgacagaagggagcaaaaggttatataaactccggtgggtacatacagttgctgtgggatattgacctgctgctaacttacctgccagggtttttccaggaacagtcagtgttagatcacgtttacttctgccacttgccaccagccacactgccttcaccgagtccaagaccctatcaccactggttggggctacttgtagctgtacacctgatctcgaagaaatataacttccctgtttaaagcccttcctagtgcccttaaaataagacccaaagacttcccaaatgtgccagggcccggcattatttacgtaacccccggctgctgtttgcttggcttgctaaacttttctacaaagtttctggccttacttctgttccttcaccaccccaagcacacgccctcctgcctgggaccctcttcacctttgtcctgctgtgccagctccttcttatcgcctaggtgtcagctcaatcatcacctcctttgcaaatcttccttgacccctagacctccctttcacaaagtaccttgagtttacactttgatgagtgtcttatgtctactgtaatactatgtcccaatgaagatgtactggcaatcataataggtagtattgggttaaaagcattagtttgctgtaggtacgttaggagtactccccatgtgattgatcagtgaatttaaaaatggctaaagtgggtaaccttaaatgatggtgcaaatataccttaaacattttatattttcattgaaaacacaagtgtacttgacacctcttgatgtagagcagaggctttttttcttcgaatatggggtcaccagtagaaggtctctggtgcatttcctgcataaactatgctctagtgcaacatctacaataattactttccttatttttgaagtggaccatatctcgacatttattaatcaatctgcatgtgtaaaacctttagatttttatgaattcctcctcaagctttatagtcaactatatgagtggattgccctctgtggatctgatagcaattttttaaatgattcacgtttcaacttgttaaaaacatttaatttagttaaaaaccaaacaaaaaagagctttgtttcttttcacattcatttctcagtttagatcatctttaattaaatataaatgtaagaaagttggaaaatgcaaagaaacgactcgttgtaagcacataactcacgtggggggaacagacatgggtgggcacactagcaaacacctgccagctgcatgtggacccaggtgggcaccggactgttttaaacacaggagagggcccattgtctaactggtgagttggttgagtggaagctggttgagaacttttactgcaaaccatttacagtagaccacaattttatagtcctgtttggcactttttcatatcactgggagcctgaagaaatagaagtgggttggatctctttcagcctcggaaaagcctgccattcccccatctaaaaaccctttccccattctcttactctgtctcatcatgtatgtaacatgtatccatgtatcatcattaagtgatctcattttatattgtttacttgaatatttcctgtaacccccctgtctgattccactagaatgtgagctctatgatggccaagcctctggctgcactgtgccccgtgtgtccccagcatcctggtggggctcaatacacagagagctcataagtagcatttgaatacatgaatcaaagtatggaatggcccagtttactgcagcctttttgcaggtgcaaaagatgatcttttagaaagcagaaacagggggtctggtgcatgagatctttttctcaatgtgactgtgctgtgcagaccttcacgtggtgtcttgtgaaagactttgaccactgtgtggactttccttcagtgtatctttcagagtgcaagactgggaatggaaagaactacagagggacgatgtccaaaacaaaaaatggcatcacctgtcaaaaatggagttccacttctccccgcagacctaggtcagacttttcctttcatctttgtgttcatctactgtaaagtgtccgtctgtgtctgtgagggattggttccaggacccctgtggctaccaaaatccatgcttctcaagtcccttatgtaaaatggtgcagtatttgcatataacctacataccttctcttgtgcaatccctaatataatgtaaatgctatgtaatcgttgttatactgtattgtttttatttgtattatgttttattgtcatattgttattttctctcatctttttcaagtcttttccatccacagttggttgaatttgtggatgtggaacccatggatacagagggccaactgtatttaggataatttcatcacttttaattcaaaccagaatatgtgaataagcagacagaaagaatctttttgatgtcgatgttcaactatttttggcaccatagtagaacatggttgctttctattttttcttgggtatggaggtttcttgaagacctagaacatagaagaatgcctagttaaaaaaaaaaatcaatgaaactacgagttttaggccaaatctgagaaaagaccaaagatgactatgtttgggactgaagtaaacatatcaagttagaactctcatcacatgtttgactcaaattgtggagcaaaatagtaaataaaatataaaaatgaaaatgaagatacgtgaaattcaaatgtcacaacttgcctattatttattttagtgcatttttttgtgcttttcccagtttggtgttaggtggccttaagttctcagtaatgacacttatcaaataggaacttagtgttactcacctttatccattcccccaacactcaacaaattgcctttgctatatccctatgagatgagcagatcaaatattccccgtgagttaatgaaaactgattcaaccaaatggcgaagtcagagactatcgggggccatggagacactctgggccatttttatgaggtagtctaggctcatcttcatgagggaactgaggtcttggggggtgggggttacccaaataggttcacagaagaaccagaaataaaacctgcctttctagactgtaagtcttgtgattgtcatctaaatggttgtctctatacagcaactcatctctagaactgaaaataagtttaaatccctcctccatccccaataattcaagctgcatttcagagaaaaccaggactttggaatcagacagatcaactttgaattcttgatctgcttcttcatagctatttatgcttaggcaagttttgttttgttttgttttacgttgccactcagtcttctcatctgtaaaacagggataataacaccttcctcaaatggttttttttattaggactaaaagagagaatgtgtggaaagatgttagtggaattcctggcacatagttcacatggacaaaatggtgttaactacgaaaatttttacagagaaaagggcaactgacaaaagcaggtgtttggaatgaattaagaccatggcaggcttttgaggcctttatatttctcctgactgtgcaataaaaatattttggctctctgtctaagacttggctgtcacagtagcaatggtaatattagctactgtgccagaagcagcctatcaatagagaaattgaaaatctgaccacacaaatgctgcagcacccagctgaaatgcatttggatgacaatctcagatgggaatcgagagcatctccttctgccttgctaatagcaagctgatttttagaatatagtctaagtgcttctcttccatcctccccagattctcacctgctacacacccctcagagggactggaggaatccagacaacgatgcgcaggggccctggtgctatactactgatccagaacagagatatgactactgcgacattcctgagtgtgaagggcaggagtggctctagaaaatgttttcatttctgcccttcacctgtaaaataatttgttgtaaagccccttcccacagggatattattaataattgcgtaacgtgttcacctctcggaaaggagcaaaactttgctcagatcccagaattaacctgatttttttttttttttctgagacagaattttgctctcattgcccaggctagagtgcaatggtgcgatctcagctcaccacaacctccgcctccgggttcaagcgattctcctacctcagcctcccaagtagctggaattacatgcatgtgccaccatgcctggctaattttacatttttagtagagacagggtttctccatgttggtcaggctggtcttgaactctcgacctcaggtgagccgcccgcctcagcctcccaaagtgctgggattacaggcatgagccaccatgcccagcagacctgaattattattattaaaatgttacatcaacatgtacaaatataaaactacatctaaactctaagtacagacttcttatgcttaaaactcttacacagtgttaaccccaagacagatttgcaattaagtagttaaaataagacaacaaagtcaataaaaatcaaataaacaatatacatttaatgtggtagactttgctgttttgctgaagctaagcaaggaaccagtttttaaatcagcaatccgttattttaatggactgagcaatttaatagtgcacctcaaaggtcaatgataaaaactaaaaaaaaaaaatacctactgaaaaaactgtcatcgtttcacatttctggctacgttagtgcaaaagggaataaataaaggtgagatttgtgtgacagtgtggatatggtactgtgtgacaactcagttctcccatcacttccacctgtttgaatcatcgggatcctttatttgtacaccatgttatcggtatttgcccttaagcaccaccaatgcaccacttttatattaagtctgcccgttttccttagtactccataaaatttaagtcacatattactctgcctcaccatgttacttcaataattctgaatcaaagtttaagtttgtgaataattttgcaaaaaaagagccaatcatgcttctcaacaacataaaaagagaagcgccgtcacttcaggtgaatattgttctccgtgaggccatgagcataaacaaaaactccagactaaaaccctgagacggtgccaggtcattcagcagtcagcggaatgatcagtataatttcaaacaaagttttaaagatcattattgaaatgatgtattttgagcttcctggatctgttcctttatgtctaccttagttcatttgggctgctgtgacaaaaatatcataaactggagagtttataaacaacagaaatttatttctcaccgttctaggggctgtgatgtccaagaccaaggcactagcagtgtctggtgaggccctgcttcctcatagatgacacattctggctttgtcctcacatggtgtcaggggctagctaattccctggggcttctttcataagtgcactaatctctgtcctgagggtagagccctcgtaacctgattgactcccaaaagccccacctcagtactatcacattgaggattaagtttcaatataacttttgaggagacacaaacattcagaccatagctttatctatcatgaatttgggggaattttcagtcactgttgcttcaaatgtttcttctgtttctttctcttttttttttttttttttgagacagagtcttgctctgttgcccaggctggagtgcagtggcacgatctcagctcactgcaagctcctcctcccaggttcatgccattctcctgcctcagtctcccgagtagctgggactacaggcgcctgccaccacgccccgctaattttttgtatttttagtagagacagggtttcaccgtgttagccaggatggtctcgatctcctgaccttgcgatctgcccgcctcggcctcccaaattgctggcattataggcgtaagccaccatgcctggctttctctttttcttctctttctggtatttccaaaaagtctccatgttccaccttttgtaattgtctcacagttcttgactcttgttctgttttttctttttcattcttttctctcattgtgtgtcagcttttgaagtatctattgacatctctttgagctcactgattctttcattggccatatccattcttttgatgaacccatcaaaggcattcttcatttctgttatggtgttttttatttctagtatttcatctttatttcttcttagtgtttttatctctttgcttacattacccatctgttcttgcatgttatgccatttttacattagagcccctagcatgttaatcttagttattttaaattcctggttggatacttccgatatttctttcatatctgagtctggttctgatgcttgctctgtctcttcaaactgtggggtttcttgtcttttagtatgctttgtaattttttgtttgaggctgtatatgatgtactgggtgaaacgaactgagttaaataaggctttagtatgagattttgtgtttctctggctaggagttaggctttgtttactctttgctatatagtcatggatgtcagaggctaaaatttcctctagtgtccttgtgttgtctcccctgtcttctctggggagctccctagaggcttctttgtaaagtagctctgagtcttgcagtgtctatccctaatcatgggaaaacatcaaacaaacccatacagcgggacatctgacaaagtaccaagtgtcaaggatcatggattgaatcctgaaacagaggaaggacactgaaggaaagactgggaaaacctgactgaggtctggagtttagttagtgatactataccaagacgaatttcttagttttgataatttgttaacagttatgttaacattgggggtagctatgcaaggggtgtgagaatgctgttatatctttaaccttggcccatggttaaggtgtttccagtgtaaggtcactgttattccttgtagttaacatatatttggcaccacaggattcattctggaattctccttggcttatttataactttttttctagtagtgagaaacctggctttcatgcagagtttacaaacgccaatttaaacttttgttttgtcatacgcaatgattttattacctgtctttatttcagagcttatgaatttttaattattctaagggctaacatagaacttttccatgttttctactcttcaagagtaggtaagactttagtttgtaatacattacaaaaggaatcctgtggttctctaagagctaatttgtcttggcaaaaggccttagcaagctgtgagtggtggctcatgcctgtaatcccagcactttgatctgagacggctggatcacctgaggccagaagtttgagaccagttttgccaacatggcgaaaccccatctctgctaaaaatacaaaaaattagccaggcataatgccatgcacctgtagtcccagctacttgggaggctgaggcaggagaatcgcttgaacctcggaagtggaggttgcagtgagccgagattgtgccactgcactccagcctgggaaacagcgagactgtctcaaaacaaacaaaaaaaccaaaaaacaaaaaaattagacgggcgtggtggcatgcacctacagtcccagctactcaggaggctgaggcaggagaatcgcttgaacccaggagttggaggttgcactgagcagagatcatgccgctgcactctagcctgggtgacacagtgagtatccatctcaaaacaacaacaacaacaacaacaacaaaaacaaattaaaaaacccaacaacaacaaaaccagcaaacaaaaaaactaaacaggctttagggaaagagcaatctaattatctgattatatgattggcactaagatgggaatgactctggcctgatttcttcagtttacattttaaaataggagcttagttagcccccaaataatatgtaattgatgtattagcgttggggagtgaatatttttcaaagcagaagatatttctcaattcttgcttacttttagaggttgaagttcaaggaagccccttccttggcactgtatcccagggaggtatttggagttaatttcagggcttagcagtgactctttagaaaagcagtatacgattgaaatgtaatgtgttacaaatgagatcactacaagtaatttaaaaatgtgctagtagtgtttttttttctgagacggagtctcgctctgaagcccaggctggagtgcagtggcacgatctcagctcactgcaagctccgcctcccgggttcgcgccattctcctgcctcagcctccctagtagctgggactacaggcgcctgccaacacgtctggctaattttttgtatttttagtagagacggggtttcaccgtgttagccaggatggtctcggtctcctgacctcgtgatcctcccacctcagcctcccaaagtgctgggattacaggagtgagccaccacacccagcctctagtagtacttttatcaaaagtaaatagaaacatgaaattaattttcacaatacattttatttaaactaatatgttcacaatgttaaaatttcaacatgtaatcactataaaaactactagtgagatatttcacattacttttttcatgtaagcctttgaaatctggtgtgtattttatatttactgtacatcctgatttggaataaccacatttcaatctttcaatagccacatgtggctagtggctactgtgttagagcagttctagaacaaaggagtccctttaaaactattttgaagtcatcgtctataaggcaatatgaaagctgatctgaatgatttctccttttccaggaaaggaaacaaaaatgaaatcatgttagggctgcatattttatggatcccaggagaaatacacagtctgaaagaatgatctcagtcagaaactcagaatgaatcatatgaattaaacattggacaatgtccaatgctcagcatgtgtttttggtttatactaagagcatattatgccaccaaatacagatatttactattatacttcgtgtaggaggtatattgagacattgttctagactaccacagttccatattttgtgaaaagttatattgcactttttttttttttgagagtgtgcccaggctggagtgcaatggcatgatctcagctcactccagcctccacccccccaggttcaagggattctcctgcctcagcctccctagtagctgggattacaggtgggcaccaccacatctggctaattgttgtatttttagtagagatggggtttcgtcatgttggccaggctggtctcgaactcctgatctcaggtgatgcacctgcctcagcctcccaaagtgttaggattacaggcgtgatccaccatgcccagccttatatttcactctttgggaattgcatcttactgtaatcttaaactacactaaaataaataatgtaaaccttttgtcaaattgctcagagtaggtttctactttggttataaggaataaaattcatgcttttgtgtacacactagacatctaaagcaaccaaccatagttaacaagcagtgctcttaccaaaaggtaactctttctagaatctggcacaccatttaatatcagtatgagcatatggtgggtttaataattgttttccatgtttataagttttctttagttttataagcagttaaaatgaatccctttcactgaaatacaatctgtggtgggacttctagcttttctcgatcttacgctgctagatttatgtcactgccatagctatgcaatgggtgatatttacactatgctcaaacaaagcaaccagaaaaacacatcattgaataatacagatattctgaagtcaagcaagccaactttcattaacagatcaatttccttagaaaagttgatgaaactaaagactgaagttcaaagaaaaagccctctcaagggggtatgaatttctggtaacttatggggtaagaaaaagagcaagaaacttgaaagtagggaagagaaaaaagaaaaggagcaagagggaatagccagctctcaaaagagtctccaataggaaagcaaaatctgtatctagccagtaccaacatgtgaagaaagagtgagcatagcaaaattgagaaaggttgcttgaaaaccaaacaaaaaaccaaatacctgtaatcctagcactttgggagggtgaggtgggtggattgcctgcactcaggagttcaagaccagctgggcaacatggtgaaaccttgtctctactaaaatccaaaaaaaaaaaaaaaaattagccaggcatgggctgggctgggctgttttccaggctggtctcaaattcctgggcttaagtgatcctcccacttcagcctcacagtgttgggattacagtcacgagccactgtacccaaccatatgtcattctttagacacactgcttactaaatttctctttttaaaggatatactgaatttccggttgagccaacttaacagctaattttctattttagctttaaaacattgataagcaacatgaagcaatctagaacttaacctttaagtggctttattaaagcaatccagctatgaaaattatgcagaaatgattatctacaatcttaccagcacataagaaattcttcctctattctgaaataccatcttctcacaatatactttgatgttatgaatcaatgtctgttcttgaacattatttattgtctttctctattaaacaattccaaaataaaatttccagcacaactaaatattgttgatgataagaggatttttaaaaaagttcttttaaaacagaagcttatatacaacttagaatctaaaaccaatagatttatggtaaaccttaaaactgaaccaaaacaaacaaaaaccaaagttttaatcatttaaaaatcatgtttattgaggtacaacttatagtaaaacctgcccttttcagcgtatagcactgagtcttgacaaatgcacagttatgtaccaccaccgaccaaggcctggcacatttttacctcctcaaagttctccctggctgcttctcccactccttggcaaccactaacctgttttctgtccttatagtactgcttttttcagtgtcatataagtagaatcacactgtacatagtattttgagtctgacctctgtcaactggcataatgcatttgagaattatccatgttgctgtactggcagtgcattcttttttattgctgagcagtattcaattgcatggctgtaccagtttgtttattcatttgccagttgaaggataactgagatcttcctcgtttttagcaattttaaagaaagtttctatgaataattgtgtacaggtttttaattaaatgttttggagatataattcatataccacataattcacctttttaaagtgcataagtcactggtttttaatatattcacaaggtttgtgcataggtttttgtgtgaatactggttttcattcctcttggataaagatttaatttggtattacccttccagacacctttctgtgttttcatacgtatatatgtatgacggtttgaccttaggcagagtagcattttcaaaattttacatggggaaactttctagatttaaagccattttatttttctgttctgtctggttttatctacgtgttatttacaatctgctgtgtaacaaattactacaaacttagtaccttaacacatatttatttcacagtttctgtgggtcaggagatcagaaatggttctatttcaaggtctctcacagggctgcaatcaagatgttggcatggctggggtctcatctgaaggctggactggagaagaatctacttccaaacttatgtggtagttggaagaatttagttcctcaaggctgctaaactgatggcctgtgttccttgcctctgggatggtagcttgcttcaacaaagtgtgcaagcagagaagacagagagagtccgctagcaagatagaagccacaatctcttgtaatctatcatttttgctgtatgctactggttaaaaataactcattaggttagcctactggctctcagggggaagagattatacaaaggcatgaatttctggaggagggaatgagggcaaagaactctgaaaagtttctcttccacaatctgaagaacttctagaaagtagaaggaagcaatattgcttagggatggacaacttggcactggttatgtgttccaagtgaggtaaccttgttcccaggaataaagagaaccagatgactgtaaacatttccctaaactgaaatgcactgttgtatgttcacctgaaatgaatggtgtaagctgaatatgagatttttgacaaaataaaaattttgctgtgttctcagatctggcaggctattgtgaggcaatgtgtcattttaccttataacgcagagttgtaacatgctactctgagcagctcatgacatctgcttgaaatttaagttgggcccctagtatgtgtttattataaagattttgatgctgcttttcagagttgggtaacctactttacccccttagctaatgtttcccaaatacacccaaacccacagaaaggaaaactattcctcattaactcacagccaacatcataaacattttatatctagagctgatgatacagtcaggtatttaccaacactcatgtatatatgtagagtttcaagaaataattgcttatccttactagattcaacatattctaatgtttcacatattatttttatttcttaattttttttttaaagatggggttttactctgttgcccaggctgaaatgcagtggcatgaccaggatttcgaccagaagtttgactgcagcctcaaactccttataacaaagaatcctgctgccttagcctcccgagtagctaggactatgggcacatgccaccagatctggtatattttaaaatttttgtagacatagggtctcgccatgttgcccacgctgattctgaactcctgttctcaagcaatcctcctgcctggtcttcccaaacttttgggcttacagctgtgagtcactgaccccagcttgtattcttttgattttaaaaaaatattctgaatgtgatccaccaaattaatttcaccatccactaataggtagcaacctgaatgaaaaatactgttataaactttacacaaaaccagagattataaacatttgcttccaaggagagaggtaaaaggtacttgtttgctctgatgggccctgtttccttcagtgccaggaagagtggctctcagacctttcttctggcatccctcatgtatgcagtgttggttattattttcaaggccttggtaaccaaatgcccctagtgtgaccagtcagactgacagtccatatctgtaatatggtggtaagtttcctttgcatgtctttctttctggcatcttagaacttttacctaggaaattttctttttgcttgaagtacatcattaagaattttcagtgaaggcagattcttaaagtttttgttttccagaagagatcttggaaaatataaaaggttggcagttatttcttttagtacatgagatagtattacaccaatgctgttgagaagtctattgtgaggcaatgtgtcttctttctctggctgcttttgagatttctctctgtcttttttaggggcagttttactcttatgtgactagaagtagatttcttcttttttttttaatattgcttgagattttattgggtttttgaatctgtggatagatatccttcaacagttctgaaagatttccagccattctcttcatatattatctgtgctgtattcttgtctctccttttagaacttcgattagtaaaaacatgtttgatgtcttttcccactcttgttttttgtttctcccatgctgaattctgtgtaatttcttttgaactatcttgtagtttacatttttttttttttttttttttttttgagataagagttttgctcttgttgctcgggctggagtgcaatggcaccatcttggctcactgcaacctctgcctcctgggttcaagcagttctcctacctcagcctcccaagtagctgggattacaggcatgcaccaccacgcccagctaatttttgtattctgagtagagacggggtttcaccatgttggccaggctggtctcgaactcctgacctcaggtgatctaccctcctcagcctcccaaagtgctggattacaggtgtgagccaccgtgccaggccttacattctctctcttaaagagaaaatgtaaggtatctaaatctgctgctaaaccatcattgtttttaattgtaataaggtctcttttatgtactcacattgataagagacaagtaggaaataatctttaaagggcaaactaatttaaatgtgttttcctgtctgtttacaggacttaccaaatgcacatcttagagttctgggtttctaatgtgtatctcctctatgaaattctttaaaaatatctgttcttggtatcccttaggttagtctcttttagaacttctaaatcaatggacccttaacttataggagccacctggacgttagcaacgtctacattaaacatgctgagcttttaaaagagacctgttagacatgctgagtattttgagataatatcattgttgtattgaaaactattgaaaactttaattttaaaatgcaaacattcttaaagtcctggttaattttataactataaaattagttataattttgagatttctgtcttgttttttataggggcagttttactcttaggtgactagaagtagatttcttcttttttataactataaaattaggtttacttttgttagaataaattaaagacagtgaacttgtaatttgaataactactaaaaatatacatgatgtattcttatttgggcccttgtgacaaaaatactattgtggctatagaaacctatcctatagtttgaagaactgagattactgtcagtattgagaacattcctccttcatcattagaaagattattaaaaaccagattcaaagaaactatcaatactacttatgaagtatgtctgtaaaaaaaattaagcctgaatcttatcaggcctctagaccagggattctcaaggtatgggccccagaccagaagtatcagcaacgaattgctaaaaatgcagaatcttgggtcagaaattggggaccagcaattggaattttagtaagtataccagatgattcagatgcctgctcaattttgaggatgactcttatcagtttagttattaggatttacaggggatggggaacatgttaaagagcaccaactagataaggtcaatcagtcaaaagtaagatgtctggacattctgggcctcctgatgtcttagaaagcacacaataccatctatggtgtatttttgtccaccatcccacccaattgcacctggatcttcctatttataggcaattagaacaagctcagtgttaccctgtaatgattaaaaaccaaatataggactgctatagcataaatgaccactttcttcaattaataagtggcacattaaaaatatatttatatatgtaattgttatagataaaaaaaacaaaatggccgggcgtggtggctcacacctgtaatcccagcactttgggaggccaaggcgggcagatgacaaggtcaggagattgagaccatcctggccaacatggtgaaacctcgtctctactaaaaatagaaaaattagctggcgtgcatctgtagtcccagctacttgggaggctgacgcaggagaatcgcttgaatccgggaggcggaggttgcagtgagccatgatcggaccactgcactccagccagggtgacagagcaacactacgtctcaaacaaacaaaaacacaacaacaaaataaagcttaaggaacatcaaccaaatgcaatatatgagccctatttaggatactataaaaagacattcacaataacacaggcaaaatgaacataaactaggtataggtgacagagaaatccaataaacattgaattattcactggggaaagaaatgatgtgtgggatttaagtctctaactctcccctatttacgccaaaagattgtccatgagttgaaaaccgttagagatgggtgacaactcaagagagattatagcgtcttccttgtgcttgtaaatgtcaaaaataaaagtaatttaaaactaaaacaaaaatgaaaccataattcttaagatgcagcttgaattcagttaactatagcagttgtatatgaagcatttcaaagaagttaatgacatcacagtattaaatccatctgacatggaaaccaactctaactacatcatagttttttttttttttttttttttttttttttttgagatgggagtctcgctctgccgtcaggctggagtacagtggcgtgacagatcactgcaacctccacctcgtgagttcaagcgactctcctgcctcagcctcctgagtagctgggactacaggcacatgccaccacgtccagctaatttttgtatttttagtagagacgagatttcaccatgttggccaggatagtctcagtatcttgatcttgtgatccgcctgcctcggcctcccaaagtggtgggattataggcatgaaccaccagtgcctggcctatggcacagttttaaaactgcatttgcctagaaagtggactgctgtatatagaccaagtgttgggctatatgactccattgtcttaggctatttggggttggaggaaggaagaggggtgaagtagaaaaggaacaagctaataaatgttttttaaaaagtagaatttaaaacaaaaccacgttcagctgaacaccagaactcaacaccaggataaaaatccaattttcaaagagctagaagatcaagctaagcacttattgtattttgctgaacgttaaaattatataaatgtactacagttgcctcaagatgttaaaaagtcagcttttcaaatctagtcacggcctactcatatgacagacccaatacaaatgagcaaaattgaaaagttacacatacagacaacttctcaaccaccaggctgtttagtttaagttagaagtcagaagttctgagactctccttttacccaccttgagcaaccgcagcaagttttcccttttcttcagggctgagctgcaacatcgtatttataacaggaagaaggctctctctctcactacctggcttcaagaaaatgaactgcagcaagacgttcttcaagtgttccacgttagctgcagactcctcttgattcctttccaatcttcttatttcacttttgagaagctggtgttagagaaatgagttaaaaatgggctttaggagcttctgattaaatatggcagactgaactcatgtatttttcttctcttccccccaaatttcccccttccctccatatggcaataaaggaaggaattcagttaactacagcagctgcatgtgaagcatttcaaaggagtttatgacatcaccgtataaaatccatttgacatgaaaaccggaactccaactatgagatagtttcaaagctgcatttgcctagaaagtggattgctgcatatgaaccaagtgttgggctatatgactccattgtcctaagctatttggggttggaaggaagaggggtgaagtagaaaagcaacaagctaatacaagaggagaaaaagtagatgagataacgtcaagacattctcacgagaaacagatgaagaggtggaaatgagtcagtccagcagcttaccaagtatcactgacaggagaggatgcatcctgtgtaaatactggagttcttgtctcagaagcacagggtatcatggaaatggagttgaaagctggggaactgatggaacgtctccatgaggagcaactaactggagccatgggttggtaccaagatgttccctctgccttctacttttgatagaaactaagccagtatggcatggggctctgaaaatgggctgaggggaacatcggtagcctccactaaccccctgcccctacgctgttcctgaagtcccaggcagttaagacgtccacagtgaacggcacttaaaaagttcagacacagtgaaaattcaggaatataagacaatgtaaaacactatcagagaaatgaggcaaagaacgatataaaaaaggtagtatcatgttcaagtctttgaggaagatttccaggttgaaaccaagccatagcttttagtatattttcattttaggttaggcaagaaagttagcgaactttgtcctcaaacctaggaccatttaaaaaagtgacaataaagaagacgaagaaatcatgaagagagtataaatttatgaaaatataacatttggccaggcgtggtggctcatgcctgtaatcccaacactttgggaggctgaggcaggcagatcatgaggtcaggagattcagaccgtcctggccaacatggtgaaaccgtgtctctagtaaaataaaaaaaattagccgggcatggtggtgcgtgcctgcagtcccagctactcgggaggctgaggcaggggaatcgcttgaacctgggaggcggagattgcagtgagctgagattgcaccactgcactccaaacctggtgacagagcaagactatctcaaaaaaaaaaaaaaaagaaaatataacatttaaataagtcatttaggtttactgggctagttagtgatttgttagctatgataatgtttttattagtgggaaaatgctattttatagagatgcatactgaagtatttaatggtggaatgtcatgatatatacaatttactgaaaataactgaattcggctttaaaataatctgacaaggatagctagtggccttgcacagtggcaggacagatctactaggaacagcaaagtacaggggaaaagcatgtacttttcagacagctatgagtttgaattttgttccaccatttaccagcttcaatttttctctcaaccagtgatgagattaaataatgtatgtagagcccagggcctgggtcataagaactcctcaataagcagtatgactatattctgaggggtgatttatcagtgagccagggtggaaatacctcatttgagtaatcctcaactgttctgcaacattcctagatgtttctggtgtctactttaaacaggaaaaacttcccatgccactttgccatctccacctgaaaactgtttagtagttcagtactataaatatcagttgaataatttaaattcactggttatctttagaattcaaagactcacacccattttttatttaagcatatgtgaacaatgatttgtgaacatctctctagtttctaaatctattacggtttcttaggaaaagtaggaattaagaaataatctttatgtaataggtgtaaaagaagtattttggctggatgcggtggctcttgcctgtaatacccacactttgggaggccaaggcaggtggatcacgaggtcaggagatcgagaccatcctggctaacatggtaaaccctgtctctactaaaaatacaaagaaattagccaggcatgttggcgggcacctgtagtcccagctactcgggaggctgaggcaggagaatggcgtgaacctgggaggtggagcttgcagtgagccgagatcgtgccactgcactccagcctgggtgacagagcaagactgtctcaaaaaaaaaaaaaaaaaaaaaaaaaaaaggcaatatttatttctcaccatcaggaatctaataatctaatataaagatcaagacgttatagatgcatctgcaatgtgaatttttaaacttgggtgcatgtgtatggagggtccagaaaaccaaactggcggttttcacagtggccaggtttctgatctcaccttaatttgctccataaggactgcactggttgcctctgtttcccgaagcaggccgtttaactgatctgcactttttgtggtggaactgagcttctgaaccaattcttctttggtaaattcagcatgccataatggaggctctgcaacatgttgttccaagaattaattttcaaaatcatacattacagatgaagattctaaataagaaaaatctaaatataaatatcttactatgtgatattttataggtctgctttctttgccattcatctattcaacatacctcaatcaacagattatatgttgtaggtgacacaaataaaacagtatctctgttgtaaagcatgtaatctaactgaatacaagccctatgagtcccagttctgaaatttgtcagaattgtgtttatagacagttttattacacatcttcttcccatctattaatattccaagattttatgtcatttcacgtataaggaaagcattaacatttactggtcacgtatcatgttccctcataagaatcttctatcaggcggggtaggtatcattattcaaactttacagacgatgaaacaggctcacagttgacaggtaattttttcagaaatcacaaagtcaaattggcttctggagtctgctgctctatcatgatgcctccgtgtcaccactattaactttgcctgaaggaaccatgacttgcagtttctaccccatgtggtcagtgaccatgaatacaaatgacccttactccaggtgattctgaagtttcaggaagatgacagattccccctaaattttgaacagtaatattaattacaggtaataaaatataccaaaacatcactacaaaaatttagcattacttcatcaagaggaataaactgaaactgtcagtttcttggaagggtgagaggatagtttatcctgctttctaatacccaccacctatttgtgactataaacttcccaccacttatttatggttcaagcctagggcaagagctagcattttattttaaaaaagatttgtttaataatttttccatttggacagtgtgatggttaatactgggtgtcaacttgattggattaaaggatgcaaagtattaatcctgagtgttgtctgtgagggtgttgccaaaggagattaacatttgagtcagtgggctggggaaggcagacccacccttaacctggtaggtgccatctaatcagctgccagcgaatataaagcaggcagaaaaacctgaaaaggcgagactggcctagcctcccaacctacatctttctcctgtgctggatgcttcctgcccttgaacatcagactcctagttcttcagttttggaacttggactggctctcgttgctcctcagtctgcagatggcctagtgatcgtgtaaggtaatacttaataagcatccatccatccatctcatccatccatccaaccatccaattagctctgtccctctagagaaccctaatacaaacaggtagtggaatattgaaagaaattttattggagcagcccaaaaaagcatatgtaccttagagtaatagtaattaaataagacagtgaaattaaagaagaagaacatatttagacagagtaacagaccaagtttagtttcgggagaattaagcagctgctctaaagactgtgtgtatgtgctggcggaagacacagactccgtaatcagttgtctccatgccttctccctcttcccgggttacagtgtgcatgtctagaagcgggaggtctgtgtttctcctttctcgaaggttcttcaaagactgctgagaggaaactgggcctattagattttttttaaaggttaagtgtgagattgttcaaaatctattgattcggccttacagagatacacaataaaatgaaaatatcaaatgataagagtagaggaattaagtaactataagtgaaaggtgtatgaagaattgctaaaacatttcctaaaatttagtcatcaaggccaggcgtggtggctcaaatctgtaatcctagcagtttgggaggctaaggtgggtggatcacgaggtcagcaagttcaagaccagcctggccaagatggtgaaaccctatctctactaaaaatacaaaaattagccaggcacggtggcaggtgcctgtaatcccagctgctggggaggctgaggcagagaattgctggaagccaggaggcggaggttgcagtgagccaagatcatgccactgcactccagcctggcgacagagcgagactccagctcaaaaaaacaaacaaacaaacaaaaaaaaacttagtcatcaaacttttaactacgttagtcattttaatagcagctataaattaattgctactagctaagataaactgttagataacacagctcataatatagtactacttattttttattaatttagagtagagggccaaactactgctaaatactggccaaaattaaaagactagattctagcaatttttcaggattaggtatttcagattgcggcatacttcttgaaacacacttgccgaaatctgcttggtagacatcctcaatcactgcccttatacctttacctctgcagcttcttaattgttgctgctcacacctacagtgctcatacagttaagagcccagaatccagggcacagaactaatcaattacgttgcctagcaagactttcctgtttgctgataaactatattttttctgagacagggtctcactctgtcacacaggttggagtgcagtggcacgatcttggctcacagcaacctctgcctcccaggctcaagccatcctcccacctcagccccacaagtagctgggacttccaggtgcatgccatcccgcccagataatttttgtacttttaatagagatgggatttcaccatgttgttcagactggtctcaaactcctggcctcatgtgatccacccgccttggcctcccaaagtgctgagattgcaggggtgagacaccacgcctggtctaaactgtaaagtttatcgggccctttgacatgtattggtttattgactcccaaaaatctgaagttcagagaaatttaatgactttgcccaaggtctcataactgagttagaaaccagaattgtaatctagatttttaaacttcagatttcatttattttgcatttcattaaattgccttagtcctgactgccctttctaaagcattttcctgggtttctggtaagctgactgcttattccactgctgattgctagattacaatctcttgtgcgacctttgccctggctgattacttcctttgttgattctttggcatatgttaaattcttctgaagttgcttttttaccctaataagtgaccgatagctgctaatgctccagtgacaatatttcccatgggaaaccaaaacaccatcaacttgctactaaaatactgcatcatcatggctgacatttttccatttcttcctggaagcagaatggaagatactgggtacggctgaactaaaactccaactaattgtaaatatgaaagcaaagaagctatattggttatgcaattctacacattcagtgctgcttgagtgtttctaagttccttgctctagctaatgtttctatttaaaaagtagacaaatttgatgactaacaacggagaacacgaaacaaatctggtgaataccagaattaagacatgtgtcagccaggcgcagtggctcatgcctgtaatcccagcactttgggaggccgaggcgggtggatcacgaggtcaggagaccgagactatctgagggagaatcttcaggttttttcttctcttttgctgtaacaccagtcaaaaaaattgacaaagataaggtattaagtattgacgttaatactctacctgaaaataaaaaccatggaacctatctataggttaaaacagcatactgataaaaaacacatatactttgatgcagagatgtacgataatcatgaattagaattagcatcctgatttagttttctaccaaaaaccctaagtgaacacagaatctatttaaaacgaaagaaaacaaaaaaatcttgtgtttacttaatagtcattgaaaagaattactacaaatttctagaatttaaaaaggttaaaaattttaaagtgttgcctaactatacttagcatacaatagtttaccaaaatatccatgcatttgcagcaattgaaaaaaatcttaaaacataagcaagtattagtatacatatgaaactaatccaaagccaactgtgattagttcctgtaaggaaagttaacaattgccaagaatggaaggtgactagagttgcatctagtttgcctgtgttcaagcatgatactagataaaattaaataaaaactgttactctatgggtagctaacactataaaatctaagaccattcatatggctgaaaacaacccatccccagccaccatcaatgcaaagggcaaaaaattagaaacagaaaaaacttctatatgcaacctgttctgatctattaatgtaaagaacaacttctggctaaaggagtttaataaagtaagccagttatgaagcatgccatgtataccaactggtgacagggaaacattctgagagctatggtgtccaatatggtagcctagccacattctattaaaacctcacaaggtggctagtccaaatcaagacatgctaacagtaagtgtaaacacacacactggattttgaagacttggtgaaaaacaataatgtaaaatatcattaatttttatattaattagaagttaaaatgatattttggacataatgagttaaatcaaatctatcgataaagttactttcatctgtttccctttttaactgtttctttttattctttttaatatggctactagaaaatttatttatttatgtatttatttgagatgcggtcttgctttgtcacccagagctggagtgcagtgatgtgatcatagttcactgaagcctggaacttgtgggctcaagtgatccctctgcctcagcctcccaagtaactgggattataggcacaagccattgcaccaaatgacaattttaaattacatacacaggttatattttatttctattggatgacactgctctgcagaaccagtgcccttccttttacaatgttaaatttgtccctctccttcattataaacgaaaacctagtatcatttcctagctaggagaaataacagtacaccgtaagatacagattcttgttccacttctgctattactcagtaaagacctcttgggtaaatcagatagcctctcttggcctcagtttactcatgtctaaagtcttcatttctaaggtcccttgggacaatgacattatcagattcaaaacagaataaggctctatgttctacagtagtgtataggcacattcgttcttaggtcagggattcctaacctagagctcacagaaactgtacgcaagtatacatccacttttaagttaacacttttcacatttctcaaagaccgtatctttaaaataaaagattaagagctaccttagctggtaataaaactggtatacttaaaaaaaaatcagagattgttattttatcattgtacttgtttggcatggctaagatgtgttactggtcactaagggtgaggtttcacttccctaacctgttcttgaaggccttcaacagatcccacttcttgttccactctagtagccacacttctaaaaatgatctgtgcaacatatataatatgcaagctgtagaatgctggctgttaaaaatggggtccattttcaaatacaacatttttctaaaccatgcacaaaagaacagccctacagggacactcttccatactgtatacatgccgttgccactacatgtgaatactggcagacgttagtggctaaagataaacattagataaaacataggtcttcactgagcagacctgaaatagcagagcaatgaagtacattacaaatcagcatcccagtacattttaaaaaacaaaccaacaagggtgtcatgccaccagtcaaaaggtactttgcttaaactggcattctttaacattcatgttgtagtggtaagtacttcatttcatacagccacagttattaatactttcctaagggctaccagctgctaaaaactgctgttatctcatactgagaatgctagttctatacctttgctctcaggctgtgaggaaggggtgctagtccaaaaggccatgggattagatttaaaaaggctaaaattaaatcctagaaaataaagaatatttcattttttaacattttaggaaacaaaatgaatatgcttttaaaacataaaaagccagaatccctcaatttataccaccaatctgactgtcttacatattcatttatccctgtagtttcattctttgctcatttaatacatgagcaagactgacatacaacacataaaatgagaacatctcaatatcatggttttttttgtttttttgtttttttttttttttttggagacaaagtctcactcagtcaggctggagtgcagtggcatgatttcagctcactgctacctccatctcctgtgctcaagcgatccacctgcctcaacctcctgagtagctgctaattataggcacgcaccaccacgcccggctcatttttgtattttcagtagaaacagggtttcaccacattggccaggctggtctcgaactcctgagctcaagtgatctgcccacctcaacctcccaaagtgctggcattctaggagtgagccaccgtgcccagcctcaatatcatgttttctgagtgacaaaagaaacagaacaaatgaaaatgaacactttaaaaaaagactcacgttaatgcgcatgattcaagcatgagtccgtacactgtaccaagttcttttgctctgccctagcatgatagaagtatcttccagttactgaaatgtctttaactaagttctcttgctctttgaaacctcaccgtgaacttattaagggagaaaaaaaattgctcaaatattttgggggtgttcacaaagcatcgtttatatcccaacattagtatcccacaaagagtctgcatcaagctaaacattaaaagaaagaaaaattgtgcttaactttaacaacaaagtacctacccttttctggtgttttaaatgtgtagttgattgaagattcttccattggaaaggaagcagagagatttttgactttgctatctgaagactgttcgatatcagagttctttgacagttcacattttttaggttccactttgctttcagatccactctgggctactgaactagtttcactatcgttacttttcaaaggtgcattaaaactaaatccaaacaaagacccagtggcagaactgttgccaaatgcaaatgggtttgatttttcactactaaaaattcttttaacagactctgaaccaaatacaaactttggaggagaaaccactgcttttgttgttgtttcagatgtgctagacacttcaacttctgaagctgcatctgctacatcatcaccctgaataacatctgtcctctctcttgtggtttcttctaatacagctacagcaattttgccacatggtgactctctgggagtgcttgaccgagaaacatgaggtgttatcaaagaatctttttcctgggctgtttttgcttcatcaaaaattttcttaaatgagtctgcaacatcctgtagtttaaaacgaacagctaaatgctctacttttctttctccatctgcaaaatcacatgcagtccacacccatactctttctgtccctttcatattttgcaaactcatgtctggagttattctgtgattggcacaaagttttaatacttggtcccttctcatcactatacgaacttgcttattatcataattctgtaaaatctttatatcaccaatgcccctttctttccattgaccaacatctttatcatatctgtagagttctgccatgtgactaaaaacaacttgttcattttcctcaccactggatacttcaactagatcaggtaaaggaacaacaggttcaaagtactgtccatctctctcttcttcttgagtaacatcagattcttcatcagtgccaactgaagtcccactctgattcaacttggcaggagacttagatagactcaaagcagatttaaaactgaagttaaatcctgttgttgactcatcaaagcggaaaatattttttctcacagggctacttgccaacggagaatcatgtactgagctactactaacattatcatccaaagcatcttcccttaaatcatagttatcccattctaatgtgggcccagtgttttcaggattgggttttattgttgtgtctgaggcaccggctgcacctgtacctgaacccttattttcttcctcagtgacttttgtttgatcatttgtcaaaaacgttttgaaatctttcagtccactcttcatttcttcagctctctgtattagcttggcagctctgccagtatctacaagtttatggggagtttgaagtggtatgtctaacagaagccgctggcattcctcaaatttctgcttgaattcttcagccagctctggtgttttaaattgtgctgccaaccgctctagtttggcatcaccatcagagaaatcactggctaaccacatccatgctctatctgatccagagaggggcttcaggttcattgtagttgttatccaatgattagcacacacttttagtacttggtctcttcgcatcagcattcttggtttgccattgacctcatttttgagaatttttaagttccccaagcccctttctttccactgacttatctcagcatcaaatctaaatagttttaccccctgtgaatacagaactttttcaccttcttctcctgttacaagttctactttttcaggcatttgaactactggttcaaaatggatgtcatcgctgtcctcagtcttacaggcatcatcatctttctcaaagtcaccggaagtgtttgctttattggccattttaccgcattgtgatgagaataatttttctccagcacctgaaaatcccttgaaattggggtcttttttgccaaactgaaatccttctcctgaagttgattttgcaacatctgcaaatgtaaaagtgctacttgtttggccaaaaatcacaccacggccattcttctggccactaatatcctgagcctggaagccagtatcattttcaagaggcttttcacttttcttttcttgatttcctggttccgaaatgccaaatttaaatccatcagcagacacagcgatggaaaatccttctttggttgacttaaattctgtattagaagaaccctgaaacataaatgaaggtgaattttcttgatccacatgcccaaaatagtcatgaaataaataccttcttcattcctaaacaatttatcaaatgatgttaacaataatgatgatgatgatgatgataacatttattgagcatttattaatgtgccagctgggcactgttctaagcactttacattattatctcattttaatatcctcaaaaaccctatgaattaaggtattattattaccctcatttcacatatgaggcaactgatgcattgagaggttaagaaacttgcctgtggtcaaaataagcagaagaacaagggtctaaatgcaccccaacactctgtcctcaaagctgtcacattcaactaccactgtaatattgagtcttcaatcaattgttatatatatagctgtatcaggcctgaaagtacttaccacatagtgggtcagcaagggcattacagttctatttctgttaaaacagaacgatgaaggatccaccaccaccactcccatttttaaaatattctaaatattcacacttattaacacaaaaataaggtgactaagaaggataatttctgtatttggagataaatttaaaatatctacattttaagggacataaaagttttaatagtgaactgctctcttgaatttatttgaaggaaccctaaacaatttaaaaagaaaataattataaatgtataaattattcctttgttacctttgtgggagtaacattagctgctggtctgagaagatactgggaattatatgctggtgactgactataatatactgaagggccagtagttgcaactaaaaaaaaaaaaagaaaagaaagaaaacactgttaaagtctatactacagttaagactatctaggcaagagctataaatacaaaagcaatagaaattaaagaaagatttaactacataaattttaaatttctgtacatcaaaatataccaatcaagattatcaaatgacaaactagaaaaaaattgctaaatatgacatgaagaataagagaatagcatcgctgtgatcaacaagaactacctcacaagcattaaaaaaggaataaaggagaaagtaactgttgccttttctaagaaagatcagtatgatgtggaattatggacattcagtcacagaaaggacgtaaggaaccaagatgccatctgatggtcaatgcatttgaagtgggcctagaaaatctgcagaaagactaggttgtattttgtaaactaaagctattactgagaatgttcagctcaaaaatcacctgacaaattcatggaaaggatgtcataaataacataaaatgtgttccctggcttaaaataaaaagcacatcaacactcatacagatgtacaaactgtctgctccctctgtttggtctgttttaccaggaaacaaaacgactagaaggcacccatgttaatgacaaaactaccaatagtcatttgcttgaactgttttatgatagttttaccagaaaacaaccaaaagaccttttatgcctgtacatggaagaagaaacagaaactgtgccaagaggttccaaacaattgcctctggaaagcactgaaaaatcaagacctagaaaaggctagccagaagcccaagtttgattttggaaaccttacagaggtgaggataactattttgaaattactatggggaggaagcaggcacagaacacagaacaacctgacagaaatggcccaagaatcttaaagtcttgcaaaatgtctgtctgcatgaaagcaaaaagaaaaaataaaatattaaataaaaaaaaaatcttagtctgaagtttaagtagggactttaattgactactgactctaaactgtgaggctctaataaatatactaaaagtaatctaattttttaaagcaccatatgaatagacaatttaggaaagaaatgttaataggcctcaaggaacatgtttttgaagtgagccttgaaaatctgcaaaatgacaaggttgcattgtgcaaattgaagctattatgagaatgttcaagtcaaaaaaattacctgacaaattcatgcacaggatctcacaaggaacacaaatgtgttcgttggctttaaaaaaatcacattaacattcatgttgatatacaaaaactcttctccatctgttttgtgtgagttttaccaagaaaccaaacaactggaaggtacccacgttgaagatggcaaaactaccaactgccatttgcatgaattgttgagcatgactagtattaaaaaaacttaaaaattgatataacttttgttcctacaaattggcaaaggattttataaactagtaagtcagcattagcaaaagtgcgaaaatggcactatcagatactagtggtaagagcataaactgaatattttgaataccctacaaaactaggacagtgtcctagaatttgtaatggcataaaccagaaacaacataaataaaggaacagaatttacagtacttccatgtgatgggacaccatgaactcattaatattcaaaaaacatttaagtttaaaaatgctcagaactaaagtaacatttaaaaaacaggctagctcatctacacacaacatagtaacatggtaacaatctcataaaaaatactatatgtatagagaaagaaccagaaggaaatgctctcaaatataagaaatgttaataaggtggttagtttttagttttcttcaccctgttcagtacttctgagtatctcctatgagctcattaatctttaattttaatcatcttattttaaaaaaacaaggaccatcttgatatatgtttacttttattaaggaaaaagaatctatgaacacaggaacagaaatcaggagatcttggctctcgccctttcagtgccacaaagctgttttgtgaacctgtaaataatccatttggagtctccatgtttctcaattgtaaaatgaggatatgctgcttctacacatttcacagggtcattgcaagaataaaatgagacaatgagaatgttggatttacatgcttgtataagaacagaagaccttttatgcctgtacacagaagaaatggaaatcatgacccacaaggcaccaaataactgactgcacacgtcactaaaaaagccccaggaaaggctagccggtttgtttatcctcttacaaggacctatatgatgtgtaaggttttaagaaaacaaggtttgaacgttagacatttcatatacttatctatgacttacgacatttaataagcttgacttcacaaagattttctgttattttgcttgtgttgagaagatactatcacaaaaggctagtggggttgccttaactataggaaccatcacacaaatgtgctcatctaaactagattttattctaaatctttcctgggctaaaaagagaaaaaaaaaagggcactactactaccatttcagaagtctgtcgtacgtaaaaggaacaatttttttatttctggctgcctgggagcaatgtattatactggcaagtgctttggagttacaccactggagtgtgaatctcggctctatcaataactagctgtataataatgagtaagttacctaacctttctttatccatttccttatttataaaaaagggattaataatggtaccggccattctaagttactgtaattaaatcaaattacattcacaaagcacttttgcacatagccaacccacagtaaacactattagtaaccttagttcattaactgtttactgtatactctaataaatgtctgatacacacccacgcccacctgcacatacacaaatgctcatagtaattatgtaaggcaagtattatctccacatttcagacaggttaacttacacagctattatagtaagtgatagagcagaacttaaaaaccctgtatgattcaggtccaaactccttttctttctttatataaccataatatttcaaattaagtaagatttcctatataacgtcctgcctctcatcattatcatcaaaataattccccagaggtgtaggttcttaattaagcatttcttagtgcataactctattcaataacatttttcaatttaaggaataatctcatctcagctcatctgaggtgtggattaagtgttctttaagcctttatatacacgtgatcacatacggctcgttttttctgcttgggattataaaaatctccgtaacaccaaatacagcttttgaagtcacatataaacagacgttgacatgtatattaacaaacatatataaacaaggtgatttcacacgttatctacttaaaagagggaagtaaagtagttttactaaaatatgcgattatgcacttgccagctcacctgttagtggagccccatgaaatgtctgtgacccctgatatccatcaggcaccgagtctggtccataattctctgtgggccaacgatgacgggatgctgacttactgctatttagtttctattggaagaaaaaaaaatcaaataattttaatcatttaattatatcatgccagaaacagtgctggggaaacttactcttttaaatttaaataactgattttttctttttttcttttttgagatggtgtctcgatctgtcatccaggctggagtgcaatggcacaatcttggctcaccgcaacctccacctcctgggctcaagcaattctcccacctcagcctcccgagtagctgggattacaggcgtcagccagcacacccggctaattttttgtataatagtagagatggggtttcaccatgtttgccaggctagtcttgaactcctgacctcaagtgatccaacacctcagcctcccaaagtgctgggattataggtgtgacccaccacgcccggacctgattatatcttttgaaagtttctatttgccaatgagttctaggtacctggtgctgattttaaaatatgattcttaatttgttaaaaatttatctgctcccattttcattcgttaatacaaaacctaattcattaactctctcacctaaacaaataacctcctaaatgatcacaccttcatttccattctacacttgcctacattaacctttctgacattcacctccagccaagacaattccctgctcaaaaaaacaagtacctacaaactaaacttctttccccaactttcacagtcctctaacattacactgaccatcctttcagtgtgttctttctatactgcaatctggactacctgacattccaaatcacctccccaaattagcttttcacttaaccccatgctgaaacaaaatacaactaattctccaggtgacgttcaaatgctccaccaggaaagggaaaaaagcagtagctgcagataatttattatgtatataataatacgtccaatgcacttaaactcttaatttttatactatctacactgttaggtaaacaatattagctcctatcttaaaatgagagaaagggatgcagggaataacagctggaatttgaaccacatctgactccaaaaatgttctcttaacacaactctgctgccttgacaagatggcagatagatacaatgccgtctagtgtagctatgtggctacctgatctctgctgaagaaaactaaatgacagcaccatacccaaccctagaacctacaaaatgtccccttacaaaacagacacttaacaggaaattctttttccaaagaaattgtagtggtatcagaaaacaggtaaattttgaaaagtttcaaacttctctgtatcagcccaggaatccgaccagttctaacaagtgaggtcagggacagatctagcatgtctgctttctttttctacaagtgtttcaaataaaaatttcccagaaagacctaaccatgaggtccaaaactatctcaattttcaagctaaataaaatttcccccactcatccatctacagtgcctagtccagatgctacacatacacatccaagaaataagaaactagtggaatcacctagaaaactttatggtcactgttggtatccgcaccagagctttgaatttgcaatcactgctgtaactgtaatttttaacattcagtgtaatgagaactggcttcaataattctctcattttaaagataagaagccagtcacgaaggaagtgactggcccaagatcattaattaatggcagagtcagtactagtaccaagcttttcaagctcatggactagtgctccactatacttccacagaatacaatgttgggagcctgaaacctgtatgttaagtcaaaattgtatgtaattgtcataggccatgactacacagaattaacattcaagatttttgtgcaaattcaaaaatgtcttccccaccaaatagtattctcttaatttgcaaatactgctgatcacactgtaataatcgccacacatcagcatatccttgatgtaactttagcagtataatttagttcttgcctgataaacatgaaagaacctacttttatttccaattccaaaaaagtcaagctcctttgaaccctattgttaaaataagatatatatacataactatttccttacataattaagtcaaattcatatggaagtattaaaatatagcaagactttttgaagctcagaccacttttcaattcctagctatacatttgaaacacatgtaatccacagctaatctgagaatgaactcatagaccagagtatgattagtacactgtagcagttcaatcactcgggaaccttctctgtgtcaggaactcttatattttaaataaaacagtttctacctttgaaggtctcaaattttgtggaagatgaggagagagacacataaagtactttcaaaaatatagtaaagggctgggtgtggtggtttacacctgtaatcccagcactttgggaggccaaggcgggcagatcgcctgaggtcagaagttcaaaaccagcctggccaacatggtgaaactctgtgtctactaaaaatacaaaaattagctggtcctggtggcgggtgcctgtaatcccagctactcaggaggctgaggcaggagagtcgcttgaacctgggaggtggaggttgcagtgagccaagatcgcaccattgcactccagactgggcaacagagtgagactccatctcaaaacaaaacaaaacaaaatatggtaaagggtcaagaccaaggtatgtaggctgggcacagtggctcacacctgcaatcccagcactttgggaggctgaagcaggaggattgtttgagccaggagttcaaggccaccctgggcaacatggaaaaatcccatctctacaaaaaatacaattagctgggcctagtggcgtgtgactctctgtagtcctggcttcgtggcaggctaagccaagaggctctcttgagctaggaggtcgaagccacagtaagctgtgatcataccactgtactgcagcctgcacaacaagaccctgtcttaaaaaaaaaaaaaaaaaagaccaaaatgtccccttgccatactatttggatggcaaggggacattctgaccagcttcagaaaaaaagtgagagagtggccagggaaggaatcttggaataaaaagtacagctagagaaattaagtgacttaccgtaatggcctttacttcttggcaaatcattttccgtaaagaattctgatcttctgcccatcgaggtggtgttttgggagaatactaaaaaaaaaaataaaaataacaaaagagcatttaaaacacttagaaacaatttcacaatgaaatgattccattctttcctgtttaccttgtaacttttacttggtgatagtgaatatttggtaggagatggtgtagaatgttttatttctgaatctgcatttcgcaaagaaccatttttatagagaggacctccttcactatagtcttcgagttcctgcatgactgacttaagcatctcttttacagactccaggggcacaggcaactaaaaataaaagacattaattaagggctttcatttgcaaaaaattccaaaagtaaaaactctaaaatgatatattttatcttatttacatttttgtcattttaataagcactttacactttaaataataatacacgtgaaagtgttttttaattatcttttttctttgtttttctgctgttttgtattattatttttatttttttgtctttattctatttttttcttcatgaacacagaaaagtgttgtacaatctaacatcttctgattctaaagtccatgctctttctattacttctgttaaccatgataattgtagaggaatgttaacttggaaagcttttccaagtgaacaaaataagttactgatgttttctaactgattttcaatggtgacagaaatacagatgctacaatacaccagacaacataaatcctaataaaagagtagtaacacaaattaatcaacaaaacactcagaagactgaacataatttaacatcatcatgacaatctcaaacagctgacagcaagaaaacaagggcgttcataatggctgatgaggatgagaagaaatgctcttaagttgtcagcaacaactttcaatttcagcaaagttcattaagaattagtcctgaggttataatatttgttttgattacactgctaagataacacctagattcccaagtttaaaaagacacaccaaacctaagacaaagcaagcaaatataagcatttagacacacacatcccttctgtgcattaataacaacatattactgagtatttttgaaattaccaaaatataagaccaacgcaaaaacactgaccagtgggttatcagtaagaacgtacatacaacaacctgctacttactttcttgaccactgaaagatttgaatcactgtcatctataatctttattaggtagtccctggtctttctcagataatttttgcattcttcttgttcttcaggaaaaacggcatcattttcaatgtcttctgctttcctgtgaaaaatctatacaaatagtgcttttatgaaatcattagctttttaaaacaaaaaactttcagcttggccacgcatggtggctcatgcctgtaatcccagctactcgggagctgaggcacaagaatcgcttgagcctgggaagcagaggttgcagtgagccaagattgtgccactgcactctagcctggccaacagagaaaccccgtcttttaaaagaaataataaataaataaataaaacttttagctcaagtactgcatctacttaccagtgcaagattccaataagaaacaacactttttatagattcaaaagcagtcacagcatcttctatatttccatgtactgcatccaatatagcaaaagttatgtgtgcatcttcttcatactcaacaatttctgatgcctaaacacacagaatagtttttagtcaaattgtttatactcagaatataaaacccaaatgattttccaaagattttatatgatcttaagagacaaacatctcattactcttctctgtcatatcttatctgtgagagctagtgaatttagaaaacaagattaccgttaaataacaaggcaattaatttaagcagtttatagctccacgtctttgtttataaactggaaattcccatctccaataaattcataaaggaactctgttacctgaatgtctacactatgaaaatgtttaaacagaggatcaataggttcaggaatactgttcttctttattatcttcaacaatggcaaaactttcttccaataatgaacacttctccctatgtattcttgttgatcataagaagaattaagacccctgccctaaaaaagaaagttaaaagcacacaactttaaggaacacgcatgattagatctaaagttcatttacaggttgtaagaactggctaaaatttcaagtcaaaaccaaatggtacctcaatagtcatttgttcaacttccaaatactgtaataactaaaccaccttaataccagtgaactcactgcaacctctgccgtgcaggttcaagcaattctcctgcctcagcttcccaagtagctgggattacaggcacctgccaccatgtctggctaattttgtagttttagtagagtttttttttgtatttttagtagagacggggtttcaccgtgttagccaggaatgatctcgatctcctgatcttgtgatctgcccgcctcggcctcctaacgtgctgggattacagatgtgagccaccgcacccggcctctacactcaacttttaaacacttctaatgataccaccctaatgtagcaatcccaactactttttaacagttgccatttttagatagctgaaacctgcctcttctgtagtgtcagtttgttcaaaaggctgaccatcttcacctaatggtgacacaaaacaaaccttaaatatttagaaagatctataatggtcttacctacaaagccttgtgctaatttttttttttaattttcaggctgaataattatcagaacttaattattaaggaataacagtaacagctcagctaatatgtaacattcactgtgtgccaggcattgctcctctaagtgcttatatttaactacattaactattttgcagcaataaaaaacacatctgtcataatatgaccaagctgctgttttctgaacaaaaaaactttcaataaaaagtgcatgattttaaaaaattaaggtaatgttctttaaaaatgcttatactttaaaactcaccattttctgaaggcattttgcccaatgtacaagcagagcaggttgaaggccatgtttttcctgggctcttagagtgtttatttcatgctgaactacaagtctcaattctgctgagtttccaggtctaaaaaatacttcaatttactaaaattgttttctaaatacacagttcagcgcttacatacatatatgttaatgggtcacatgacaaattaaatcttcacatgaggattaaatccccggtaaaacctacgcactaagtgaaagcaatatttttgttttactacttacactgcttttctgtgaatcagagtacaaaccgcatcccaccaagatttttgtctctctgtacaaagccgtttacacacaggaaggggcaggcataacggctgataggagctgtggtgagaattacatttctcctttaattgtaagtggctggtatatactactccaaggagaaatacctgttttatttaaggaaaagttaagttagaaaaaaaaattaaacaaaattcagaatatttaatttgttaaaatctttgcttacttcaagatctaaaatacatattgattcaggtgcatttgtttcaagccttgaggtttcctggggcaaatgatggaaaagctgttttagccattttcggattccaggtaaagcaggcaatgaattccactgtaagccaagccaagtaaggtgctgaagactaccattatgtgcttgaatagcacctgaaataaaataaaaaaattggcttaagggttcgaaatttttctttgtgccattagttttgccaacataaacaattcacattatatatatcttaattatataactgcttttctatatcaaagctggagggaattctatgttaggcaaaatctcatgttcttattaaatgcattctcacttgattatttctagaaattttaataaaaatagtagtgatgaagaatgtttaagtccatcttaaaaaatgacactgactagaactcaataaaccaaaatcaactgacaaaagccaaataaagaacacctaacctaataagaaaccccaaaacaatgggttttcctttaagtcattaaagcaatggaacaccactatattaatccatcggtacagtaaagaaatctgtttttctacaagaaagtcaatattgaaaaggttatgtgcagtcaggagttcgagaccagcctggccagcatggtgaaactccgtctctactaaaaatacaaaaaattagccgagcatggtgtcacatgcctatagtcccagctacttgggaggctgaggcaagacaattgcttgaacctggcaggcggaagttgcagtgagccgagattgcaccactgcgctccagcctgggtgacggagcgagactctgtctcaaaaaaaagaaaagaaaagaaaagaaaaggttatgcgcttctggaagcatgaagaggtataatctttctgtcattttggcaatttgcaagacttaaagatgttcatgtcctttgtctcagtaattctgtttttaggtatctctatggaaataacttgcaatgaagacactttttgttgaagtttttatcagagtatgattattaacagtggaaaagttgagaaaacttggatgcccaataacagaaagttgcaagcaaattatgactacttcataaaaaagattatattgccaataaaagtgatatttatagttttaatacagagactatgggagagaattcatgaaggaagcaagataaatcatacataaacaaccatttagatgaaaaatatggtcagatgcagtggctcatgcctataattccaacacttttgtttttgagacgaagtctcgctctgtcgcccaggctgtagtgcagcagtgtgatcttggctcactgcaacctccacctcccgggttggagcgattctcctgcctcagcctcctgagtagggactacaggcacatgccaccacccccggataatttttgtatttttagtagagatggggtttcaccatgttggccaggatggtctcgaactcctgatctcaggtgatctgcccgcctcggcctcccaaagtgctgggattacagatatgagccactgtgccaggcctaatcccaacactttgcggggcttaggcaggaggatcacttgagcctaggagttggagactagcctgggcaacaaagggagaccctgtctctaccaattaaaaaaaaaattatctgggccgagtggcatgtgcctatggtaccagctactcaggaggctgaggcaagagaatcccttgagcccagaagttcaaggcagcagtgacctacgatcacgccactacactccagcccaggtgacacagcgagaccctgtctcaaaatacaacaaggctggtcgcggtggctcactcctgtaatcccagcactttgggaggccaaggcaggtggatcacctgaggtcaggagtttgagaccagcctgaccaacatgatgaaaccccgtctctactaaaaatacaaaaaattagccgggcgtggtggtgggcatttgtaatcccgctacttgggagactgaggcagtagaattacttgaacccgggaggcagaggttacagtgagccgagatcgcaccactgcactccagcatgggcgacaagagcaaaacttggtctcaaaaacaacaacaacaacaaaaaatacatgccacccctacagcaccacattcaaactccccccagcccaacccacacacaaaaggaatacaggaaaatattaagtcgttatttctgggtaataagattatgggcaatttataataattaagacggagaccatttcctctgaaacatataacttaccaacatcgtatctagccaaatcttcaagctctggttcttgtacatcaatgtttccaatatcatcgctaccaagaaaagatgtatccttagatgactgactagaaaacagagcattatataacacagactgcccgcttttgttggcaaaagtttcaacaacctcttttaaaaaatcttgcttgccacgacttaagtttagcaacatatgccctgaaaaaaaaatttaagttatttccatcactttaaaaatacagattgtatttgctcacgttgtctcatttgtatacccaaaggggaaataacatgattattgcagacctaaccctccaacccaaaaaatacagctggacaacaaaacgggtgcttatgtagcaaatgaaaagagtacaggtttaatattctcagtatctacataagacagcagaagggggaaaaaagacaggaatgtgtatgaaaaatgccaaacatatttgcattttagatgaaaaggtctggatttaagtggccataggagaacagggacaagctcttattctctgatctgatacactgatttctgaacctggctgatcagaatcctcctttaaacagcttttaagaattatttccggctgggcacggtggctcatgcctgtaatcccagcactttgggaggccaagctgggtggataatgaggtcaggagatcaagaccatcctggctaacacagtgaaactccgtctctactaaaaatacaaaaaaaaaaaaaaaaaaattagccggccctggtggcgggcgcctgtagtcccagctactggggaggctgagggaggagaatggcgtgaacccgggaggcggagcttgcagtgagccgagatcacgccactgcactccagcctgggcgacagagtaagactgtctcaggaaaaaaaaaaaaagaattatttccaggccttgttcccagagatttttattccataggtttacagtaagcaatcaaaaaatcatagtcctcggataaaatactgatacatgctataacacagatgaaccttgaaaaccttgctaaatgaaagaagccagtcacaaaagaccacatactacatgattccatttatgtgaaatgttcagaagaggcaaaccggccgggcgcggtggctcacgcctgtaatcccagcactttgggaggccgaggcgggcagatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaatccgggaggcggagcttgcagtgagccgagatcccgccactgcactccagcctgggcgacagagcgagactccgtctcaaaaaaaaaaaaaaagaagaggcaaacctacagagacagattagcggttgccaaggctgagaggtttgggtaaaatggggagtaactgctaataggtaagaaattcctcatggagtgatgaaaatcttctaaaactgactgtggtgacagtggtaatactctatgaacatagtaaaagccactgaactgtacactttaaatgggtgaagcgtatggtacatgaattatatttcaattcaactttttttaaaaaccctcctttgagttaattctgctgggcaattaggtttggttaccactacacagttgtgtctcagcacacttacagaggcaccctcgggatgcccagatcaaagacataaaaaaaaaatacaggcaattttcatctaactgtgacaccatgcaaaggcacttatgagagccctgcaagggtagaaggaaaagagaaaaggaaaaaagtagaaagtcactttaaggactgaaagcctagctcccacaaaaaaagtgggctatggaataaaagagcaatgtgagctttggccaacagcctaactatacaccaaagcttataataactttgatttaatattacatcttgctctttacaaaattcatccaattttatatcaaaactgctccttataggaagcattatgtttcttcagttcactgcttgattcaatggccatctaactaccttaaagtttgtatcttagcaaaatcacaggtaatatgcaacagacctttaggattcatcccaagccaaaaacgggggaaaaaaatccacaaattccaagagcctaatataaggtaagtatatatcttctatcttcctcactatgctctcagctctttaagacagatccgtatcttcttcatctttatatccccacagcagtgtttttagaatcagctggtgttaaatggttggcaaatcaataattatacttagttcaggaagtgactaaatattcaggctagaggctctagcagccagatgaagaaagagttaagaaatcctctccacataggaacaaacaatatcaaatattcattttttttaaagaatgtgctatttcttcgcatctcttccatacctattgctcttaactgatacggcaaaaagaaataattttgacaaattatctcctggacagatgaagattttatcataagatatgccttaacagaaattcctttttctttttaaattaaattagtttaatattactattacctgattggctcagtcggtcacaggccatcatttccagcagattttgtccagcttcaccttttattaatttaatctttggtcttggaacctaataattttagaatcaaaaatcttaatttgatgatacccatacttctaatagtaacatggtcttgtctattacactgtactttttttgataatgaataaacagttaaccattaattaaactgaattggaaaagactgcaaaaactgggaaccaaggaatttatataacctatgaaagataggccaggtacaggcgtggtggctcacacctgtaatcccaacactctgggaggccaaggtgggctgatcacttgaggtcaggagttcgagaccagcctggccaacatggtgaaacccagtctctactaaaaataataaaaaaaaaaacaaagaggcaggcgtggtggcacacacctgttaattccggctacacgggaggctgaggcacaaggatagcttgaacctgggaggcagaggtcgtagcgcgccgagactgcgccattgcactccagcctgggtgaaagagcgagactccatcgcaaaaaaaaaaaaaaagaggggccagacatgttggctcacacctgtaatcccagcactttgggaggccgaggtggggggatcacttgagcccagagttcaagaccagcctgaacaacacggtgagaccctatctctaaaaaaagttttttttattagccaggagtggtggcacacaactgtggtcccagctactcaggaggctgaggcaggaggatcacttaaatccaggaggtcaaggctgcagtgagccatgatcatgccactgtgctccagcttgggtgacagagtgagaccctatctccaaaaaaagaaaaaaaaaaaaaaagcatacacagagcagctctgagaaattagtttctactaaaagcacattcgtgttacattcagagaaatggaaaatttaattatattacttttctgccctgaataaataggacaacagcagatgttgtcctatttgagtagatatgacaccctactttaaaaagtacaggtgaaatgacacttggaaatgccacattgtagataacacattttcagagtatggataacaggggatagcactagaataaatgggacaaccaggaaattaaagagatcctaatgcaataacctatggaaaaaaaaaaagcatgatgaatagaatggcgaagggaagacgtgacagctgccttcaggtattaaaattattttataaaagaaatcatcaaaagaagaaacaagaccaacaggtagaaggcttgaagaatatttttattctatataaggaagtaccaagagccaaaccacctaaagatgcactgggctatcttgaaaagtaatgaatgcccatcactgaaaacgtccagtcacaggcaatgcccacttactagaaacatgccaaaagtaactatatgggtgactagagcatcggcttttaattctatcaccactttcttaattggtggtggaaatgtaatttgatacaacctctttagggttagatatttggcaacagctctaaaaattataaatgcacagatatactttgatactgcaattctttcaggaattcatggcacaagttaatcattgctaaattacttgaagtagcattaaaaaaaaaagtaaaagcaagctaatgtcctggttttaggaccctggttttaaaaactccaaaactacagtacatccatacaatggaataatatgcaagcatccaaactaatgagaatgccctttatatatactgacatggaaacatctccaagatacagttaatggaaataaagtaaatgcaatgttcaaatgttttcctccttcctttaaagacaggggatatatgtgtgtttacttggagatgcataaaacatttcctgaagaacacacaagaaagcaataacattagtttctttggggctggagaaagtaaataactagggaacagaaaggagtcttcatagcatattcttaagagccgccagaattttaaaccatgtatatataattctttccaaacatgctcatttttcaaaatatatgatttatgaacctaaaagcttctgattttgaattttagaaatattcatatcgcctatccttttactcacaagttttctaaacatcatgtcaaagtttgtcatctatatgttgaaaagagcacacaaagtaagaaacaaaatgttgacatcattctttttgttttcaaactgacctcaattcataaacccggcctcttttacaaaattattcaacagttgaatctgtgaccagttaattagttgtgaatccactcaatcaaatcatctcaattcactatttcctcttttttttttgagatggagtctcgctccgtcgccaggctggagtgctgcagtggcacgatctcggctcactgcaatctccgcctcctggtttcaagcaattctcctgtctcggcctctcaagtagctgggactacaggcacctgccaccatgcgtggctaatttttgtatttttagtagagatggggtttgaccatgttggtcaggatggtctcaaactcctgacctcaagcgatccgcccgcctcagcctcccaaagtgctaagattataggtgtgagccaccacgcctggctatttcctcatcttaactaaaaggtttcaagatactttgttaactacctagctgcaatgcagatgcacttactagaaccacagtattcctctgattaagagtctgaaaatcttgccataaaagttagccaattcttaaatacccaaatgccagcacataacctacattttatgcttataatcatttgttcattaagctttaaaataaactgatcaaataaaatacaagcatctaagatgtttctattatatattcattctacagaaatatgtggtagctaataaagactgaggtaggtatctctgtgctgaagtggaacaatgaagaaacattcagaaaagcaaggcatctggcaataggtaaagcacacccacattgaggcacaatattttttaaaagcagagaaagaatgtattgcacatttgcatatgcaaaaaatatttctgaacacccaagaaactcctaacagtagctgtcatctaggaaaggagacctgagtgaatggattaagagggaaactaacttattatgattaaaagttcacagtcaggtgtggtggctcatacctgtaatctcagcactttgggagggcaaggcagaaggatcacttgaagccaggagttcaagaccaaccagcctgggaaacatagcaagaccttgtctttacaaaaaatttaacaatgtagccaggcatggtggcaggcacctgtagtcccagctactgagctgaggctgaagcaggagaggatcacttgagcccaggagttcgaggatgcagtgagctatgatcatgccactgcactccagccagagcaagagtgagactctgcctcccaaaactacatatcgaaaaattttaggctgtgcgcagtagctgacacctataatcccagcactctgggaagctcgagcccagttcaatgttacggtgagctacgattacgcaactgcactccagcctgggtgacacagcaagactctaatagacacacagacagataaattttaaagtttccattaaaaataagaactattggcagggcgcggtggctcacacctgtaatgccagcactttgggaggccaaggtgggcggatcatgaggtcaggagatcgagaccatcctggctaacacggtgaaaccccatctctactgaaaatacaaaaaaattagccaggcgtggtggtgggtgcctgtagtcccagctactcgggaggctgaggcaggagaatggcgtgaacccaggaggcggagcttgcagtgagccgaggtcgtgccactgtgctccagcctgggcgacagagtgtgagactccatctcaaaaaaaaataaaataaataaaaataagaactatcagttacttgagaatttctataagaaccttttaatgtttgtattacctagtgaacctcactaaatccattaattttcactaatccattccttatgaacacagaagtttctactgagccaatattagcatttaacatgtgaactgtctatcaacggtgtttttaaaagatttacaggccaggctcaatggctcatgcctgtaatcccagcactttgagaggccgagtcgggtggatcacgaggtcagaagatcgagaccatcctggctaacatggtgaaaccccatctctattaaaaaatacaaaaaattagccaggcatggtggtgtgtgcctgtaatcccagatacgtgacaggctgaagcaggagaatcacttgaacccaggagacacaggttgcagtgagctgagattgcgccactgcactccagcctggtgacagagcgagactccgtctcaaataaaaataaaaagatttatattaggcagggcatgctggctcactgcctgtaatcccagcactttgagaggccgagacacgcagatcacctgagttcaggagctcaagaccagcctgaccaacatggagaaacctcatctctactgaaaatacaaaattagatgggcgtggtagcgtgtgcctgtaatcccagctactcgggaggctgaagcaggacaatcgcttgaacccgggaggcggaggttgcagtgagccagatggcgccattgcactccagcctgggcaacaagagcaaaactctgtctcaaaaagaaaaaaagatttatattagaaggaggggccttctctaaaagtaatgaatccttttttttccctccccaagcaaaaaatccttctctaaaattaatcatttttctaagcctggtttaatgctttttttggaagactgcttatttcttttcctttcaaaagttatgcaagctcattaaaaaaaaaagtccgggaatggtggctcacgcttgtaaatcccagcactttgggaggccgaggcaggtggatgactaggtcaggagattgagaccatcctggctaacacggtgaaaccccgtctctactaaaaatacaaaaaaattagccaggcatggtggtgggcgcttgtagttccagctactcgggaggctgaggcaggaaaatggtgtgaactcgggaggtggagcttgcagtgagccgagatcgtgccactgcactccagcctgggcgacagagcgagactccgtctcaaaaaaaaaaaaaggccaggcacgccaggcacagtgcctcgggcctgtaatcccagcactttgggagaccaaggcaggtagatcacgaggtcaagagattgcgaccatcctggccaacatggtgaaaccccatctctattaaaaatacaaaaaattagctgggcttggtagcacgggcctgtagtgccagctactcgggaggctgaggcaggagaatcacttgaacccaggaggtggaggctgcagtgagccgagatcacaccactgcactccagcctggcaacagagagagacttggtctcaaaaaaaataaaaaaataaaaaataagaaaaggttttatgttttcaaagattaatagatatactgttacatatacacaatacagccataaatgttatatacatgtgtttcaattaacatgttaaattgcaatcatattcttctatcataggctataaagccattgccctacatctacttattaggattttgtccaagtaacacacctttttgaatcaagctttacccataatacgagattacatctttatcatgttcccaaaaatggcagagtaaaaagatcaaactcttcaaatttgtctacaaacaaatcatggcaatgcaggctttcgacaagagtgcactcaacatccctgtttcaccagcctcaccagtattgtgtatgcttagttattttccactgtatcaaattgactatttcattttaattccacagtttgttcacatattgtcattacataccagagcacaccttcatttaaaacacatcaagactccgtgaaatgtcaattgctcctacaagtggaagacttacctgaaatgctatgacatagcacaatgcagccagctcagaaagagcttgccattgaacattattaccatgctgacccatcttcaagagcagagaaccagcatgcatgtagaaatgtcctttcatttctaagaaagtagctgacagttcatcatttccacccaaagaagattttgcagactgaagagcactatcaaaactgtaatatgaaaatatcaaacagatgatacacacttactgcactgtgaataatcatggttcatttaattcaaaacaaaataaaaattttatttcaagcttcatcttccacattcaacttctaataattcttattccccatgttataaattatgaatcatctaatgcttatttttatcctgcatacttcctatacttcatgcttaacctctcaaatgatgtcttattcccagttatttccagccctccaatcacaggataaatataagattagtgattataggtgcacatttcaaaataaaccaggataaagttgggagactattttgtagtttcttcctgatcatataatttcattatttaattaacagttgtaatttctcaaattagacataccatttccaaattataagtaagtaactgacaggtatttgagtatcaatacagcaattgctctttttactatatagatcattacagcgttaaattgttttttttttttttttttttttttgagacagagtctctcactatcgcctgggctggagtgtaatggcacgatctaagctcactgcaacctccacctcccaggttcaagtgattctcctgactcagcctcctgagtagctgggattacaggcacctgccaccatgccccgctaaactttttttatatttttagtagagacagggttttactatgttggccaggctggtctcgaactcctgacctcacgatccgcccgcctcagcttaccaatgtgctgggattacaggcatgagccactatgcctggcctattatttgtaatctatattctaaattagttcttctaaatcctaatgtttctccaaatcctcactttggaagaaaagtaaaagcaaaaagcaaacacttaaacgtgaagcatgattttaaagtggcttacaataacgcaaccagagcaaatgaggtctaaagatctctgagggtgctcaaaaaccccttcaggggatccatgaagttaaaattacttttacaataataccaaaaaaaaatttatatattacatactcattttctcatgtatgtagagctgagtttttttgtttttgtttttggagacagaatctcactctgtcacaaggctggagtgcagtggcacaatcttggcttaatgcaacctctgactcccaggttcaagcgattcttctgcctcagcctcccgagcagctgggaatataggcgcgtaccaacatgcccggctaattttttgtatttttagtagagacaaggtttcaccattgttagctgggatggtctcgatctcctgacttcgtgatccacccgcctcggcctcccaaagtgctgggattacaggcctgagccaccgcgacccgctgagctgagttttctagaggcttcatgacatgtaatagttttacagactgaaagaggaagtaaatgagaatctagctatgttctattaagcgagacattaaaaagatttacaaaaatgcaaaaacaatgacacttttctgactacttttttgctgttggaaaataattatttttcataaaaaatgctattattggccctgcgcggtggctcacacatgtaattccagcactttgggaggctgaggcgggtgggtcacctgaggtcaggagttcaagaccagcctagccaacatggtgaaaccccatctctactaaaaatacaaaaaattagccaggcgtggtggtgggcacctgtaattccagctacttgggaggctgaggcaggagaatcgcttgaacctgggaagcagaggttgcagtgatccgagatcacactgttgcactctagcctgggcaacaagagcaaactccgtctcaaataaaaaaaaaaaaaaaaaaaaaaaaagctattattattaacacacaatagggcttattacatttttaatggattacattttttatttgttttaatttctaatgtaataaacactgacagaaataacccacatacggccaggtgcagtggctcagacctgcaatcccagcactttggaaggccaaggcaggcggatcacgacgtcaagagattgagaccttccagtactttgggaggccaaggtagacagatcaagaggtcaagagatcgagaccagccgggcgcggtggctcatgcctgtaatcccagcactctgggaggctgaggcaggcggatcacaaggtcaggatatcaagaccatcctggctaacacagtgaaaccccatctctactaaaaatacaaaaaattagctgggtgtggtggcgggcacctgtaggcccagctactcgggaggctgaggcaggagaatggcgtgaaccctggagacagagcttgcagtgagccgagatggcgccactgcactccagcctgggcaacagagcgagactccgtctcaaaaaaaaaaaagatcgagaccatcctggccaacatgatgaaaccctgtttctactaaaaatacaaaaattagccaggtgtgggctgagcgcggtggctcacgcctgtaatcccaacactttgggaggccgaggagggcagatcacgaggtcaggagatcgagaccatcctggctaacagggtgacactccgtctctactaaaaatacaaaaaaattagccgagcgtggtggtgggcgcctgtagtcccagctactcaggaggctgaggcagaagaatggcgtgaacctgggaggttcacaagggggggtaacaaagggcccatgagtcctgattaactgatctgacaaaccatctgtcacccaccaccctaagccacactgtgaaactgcctagggtggcaccagctttttatcttcctcagggtcctcccctcaggcccccaagtcaccccctcatggtccggattctcccctgagtgactccatccccatggtcatctcccctcctgagcctccccctctgagggccaagggctgtcctcagggccctcctggggcttcctggtggggaacaacctgaggcaggaggataagctcttattcagagcattgagaggaaattgtgaagcttgcagtgagccgagattgcgccactctactccaggctgggtgacagagcgagactctgtctcaaaaaaaaaaaaaattagccaggtgtggtgtcgggcacctgtagtcccacctattcaggaggcagagacaagagaatcacttgaacccaggaggcagaggttgcagtgagccgagactgcaccactgcatgccaacctggcgagagcaagactcagtctcaaaaaaaaaaaaagagagattgagaccatcctgaaccccgtctctactaaaaatacaaaaattagctgggcgtggtggtgtgcgcctgtggtcccagctactcaggaggctgaggcaggagaatcgcctgaacccgggaggcggaggttacagtgagtcaaggtcatgccactgcactccagcctggtgacagagcaagactccatctcaaaaaaaaaaaaaaaaacaaaacaaaaaagaaagaaagaaagaaaaaaaggaacccacatacaaagatctttgatgtccttaagaaaaatgtaaaaggaacttgtgaccaaaaaatttgagtatacaaagaacacaaaataaaacatcctacatgttttctaaaataatcttaaagttatgttagttcttttagatactgctcttaccctaccaatttaggacactatgtactttttcaagaaaattacctactccctgcactcagtgaaatgaacttctttccttataccagatggggaaataaattaacttccaaacaaatggacagcctaaactagcaatcagtaaactttttctacaaaaaggaggagattactaatctggctttacaggcatacaatctctgctgcaaccactcaattccaaccttgtagtatgtaagcagccacagacaatacataaacagaggcatgttgcattccaataaatattaacaaaattaggcaggggccatatttggcccacaagttctaaccaacccctgctctaaactaacatttttatacaaatccaagtgatgtttttgttcaatggaatttattttcaaaatggagacactggttttcaaaatcaaaatttaggaaaaaaggtaaatcacatagttgagttattttgtttcttagctaaaacagtattttctgaaataccagtgatgctaagtgcttatactagtacatgtgaacctagccatctgatgacagatgaaccttaattttcactcaagattatactattataaaaaataaaatatgaaatagcagttagaacattcattttaagcttgactatgacaaacctgagtatttaaccataaggctaattttaatcaagcttgaactataagagttctctaaaaaggaaagtcatataaaaccaattagaacttccccgtaaaagaagaaaaataagattgcctcctagtggttcactgtattaactataactcctaggtacattatagaaataatgatgcagtaaagaaatttagagcaatgaacttactgcaaaaagaaaaactacaatttatactaaagcattctcctcaaagtcaacgcacctttccagtaattctctactttcctgcacatctctagtggaaagcgtaagaagcataagattagcataggccagcagtaagtctgtattggttgctcgccagtcacttttatcagactccaaacactgtaaagactccagatattcctattttgtggaatgaatagtaagttacaaaacttaatcaagtgttaagaaattaaccattttatgcctacaaattccttttctcactctaaccacgtttgtgaaactacattgatttttacatcaaccttataaatgaaaacaccaaaaatatatacatttatcatagttatctccccaactttcccattataaatttaactgatcctggtaaaaatttcattttataactgttctacctaaataaaagaaatttaagtcctgcggggcactgctgctttagtacaaaaagatgtatgctaattgcctacatagaaatgtaaagacccaatagcttttatctaccttaagggtctgtacaacacacgaattccactctaaacttgaacgcaaagctatgttcctctctgcctcatggcagcgggccacagcatccttcaatcttttatttgagcgatacaactccactagccggatgttcatatggacgtcatcaggtcttacataaagttctgactgaatccagtcaaaaagtttattccatccatcttcaccttcacaatctagaagatgttcctatttagaggggaaaaagaaaaattattagagtaacacttgtgcaattttaaacaagtcatgctcccaaaaagcaccattccactatgtctagttttatgatgatgccaccaaaaacaccatcctatataccttattcgtcccttctgagagttgcttacaacccagaaactaagcctcaagaactgtatgtgaagaaaagcatctgtgattactgcagtagcttatactctcttcagagactaccaggactattgccacacatccctgtccatctgagtcaccaccagaagcctagacctccccagtcaatcctcagcaacaaggtccttatgctcaaactgctctgtatctccttaaatctgactcaatcccacatcccctctcctcccactgttctgttaccttcatcatcatctcaaagcactgtcatcacctcctgatcttaaatgaagacagtatcatctcaggataacccccactaccatgatggctttttctctctgaacttacatacaaggagaggaagtagggtttgtggccactcgcttctcatttgcgatgctcttccatcagcctctcaagaagctaggaccataggcatgcaccaccatgcccggctaatttttttttaacgttctgtagagatggggtcttgccgtgttgcccaagctgactactcagttccttaatcacctcatctccagtcatgttatcctctactccaacctcaaccatccacttgccactgacacaggtcttcaaaatctgcattttggtcataccaccgaaacgaccataccatccttcttattcttccacctcactgagggcctacgtacccttactttcagaaatatacttctccaccacatgacaagttcccttcaagacaataacatcatcaagttttaagcacctgtaaacacatataaatacacacactttcttctgtcaggcaaaaaatgctataatcccttatatccataattactgtttgcttacagatcccttcaactaattccctcttttcctcagaaccctcccaactggtttctgtgtgcttagatttgggaaatcataaccccaagctaaccgatttcatttgcattatctcaaccatcaaactggtgctgcctaaaacaaaatgccattttagtactaacagactcactttctccactccctgacacttcacacctcctcctatttcctcaacttccccataccttcctttgaccctcactttcaacttataacctagattcatccttcactgagaaacctgatgctatcacatataaattccattttaccttacctacttaaactcgtctttccccagctctcaagaccaagccgtccattactactctgtatttcattcccctctctcctttatcaatttctcctcttctggatgagatggatgataccctggtctctccctattgcaaaagccctagtctttgactctatgttaaacattttttaaaaaaccactatgagtgcttttaaaaagttctatctcatacttgagagaaaaagccttctcaacagtaatactctcattcattaaacaaatgtcagaaactgtttaccttagcaagccttaaattttaggagaaatggaattactttgcatgacaattataaatctcatggatttcaattccaaaaaaaaaaaaaaatctgatacaggaaaggtgttaacagtgccttcaagttattaaagaaaatctttaaagagtgcttcaaagtatctaacttgttacactgcaagaaaacaatctcctgccattacatatgttctttaacactactgacaccagattaactggattgccacgcccaatatgggagttatgtttgaggcataacacctaagagagtaaagaaatctgcacaattagacctcatgttttagactaatatttaaaatccagctgcttattactggggagaaaaacttatcagtaatatttatctttggaagcatcttcaatgctttttcagcttcaaaaatctggacatgattgttcatagcagttgaacaacagccaaaacctagaaataaccaaaatgcccctcaaaagtgaatggttaaggctgggcacagtggctcacacctgtaatcccagcactttgggaggccaaagtgggtggatcacctgagaacccgggaggcagaagttgcagtgagccgagatagcaccactgcactccagcatgggcgacagagcaagactctgtctcaaaaaaataaaaataaaaaaagtgaatggttaaattgtggaccatgaaatgctactcagaagtaaaggaaccaactatggatatacaaaacttaatatggatcacaaatggtattatgctgactgaacaagccaacctcaaaaggtcacatgcttggctgggcgcggtggctcacgcctgtaatcctagcactttgggaggctggggtgggcagatcacatgaggtcaggagttcgagaccagccaggccaacatggtgaaaccccgtttctgcaaaaatacaaaaataagcgggacacggtaacatgtgcctgtagtcccagctacccggaaggctgaggcaggagaattgcttgaacctgggaggcacaggtggcagtgagccgagattgcgccagtgaactccaacctgggcaacagagcgagactccgtctcaaaaacaacgaaaaaagaaaaaaaaaagtcacacatttcatgatgacatttacataacattttgaaatcaccaaagtataaagatggagaacagattaatggttgccagaggtcaggcatagtgaagagaagtaaatagcatgactacaaaaggggcagcatgaggaagatctctgtggtaatagagtagctctgtatcttgacagtagtggtggtatgaatctacacatgataaaatgaaagaaaactatatacatacacattgtaccaatgtcaaaattcctgattttgatattgtgctttggtcgggttaaacaggttgagtatcccctatccaaaatgcttgagaccagaagtatttcagattttgaattttttcagactttggaatatttgcaggatacttagcaggcagagcatcccaaatctgaaaatctgaaatccaaaattttccaatgagcatttctttgagcatcatgtcagtgctcaaaaaatttcagattttggagcatttaggatttcagattttaaatgctcaacctgtataagcattggggaaaaatgaagtagcatataggatctttctgtgcaatctttgcaacttcctgtgcaaaaaaatctataattatttcaaaattaaaattttttaaatttctatcagaaacatatacaatgggggtaggaggaggctaaaggcaaatatacatttataattttatattgtacatacacaataaagtatacattaatatataaaatattacaatatacattttaaatgtttgccaaacatatttgtgtagattttctccagaacagttacttagtaaactatattttgctctataaagaatatcaggaccagtcaatacactagcaagaacttcctaccatttttagtaattacatcttatatactagagaaaccaccttttatcttttccttgaaaactttactatctcaaaatacaatcccttctactttcagaccatagttattagaaaactcttctttaaaatatccctaaattgtcatcctgtaggtaattttcacttaatgaagcaaaaattgtataccagacagaacttaatgtaaatcttagctctacttagtttacagctactaaactgtaaaatccctaaaatattaattattccagaagggtaaatgagatgtcacttataaagtataacaatgcctaataagacagcagatgctcagaaaggttttaatacactttttaaaagaaaaatgttaaaggaaacacaaacacctgggcttaaggtttgctattgaaaagtaatttaaactccaaatattagaaatggttatgtcttaagttttctccctttatgttttgtatgtttacctttagtttataaattgcaggacttcctgggaaaagtttcgctgccctttcaacccagtattttgctcttccatcagtaacatcatttttacaaagcaattctgcaatcttcaacacaagatctttttgtggtgggtttaattccagtgaacgctaatatcagaaaagaaattaaagattagtaaataaattgtatgtatgtatgtaggagtatatatacttatatacttatatataaaggttaaaaattatcactccaacccttaaaaaattctacttctagagaaaacatgttacttcaaaggtgttaaaataaaagtgtcttggaattttctggaaatgaatcaaataaaaattatatttgtgtcatttgaatgcaaaagaacacaaaagaacaccatttctgaccatgttagacttacaatttataggtgttaaacaattctaaatctgttccaagctgtgtcacataattgtactatgataccaatgcctgttttatgatattcataaaatatatttgacttacttatataaatttctctgggcatcatgtgtttggctatgcaaaggctatatttgaatcctataacttaccctgtaacattcaacggctttctctgtgttttcttccaattcataaagaagacccagaaatctgtgagctctgggatccctctcttgcacactaaggtaagtacatacgtatctgtttttcaaaagtaatacaaaagtaaattaaacttagaactgtacttttaaatgctaaccgaagaatacatcttaaaccaaagcaaccactaaactcgtttatattgttactcaaaactaccactatttatgcagataactcagaagtattcatagaaagaaatgggtaatacttaaaaacacgtacatagagttgaccacatactcgttttaccattaaatgtcacatttaccaaatttttctccagtgttatccacgcataagaaatgaacatataaattgctttttcttcctgatcacattttaataaagcactaacagttttgcaaataaattagaagtgattatagtaaacatttttaaagttatcataatgcaaaatactaaacagcaacaatttcccaaacaacaaagggaaatacacctaccctttaagcaagaaagtaatttctaacagtactatatccagctaaaatcgaacagaagacaaattactaattacagtaccaaatacaggaaatttccatttctcaaatcaagtaacaactaaaataagtaaatatcctctaggttccttgacagtattaccatcagagaaattaggccagacccaaactaagggattaaagtctcacagtaaaaaggtacaagagttaacagtcacagtgctgctagttacataatttatgtaccaccattttcctttcttaccagcatttccatcttcctttggatgcctttaaaagcctgcctcccagctgggagcagtaacacacacctgtagtcccaacagtatgggaggccgaggcaggcagactgctgtgctcagaagttcaagactagcctgggcaacatagtgacacctgtctctaccaaaaaatgcaaaccttagccaggtgtggtggtgctcatctgtatccccagctacttggggcgctgaggtgggaagatctcttgagcccagaaggcagaggttacagtgagcaaagatggagccagctgctgcactccagcctgagcaagagagacagatactgactaaaaaaaaaaaaaaaaaaaaaaaaaccctgcctccctcttaatttcctgctttaatccactcccagtcaggaaatcagaatcaccaagcttcttatccctaggatagagccttagagcatcacatattgtgtcaattaaagatcttttatacaagctattctcctgccttacaattacagttttttattcattgctattttccatctgattaaggtatcagatatctaaccaaaaacaaatgaagatataggcatggtcctcttttactccaacagaagacaatttttagaaaaagtgttttaagccaaacaatttcttgcccttggtataaagcagcagcatgcagaaaacactaattacggtttcaatctcaatggaatctaggctggtccttagcatcagtctgagtgataaatcccttattccagaatacacttaggaagaactactaagaacatatttttacctatttcaaagaagaaaatgagaaaaggcattgattttaaaaaaagaatacatgttacagtttgtacttactttttagcaagatcatattctttagcttcataatacagctttgcaaaatagaatcctctcaacttctaaaaaaaattaaaagttgttttacgtttcatacagaaatattttccaacattttttcaaaagtagtaaaaatctgccctaagtttatgttcaaatatgccattttcattcacttaaaagttttttttaaagcctgacaaatgcataattccatgttttataatttcctatcacaaaacaaaaaatagagctgggtgcagcggctcatgcctgtaatcccagcactttgggaggccgaagtgggcggatcacctgaggtcaggagtttgagaccagcctggcgttataacatggtgaaactccgtctctacaaaaatagaaaaattagccaggcatgatggcgggtgcctgtaatcccagctactcgggaggctaaggcacgagaatcagttgaacccaggaggtggaggttgcagtgagccagaggttgcagtcagctgagatcgtgccatcgcactccagcctgggcgacagagactccatctcccaaacatcatcatcatcgtcatcataaataagctgggtgcagttggtcacacctttaattctatttaattctagcactttcagagaccaaggtgggaggctagctttgaggccaagagtttgaaaccagcctgtgcaacacaacaagatcctgtctccagggggaaaaaaatagccaggcatagtggagcatgcctgtgttcctagctactcaggaggccaaggaaggagaatcacttgagcccaggaggttgacactgccgtgagttatgactgtgacactgcactccagcctgggtgacacagggagatcctgtctctaaataataaatacataacatacaaaaaataaattcaagaaagcaagacaagcagacaacagaagttaagaattttcatcagccttggaaatcttggaaaccctgtggtaccactctctcacttaacaaacaaaagaaaccagctttctttggggaggaaaggtattccagaaatctcttctcctaccatgtgtaagcctctatgggaaagaataagtaagtacttacgatctattaaggcactgaggattccctgtgccttaatagtacatgtactgttctctctacagatcagatcagtattttacagtcaaggagtcaaaaaggcagaaataaatattgaattcttcaagtaataaacaaggtccacagcctggctccttggttacgtaaactccaaagtccaaaatgctgatgcacaccaggctgggtgcggtggctcacacctgtaatcccagcactttcggagactgaggcgggtggatcacttgaagccaagagttcgagaccagcctggccaacatgcagaaacctcctttctactaaaaatacaaaaattagctgggcatggtggcacacgcctgtaatccccgctgcttgggaggctgaggcaaagaatcgcctgaacccgggaggcagcagtgggccaagaccgcaccactgcactccagcctgggcaacagaatgattccatctcaaaaaaaaaaaaaaaaaaaaaaaaagctgatacaaccagagtatgttccatccatgtgataaagagtatacagccactcaaacatcttatttttgaaattccaagaccccagtgaatgtccaaaacgatgaacagtatcaaaccaggttgccatcaatcgaaacatgtttcctgtttgtgtcctccacccacaaatttaatgtcttgtccatctcaacaaagcacttatcacacactgtggctgtaacttttgcagtttggggtgtcacaacaaaactagcacaaatttctttttccttcttcacaatttcatggacaaaagatttgttcttaccgtagatcttagcaaccccagtatacgatcttttttctttcctaagtcaaaaactcacctcttcacttaaaggaagcactatatggcttctctctggcatatgtgaactgccagcatcgctattcttgctctttggtgccattttaaataaaataagggttacttgaacacaagcaccgcaatactccaacaactgatctgataactgagatggctagtatgtaactagcgggtggggagcacatacagcatgaatatattggacaaagggatgattcgtgtcctgggtaggacggagcaggaggctgtgagatttttatcatgttattcagaactgtttgcaatttaaaactcatgaaatgtttatttatataatcttccattcaatatttttggaccacgggtgacgcaggtaagtaaaaccacgtaaggcaatactgtggataagaagggactactgtaccagcaacgaacaatcagaaaaggaaattaagaaagcaattccatttacaatcgcatctaaatgaaaaaaatgcctgggaataaatgtaaacaaggaggtgagagacttgtatgcttaaattacaaaacgttgctcaatgccaggctaacacctgcaatcccagcactggcgacagagcaagactccatctcaaaaaaaaaagaactatagcaatcttaacaaaaataatacacaacagtcaggacagcacataaaggaacaaggcttgttccccgcttcctttttttttttgagatggagtcttgctctgtcgccaggctggagtgcggtggctcgatctcagctcactgcaacctctgcgtcccgggtacaagctgggactacaggcgcacgccaccatgcccagctaatttttgtatttttagtagagatggggtttcaccatgttggccagatggtgtcgttctctcgaccttgtaatctgacttcctccgcctccgaaggtgctgggattacaggcctcagccaccgagcccggccagttcccccttttcaaaatgaagaaatagattcaaggtacaatgccaaaacataatagaaaaataattccattaccttctttgcttccaactatgttattaaagtagacaatcttaagataattaaacaactttacaaattattcttctgtatgatcttttgcctctaacctcactttacaagggaactgaagctcaagcaggcaaatgccttgtttaaagatatacagctaggaaggagcacagcccacgttatgtaaacaggacaatatctgattcaagcagtacttctttacatgacagcagatgtcactataagcaaatacctgaattcacttaagctgccaaatatcaagaactgatgcagggctgaaaacaggaacagtaagaccctaagagatgccacatcatcgctatcttgcacagtaagatagagatgtaattgtaattgtccaaaacttaacatttgtggcctactttttcattatgcagttctaaatttctctctctttttttttaattcaaacggagtctcgctctgtcgcccatcttgcacagtcaaatgaatctccctccccctaaaatcctccaaaaaagctgctgttctcaacaaacccatctgatcagctccaaatctgtggagtcccaacaagggtgaaggccgtgattatacaggacaatgaggaaaagtctagatactgaaacatgaattccccagtcttcttcccctggaacataagggtaaggaaatctctcaaaaggcagaacaaacaaaagaggagaataagagaaaaattagagaaactccagctttcaggtaaacatcattaaaaaaaagggtaagaaatggtcaaagaaataatacaagaaacgctacagaactgaaagaaatgagtttcccaattgaaaggacacttccagaaaacctttgttaccaagaacaagactctcatcagactcctaacaacagaacttctggaaaatggagcaatgctttcaaaattgcgaaaaaaattatttcaaactcagaattcgataaccaaatgatcaactaaattaagtaaagatgttttaaagacataccattagtttccagaccagcctgaacagtatggtgaaattccatctctactaaaaatagaaaaaattagccgggcatggtggcgcacacccgtaatcccgctactcgggaggctgaggcaggagaatcacttgaacccgggaggcggaggttgtggtgagctgagaccatgccactgcactccagcctgggcaacagagcaagactctgtcccaaaacaaaaacaaacaaaaaaacctctcatccacttttcctcaaagcaagtgaactatgctacaccaaaacaaagaaagtaaatgaagatgacatgagatacaagaaacaaagggtctaactcagaaaaaagatgaagggaattctcaaactggtgataaagggaagtcccaagagcacagctgtgtagcaaagaggaagaaaaaccaatctgggttggagaagtcggttagtaagggtattccaggtagacagacaatcaatcaatcaatcaatcaatcaatgttttaagctgaaattgatcggattatgtgaccagtttgaccacatttgagggtttaagttgctgagtttaagtaaccaagtagtaacacaacatacaagcaaaccaaaaaataaagcaattattcagtccaggaaaaacaaaactgcacaacaagggcaattcaaatgcaaaatatttaccttatatttatataaatgttaaatattcatttaaacaaaaactccaataacagtactgaaacaatgaggggcaaagcaaagtgtctgaggacagttttggaggagcataatagccagtacagaatgtctaaagtggggccgggcgcggtggctcacgcctgtaatcccggcactttgggaggctgaggcgggcggatcatgaggtcaggagatcgagactatcctggctaacacggtgaaaccccgtctctactaaaaatactaaaaaattagccgggtgttgtggcgggtgcccgtagtcccagctacaggctggggcaggagaatggcgtgaaccccggaggcagagtttgcagtgagccgagatcgcgacactgcactccagcctaggccatagagcgagactctgtctcaaaaaaaaaaaagaaaacaaaatgtctaaaatgggagaaagggaattcaaaataacaaaagtatatgtgtgtgttactcagaagcatgaagtatagatgtaaagggcagaaaaaaaaactaacagctgtcaaaggtgcctgcctgtagtcctaagtactcaggcaacagaggtaggaggatcatttatgcccaaaaatttgatggcagcctggacaacacagcaagaccctattctaaaaaacaaataaataaaaataagagctgtcaagtagagtttgagaagtaggaatcagctgcagaataagaaaccaacttgacagaacatagaaaaactaaacagaagccatctggaaaaagaaaaactagagaaagaattatatatttttttatttttttattttttggagacagagtctcgctctgtcacacaggctggagtgcagtggcgcaatctctgctcaccacaacctctgcctccagggttcaagcaattctcctgtctcagcctaccgagtaggtgggactacaggcgctgccaccacgcccggctcatttttgtatttttaatagagacggattttcaccatgttggtcaggctggtctctctgcctcccaaagtgctcggattacagacgaagaatatttttaagaagggcaaaagcacatgtgagggagtagaaaaatggcaaaacaagagaagattaacaaatgaaagcacaatggaagactagaaagatatgatatacagacgcatcatcacactccaaaactcagacattctagaaagcatgggcagttcacagatggccagcctctgccaaactgggggagaatactaacctctttatattcttcacagccactgcctcttctccctccattccttaccttctatccaaagcaccctgttttgtcatttcactcaaacctaactttacagaatagcttcacatgttccaaagttactcactagttaatccatattccgttgaaatccccaggttctaatgtaaatgactttaaatttgggggaaaaaaaaagactctaagtgtaagagaggtgaggccgaggccgaggccgccgccgccgcccggccaggccgaggccgccgccgccgccgccgccgccgcccggccaggccgaggccgaggccgaggccgccgccgccgccgcccggccaggccgaggccgccgccgccgccgcccggccaggccgaggccgaggccgccgccgccgccgccgccgccgcacattaaccttttaagttaaagattaagagaaccaacacctctttacagtgaaatgccccaactaaatactaccgtatggcccaccataattgcccccatacttcttacactattcctcatcactcagctaaaaatattaaatacaaattaccatctacccccctcaccaaagcccataaaaataaaaaactatagtaaaccctgagaaccaaagtgaacgaaaatctgttcgcttcattcattgcccccacaatcctaggtctgcccgccgcagtactgatcattctatttccccctctattgatccccacctccaaatacctcatcaacaaccgactaattaccacccaacaatgactaatccaactaacctcaaaacaaatgatagccatacacaacactaaagggcgaacctgatctcttatactagtatccttaatcatttttattgccacaactaatcttctcgggctcctacgccgaggccgccgccgccgccgccgccgcccggccaggccgaggccgaggccgccgccgccgccgccgccgccgcccggccaggccgaggccgaggccgaggccgccgtcgccgccgccgccgcccggccgaggccgaggccgaggccgccgcccggccgaggccgaggccgaggccgccgcccggccaggtcgaggccgccgcccggccaggtcgaggccgccgcccggccaggtcgaggccgccgcccggccaggtcgaggccgtcggtctcttcgagatccactcacctttccaggcgacggggcggagccctgcaccgaggcgaggtaccgctccccgtaggctttgctgcgcctcatcgcaccgccaacctggctcccgagacgcgtgaaaccagcgctcagccccgcagcagtcgccaattccaacaggaaagcgcctgaaagccactgacgtagccggcggaggaccactgtgacgcacttgtgtactgcgtcagcactgtgtatccttggcgacgtcggcgctcgagctgcactcggccgggctcttggcagcaccctgtgctctgagggtgtcttgcccgccgggcgccgtggctcacgcctgtaatcccaacactttgggaggccgaggcgggtgctgtaaaccattcatttgcttatttcaatattttcatttgtatgctttcagataagctgaacttgttccaatctgctatacataggtttgtttatatctttacagtaaatatctcagttaagaattattttctctttgtaaagacattgtgactcagatactacttgtaaagtctataggaacacacagctagtaaatggcataattgaaattcaaatggaaatctgattctaaaatatacttgtagcaacatagctgattcctgttactgtatctgctcctgtaaattttgtaaattcattacaatttttaaaatataaaatattttcatatatttatttagtctttgctaccatgaatagcttcaatgggaatgatgattaattctagaatgtgcttgtcttttacatttctatgatttttagggttaaaataaaccttgttggtttacaaatgattcctgaatgatttctttcctctaaatgctacagcacttcactacaaggtctgcaaagaagctatgtgggggagtgaagtaggaggtgactgagattatgtaattaagttcatatatgtcataatttttcattgttcccactgttttagagaaaagtaacaaaggagaagacatgtgggcgtgtagagaaatgcaaggtggagatattaatgctacagtataatcttctgtgggtgtttagcctggggatgagaaaactaaggagaaccatgccagttgtgttgaaatatttgaagagctgtcatgcagaagagagaatagacttttttctgtaggcccagagggtataactaacattaagggaagaaagtcatagggtagaaaaattttattcaatttaaggaataactttctaatagtgcatagtattggaacaggtggctgcataaagtcccacgaagtgttcattctaatgctgaatacccatgcaccaagaatcctgtggaaatgatgcttgcagggattaaagaatgaagtagaatctaatctaatatagcctcttcctactagaatgccaaactcagaaagactttctctctgttctctctttctctctctctcgtgctctctttgtctaatttatctgtatacctatttaatttccaaaaaatgagattgacaggaagtgtaagagttaaaaagaataatgtgtgtatgcgtgtgcatgtgtgtgtgaaaaaatggattttaaaggtattggatgcccgttgagaatgtttatattcctctaccccttgaggtttatggttagcaaaaaaatagtaacaaagataattttgttatatcttattgtatggcagaaggagatttccatagtagaataaaaaaaacttttaaatcagagataacctgggttcaaattccaactttctcactttcagctttttgaccttgaaaaagtaactgaacctttataaaccttcatttttttactataaaatttggataataaagtaccttaactgtagggttactgagaaattaaatgagacaagtcacatgaagcacactttatattgcctagtatgtagacagcaataataaatcctggcttcatatatttccttactttagtttacattgtttttacaaacgtatcacatcagctgatagaattttgatgtcgtcatttaagtttctggttatctggtgtagaatgcaactgtttttctgatttaagataattcaatcaacaaatttttcttgagctccaattttgctcattctacctttctctccatgcaaaaagaaagtgagaaatgtcatttcatttggcaatggttaaacataggcaaacctttagaaatatttctttattttaaaatttgtgcttgtaaaatacttagttataatatatgtttactaatttactgttttttaaagttgttttattacggaaaaacaattttggtgctatacaccccagagaatactttaatgctcaattatctgaaaaaataatctatggtatgctttttcacagccctgctgaattctaggtactcttcctcgaatttgtgtgagaaaatatgtagactcacagtttacttcagaattaaaaatattactacagaatacattcaaattttatacctctgattgcagcatattgaaatgcttaagaagttccattagtgcagatgatgacaactatgtatgcaaaagtaccagagaaattttatgtgtgtttttatgcatgtatctttgtgtatggttacagtatgatcgtggcaaatgtataagatacacacatgttacacttttcatgcctgattaattcataaaaggcatgtgtgtgagtgtatgtatgtgtgtatttgcttatgctcactttctgtgcttgtctaaataatgaagatttttttcctgtatctatgctttcagaaaccatacctgactaactggtggggaatgtgtatttacattttgccactacactaattatttctgattaaattttctagttgcttacgtaaatcatgaattggattctcgtgttaatttgactaaaactaccaactagtaaatattttcaattaagtgattttcttcataattcccatcaatgattctttgttcttgttttttaaagaatattttgattaaaatacaatagtgtcattgtaaaatgattgacaagtataatgaatgaaataaaaatagttgaagatttttaaaccaaaacaaattcagtgataaatgttaatatattttattctagttgtttgtatgtctgtatgtagcagataaaagaaaatctccatgggaattgagatgcaaatgagattgagacatcattaggataaaaatgttagaatcatgaatgtcagaaaaaaaattagtacctggtaaacttgaggaaatctttgtactttccaaagataaaaagaaagttgttgcaaatcaatttatttttattccgaaaagacaaagtgatccagctgatatacagttatagataaatgcatgtacagtcatacagtgtatatcctgatgctttatataatatgtgacagcaagcttgtctttcttctttaataattgttgaaaatttaatttttgtgaccacatggtaattgattacaagaagggactatagtgtgtttatttattcatttcttgaacatttccattgctttctactttaaaattgctttaacagtgctgcagtgaagatacatgtactcaaatattttttaataattctactaattttcattaattatattcctggaaatgcatgtagaaaattaaatgatatagatattttaaatattcttattaccatattacttgattatttttgccacattactttctagaacagttgtgtcaatctgttttcttgttgggaaggtaaaatgcaaacattagatgtctagaacccaataaaaaagacaatgtaaacaagttgtattagtttgttctcacaccattatgaagaaatacctgagacacagtaatttaaaaaaacaaaaaaacagaagtttaatggactcacagttccacatggctggggaggcctcaaaatcacagtggaagggaaaagaggagcaaaggcaagtcttagaaggcagcaggcaagagagtatgtgcagaggaacggccctttataaaaccttcaggtctcatgagacttattcactattgtaagaacagcaagagaaaaaaaacccgctcccatgattcagttgagtcctgtcaggtccatcccatggcatgtagggattatgggaactaaaattcaagatgatatttggttgaggacacagccaaatcatatcattctgcccctcaccccttcctttcaaatctcattttctcacatttcaaaacacaatcatgccttcccaacagtcccccaaaatcttaactgctttcagcattaactcagaagtccacagtccaatgtgtcatctgagaaaaggcaagtctcttcggcctgcaagcctgtaaaatcgaaagcaagctggttacttcctagatacacgggggtgaaggcattgggtaaatacacccaaatgggaaaaaatggcaaaacgaacaggctacaggccacataaaagtccaaaattcagtgaggctgttaaatattaaagctccaaaatgacctcctttgactgaaggtcccacatccaggtcacactgatgcaagaggtaggctcccacagccttgggcagctctgcccctgagactttgcagggtacaggctctctcctgggtactttcacagcattttccacccctgctgaaaacttctgcctggacatccaggcatttccatacatcctctgaaatctatctagagattcccagcaagatcaccatctacatctgagaccacctcagcctggattttattgttcatttcactatcagcattttggtcaaagccatccaacaagtctctaggaagctctaaactttctcacatttttctgtcttcttctgaaccctccaaactctttcaacctctgcctgttacccagttccaaagttgcttccacatttttcagtatcttaatagcagtaccccactctactgataccaattgactgtattagctcattctcatactgctatgaagaaataacaagactgggtaatttataaagaaaaaggtttaaaggactcacagattcacatggctggggaggcctcacaatcatgtcagaaggcaaaggaggaagaaaggcatgttttacatggtggaaagcaagagagcatgtgcaggggaactgccctttataaaaccatcatatctcatgaaacagtcactatcacgagaacagcactggaaaaacccacccccatgattcaattacttcctgcttggtgtctcccatgataaatggggattatgggagttacagttgaagatgagaattggagtgggacaccgtcaaaccatatcacaaatagtagaaaaagacctacagcacattaacatagttgcgttaccacacaggctttaaaattaaagttatttttgcatgaaataaaacacgagaaatatgtttttgcatgaaacaatgaaaatagtcaataaaataatggaaagtatggtaacttaaataattggattcatgagaaataaccaaataaatattctagagattaaaaatgcagtgtctcaaacttaggccatataaaatatgtttaacagcaaacaggacatggcagaagacaaattagtaaaatggaaaagatatcaatggaaaatagtcaatatgaagcacagggcaataatgatttttttttactggacacagtgtaaggaaaatgtgagcacattaaaatatctaacatatatgttgttagaggtacagaaagagaagagagagaaaatagagcagatgtaatatttgaatatgtaataccaaaaattgatagacttcaattgacaaattcaagaatatgagtgaaccccaaccaaaataaaaacaaagagaaccccatgtatatgcttagtcaaattactgtaagctgaagtcaaagtgaaaaaacatatcttaaaaaaatagctgtgatttgggaagagacatacaatgttactttcaaatcagccacagtaatactaacaactagattattttccataagaaatggagccagaagacaatagaaagttattattaaaatactaagtaaaacaaaatcctaataaagagaaagacctaccaacctatgatagtatccctaataaaaatatcactcaaactgaaagctaaataaatcattttcaaacaaaagattgatgagataattcatcagcagaactgctaagtgaatttctcaagctgaaatcaatgatgataccacatgagaagcagaatcacagtaaaaaaaaaatgaagagtattagaagctttaatatataaataattataaaataatattttaataatattgttaacacagaaacaacaaaatcttggtagatttataataaatatgtatataaatatatgacaaatatcacaaaaggcatggaaatggtgcgaatagttatatatgctttgtaaaatttgtgcagttttataaaaatattagtactactaaaaaatggttgattataataactaggaatgcattctgtaacctaaagatgttaataaaaattaataaaagaatgtacaagtaaaacttaatataatagaactaattgtataagaatgatgattaattgaaaataaataaatttaccaaaaacaaagaagaaataatgaaacaagttgcaaaatggttgacttgaacctacctatgttagtaattgttttaaatgtacatgtactaaacactctaattgaaaagcaaactgtcggaacaattagaaaatacaactagatgctgtttaaaaaggacaaatattaactacaacaacacagaaagtctggaagagaaaggacagaaaagatataccacacaatctctaaataaagttactgtaggtaaatataaactatatcaaaatatcagaccatgttgaaagtaacaacttttattctttggaccataaacccacacacagaagaagattattaaaatatgcatttaacaaaagattttatttagaatagataaagaaatcctggaagtcattaaaaacaagataggcaattaaatttaaaactaaatggtaggctggatacagtggctcagtcttgtaaacccagcactttgggaggctgcggtgagagaattgcttgagtctagaagtttgagaccatcctgggcaacatagcgagaacctttctttaaaaaaaaaataaaaattagccaggcttggtggtgtgtactccagaggctgaagtgggaggattactttatcccaggaattcaagactgcagtaaactacgatcatgccactgtactctagactgggtgacagagagtctagtctctgtctataaataaataaataaataaatataacatagtaaaagaacctgaacaagactttcagaaaatgatatgtacatgaccaataagcacataggataatgatcaacgcaactagtcattaatcgaatgaaaatagaatcacaatgagacactactacagacctactgatgactaaaattaaaaagacaaataataccaaatgttgacaaggatgtaaaggaactgacaatcccatattttgccagtggaaatataaattgctgtcagtttttcagaaataattttggctgtttctactatatctaagaatacatacatctggtgagccagcaatttcactccaagagaaatgagttcttaccttcaccatgacatgagcaagaatattcataacagttttatacattatagccataaacataaactgccagttaaacgaggagtttgaggagattttggttgaaaagtacaaagatttagttagaatgatgaataagttccagagcactattgtacagcatggtgactgtagttaatagttaacataatgtatactttaaaattgtttatagagtagatcttacctgccttcaacaccaaaaaataataagtacgtatggtgatggatatgtttattagcttgatcccgtcattcctcactttatacatatataaaaatatcatatatgcttcaaatatatatatagttttttgttaattatagcatagtgaagctgaaacaagataaaataaaatgtgggggagttttaccatatggagaagctggtaatagcacaataacaataataataacagtaataattgttatataacccaaatatttcaaagaatgaatgatagttaaaagctacatatcttatattacaattttagttatactatttatctaaagaagccaaagcttaaatataattaattgatattttaaaaagtaaatacttttatcgggaaatgcagaaaagagagcactttccagctttcagtagaaagccagcattgtcctgacatcaaaatctgatacgtaaattataatagaaaactacagaaaaatgtctgtcatgaatatagatgcaaaaaaatttataaaacattaggatacaaaatccatcaatttataaaatgtatactacatcataaccaagtggattttttacctggaatttaatattggtttaatatttgaaaatcaatcagcgtgattcaccatgaacagagaagcggagaaaaatcagaaaattagaagtgcatttcctttatctgataaataacatctaagaaaaccttcaatttatatcatatttattggtgaaaaactgagctctaaaccggggaagaagaaaaaggtatctgtgcacaccatttgaagtcaaaattgtaatgaaagccataacaagtaagacaaggttgaaaaaatatgcaaggcctcagcctgagaagcaagaattaaagctctccttatatgaagattacatgatcatagatgtagaatatagtaaaaaatgcacagaaaatctactagtgctagcaaatgacttttgcacatattcaggatacagtgtgaatatatagaaaaaatagattttttgcttactagtaacaaacaattggaaagatttaaaatatcactcaaactaacacaatatgaaacaattggatatgaatttaacaaaatacatgcaaaaattatacactgtaacacataaacattgctgagaaaaagttaaaaagccataaatgagtggggaaagatattgtattcatgaatttgaagttccaatattgttaagatgcccatattcataaaatgttacatagatttattgtaatctcacacgaacatgaggatttttaaaaaaatggttaagtggatttgaaacttataagaagcaaaagacctataatgcagaaaaacaattttgaaaaagaagcccaacgttgtaatactaacattagcaaattgaagactcaatatataactgctgtatatgatcaattgattttctgactaaggtgctaaggtaactaagtatggaattaataatatgtcaacaaatagttctgagaaaaacaggacatctgtagataaaaaaatacatatttacatttatctcactccatatacaaaaatgaactggaaatgcatcatagatctaaatataacaaccaaaattaaaagcttttagaaaaaattgtaggaagatgttgctgactttgaggtaggcaaagggttcttagacatataagaacaaattctagtcatagaagaaaaatgatctgatacagctgaaaacgtcactataagaattttataatacaatcagaaatatcaacaagagaaaggaataagcagaggaaagaatctcagtgttcaaaaaaatccgttctttgaatcaactcagtcagacaattataaagaaaaaagaataaaaagaatgattaaaacctctgaaaaatatgggattacgtagacaccaaacctatgactcattggtcattgtgttgtgggaattgagggactagagagaccaatgtgtggaacaggagaattttatttaggtgaccactggctcagtgaactaacatccacaggctgagccctgaacaaagacagggctccacttttatacatgcatctgaaaagggtgtgaaatctgtaaggcgggtaagcaagcttacagaagcagaacaaaggcagtttatcaaccagtgacaggttttacaactcaagccaggtgttgcaactcaggcatatcttgtgaccttcgttgtgctgcacagaagggaaaaacaggaacttacaaaacttgcaaagataattgtgagaatagtaagggggaaagtggaagctgaaagagaaaaacttgtttttcccaaccttgctctgggtttggagggagagactctggagcccattccttcttagccttggctctgcagatagtgctatcaaagcctccacagagccctgcccttccctgggtcttggagtgagtgagcctagtacagaaaaacttgtttttctttttatatcttctgcttcaattggtgtccttgaaagaaagtgagagagagcaaacaacttggaaaacatatttaaggatattgtacacaagattttcatcaacattactatagaggtcaacattcatatccaggaaactcagataacccctgtgagataccatacaggatgaccattcccaagacacatagtccttgatcctccaaggtcaaagaaaaagaaaaaatattagtgggaactagagagaagagacagacaaatagagaaagaaagaaggaaggaaggaagaaagaagaaagaaaggaaagaaagaaagagaaagaaaaagagagagagggaggacggaaggaaggaaggaaggaaaaaaaagaaaagaaaagaaaggaaaacagaaacaaaatatcaggccaacaatggaccattcagcagaaaccctacaagccagaagagactggggacctatattcagcattgttaaagaaaagaaatttcaaccaagaatttaatatctagccaaactacacttcataagtgaaggaaacattaaatatttattagaccaagaaaatgctgagagaatttgttaccaccagagctgccatataagagttccttaagggagtactaaatttggaaacaaaaggccctaaccagctattgcaagaatcattgacaatgtaaatgaacaacacaatcaagtcatcataacaactagcttacaacacaataacagaattaaatccacaggtatcaatattaacatccaatgaaaatggctacatgctccacctaaaaagcacagagtgacaaattgggtaaagcagccaaacataactgtatactgccttcaaaatagccatctgacatgcaatgacacccataagctcaaagtaaagaggtagataataacttatcatcaaacagaaagaaaaatgagcaagggctgctattcttatttcagacaaaacagactttaaaccaacaatcatcaaaaaggacagagaagagcgttacataatgataaaagtttcaattcaaaaatatgtgactattctatctatatatggacccaatacaggagcccccagattcatcaaacaagttcttagagacacacaaatagacagataaccacacggtaaaactgggagacttcaacattccagtaaaggaattagacaaatcatcaaagcagaaaactaacaaagacattcaggacccaaatttgatacttaactaaatagacctaacctctaccaaaccttccacccaacaacaacagaatatacattattctcatctgcacatggcacataccctgaaattgaccacacagtcataaagcaattctcgacaaattcataaaaactgatatcacaccaaccacactctcagaccacagtgcaatataaatagaaatcaatatcaataagatttctgaaaattataaaattacattaaaattaaacaacctgctgctgaattactttgggtaaagaataaaattaaggcagaaatcaagaaattctttgaaactagtgaaaacaaagatacaacgtaccggaatctctggggtgtagcaaaaatagtgttaagaggacagattatgacactaaatgtctacatcaaaaagttagaaagatctaaaattaacaacctaacatgacacctagaagaactagaaaaataagaggcaaccaacacccaatctgccagaagaaaagaaataaccaaaatcagagttgatctgaaggaaattaagaagggaaaaataatgcaaaagatgcaaaaaaccaaaacttggtttcttgaaagaataaataagtttgatacacttctagttagaataatgggaaaaataagaagatttaaatagaaacattcaaaaatgagaagaacacattactactgactatacagaaatacaaaaaaccctcagggacaattacaatcacatctatgcacacaaattagaaaacctagaagaattaaataaattcctggaaacacaaaacctcccaagatttaaccaaatgtaaattaaaaccataaacacacctctaaggagttctaaaattgaatcactaataaaaagctgatcaaccagaagaagcacaagaccagttgaattcacagtcaagtagtactaccagacatataaagaagagctggtattaattctactgaaactgttccaaaaagttgaagaggaggcactcctccctatctcatcccataaagcccacatcattctgatacccacaccagtcaaacacactgcaaaaaaggaaactttaggtcaactttcccaataaacttagatgtaaaattcttcaacacaatacaaacaaagttaatccagcaacacatcaaaaagctaatccaccatgatcaagtaggcatcattcctgggatgcaaagttgggtcaatatatgcaaatcaataaatgtgatgcatcacataaacagaactaaaaccaaaaaccacgtgattatagatgtagaaaagactttcaataaaactgaacttcctttgtgttaaaaacccttgacaaactaggcatcaaaggaagatagcacaaaatactaacagccatctatgacaaacccattgccaacataatactgtacaggtaaaagctagaagcattccctttgagaaccagaattaaacaaggatacccacttttacaactcctattgaacaaagtattggacatcttaggcccattctatttccgcagaagaataatgagatgttcaacaaagctgacgataagaagcaatgggaaaaggattctctattcactaaatggtgctgtgataactggctaaccatatgcagaggattgatactgaattacttcatttccccatatcccaaaatcaactcaagatggattatagacttaaatgtaaaacccaaaactataaaaaccctagaagaaaacctatgaaataccattctggacataggtcctggcaaaggtttcataaaaaaaaatccaaaagctactgcaacaaaaataaaaattgacaagtgaacctaatgaaactaaagagcttctgcacagtaaaagaaaccgtcaacagaaaaaacagacaatctacagaatgacggaaaatatttgcaaactatgcatccaacaaaggtctaatgttcagaatctataagacacttgaacaaattaacaggcaaaaaacaaacaaccccatttaaaaaatgggcaaaggccatgaacagacacttctcaaaagaagacatatatgtggctaacaagcatatgaaaaatgctcaatatcactaatcataagagaaatgcaaatcaaaaccacaatgagataccatctaataacagtcagaatggctattatcaaaaagtcaaaaaataacagattctggtgatgttatagagaaaaccatttgacccagcaatcctattcctgggtatatacccaatggaatataaatagttctaacgtaaagacacatgcactcatatgttcttcacagcactattcacaatgggaaatcaacatagatgcccatcagtggaggactggataaagagaatatggtacatgtacaccatgggatactatgcagccataataaagaagaaaattgtgtcttttgcagcaacatggatggagctggaggccattatcctaaatgaattaatgcagaaaaagaaaccaaataccacatattctcacttataggtagaagttacacaatgagtacacgggaacacaaaacatggaacagtaaataccacagcctacttgaaggtggagggtatgaggagggtgaggattgaaaatccacctactgggtactaggattattatccagatgataaaatgatctatacaccaaaccttcacaggtactcccaaacctaaaataaatgttggaaagaaaaaaaaaacacattattcctcaagagtgtttacacaaatagcacacttactgtaaaagccagaaaatggaaataactgaccaatgaagaaataaattgtggttcatccatatggtgtgtactgaatttaagagtatccccttcaaagttatgtccacccagaaggtgtgaataggatcttatttggatataggatctctgcgtatgtagtcaagttaagatgtggtcatgaaggattagggtaaattctaatccagtgactggtgtccctataagaagagggaaacttcgacaccaatatactcagaggaaaatggctatgtaaagacagaggctgagattagatttatgctgccacaacctgaagaagagcaaggattgatggtaactcccagaggctagaagaggcaagaaagaatattttgatagagcttttggaggcaatatggacttgccatactcattgattttgaacttttattctccaagaactttgagatgataaaattctgttatttttagctgcacagtttgtggtaatttgttatggcagccttagaaagtagtacatagaggatgttacccagaaaaaacataaatgaacccttgatatacaaaacatggatgtattttaaaaaaaaaatttaaaaagaagttgaaatgaaaaatgcatgtagtatgatgtcctttatatacagttttagaaaggtaaaactgttaataagataaaggagaccagtattttcctttgttcagatgtgtgaggaattcactgcaaagagcatgaggtagttttatgagaaaaaaagaaatactcaatatctttttctatatagttattgatgtatatacatttgtcaatataaatcaaattgtacacttaaaatgactgcattttatgctatacaaatcatagctcagtaaagtttattttaaacagaaaagaaatatatgcattgtagaaaacttaaaaatatatttaaaatgatgtttatataattgtattagaaggaaatcactgttaaattttgacacaatcatgttctatcctaactttctcacttgtcacatcaatttcccaaatcaacaagacactttaataggactataactttctaatctgtatgacagttgatatagtttgggtgtcttctctaaatctcatgttgagatgtaatcctcagtattggtgttggggcctggtgagaggtgtgtggatcatgggagcacatccctcatgaatggcctaccaacatttccttggtgatgagtgagtttacacaagatctagttgtttaaaagtatgtggtacatccccccttctctcttgctcctgctctggccttgtgacatccctcctcccgcttcacctttcaccatgagtgaaagctcccttgaggccgactctgaagctgagcagttgctattaatagcaccatgcttgtacaacctgcagaaccctgagtcaattaaacctgttttccttataaattacccagtttcagatattcctttatagcaatgtgagaaaaacctaacaccacagtctcatattacaattatataatttctttaaattttaaatataggtttggtaagctattgattattgccacaatttcagagcctgttattggtctattcagagagtcaacttcttgctggtttagtcttgggagggtgtatccatgaccagatggattcacagtcgaattctaccagaggtacaagaaggaactggtaccattccttctgaaactattccaatcaatagaaaaagagggaatcctccctaactcattttatgaggccagcatcatcctgataccaaagccgggcagagacacaacaaaaaaagagaatttagaccaatatccttgatgaatattgatgcaaaaatcctcaataaaatactggcaaactgaatccagcagcacatcaaaaagcttatccaccatgatcaagtaggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggatgtatctcaaaataataagagctatctatgacaaacccacagccaatatcatactgaatgggccaaaactggaagcattccctttgaaaactggcacaagacagggatgccctctctcaccactcttattcaacatagtgttggaagttgtggccagggcaattaggcaggagaaggaaataaagggtattcaattaggaaaataggaagtcaaattgtccctgtttgcagatgacatgactgtatatctagaaaaccacatcgtctcagcccaaaatctccgtaagctgataagcaacttcagcaaagtctcaggatacaaaatcaatgtataaaaatcgcaagcattcttatacaccaataacagataaacagagagccaaatcatgagtgaactcccattcacaattgcttcaaaggcaataaaatacctaggaatctaacttacaagggacgtgaaggacctcttcaaggagaactacaaaccactgctcaatgaaataaaagaggatacaaacaaatggaagaacattccatgctcatgggtaggaagaatcaatatcatgaaaatggccatactgcccaaggtaatgtatagattcaatgccatccccatcaagctaccaatgactttcttcacagaattggaaaaaactactttaaagttcatatggaaccaaaaaagagcccgcatcgccaagttaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctcatcttggacaaacctgagaaaaacaagcaatggggaaaggattccctatttaataaatggtgctgggaaaactggctagccatatgtagaaagctgaaactggatcccttccttacaccttatataaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaattttcgcaacctactcatctgacaaagggctaatatccagaatctacagtgaactcaaacaaatttacaagaaaaaaacaaacaaccccatcaaaaagtgagcgaaggacatgaacagacacttctcaaaagaagacatttatgcagccaaaaaacacatgaaaaaatgctcaccatcactagccatcagagaaatgcaaatcaaaaccacaatgagataccatctcacaccagttagaatggcaatcactaaaaagtcaggaaacaacaggtgctggagaggatgtggagaaataggaacacttttacactgttggtgggactgtaaactagttcaacccttgtggaagtcagtgtggcaattcctcaggaatctagaactagaaataccatttaacccagccatcccattactgggtatatacccaaaggactataaaacatgctgctataaagacacatgcagacgtatgtttattgtggcactattcacaatagcaaagacttggaaccaacccaaatgtccaacaatgatagactggattaagaaaaggtggaacatatacaccatggaatactatgcagccataaaaaatgatgagttcatgtcctttgtagggacatggatgaaattggaaatcatcattctcagtaaactgttgcaagaacaaaaaaccaaacaccgcatattctcactcataggtgggaattgaacaatgagaacacatggacacaggaaggggaacatcacactctggggactgttgtggggtgtggggagggcggagcgatagctttaggagatatacctaatgctaaatgacgagttaatgggtgcagcacaccagcatggcacatggatacatatgtaactaacctgcacattgtgcacatgtaccctaaaacttaaagtataataataataaaataaaaaaataaaattttaaatataggtttttaatagtttttgctttaaattattcaattcaattttacttattctgatacacggtttcagaataaaaataattattaatagtgttttgcagttatgatatttttaattttataattatttaaaagtaccttttcttatctatttacacatattcttgattgtttagatattataatgtagtcaaggactcggtacatctaggctgatagcaaaacattcactcttgttctgatttgcctattatatatttcagtgatgattcatgaaggttttcttgtttttactttttaaaataatttcacgtaattttaggtgacagaataatttttatgtttcgaaattaataaaggtgaattaatgtcatgtggagatacattatatatatatattcaagtgaattcgtccagaaagatggaattttaaatttccatttcttaagtctctcagtaatttctaaaatttcttaagatattatctatgttatttgtattaattttttattttattttacaatttcattgtttcttcaaatatatatttctattatattttctaacctgtaatatctcatttataaggaaattattgattttgtatatttagtttataatcatccagtttacttctattacttgcagtattttgtagttgcctcttttgcattttctatttttctaatcatagcaccttaaaataacgattattttgtcatcaattttcaaataggtaaattactgattcttttcttattgtctgagcaatacactcagactagtattaaataatcctgatgacagtgcatattatttcttgtcttttattccaatgaaaataatgttggctcttaggttatggtaaacttgcactgtggctaagagtatgtcctatggagaaattctgcatttcctagttgaactttcagtgactcaaactcctgagcctttttcttcatttgaaataaagaagctgatagtgccttatcttatagagttattgtaaggattaaatgaggtaacaaatgtaaaatgtttactacggtggccaacatattctaagggctcaatgttagtaacatcaggtatgaatgctaaattaaatgtctttctgtggacatttcttctgtggagctatttttttctcattctatttatgttatagataaaatatgatttagtatagtaacatattcataaaagaaaatataaagctattttttcattgatgaaacaataatttcctcaccacagaatagcatcattttatacacaaatgagtttgatttgctagggggggtttgttgaaaatatattttaaattagcatgtgcatgatcaggctgtacaactttgtgttattatctataaggtcatggtattagttttaaactagcttagcaaaatataaatcttagttatttttataagtgacagaagagtttatacagcatattaattatccgatcttgaaattttaaataaattctctgtaaaaccaaatgaaactagtgctatatttttagtaatgctttattaccttttttaatattttccattgtcattgtttctttcaagacttt

SEQ ID NO: 1298 - DNA, 1892 bp, Homo sapiens
tgtaaagttgtgttatgattcaaaattatacatttaaggacttgtgaaggactcattttctttttttttcttctttttatttatttatttattattatactttaagttttagggtacatgtgcacattgtgcaggttagttacatacgtatacatgtgccatgctggtgtgctgcacccactaactcgtcatctagcattaggtatatctcccaatgctatccctcccccctccccccaccccacaacagtccccagagtgtgatgttccttttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccaaatcatgagtgaactcccattcacaattgcttcaaagagaataaaatacctaggaatccaacttacatgggatgtgaaggacctcttcaaggagaactacaaaccgctgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccacatcgccaagtcaatcctaagccaaaagaacaaagctggaggcatcacactacctgacttcaaactatactacaaggctacagtaaccaaaacagcatggtcctggtaccaaaacagagatatagatcaatggaacagaacagagccctcagaaataacactgcatatctacaactatctgatctttcacaaacctgagaaaaacaagcaatgggtgctgtttttaataaatttaataagtggtgctgggaaaactggctagccatatgtagaaagctgaaactggatcccttccttacaccttatacaaaaatcaattcaagatggattaaagacttaaaacgttagacctaaaaccataaaaaccctagaagaaaacctaggcattaccattcaggacctaggcatgggcaaggacttcatgtctaaaacaccaaaagcaatggcaacaaaagccaacattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatctcattttcttaaattataaatttta

SEQ ID NO: 1299 - DNA, 26022 bp, Homo sapiens
ctacttcctttaccattgtgatgattctggatgtgatcatttaagaaatggctttgtaaaccataaagtgttctgtgaatgtacagcatcattattagtattgattccaacaactgagagagctataattgcctgtaataagattgattatgcttcacgatataaccaataaactagctaaacctcaaattctaatccccaaatgttcgtacaaaacatgactgaaaacaaatgaaatcatattgatcagctctaaaaataatagaacctgattataacatttgtcctgtggcagctgcttttatccccctatttctcatcatatatcacacagagaaaagaccctttttctcgtgcctgccatcatttatcctttaggaaaaaaagacctctcttctctatctcctcaaacttgaaagataaaacaagatataatgaagaagtgtgaagagcagagaattagtgagtctactcctttttcctccttttgtaagacggtttgatttgattcaatatcagcccagaaagatggaggatatttcttttggtggggttctgtcaacagaaattagacaatctaatttaaggaaaataggaaggaaaaaattcaaacttactgctattttacaatccaaaacccagtatgtagaatgaatatctttgaatcattggtatgtaaggttttcaaaacactgaagctgtccctttatcaggtctagcatttcccctagaagcaaatgataaaatatgaagagtaaaaactgtttcaatatcattataaagtacagatttgtagttctgtacattcaaaatagaaaataaaaaattaaacttaaggatttaatctgatttaggcctaatgaactttgctcaatagtgtgttaccaacatctagccatttcaaaaaatcacatctttaccattttattatttacataattaagtctctcttcatctcacaagtctacagaaaccagtactggtggttacaagttaaagtgtccactcattttctctcataacttatctctgaccttgtcaaatttcctctccaataatatgcgtcatataaatgtatagtacttaatatataaaatgtcaggcatatacatagaactttatagtttccttaacactttcatatgtactgttatatttataattaagcatattttaaatggccgtttttaagtggtcatcattaaaacacagagtatctactctgtacttagaaaaagaagcaaattttagatcacttactttttgacacttatctttagtgactaagacaaatatttatctaatttctatctgcaacaagtttttcaattgctttaatcaccgttctctgatctattatttatacctcggcaagtttttttaatcaatcagcttacttctttttttttgtacaaatagttttatctttaaaaaatcatttcatagatcaaaataccataggaaccaactttttaagtcttagatgtttttcatatatcatttactggtgttaaaaacagatttcttacctctttatttgacttcacattgtctgcatcagctctgctctctcaatcaactctgccaactatagaggtcaggaacaataacatgtaatctttagcttttctgaagttgaatttcctgtgtctaactatatttgatcttttagtagaggctttgaaatggggttagcataataatttgttagtttataaataaaggcatgtggtcaatttttggcatgtcatgagttgtttttgctgagaacaggatgtgagtacactggtgagagtaacttaattgtatttgaatttttccacatcccattgtgcctaatacaccacttgccacataatcagtactcaatacatgcctgctaaattttaattatgtaaataatgaaataatttaagattataatttggatttattttttaaatgttgaactgaattcctgaattagccaatgtttggtgcttagtctggaattaaagacccccagattatttcaaaagctctcccatagagtaataatacacatttggccataataaaccttacttattacatcagtgttaggcatataacgtttaaatctctatcataatttcagatctttggtcaagacctgctacctaagcgaaaacaatttttaatataagagcaggcttagtgacaaactttcattcataccttaaagtgaataccattaaaatggcaaaaactgatttatatgctaagtttccaacacagacaaagttttccaatggctccagagtgcccaattatggaaagaaatgggaaaaaagcataaatacatgaacaacaacaaaaaaagccttactcctgccaaactacaaaaaaagacacatgggaaaacttgatatttaaaaaaaacaacaacaaaaagaatggatgggctataatgcagcacttttaaaaggaaattacagtaaggcactcaagcaactaaatataaaaaatttcaagaaagaaagtcaaaactacttcgagttgtttatttttttattttttggaagcacaaaactcatagggtctataaaacaataacacaatttaaaaaagtaggcaacaatatgatgaatagaacactcccaggtcacacctcaatgttttattattattattattatacttaaagttctgggatacatgtgcagaacgtgcaggtttgttacataggtatacacatgccatggtggttcactgcacccatcaacccatcacctacatttggtatttctcctaacgctacccctcccataacccccccaccccctgataggccctggtgtgtgatgttcccctccctgtgtccatatgttctcattgttcagctcccactgatgagtgagaacatgcagtgtttggttttctgttcttgtgttagtttgctgagaatgatggtttccagcttcaaccatgtcctgcaaaggacatgaactcatcctttttattggctgcataatattccatggtgtatatgtgccacattttctttattcagtctatcattaatgggcatttgggttggttccaagtctttgctattgtgaacagtgctgcagtaaacatacgtgtgcatgtgtctttaaaaacaagctggtacaaaaagaggaaattcactagtcctggaatatctcagagataagatgactgtcaactactccaatatttatgtcacttttcaacagattgatttttgacttggattgtttttatgcaattaaaaatcataattaccttaaaatatttctaccctacatgcaatgtttagcatttaatgaaatgtaatgttgagaggagggaagcagggagagatggtggaatagaacactccagagatcatcccccctgcaaggacaccaatttaacaactagctatacagaaaaaaaaaaaaaagaccttcataagaaccaaaaatcagatgaaacctcatagtacctggttttaaattcctttcattaaaagaggcactgaatagatagaaaaaaatagttttgaattgcaaatgtcaccacttccccacccacctcaggaccactcccccccatcccctgacagtgatggtgtggtgcagagagtgtctctggattctgggggacaaagacaatgacaattgtgaggcactgaactcagtgctgttcagttagagcagaacgcaaaaccagatcaaattcagatgagacccgcctacagagggagcatttaaaccagccttagttaaaggggaattgccgatcccagtggtcacaacttgagttcccacagacctttccacaaagtggtaaactgctctgagtctctaagtgaacttgaaaggcaggctaagccacaaggactacaactcttaggaaagtcctagtgctgaactgtgcccagagacagtggactggggggagggtgatgtgacctgctgagataccgggttgaggcagtcaaaagagtgctggcatcatccctcccctaaccccagtctgctcagctcacagctacaaaagagacccattacttctgcttgagaagataagaaaaaagagaggggaagactttttcttgcatcttggataccagtacagccacagcagaatagggcactgatcagagttatgaggtctctcttccaggccctagctccaagatgacatttctagacacaacctgggccagaagaaaacctgctgcattgaagggagggactcagttctggcatcatgcatcacctgctaactgaagagcccatgggcccagaataaacagcagtgataactaggtactatgtcgagggccttgggtgagcctctgagacctgctggcttcacgtatcagcatggccaaagagaggtagagcaccaagttggctaatgtggtccctgattccaggaattgactttttttttttttttttgagacagagtctcgctctgtcgtccaggctggagtgcagtggcatgatctcggctcactgcaagctctgcctcccgggttcattccattctcctacctcagcctcccgagtagttgggactacaggcacccaccaccacgcccggctaatttttgtatttttagtagagatggggtttcaccatgttagccaggatggtctcaatctcctgacttcatgatctgcctgccttggcctcccaaagtgctgggattacaggtgtgagccaccgctcccagccaggaattgactcttaaatgatgtctctgaactgccctgggccagaggtgagcccactgcctgaagagtgattcccaggccaggtagcattcaccacaagctgacttaagagattgtggtcaaaacacatgaaaaaatgctcaccatcactggccatcagagaaatgcaaatcaaaaccacaatgagatatcatctcacacatctttagaatggcaatcattaaaaagtcaggaaacaacaggtgctggagaggatgtggagaaataggaacacttttacactgttggtgggactggaaactagttcaaccattgtggaagtcaatgtggcgattcctcagggatctagaactagaaataccatttgacccagccatcccattactgggtatatacccaaaggattataaatcatgctgctatacagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagttggaaatcatcattctcagtaaactatcgcaaggacaaaaaaccaaacaccgcatattctcactcataggtgggaattgaacaatgagaacacatggacacaggaaggggaacatcacactctggggaatgttatggggtggggggagggaggagagatagcattgggagatatacctaaggctagatgatgagttagtgggtgcagcacaccagcatgtcacatgtatacatatgtaactaacctgcacattgtgcacatgtaccctaaaacttaatgtgtaataataataattaaaaaaaaaaaaagaaaaaatgctcaatatcactaatcatcagtgaaatgaaataaaaatttaaaccacaaaaaaaaaaaagaaagagattttggtccttaagaatgcatcagcggtggtctggctgtactcctcatagcctgtggtggtgatggctatgaggagaggttcctctgcctttggaaaaaagagagaagagtaagagacagggcatcctgtggtttgagtgccacagctcacccatagtacaaaagaacaccaggtagaattctaggttttttgactctagtctctgactcttgaagggcatctctggacccatccagagcctgggggaacatgccacctgaagacaaggatatacacctggctggcttggccccctgatgattgtagagcccaagggcctagagcaagcacagattgtagccagggagtgattacagcaggccttgggtgagacccagtgctgtgctggctttaggtctcacccagcacaatcatagtggtggtggctacaggggtgcttgcgtcactccaccccaagatttaggaggcatagaacagagagagagaagctatttgtttgagagaaagtaagggaagagaacaagagtctctgcctgttaatccagagaattctcaagaatcttgtccaataccatcaagttggtacctctacatatcttcaaggtttacttcaaagcccacaggtttactgggcttggggtgccccttaaagcagatagagttttgatcacaacacccaagtccttccaaatatctggaaagttttcccaaaaaggatagctacaaacaggtccaggcatgaagtctaaaatgaatacctaaatcttcaatgcccagacactaaagaacatctactagcatcaacacgatccagaaaaacatgaccttatcaaatgaactaaataaggcactagggatcaatcccagagaaacagagatatgtgacattttagacagtgaattcaaaatagctgtgttgagaaactcaaagaaattcaagataacacagagaaggaatttagaattctatcagatacattcaacaaagaggttaaaataattaaaaagaataaagcaaaaattctggagttgaaaaatgcaattgatgtactgaaaaatatatcagcatcttctcagagcagaatggataaagcacaaaaatgaattagtgagcctgaagacaggccatttaaaaatacacagtcggaggagacaaaagaaaaaaaaaaacatgaagcacaactacaggatctagaacatcatctcaaaagggcaaatctaaaaattattttccttaaatatgagggagaaactttattcaaagggataataacagagatttttcacaacctagagaaaaatatcaatatccaagtgcaagaaggttatagaacacaaagcagttttaacccacagaagaataactgaagaaatttattaatcagtctcccaatgataaaggataaagaaaggattttaaaagcaatagaagaaacaagtaaacaaatagcatacaatgaagtgccaaagcatcttgcagcagatttttcagtggaagacttacagaccaggagagagtggaatgacatatttaaagtgctgatgaaaaaaaccttttatcctagaatagtgtatctagtgaaaatatccttcaaacttgaaggagaaataaagactttctcagacaaacaaaagttcaatttcatcaacaccagaactgtcctacaagaaatgctaaagggagtacttaaatcagaaaaaaaaaataatgttaataaacaataaatcatcacctgaaggtaaaaaaaaaattcattgttaatagtaagtatacagaaaaacacataatatcataacatttaaccgtggtgtgtaaactactcttatcctttgtagaaagaataaatgatgagccaatcaaaaataataactacaacttttcaagacgtacacagtacagcatgatataaaaagaaacaatatactaaaggaagggcaagagggcctactagacacagccagctggaacagttcccactaagggactgagacaactggcatgcttttaacagatcttcagagtaaaggtgctaagagtggagagaggaaagatacagaagctggactgaagagagagaaagctggaaacactgcatggggctactatgcactgggacttacttttgaaccacaacagcttcaggagtacgagtgagttgaactgtcaaggaccaaccagctctcaccatgggcccctggaaccctgacaggaggagacccctcaaccatcaccgacatgtgagttggcagaaagagctgcttagagaagtggtaagggcagcaagtcagtggatgtggaacccagaggatttcttgcaggaatgttggtagcagagcatggccaacaacagccatacccctatgcttgacttgatcccatagaagactttagccctaggagaactgtcagacctaatctctgcagggcattcctgcccatcagacatgactggtccgacttgagagccccttggtctgctggcctctcctggggccccagcctggcctgcctgctttcaaggcagtcctgggtgccatgagggcctacaccatattctctgcaccgatagattctgcctgaccagtggagagctccagtgaggtggtctctatggcaacacgctagcccacttgccccctccccatattgcagctttcccagggcgcatggcaactccccacatcacttttctggtgtgtgtctgcactggcaggttttgctttctttgccccactaggatacgggagtgtagtccacatcccaccccccacaaccgccattgcagacaacgtcttggcaggcacagggacagcaagccctgcccctgccagcaccctgtccttgggctaacactgcacagaaaacagcagatcctaccccagattgagtatcactcccgcttgtggggtagacaaggcacccagagctgcactggccagcaccccaccccaaaatcaacaccacatccagcacaaccacatacacagtctcaagtaggggccccacgacccccacagctgcattgcctccaacactgtggtgaacacccacagggaggcaggcaccccagcacctgctagcactctgctgaagctgctgcacctcaccacctctccccagtgttgtgggttgcaaacctaaaggaaccagataacaaagtcagagtaaaatgcaagtcccccagagttagagcacataatccaggagttggaagctgagtcttggcccctgaaaatcttccagaaacaaagccagttagctaaacctaccttataccacaatcaaaacctcgaggtcatcaaatatgataaaagaaaaaaaacattcaaaggttggcaaagtccaaaattgaagatagataagcccacaaaaatgagaaataaacagtgcaagaaccctgaaatctcaaaatgccagagtgcatttttttctccaaatgaccacatcacctttccagcatgggttctgaaacaggctgaaatggctgaaatgaaagaaatagaattcagaatatggataggaattaatatcattgagctacaggagtacgttgaaacccaatgcagagaagctaaaaatcatgataaaacaatttatgaggtgacataaaaatagccagtatagaaaagtgtaaatgtaaatacacccaacactggagcaccaagatacgtgaagcaactattattagaaataaagagatagacaggccccagtacaataatagctggaaacttcaaatcaaatggatcagacacttacatctaagcatcacactatgaaactactgaaagaaaacattggggaaaatctccaggacatttatgggggcaaaaatttcttgacaaacacagcagaagcataggaaataaaagcaaaaatggacaaatggaatcacatcaagttaaaaaaaacttctgcacagcaagacacaatcaacaaagtgaaaagacaacccacaagaatgggagtaaatatttgcatgctactcatgtgacaagggactaataacaagaatatataaggagctcaaacaactctataggaaaaaaggtaataatttgattaaaatatggacaaaagatttgaacaaacatttctccaaagaagaaataagagtagcaaatgggcatatgaaaaggtgctagcatcattgatcctcagagaaatgcaaatccaaattacaatgagatatcttctcacctcagttaaaatggcttacatccacaagacaggcaataacaaatgctggcaaggataaggaaacgcccacacactgttggcgtaaatgtaaattggcacaacgactatggagaacagtctgaaggttgctcaaaaaaactaaaactagagctaccatatgatacagcatttccactgctcggtatataaccaaaagaaaggcaatcaatataccaaaggcactcccatgtttgttgctgcagtgctcacaatagctaagatttggaagccacctaagtggcttgattcatccatcaagagatgaatgaataaataatatatggtatttatacacaataaagtaccattcagccacaaaaatgaatgagatcctgtcatttgcaacaacatggatgaaactggagatcattgtgttaagtgaagttagccagatactgggagacaaatattgtatgttctcacttattttgggaatctaaaaataaaaaaaaaaatacccatagacatagagagtagaaggatgattatcagaggctgggaagggtagtagggggttggcgggaaggtggggatggttaatgggtacaataaatagttgaaaataattaataagacctactatttgataacaaagcagtagtatagtcaataacttaattatattttaagataactaagagaatataattggattgtttgtaacacaaaggataaatggatgagggaatggatacccccatcctccattatttgcttatttcacattgcatgcctgcatcaaaacatctcatgtaccccataaatatatacacctaatatgaaaataaagtattctgaaaaaatcacatgtaatgaaaaatactgtgaaacagaagcatcgtaggaacctattaaacattaaatcttatcaaaagtgagagtccattaataaataaatatgatttgaacagtttttggggatcatcttttcttggaatatttatctttaggaaaagcatagtaaatgagaatttaatcagaaaatctgcaaaaatatgaatacagctaaagtcttttataaaccccacataagccagtgcttctcaaactatctgcagttaaacagcattttttttcaaaatccctaatttgttctagaccaataaatttgtaaagcacaataaaaataaataactagaaaatcgtaagagaaaaaataaagatttgaaaagacgtgcccacatcttttatgttcagattctacagacttaaaattaccctatcaaattgctataaaattttctcaagcttactttaaaattctctacttagcttgttgcagaccaaaaacaaacagcacactgtcaactgtgggcacctcactgtatgcatcacttattatccttaaaacaaaaatgaagagaaatttttagtaaacatatactaaatgaaacagaaagccaaaaaaagtagatcaggtgaaaacaaattttacctacagaaaatattttgtgttataataaaaggaatatttattgacttaagtgtaaagaaaccatttgtttcacatggtgcacaaaacatcccctataagtacactacacaaaatatttccaaaatcttctctaactgctatacactactatgttaaccatatttgcaatcaatcaactatttggattaaatgataaattttaatgctaaatttcatcttttaaaataagatttacatttcattaatacaataaagacttactgatgacccactatatgccagccactatgctaggcactaaagctgtgtgtgtcaaatctgactttaagtaatgttggtggaacactaaacttaattcttatgaactatttttctgccaaagatatggcaggtgaggccatctaccacagtttcattataataaagtatgagttggctaggtgcagtgacttatgcctgtaatcccagcactgtgggaggccaaggtgggcagatctcttgaggtcaagagttcgagaccagcctggccaaaatagggaaatcccccacctctactaaaaatacaaaaattagctgggcatggtggcgcacgcctgtaatcccagctacttgtcagtctgagacaggagaatcgcttgaacctgggaggcagaggttgcagtgaaccgagatcgccccactgcactccagcctgggcgatagagtgtaacttcgtctcagataataatagtaataattaataataataataaaatgtgagttattgcaagccttgggctggtttaaaatttttccttcagagaacacaacatattaagcctataatatctcatttctctctcatcagacttgcaaagaattaaaatagttttaatacacttcttgcaagaatgcagggaaacaagcactcatgtactactggcgactcggcaaactgttagcacttctttagtggcaatctaacaaaaattttcaaaatttgacatgcatatactgtttgactcagcaattttacctctttcaatttatcctctaaatatccttgcacatacgcaaaagatttatatccagaaaaccaactaaatattcatcaataaaggaatggtttattcatcaataaaggaatggtttaataatcacacacacacacacacacacacacagagagagagagagagacagagagagagagaaacaagcatttataatgaaatactaagtaaccagtaaaaagaatgaggtagctagctgtgtactgacataagaaaatcactgacatggttaactgaaaacaaatgatttgcagagaactacaatacagcatgattgtataagtgcatgggaaatttctggaagcatatccaagatattattgggagagttaaaggagttatctgaaatgggaaggaaactctctttttgtcatctgccctttaattctatctgaactttttcactatgcccatgtttttgaataatataaaaaatagaaaaaaagtaaaactcaatatcttgaccaatgttacctaccatttgtaattcataaaaagatatgtacctctcattgaggagtaataaaaataatagttcctttagcaatcaaatctttgtgcttccttttgtttacttgtctgtaaaagtacttatatattcttgaaaattagaaggcttcactagtgtctcatattaaacaccaagttgacaaactcaacatatttttatgttttataaaacaaaccctatataaagatttggaaaatactgatgggggaaaaccttgaaaaaataccttcaaacattttcatgaacttccattctcatgttctaaaattaataatacacatataggaaattaaaaatgtattattgttactatcaattgataccaattgaatgaacgtaatgctgaaattttctagaaatgcatacataccattgtttgcacataactatgcattgactattagcataatagtacccaaatactgcatgcatcctgcatttacttaggaaacctaaactagctcttttagacaacagggaaggaaaaaacacaccacaaatgtttcttctcatttacgtttaggtcccagtaaaatagtctcccattctgaaatttggtactctaaagatatccactgggattactactgggttttggtgtagatttcctactgtcatactgtcttattgtatcaatgacagtatttaaatatcttaatttcctcctctaagaaactgagctgtgctttcaaaagctttgatgaatataactgaccctagatctagcccatagtaattttgttaaaagtttaccttaagaatggactatatttcagagggtcaggcaaaatatatcaagggaaaattgcagaattacaaggaaatatcatcttgtggagtttcatacatacaaataaagttataaaagcacactttgagaggagagaatagcttgataggctgaacttctacgaagattttagtatctttcagtgatagaaaagaagttagaaagcttaaaatatccagtaaggaagacttatttgggtcaatgtcacaacaatatgtgagcttggtttggaaggttggaaaaattttaatctagtaaaaatcatatagaaacatttttctcatcaaaaaacaaaaagatggataaatcagtaaattatttatggtgataaatagcctgagatgtgggagtaaacaatcgaatcaattgtatcttaacacattaacgtgttaagaaacacattaatatcatctaagacattcagtaaaatgtatatgtttatatagatgataaaagtgttaatgacatggtcccttaaatcaagaagatatgatttttattcaggagacaaaataaataaaagtggaacaaaacataacaccagacagaatatgatcaaatattaaactctattgtccagtcaatacatgttataagaaattccaggagaatggcgtgaacccgggaggcggagcttgcagtgagccgagatcccgccactgcactccagcctgggcgacagagcgagactccgtctcaaaaaaaaaaaaaaaagaaaaaaaaaaagaaattcctaaaggtgcaagtttgaaggctggagtattgaggaggtgaaactcaagttgatattattaagatagatattttcttgataagaaaggaaagggagaagaagaatgctcttctccatttcacatcccccgcaacagacacacacacacacacacacacacacacacacacatacatacacaaatggtcttatattttgttttcatattctataaagtttgtattaatagcatagggataaatgagaaaccagacatataaaagatattaatttctgattcccaaagtagcttttaggacctctaagttctttgggtaagaagaaaagtgagagaaatggaagtcggtgtgctaacaaagtttagttggtttgtgacataagacataaaatacaactttacaacctagttcatcaacactgcaggtactggacaaattgtttacaaatatccttgcagttccaatggaagaactgtgggtgtcttcagcacaggattctgtaattacctttaagaccaagagtaactgtgagtggacgaaccagtttggagaaaatgccttcaaaatcttaaacaactacaaattattatttcaaatattttgaagactcacatatatatgcaattatgtatgcatatatttataatacagtactgagtatatgcacaacaataattatatgttcagcaataaatccaagtttatctataacacacacctacatatgcatgttattttcatttttatatttctacacttcagaaatttacccatgagctgaatcagaagtgtcaaagcatagtaataaaagctacttacaagcagcctaattaccatctctagctatgccctgaaacttaaatcagacgtaacaaagacacattatttaatctgattaacactagcatctatccccagagctcttctgttaaaaatctctttctgtcaggcctgtatttaccattgtcaatcagactacattgtttgaatgtcattttatttttatttttttaaaaattgtataccatttaacatgttttatttcaacatactagatcttttaatgcttcttagaattcaaaatgaattatacaaaaatctttgtatttcatgtcatattatataaggaaatcaaatttggaagaataattcatgctgttttaaatttttacattacttatacattttaatagctaatcaactcttaagcatacttttttgttttattattttattttattttttattttattttattttatttttccttaagttgttggagtacaggtggtatctggttacatgagtaagttttttagtggtgatttgtgagattttggtgcgcccatcacctgagtagtatacgctgcaccatatttgttgtcttttatccctcgccactttcccactctttcccccaagtccccaacgtccattgtatcattcttatacctttgcgtcctcatagcttagctcccatatatcagtgaaagcacacgatgtttggatttccattcctgagttacttcacttagaataatagtcttcaatctaattcaggtcattgaaaatgctattaatccattcctttttatggctgagttgtattccatatatatatatatcacagtttctttatccattcattgattgatgggcatttgggttggttccacgattttgccattgtgaagtgtgctgctataaacatgcgtgtgcaagtatctttttcaaataatgacttcttttcctctgggtagataccctgtagttggattgctggatcaaatagtaattctgcttttagttccttaaggaatctccacactattttccatagcagctgtgctagtttacattcccaccagcagtgtaaaagtgtaaaagtgttccctgatcatcgcatccatgccaacatctactgttttttgattttttgattatggccattcttgcaggagtaaggttgtattgcattgtggttctgatttgcatttccctgatcattagtgatgttgagcattttgtcatatgtttgttggccatttgtatatcttcttttgagaattgtctattcatgtccttagcccattttttgatggaattgtttttttcttgttaatttgtttgaatttgttgttgattctggatattattagtccttggtcagatgtatagattgtgaagattttctctcactctgtgggttgtctgtttatgctgctgactgttccttttgccatgcaaaactctttagtttaattaggtcccagctatgtatcttcatttttattgcattcgttttggggttttttggtcatgaaatccttgcctaagccaatgtctagaagggtttttccaatgttatcttctagaatttttagagtttcaggtcttaggtttaagtccttaatccatcttgagttgatttttgtatatggagagagatgaggatccagtttctttctcctacttgtggctagctaattatcccagcaccattttttgagaatggtgtcctttccccacttgatgttttcgtttgctttgtcaaagatcagttggctataagtatttgggttcatttctgggttctctattctgttgcattcatctatgtgcctatgtttatagcagtgccacactgttttggtgactattgccttatagtacagtttgaaatcaggtagtgtgatgtctccagatttgttctttttgcttagtcttgctttagttatacaggttcttttttggttccatatgatttttagaattgtttttttctaattctgtgaagagtgatggtggtattttgatggggattgcattgaatttgtagattgctttcagtagtatggtcattttcacaatattgattctacccatccatgagcatgggatgtgtttccatttgtttgtgtcttttatgatttctttcagcagtattttgtagttttgcttgtagaggtctttcaactccttgcttagatatattcctaagtttttgttttgttttgttttgttttgttttttgcagcaagtgtaaaacgggctgagttcttgatgtgattctctgcttggtcgctgttggtgtatagaagagctactgatgtgtgtacattaatcttgtattcagaaactttgctgaattattttatcagttctaggagttttctgggggagccgttagggttttcaagataaatgatcagcaaacagggacagtttgacttcctctttactgagttggatgcccttcatttttttctcttgtctgattgctctcgctaggacctccagtgctatgttgaaaaggagtggtgagagtgggcatccttgtcttgttcccattctcagagggaatgctttcaacttttccccatgcagtattatgttggctgtgggtttgtcatgggctttagttacattaaggtatgtcccttgtatgccaaatttgcttagagttttaaacataacgtgatgctggattttgttgaatgctttttctgcatctattgagatgatcatgtgatttttgtttttaagtctctttatatggtgtatcacatttattgacttgcatatgttaaaccacccctgcatccctggtatgaaacccacttgatcatggtggattatccttttgatatgttgttggattcggttagctaatattttgttaaggattttagcatttatattcatcaagcgtatcactctgtagttttgttttttggttgtgtcctttcctggttttggtattaggatgatgctggtttcataaaatgaattagggagggttccttctttctctatcttgtggaatagtgtcaaaaggattggtacaaattctgttttgaacgtctggtagaattctgctgtgaatccatctgtcctggaatttttgttggtaattttttaattaccatttcaatctcgctgctagttattggtctgttcagggtatctaatttttcctgatttaagctacgaggattttaattttccaggaatttatccatctcttctaggttttctagtttatgtgtgtaaaggtatacatagtagccttgaatgatcttttgtatttcagtggtgtcagttgtaatatttcctgtttcatttctcagtgaggttatttggattttctcttttcttttattggttaatcttgctaatggtctatcaaatttatttatcttttcaaagaaccagctttttgtttcgtttatcttttgtacttttttgtttgtttcaatttcatttagttctgatctgatcttggttatttcctttctcctcctgggtttgggtttggtttcttcttgtttctctggttccttgaggtgtgaccttggattgtctatttgtgctttctcagactttttgatggaggtgtttggggctatgaacttttcttcttagcactgccttagctgtttcccagaggttttgataggttgtgtcattattgccattcagctcagaaattttttaaattttcttcttgattttgtttttgacccaatgctcattcaggagcaagttatttaatttccatgtatttgcatggttttgaaggttccttttggagttgatttccaattttattccactgtagtctgagagagtgcttgatataattttaattttcataaatttattgagtcaccttttatggcctatcatatggtctatcttggagaaagttccatgcactgttgaattatctcaatagatacggagaaggcttttgataaaattcaacagtcctttatgttaaaaactctcaacaaactaggtattgacggaacatacctcaaaataataagagccatgtgtgacaaacccacagtcaacatcatactgaatgagcagaagctggaaacatccccattgaaaactggcatgagtcaagggtgcgctctctcaccaatcttattcagtgtagtattggatgtgctggccagagtgatcaggcaagagaaagaaataaaggcattaaaatagtaaaagaagaaggaatctatcctgtttgcgatgacataatcctatatctagaaaaccctgtagtctcagcctaaaagattcttaagctgataaacaacttcagcagtcttgggataaaatatcactgtgcaaaaatcactatcattcttatacaacaacaacagtcaagctgagagccaaagcaagaatgcaaccccattcacaactgcgacaaaaagagaaaagtaccaagaaatatagctaaccagaaaggtcaaatatctctacaagcagaactacaaaccactgttcaaagaaatcagagatgacaaaaacaaatggaaaaacagttcatgctcatggagaggaagaatcaatatagagaaaatggccatactgcccaaatcaatttatagattcaatgtttttactattaagctatcattgacattcttcaaataactagaaaaaaactattttaaaattcatatggaacaaaaaatccaaataaccaaggcaattctaagcaaaaagaaaagagctggaggcatcatggtacccaactttaaactatactacaaggctacagtaaccaaaacagcatagtactggtataatatcagactcatagaacaatggatcagaatacagaacccagatataagagggcgcacctacagctatctgatctttgacaaacctgacagaaacaagcaatggggaaatgattccctattcaatatgtggttttgaaataactggctagccatatgcagaagattgaaagcatgccccttccttacaccatatacaaaaattaactcaagatgaattaaaaacttaaatgtaaaaccctgaactataaaaaccctggaagacaaccgtggcaatatcattcaggacagaggcatgggcaaagatttcatgacaaagacaccaaaagcaattgcaacacaagcaaaaattgacaaatgtgatctaatcaagctaaagagcttttgcacacaaaaagaaaatacaaacaaacaacctacagaatgggagaaagtgttcacaaactgtgcatccaacctaggtctagtattaagcatctataaggaacttaaacaaatttacaataaaaagcaaacaaacccactaaaaattaggcaaaggacatgaaaaaatactcctcaaaagaagacatccatgtggccaacaaacatgaagaaaagctccacatcactgatgattagagaaatgcaaatcaaaaccaaaatgagatactctctcacaccagtcagcatggctattactaaaatgtcaaaaaacaacagatgctggtgaggttttggagaaaaatgaacacttttacactgttgttgggtgtgctgaattagtccaacctttgtggaagacagcatggtgattcctcaaatatctattaagacagaaataccatttgacccagcaatcccattactgagtatatacccaaaggaatataaatctctcaattttaaagacacatgcgtgtgtatgttcattgcggcattattcacaatagcaaagacataacatttacctaaatgtccatcaataatagattggataagaaaatgtgctacatttataccacggagtactatgcagccacaaaataaaaggatcatgttctttgcaggaacatgtacagagctgaatgccattactgttagcaaactaatgcaaaaaaaacagaaaaacaaataacacatgttctcacttataagtgggacctaaatgatgagaacacagaacaacccacactggggacaatcagagtatggaggatggaaggaggaagaggatcaggagaaatcactaacaattagtaggcttaataccttggtaacaaagtaatctgtataacaatctcccatgacacaagtttacctatataacaaacatccacacgtacccctgaacttaaaataaaagttaaaaaaattctgtgaaaaaagagaaacagcaaaaagttaaaagcagggaaatgaagttaaggcacagaatttttattagttttcttgttgcttcttttattatgcaaatagtgtgaagttgttaggtaaaataatgagttataagatggcattttcaagcttcatggcaacctcaaaccaaaaaacatacaatggatacagaaaaaataaaaagcaaacaaccaaatcgtatcaccagagaaaatcaccttcactaaggaagacaggaaatacagacagaaggaagaaaagaccacaaaacaaccggaaaacaaattttaaaatggcaagaataagtccttacttatcaaaaataccattaagtgtaaattgactaaaccctccaattaaaagaaatggagtggctgaacagtttttttaaaagcacgacccattgatctattgcctacaagaaacacacctcacatataaaaacacacatagactgaaaataaagggatgtaaaaagatattccatgacaatggaaaccaaaaaagagaatgagtagatatacttatatcagtccaagtatatttcaagataaacactataagaagagacaaagaaagtcactatataatgataaaggggtcaattcagcaagtggatattacaagtgtaaatatccacacccaacactggagcaccaagatatgtgaagcaaatattattagaaatagatagacaggccccagtacaataatagctggaaacttcaacaccccactttcagcattgggcagatcttccagacagaaaatcaacaaccacaaaaaaaaatcagacttaatctgcactataaaacaaatggatccaatatgtttttgcagaacattttatctaagtgccagagaatacacattttttttcccttggcacgtggatcattctcagggatagaccatatgttatgtcacaaaacaagtctcaaaacagtcaaaaaattgaaataatatcaagcaacttctctgaacacaatggaattaaacaagaaatgaataacaaaaggaactttggaaactataaaaatacatggaaattaaatagtatgctcctgaatgatcagtgggtcaatgaaaaaattaagaaggaaattgaaaaacttattgaaacaaatggttttatggcctgtcatatggtctatcttggagaaagttccattcactgttgaatagaatatgtattctgcagttcttggatgaaacgttctgtatgtatctgttaagtccatttgttccacggtatagtttaaatccattgtttctttgttgtctttctgtcttgacaatctgtctagtgctgtcagtgaagtattgaagtcccccactgttactgtgttgctgtctattttatttcttaggtctattaattgttgtataaatttgggagctccagtgttaggtgcgtatttggtcaggattgtagtattttcccattggacaaggccttttaccattatataatgtctctttttgtctcttttaactgctgtcgctttaaaatttgttttgtctgatattggaatagctaccccttcccgctttttgtgtccatttgcctgaaatgccttttcccacccctttaagtttatgtgagtccctatgtgttaggtgagtctcctgaaggcagcagatagttggttagttcttatccattctgctattctgtaccttttaagtggagcatttaggccatttacaagcaatgttagtgttgaaatatgaggtaccattgcattcatcatgctttttgttttctgtgtatttttgttttttgtttttgctttttaacttgtatttttcttttataggtcctgtgagatttatgctttaaataagttctgctttgaagtgtttccaggatttgtttcaagatttagagttccttttagcagttcttgtagtggtggcttgataatggcaaattctctcagcatttgttggtctgaaaatgactgtatctttccttcatatatgatgcttagttttgccgaatacaaaattcttggctaataattgttttgtttgaggaggctgaagacagtgccacaatcctttctagcttgtagggtttctgctgagaagtctgctgttaatctgataagttttcctttataggttacctggtgcttctgtctcaaaatgcttaaggttctttcctttgtcttaactttgtatagcctgatgacaatgtgcctaggtgaagatctttttgtgatgaatttctcaggtgttctttatgcttcttgtatttgcatgactagatctctagcaaggccaaggaagttttccttgattattccaactatgttttccaagcttttagaattgtcttcttcctcaggtacaccgattattcttagatttggtggtttaacataatctctggcctcttggaggctttgttcatattttcttattattttttctttgtctttgttggattgggttaattcaaagaccttgtcttcgaactctgaatttctttcttctacttgttcaattctattgctgagactttccagagaatttcacatttctaaaagtgtgtccaaagtttcctgaattttttattgttttttctttaagctatctatttccttgcatatttctcccttctcttcttgtatcattttttggatttccttgcattgggcttcacttttctctggcccctccctgattagcttagtaactaatctcctgaattctttttcaggtaaatcagggatttcttcttggtttggatccattgctagtgaactagtgtgatttttggggggtgttgatgagccttgttttgtcatattaccagggttggtttcctggttccttctcatttgcgtaggttctgtcagagcgaagattgagggctgaagctgttgttcttatttttttgtcccacagggtgttcccttgatgtagtactttcccccttttcctgtggatatggcttcctgtgagccaaagtgcaatgattgttgtctctcttctgggtctaacctcccagtgagtctacccggctccaggctggtactgggggttgtctgcacagactcctgtgatgtgaatcatctatgggtctctcagccatggataccagtgcctgttctggtggaggtggtggagggtacaatggactccgtgggggttcttagctttggtgatttaatgctctatttttgtgctggttggcctcctgccaggaggcgttgctttccagaaagaatcagctgtagtagtgtggagagggactggtggtgagcagggccctagaactcccaagactagatgccctttgtctttcgttaccaaagtaggtagggaaggacaatcagatggggacagggctaggtgtgtctgagctcaggctctccttgggtgggtcttgctgcggcagctgtggggaatgggggtgagattcccaggtcattggagttgtgtacctaggaggattatggctgcttctgctgagtcatgtaggctgtcagggaagtgggggaaagccagtggtcacaggcctcacccagctcccatacaaactgaagggctggtctcattcccaccatgccccccacaacagccctgagtctgtttctaggtggagggtgagtcgggcttgaaaacttgccggaggcttcctgcctcccagctgcaaaagaaaagggctttagttcttccccgatctgtgaagtctgcaattcggagtcataccctcccctgagttctggccaggaggcttctcgccccattcaagttgttacaaagttcagctagagaagtccttctccctgtggagttttaccgcctgctcctctggccaccatcctgatagatctctgtgatgccaagcaataataggctgcttggggatccagcaagctcccagggtccttctgctgcttcctctacccctgtattcactctgcttggctgtctaactcaactcagctccagataaagttgggaacttctctcacaaacagaccttcaggttctccagtgggggtgtgtgttcaggagaggggtttctccctttcccacttccagagttggagcactcacagtatttggggtgtctcccgggtcctgcaggaacagtccacttccttcagagggtctgtgggtcctctcaggattgctgacttgttcctgcggtcaatcttgagctaaaattcacaatgcaagcttccgcatgatgctctgtctggagctgcaattctgtcctgcctcccatctgccatgatgcctggtctcctctgaatgtcattttaattctctttatataaaatatcacaaaccagacctaaaatttctctcaagaccttttctccattctaatattttctttatggttggtggcactacaattattacagttttatccgtttcataaacttgcagttattttgtatttctccctattcttaactccttatatctctttagtaacaagtcttttatgttactaacctttagattcactggaatttcacatcacttttgttggttcttttctttcctctcagatattttcttttcactcaattttctagacttgtctctttctgc

SEQ ID NO: 1300 - DNA, 100482 bp, Homo sapiens
gagcaccatagaaacacttgaccaataacttatttttcttctagagcatatcccatccactatacccaaaaaaaagttcatgaataaaactatgatgcaaagggaaaagtactgcattttcaaatttccttcatgtcacatgctatgtgtgtctgttaataaatacagtataatcccaatggtgtgatataaaactctaagtgcaggcaccaatgctaaagttagcagtgctttcagaacaagcctaatttaaacatcaaacctcactaattagcatatttttccctggcaaattttgttttacaaactccggcctaaatctgaaaatcatggtagcttaataatcatagaattgtagaataataaacacggtactgagcacaacattgaattgcagttaagaagaaaacctgaattatatatgttatgcaattttctttcttcccatgattgaaaaattcttcttctaaactaaaaactgaaataaagacagttgcctgttttctatcaatttatttctactcagattattttaaagcatttagaaatggaaattccaagggagaaaaatcaggaatatctcttcccacagtctaatataagtttccagcttctataaatattaggtccctggagttcttgacattgaaatgtgatactttgtattacttttgtctatttcaaaggatagatcaatggctttttttattattattatttgattctagcttgaatttttctttttctctttcctctgcttggaacaaattcagttgcataaaaagacagtccttaggcacctactcattataaatcacttctcattctactttactaacgttgtaccatcagtttaaaaaggttcttcagaatattaaaagacttagaacaatacctctgaaaatggaattgggttttctttgaaatttcagatggttttctttttcatatggatatttgttgcccacatcccattccatttcttttcctaaggtctgcttcagtgtagaggtgataatcattccttgattcactcgaaacatttccgatataatgggcttctacattggttgtttacatctgtgtacgaagaatctcttcagctttctagtttgactagtaagcaaacatcagcaagacaatacttcactgtcttacttccttggcatcataaggaaaaaggccatttcagcatccgaaacctgggaagtcttttatctcctttccatttttataggtttaaggtgatttatttgaagaagcacttaggagaaaagagggcaagaatttaatacacatcacaggattctgcactacatgcctcactatatcttagtaaaacatattttggcataattggtggtgctggaatctttcccagaagcacagaattgcctacaatgggggtaaaactgaactgcctatgctaaatctagacagtcatttcagactgttaattccaccatatgaaaatgtcttttcaggccttaaaaatgaaaaaaaaaagcttcattcagaatgtttaagtatatcaaagagtactgtttcatggctagtgccaatgttcactgttaaacataggggcctcaaaggaaaaacagactgcttagaaatagaatattcatcaagttataatggttgataattatattgctacattccccagttgttttctaaagaagacggaaagcaacatttacatgttggcatcatatcaccaccaactggccaagagtgtttactaggaatgtttactaggaagaaaataatcaacttctaaaaacaaaacaaacaggaatagacaaacacagtatttgataagctcatggggaagctaaatactcctcaacttgcttttctttttttaattggcaattgagattgaatttcaacatcaaatctgagaaatactggcagctgagattctgtcaattctgtgagtccaccacttgtcaatctatattttagccttgaaaaatgttcaagagttggttcactaagtctgttttctgctttatgaacctggtccaaataaactattttatgcaattatttggtgacaacattagctgaatattcagtattttaaaaggtgatactgcttcctggtggttaaactttatttagaacaaccagatataaaactggaaacctgactggatttattgttaacctaagtgcagttctgacaatattcaggagcttctagtacttatccaggaagaatatatttctagttcttatcaaaccctcaaattcaccttctcaattgcagaactcatattatgacagagtacatatcttgtagatgtttgtatgtggtcaaaggtgattggactctattcaatacatatgtatttggaaaactatagtccgttctacagtgatgatccttgtagctttgtttagatgattatgtcagctctttccccttaatatttacctcatcaccaatacaattatttggctataggcaggggaaatgaggcttctgagtggctaactcttcagtatagatacattcctgataattatatacactatttgaccacatcactatgtcccttttaacattattatttctcattcaccactaaggaagcgtggtatctaatagcattcgagtttggcgctttgtctcaactctggctgccactactcttatctaaacctccttatttacaataccacaacaatttccaaactaatttcctagtctcaagtctctttgctctcaaatccattttctgcaccattgcccagctcaccattttcaaggatcacttgcaacttgtagtcttataattacaagctactggaaaggtaccctgttgtctactggatcaaatctaaattcatcaattggcaaagcaaacaacctataatctaacacaacactccctcacactagccaccaatattgaccttcagttctggccaggtgactcctcttgtcatcctatttcaactcccacaaaagtcatgacacatttttataatttaactattttttaagctgcaaaatgaatattataataatagaaaaatacaacagaattctcacaatttcataacaaatatttttcttttgtctatataataatagcaaatagtaatagtgatatattgtttgctatggattgaatgtttgtgtccccctaaattttatactgtgaaatcataatgtccagtgtgatagtcttagtaagtggggcctttgggagataattagatcatgaagttgaagccctcattaatgagattagtgccttttaagaagaggcatgaaagcttgctctttgtctctgctctctgccacttgaggatacaacaagatggccagttgcaaaacaggaagcatatcctcatgagacactggatctgctaatgccttaatgctgtacttctcaatctccagtactatgataaacaaatttctgttgttcaagccatctaattgatgatattctgttatagaagcctgaactgattaagacagctcttatcaggtttcatgccctattctaacgtctttaaaaatgtgacctctatacacagcatctattttgattggttggtgccagtgtcatactgcttctaaatacctgtatggtgaatatcattctggggagcagaagtggtcagagaggtttacatctatgctgaattagaagcaggagtactgaataacatttcaggcagaggaagtgacaggccaaggggcaccagggtccaataaaacatagcaaatttgggaaattgcaagagtcccagtatgcttggggtgaagagagagtatggaactgagaaagaatgcttgaaagaaacactagagtctgattactaagagccttaaaagtcatgaaagcaaagaagggactaaagttaggaaattgcctgttcagactagtatttcggaaactacttgatatgatttggatttatgtctccgcccaaatctcatgtcaaattgtaatttccagtgttggagatggggcctggtgcagggtgattggatcatgagggtggacttacccttgctgttctcttgataacgagtgagttctcatgaaatctggttgtttaaaagtgtgtagcacctccctttcactctctttctcctactcccaccatgtaagacagggctgcttcctctttgcattccaccataattgtaagcttcctgaggcttccgcagccatgcttcctgtacaacctgcggaactgtgagtcagttaaacctcttttctttacaaattatccagtctcaggtagttctttataacaatgtgagaatggaccaatacacaactactgcagcaatgtgggaaatagatttcagagattaggttgcaggcgtaaatagttgtatggggaaactctcttctgactttgtcacatttggctcactcaaactgtattctgtgaacagttttaagctttaaacatctttctcaagcacaaatggactacaccattttttttttttatcttttcagaactagctcgtgtgtgtccaacaggagcatccatttctgttctgtcacctggtcaccttttagcttaatgctttctaaggactggcaatcaaagttaaaataaaatccaaagtccttcctttggcttacaagggccaatatgatcttcttctctgcacatgtccatgtgttcatctcatatcactttcacactcacttaccatactccagtgacactggttttattactattatttgaataaatgaagtatttggcaatagttgttttcttctgcttgaaatgtacccacactctccccttctcaatctccagtgttactcagctggatcctttcgtgctcttcagatctcagtttaaatattacctttacaaaaaggtcttccctaactactaaatctaaataaccaaaacacttacatatccaaggtaaaattccatgcatagcacatattattctctgccacttttcttgtaatttgtttgttgatttcttagcaagttattgtctatatttcttcaacactaaaatgtacattatgagaagacaagaaacatgtctatctcattcattgttgaatttccaagtataggatataatatatgttcaataaatatttgttgacggaatagatgaaccaagcgagcactaaccatactgattcaagaaagctagaaatctgtttactatatatcaataaacaagtattaaaaataatacttatggtattgtttatgctgtgtttttctgcatattaaaacacaactgatgaacatacatggtgtgaacctcaaagaataacacagttattctgtattttgcaagcccttaaggaaatgtattctgtggagtttctcagtttgagagaagtctagtattgtactaataatatatgagcaaaaaatatagtgaagatgtggatgcaaaatataagagaccttgatccatacttaccagaatttcttgaatgtacacatgctgctattcacactacttttatcacacaaacatatcatctaggaggttcactggtggatatgactaaatgaatccatttctagtaactttttgttataaaacagacctatttattcaggagattatgttgttttgttgaggctttacatttacatatacatgtagtgaagataaacctttcatgcactcatttgttaaataataaattattgattactgcagacaaaaaaaaactgaccaccaagacagaagaaaaagtgcagtaataaatccatacatttttctttttaaaaaattttaatttaagttctaggatacagaacatgcaggtttgttacataggtatacatgtgccatggtgatttgctgcccctatcaacccgtcatctagcttttaagcccctcatgcattaggtatttgtccaaatgctctccctctccttgcactccaacccccaacaggccctggtgtgtgttgttcccctccctgtgtccatatgttctcattgtttaacttccacttatgagtgcgaacatgcagtatttggttttctgttcctgtgttattttgttgagaagatggcttacagcttcatccatgtcccagaaaagggcatgaactcattcttttttatgactacatagtattccatggtgtatttgtgtcacattttctttatccaggctataattaatgatcatttgggttggttccaagtctttgctattgtatatagtgctgcaataaacatacgtatgcaggtgtctttatagtagaatgatttctaatcctttgggtatatacccagtagtgagattgctgggtcaaatggtatttcttgttctagatccttgagaaatcaccacacttgtcttccacaatggttgaactaatttacattcccaccaacagtgtaaaagagttcctatttctccacagccttgccagcatctgttgcttgctgactttttaataatcaacattctgacttgcgtgagatggtatctcattctggtcttgatttgcgtttctctaatgaccagtaatgaggtttttttcatgtgtttgttggccgcataaatgtcttctttgagaagtgtctgttcatatccttaccccaatttttgatggtgttgtttctttattttttataaatttgtttaagttccttgtagattctggatattagacatttttcagatgggtagattgcaaaaattttctaccattctgtaggttgcctgttcacactgatgatagtttctgacctcttcaaggagaactacaaaccactggtcaaggaaataagagaggacacacacaaatggaaaaataaaaaactttcctgctcatggataggaagactcagtatcatgaaaatggccagactgcccaaagtaatttatagattcaatgctattcccatcaagctaccattggctttattcattgaattaggaaaaactactttaaatttcatatgaaaccgaaaaagagcccatatagccaagacaaacctaagcaaaaagaacaaagctggaggcatcacactacctgacttcaaactatactacaaggctacagtaaccaaaacagcttggtactggtgccaaaacagatatatagaccaatgaaacagaacagaggcctcagaaataacaccacacatctacaaccatctgatcttcagcaaacctgataaaaacaagcagtagggaaaggatttcctatttaacaaatggtgctgggaaaattggctaaccatatgcagaaaactgaaactggacccccttccttacaccttatacaaaaattcactcaagatggattaaagacttaaatgtaaaaccccaaaccataaaaaccctagaagaaaacctaggaaataccattcaggacataggcatgggcaaggacttcatgactaaaacacccaaagcaattggaacaaaagccaaaatagacaaatgggatctaattaaactaaagagcttctgcacagcaaaataaaccatatatttttctaaaatgctatttatgtcaatcaaatggaaatatcaggaaaactatttgagaagaattcacgaaagagagtatgcacgtgattaagaaatacgtgaaaagttgataaaccttattagttatcaagaaaatgcaaatgaaaccaccatgaaatatcctataaacccaccagaatgactaaaataaaaataccatattttggcaacgatatagagcaactataactctcttaccttgtgggtgggaatgtaaattggtgcaacaactttggaatactgttaagtagtatctactaaagctgaacatatgcctatcccatgactcaacaattccactttgacaattttgtatataaccagcacaaatgcctacattttgttcaccaagagacatgatttagaatgcttatgtcagcaccatttgtaagatcctcaaactggaagttttctattaacagtataatgaataaatattggtatattttacaaaagaaaatagtatatagtaatcataaagaaaaactgcaactgtatcaagtaacatagataaatcttactaacataatgctgagtgaaaatacccagaaacaaaaaaaaatgctactgtatttttcaataatataatgcagcaaacagacaaaactcatctatattagtagatattctgatagtggttacccttaggccatgagtaatgatgaaaaggaagcataaattagtttctagagtgctggtactcttttatgttttatctagatactgttttacattatagtgataagtcagcgattatttattagcccgtatacttacattatgttcatttttctgtatgtatatttaaaatgtaaacaaaaatttgaaaatgttgttttgagcacctcctatgctctaggattttttttttattgtggatgcatatacagatgaacaagctgatgtggttcctgctctcagagagcttactttttatttagagaaaatagacaagcagacaataagtatttacataataaaataataaaatatcagtgttataataaacatgacaaatatgttgcctaactacactgagtttactgttcactagaaaaactagaccattaaactgctaatttcaacaaaatgtgataaagttatacactctaaaataaagtgcactatgctagtctggagactgcagaaaagaagaagaatatgagttgagatctgaagcacgaggtagtagttagagaatggggaaggatatgtatgtttctaaataaatttaattccctgaaactctgaagctaagtttaaagagaatcactgaaacttgaagaccaaggggaaaatacagcagaatggggtacagtggtcatcaagaaccctattattaggccgtgtggacctagttcacaaacttggattttattctaagtgcaatgcaaagccaaattttaaggacaggggtcacaaaatatgatttacagtcttaaaaaatcattctggctgcaaggttaaaagaatacgtagctagatatcggttaaactattgtagttcaccaggatagatgataagttgggacaaaatgatagcaattggactggaaaaatggttaccagaggctagaattgatagtgggaaacttgggggaggtggggatggttaatagatacaacaagtagttggaaaaaatgaatacgatctactgcttgatagcacaacaaggtgactatagtcaataataacttatatgtacatttttaaatgactaaaagagtctaattggattgtttgtaacacaaggataaatgactgaagggatagaaaccccattctccatgatgtatttcacattgcatgtcttcataaaaaaatctcatatactccataaatatatatatatactatgtacccacaaagattaaatatttaaaaataaaaaataagtagactaatatgggatatattttgaagttaaagtgaactgacttagttcccatgttaaaaagtggtgagggactcaatcgtctttgattgacacttgtttggtacttaaatagctggatagtgcccattatgtaattcttacctatatataactggctcactctcttacttcatttaggtatctattcataaatcacctaatcagagagccttttcctgacttctctatctataatattagcaatttccatcactctttctctccttaccctttttattttccttcttaccatttataacctgacattttgttttttatttgttgacactttcatcagtagcagacatactccataaaatcatgaacattgtcagttttgttcattgttatagccgtcatctaaaatgatatctggcataatatatgtacaataaagttttgctgagtggatacatttttctgaatatatagaatactaatgagggtaaaagttagaagaaaatcaaagttttcattatttgaagtttgagctattacacatttcagtagagatcatgagtaggcagtggatctacaggtatgaaggtcaggaagaggtcaggaatagagatataaatttatcagaatatctatggcttctaaaatggttgaacatcataatgccatggtgctagtttgaggccttgcagttttgctcttgccctcttagaatgctgttctgagacttccatgtgaagaagctgtcttagcctattggaaaatgagagaccacatgaagacctgaggtggcacagccaatgctagcaccaactgcaaaatctatgagtgataccatcttgactcctacagccattatagctgccacctaaccatacaaataagatggatgagaacagaatagtcagctcacaagtttgtaagtaatagtaatttggtatgttttacaccaataaactttgtaatagtttgctaaatagcagtagctagctggagcagtcaacctgggtgaaactgaagaaaaacatgcagttagatgaataaattggagaaaaattgagacacattttgatgcatatatttgggtggtagaatggaacagaggggaatggaatgaatgtgttaaatgacaagaaatcctaaataacttcaatgttctatgagttgacagagaaagtaggaatagaaaaggagacttagaagaagtagccaaggggataggagaaaaagcagaaaaataaaatgtcacagaacaaaataaaatagttcacataaagagtagtaaattgtatgaaaaacttctgatagatgaaaagtacatgaacattctaaaataatcattatatttagggagatcacataaacaaaaataaatgtgatatatattataatgaactactgaatggatacataaattattcaaaaagtttaaactctacattatacaaacatcattgataattgatttaatatattggtaatcattttcatttttaaatgtattgttactgtgccctttactatgtaatctcctagtatgaaattgtttctaagagaaaacaatatttgcgtaaattatttcatcttgaaggtttttgtaggaaaaactaagttacaactttgaataatttatttgattaggaaaaaagtctggtactcaagaagggtagtatggcatttgccattgttgaaataattttagtctgacaaacatacctctcagaattctcttatgaaaatttacctttaaatgcaagaaatacttctttaaagctgaaatatattacctcattatttttctctgaaagtagacaacagaaaactcaattacttgagttttcaaaatttacttttaaatttattttatacatcttagcaattcataatgaattcaaagggtacaggaaatcaaatgcaactttataacaaaaacacctagaaaaagcaatctaagcatcttgcatatgcccatttgattattttacactgttgacacttgtgaacatcaatataagactataatggagactgacctacaaatatgctgcttcccttacctgtttacatttgagcattgttctgtgctacttctctacttactcactcttactgttttgatgtttaattgtcagaagcatacatgaatccagaaatatatagaccttttcaagttactaaattactgtacattgcctcactagtcaagtgaggttattgatgtaaagaaacttactgatgtagcagaaacattttatccttctgtgtgttgagcatttataattacttcaactgaaacccaaatagaaacacacacacacacacacacacacacacacacacacacaattgtcactacatcctcttcaaccctttaattctagcgcaagttgccataacaatctcaggtttcaatgaaaggtgtatggaaagatttatagttgaaaacgatgaagttaacttggcattttctctattttttctcataaatcactgaaaagcaaacagtatggaagaaaaaaatacaaactatatctgcaaagaaactaaaaggtgcctcaaatttcaaaggctaaaataagagaaagtctgcaaaagtattgatgggcaagtaaaattgaggggattcaaggagacggaatgcagaccttagtgaaatctggcaagtaaatggcatagcctgaaatacaaaatcaatgttcatttgtttgtcacatcaaaaagattgagtgatggtagtaactgaagcttttctgggccacattaaacataaagtcttgagaagctgtgaaaatgaggctgaatataatataaacatgcaacatttacaggaaattgactaccaataattcagggaaaaaaagaaagattctgcctacgctgattctagtttattgactctgaaaatagcacactcacaaccctttggcatcaggaaaatatccgagagtttagattatcatctttctcccaccctcatgcaggttttctaaataaacttatcttaggaaaaaatgtagctcattaagaactatgtaaaaaaaattaaattttggtttaaactctgacatatgaaatacttagaagttgtcactcctgtccttataagaaaaagctgaacacattgaaaaaaaaaaaagtaatttcaatgaatcgcaaaaggctgagtgtggaccaccattaagagtgacaaattcctggggatataatctttagggtgcatccagactattgtagattttgcctccaggaatttgatgaggttttcatagccagaagacaagaaagactcatcttcattctggtaaaagaggagaagagtaaccactttgaaatacacccacagaatttttttaaattacactttaagttctgggatacatgtgcagagcgtgcaggtttgttacataggtaacaatttatgaatttcttcataacaaaatcctaccaaactttagcagagccttaggccacctgggagaagggtatttctttcaatctagaaccacctattcttcctgttttatctaaggaaagaaaaagccaaggaatatttggaaagtcacagcctaaagacgcaggcccactaagagactgagatttaatcataatattatagaatacttctgctactctacatcttactaccacacaacagggatccagtatagtaacagtggattatagctgaaagaactacaagatacagactgtctgaggagaagtacctagggaagtccaaaggcaagaaggtatatgaaaacaaagacaccagaggattttgaagactttggcacctacagctacagcaaacattctaaaaagttcaactactagccaagttaacataaatcctaacactagaaggcatttatctcagatcctattacctgacacgtctggctttaaacagaaaatttcaaggcacaccaaaatacaagaacaaaacaaagtctaaagatacaaaccattcattagaaataaactcaaatattacaaagatgggattatcagacagtttaaaataacaatgattaataagttaaaagttctaatggaaaaagtagacaatttggaagaacagatgggtaccataagcagagagactgaaactctacaaaacaatcttaaggaagtattgaaaataaacactgttacagaaatgaagaatgtattggataaactaattagtagaatagacactgctgaggatagaatcagtgagttggaaacaggtcaataaaaacttccaaaacttaaattcaaagagaaaaaataactaaaaacaaattcagggctgggcgcagtggctcatgcctgtaatcccagcactttgggaggccgaggcaggtggatcacgaggtcaggagatccagaccatcctggctaacacggtgaaatcctgtctcttctaaaaatacaaaaaattagctgggcacggtagcaggcgcctgtagtcccagctactcgggaagctgaggctggagaatggcgtaaacccgggaggtggagctggcagtgagccgagatcgcgccactgcactctagcctgggagacagagcgagactctgtctcaaaaaaaaaaaaaaaaaaaaaaacaaacaacaacaacaacaacaaaaacaaaaacaaaaaaactcagaacattaataactatgggacaataacaatagatataacgtatgtataatgggaatatcaaaagcagaaaggaagaaaaaaattaattaatgataactgagaattttccagacaccaaaccacagatccaggaggccagagaatataaaacagaaaataaaatcaaagaaaaataagaaactacacttggggaaatcatattcaaacaaacaaacaaacaaaaaaagaccaagagaaaatcttgatgaaaaccaaataaataaagtgcattgccaatagatggacaaatgaaacaaattcaatggatttctcatctgaaatcatgcaagcaataagagagtgaaataaaatatttaatataatgaaagaaaaaagaaacagcaacccagaattatttactcagtgaacttgttcttccaaagtgaaggagaaataaaaactttttcaaacaaaaatgaggaacttcatcactaacagatctgtccagaaataaatgttaaaagtagctattcagagagcatgaaaatgatatagatcagaaaggttaatctacaaaagaaaagaaaacatcagaaaatgaataaaggagaataaaataaaatttttaaattaatcttattcttaattgagataacataactttcttgaaatcaataataataatgtattggatgattatagtaaatggataagtgaaacgaatgacagcaacattgcaagggatgggagggaggacttgggaatactctgttagaatgtatctaagtacatataaaatgatagagtgttatgtgatactgaacttagttaaaactacatactgctaactccagggcaaccactgaaaacagttttttaaaaagttgaaactgatacgcgaacagggagataaaatgagttcatctaagattttcattggaaacatagaaggcagaaaataagggaaaaaatgcaataaatagaaaatagttatacatatagtacatattaatacaaatctatcaatgataactttaaatgtgactagactaaaatataccaattgaaagacagacacaatcagagtgaataaaaaacaaggatcatgtatatatcatctacaagaatctcactttaaataaaaacaaataggttgaaagtaaagaaatggagaattatatactatgttaatactaatcaaaggaaagcctggatagctatattaatttcatataaagcagacatgagaacaaggatgataaacaggaatacaaagtgccattttacaatgaaaaaggggccaattatccaaaaagtctaaacaatgctatgtgtatgcatgtgaaaacagtgtcaaaatatgtgatgccaaaaaactgttagaaatgcaagaagaaataaataaatatactattatagttgcttggaaacatcaacatcctctctcagtaatcgatacatcaaacagaaagaaaacagtaattgacctaaacagaagtatcaaacgatttgatataatagacacaaagacataccccatccaaccacagtagaatgcacattcttctcaggtttgcttagaactttcactaaaaaacaatattcttgataataaaacacccctttacaaatttgttaaaaataaaaatcataaaattatgttctcagacaatggaattaagctagaaataaataccataaagagagctgaaaaatctgcaagtatctggagatttaacaacatatttctaaataacaaaaagaccaaagaagaaaactgaagaaaaaaataaaatattttgagtgacatgaatataaaattatagaccaaaaaaatttgagaggtgcagtaaaaatagtgcttaaatggaagtatatggcactaaattgatataatagaaaagaagaaagatacagaatcaaaaatctaagcttccaccttagaaaactcaagaggaagtcaaattatccctgttttcagaccacatgatcctgtatctaggaaatttcatagtctcagcccaaaagctccttaatctgataaacaacttcagcaaaatctcagaatacaagatcaacgtgcaaaaatcacaaacattcctatataccaacaacagtcaagccaagagccaaatcacaaattcaatcccattcaaaattgccacacacagaataaaataaaacaactaggaatacagctaaacagggaggtgaaagatttctacaaggagaactacaaaccatttctcaaagaaataagagatgacataaataaatgggaaaacattccgtgctcatggatagaagaaatcaatattgttaaaatggccatactgcccaaagcaatttatagattcaatgctatgcctattaaattaccactgacactcttcacagaactagaaaaaaatattttaaaatttatgtggaaccaaagaaaggctgaatagccaaggcactcctaaagcagcgggggcggaaagctggaggcatcatgctatcccactacccaacttcaaactatactgcagagcagtaagcaaaacagcatggtgctggtacaagaacagacacatagaccaatggaacagaatagacaacccagaaataagaccacacacctagagctatctgatcttcaacaaacttgacaaaaccaagcagtggggaaaggaatccctatgtaataaatggtgctcggaaaactggctagccatatgtggaagattgaaactggatcccttccttataccatatacaaagactaactcaagatggatgaaagacttaaatgtaaaaccaaaaactataaaatccctggaggaaaatctaggtgataccattctggacataagaattggcacagatttcatgccgaagacacaaaaggcaattgcaacaaaaacaaagattgacaaatgagatatcattaaattaaggagctcctgcacagcaaaggaaactatcaacagattaaatagagaacctacaggatgggagaaaatgtttgcaaactatgcatctgaaaaaggtctaatattcagcatctataaggaacttaaatttacaagaaaacaaaacaaaacaaaaaaattaaaaattggccaaaggacatgaacacttttcaaaagaagacataaatgtggctaacaatcatatgaaaaacagctcagcatcactgaccattagagaaattcaaatcaataccacaatgagataccatcttgcaccagtcagaaaggcttttattaaaaagtcaaaaaataacagatgctgctgaggcagtggagaaaaaggaacacttatacattgctggtgggagtgtaaatgaattcaaccattgtggaagacagtgtggtgattcctcaaggatgtaaaaagagaaatactattcagctatggaaataattataataattctctagtatgtctttcagacagtagaagcagagggaacatttctaatttattctttgctatcattactgtaataccaaaaccagataatgatattacaggaaagaaaaattataggacgaatttctcatgaacataaatacataaatgcaaaaatccccaacaaagtgttagtgaattaaatcccacaatgtatcaaaataattagacatcatgagcaagtgggatttattttaagtatgcaagactgggatttattttaagtatgcatgactgggacttactttaagtatgcaagactggttaaacatccaaaagtaaatcaatatattctaccatatcaataggccaaaggaataaaagtcatatgatcatatgaataagtgcagaaaacacatatgacaaaaaccaacactcatgattgcatctctgatgaagaaaattaaagaacgtctacataaatagaaaactatttcttcttgtaagagtgagaaatttaatattgttaaatgtcacctcttcccaactgtatatacagatttagtgcaatacaaatcaaaccaagctattttgtacatatggacaaactgattctagtagaagttttatagaacccgatatgggtaatttataaagaaaagaggttaaattgattcacagttccacaggctatacaggaggcatggttgtgggggcctcaggaaacttacagtcatggaagaagggcaaatgggaagcaaccatgtcttcacatggtgacaggagagagagagagagagagcgaaggggaaagcactacacacttttaaactacatgatcttatgagaactcattcactgtcacaagaatagggagggggaagcctgccccatgattcaatcaccttcttttaggcccctcctccaacacatgggattgcaactcaacatgtaatttgagtggggacacaaagccaaaccatattattccagcactggcccatcccaaatctcatgtctttcttacatttcaaaacacaattatgccttcccatcaaacccccaaaatcttaactcattccagtattaactcaaaagtccatgtccaaagtctcttgactttgacatggacttttgagttaatgctggaatccttcttgagacaagttgagacaagatgagttaatgctcatccttcttgagacaagccaagtcccttctgcctatgagcctgtaaaataaaaaacaagttagttactttcaagatacaatggggatacaggcattgggaaatggtcccattccaaaaggtagagattttccaacacaaaggggctacaagccacatgcaagtctgaagccagcagggcagtcattaaatcttaaagtcccaaaataatctcctttgatcccatgtctcacatccaggccacactgatgtgaggggtgggctcccaagttcttggggagcttagtccctgtggctttgcagcatacagcccccatggctaccttcattggctggcgttgagtgctagtggctttaccaggtgcaaagtgcaagctgttggtgggttctaccattctgggttctggaggatggtggccttcttctcacagctccactaggcagtgcctcagtggggactctatgtgggggctccaaccacacatttcccttctgcactgccctagtgaaggttctccatgagggctcaagccctgaagcagacctctgcctggacatctagatgtttttgtacattctctgaaatccaggtggaggctcccaaacctcacctcttgctttctgtgcacctgcaggctcagcaccacatggaagccatcaaggcttggggcttgcaccctctgaagcaatgatccaagctgtaccttggccccttttagccatggctggagctggagttgctgggacacaggatgccacgtcctaagggtgcacagagcaacagggcccatgaaaccactttttcctcttagaccactgggtctgtgatgggaggggctatctgaaatgccctggaggcattttccccattatcttggccattaacatttgactcctctttacttatgcaaacttctgcaaacttctgcagctggcttgaatttctccttggaaaattttttttttcttttttaccacatggtcaggctgcaaactttccaaacttttatgctctcctttccatttaaatacaagttccagtttcagatcatctctgttcatgtatatgaccgtgagaagcagccaggtcacaccttgaatgctttgctgcttagaaatttcttctgacagataccctaaatcatctctctcaatttcaaagttccacagatctctagagcagggacataatgcccccaggctctttgataaagcatagcaagagtgacctttactccagttcccaataagttcttcatctccatctgagaccaactcatcccggacttcgctgtccatgtcactaacagcatttttgtcacaacctttcaacaagtctctaggaagctccaaactttcccatcttccttcttcttatgagccctccaaactgttccaaactctgcccattacacaattccaaagtcacttccacattttcaggtatctttatagtaatgccccacttctctggtatcaattttctgtattagtctgttttcacactgctataaagagctacctgagactgggaaatttataaagaaaagaggtttaattgactcaaagttccatagactgactgtacaggaggtatggctggggacacatcctcagatggtggcaggcgagagagagagtgaagaaggaagtgctacacacttttaaacaaccagatttcataagaactcagtcactgtcataagaacagcaagggggaagtctgccccatgtttcaaccacctcacagcaggccactcctccaacacctggggattacaattcaacatgaggttttggtggggacacaaaaccaaagcatatcagagtcctgttcccattgcttattactgtcaactttgtcaaagatcagaaggctacaggtgtgtggctttacttctaagtttctctaacctgttccattggtttatatgtctgtttttgtataagtattatgccattttgatagctgtagccttgatgaatagtttgaagtttggtaatgtgatgcctccaccttgttctttttgcttagaattgctctgactattcaggcttttattgggtttcatgtaaatattagaatagttttttctaattctatgaaaaatgacattggtagtttgaaaggaatagcagcatggccattttaacaatattgattcttcctatccgttagcatgaaatgtttttccattttgtttgtgtcatctctgatttcttcaagtaatgttttgtaactctccttgtagggaactttcacctcctgggttagttgtattcctgtttttttgttttgttttgtttttggtttttttttttgttttttgatttttgtgtttttgtagcaattgtgaatgggattgcattcctgatttggccctcagcttggactatattggtgtatagaaatgcactgatttttgtacattgattttgtatcctgaaactgtactgaattttatcaattcaaggatcatttgggcagagaatggggtattctaggtatagaatcatatcatctgtgaagacatatttttactttctttctttctattttgatgccttttatttcattctcttgcctgattgctttggctatgacttctggtactatgttgaataagagtggtgagaattggcatccttgtcttgtcccagtacttaagggaaatgcttccacttttcacctgttcagtatgacattggatgtgggtttgtcaaggacatcacttattattttgaggtgtgatccttcaattcctagttttttgagagtttttaacatgaagaaattttgaatttttatcaaaagccttttctgcatctgttgagatggtcacgtggctattgtttttagttctgttcatttgatgaatcacatttattgagttgcacatgtttaaccaaccttgcctcccagaaataatgcctacttgattgtggtagattagctttttgatgtgctgctggatttggtttctagtattttattgagaatttttgcatctatattcaacaggtatattgatctgaagttttcttctttcattgtgtctctgccaggtttcagaggaaaactagctaaaatataaagacacaaataggttaaaagtgaaaataaagacaaagatattccatgcaaattataaacaaaagagatggctacactaatatcagacaaaatagactttatgtcaaaaacttttacaagacaaagaacaataataaaagtgttcatttttaagaagatataagaatataaatacataggcatcaaacattaaagctcaaaaaaataaagtgaaattaacaaaattgaagtgagaaatagatagctctgcaataatggtaaaagcctttaattctcaccttcaataatacatagaacaaccagagagaaaatcagtaagagaatagaggacttgaacagcactatagaccacttagatctaacaaacatatacagaacactttatgcaacggcaacagagtacaaatttttctcaagtgtacatgaaaaactctctagtatagatcatgttaggccacaaaacaagtctttctaaattttaaaagatttaaatcatacaaagtattttacccaatcactatgaattaaaactagaaatccatagcagaaagaaaactgagaaattcccaaatatgtgaaagttaagcagcataatcttaaatagcaaatggataaaagaaaaattcacaagggaaattggaaaatatcttgagacaattaaaaatgaaaacacaacataccaaaatttattggatgcagtaaaagcagtgctatgaaaaatatttatggctgcaaatacttagattaaaaaagaagaaatatctcaaataaacaacctttcgttccccaaggtactagaaaaagaggagcaaattaaacacaaggttaacagaacaaagaacataaaaaaattatataaataaaatagacaatatgaagccaatagagtaaattaatcactatgttctttgagaaaaaataataatatgacagatctatagacagattgagtgataaaaagaaacaattgtcaaataactaaaatcagaaatgaaacttgggtcattaatactaattttatataaataaaagtgattataaaagagtgctatgaagaattgtatatcaacaaattggattacctaaatgaaagtgacaaatttctagacacgcatggcctaccaaaactaaatatttttgtaaaagatagaaaatctgaatgcacctataactaataatgatatcaaatcagtgataaaaaaaaaaccttctaacaaataaaagtctaaaatctgatggcttcactggtcaattttatcaaacatttaaagaattaacaccaatatgtctcaaaatcttccccaaaattgaacaagaaggaatacttcttaactcattctatgagggcaaccttacctgataccaaatcaaggcaaagactgtaaaagaaaaccacagaccaacaatccttatgaattcaaaaactctaaaaaaactttgtaaaccaaattcaacagcacattacaagaatttattactgtgatgcaatgatggttcacaatacataaatcaatcaatgttaatataccacattaacagaatgaagaaaaacaaaatggtcatcttaattaatatataaaaagcatttgacaaaatttaacagattttcatgataaaaacactcaacatacttgaaattgaaagaaactacgttgacataataaaggtcatatataaaaactccacagctaacattttactcaaatgtaaaagcctggaagcctttcttctaagatcagaaacaagacaagcctgattttgtcacttctattcaatgtagtagtgagatttctaggcagagtaattaggcaagaaaataaaaggcatacaaaaagttgtgtaatctctgattacagatgacatgatcctctatgtctacataccctaaacattccacaaaaatgtattgcactaataaaacaattaggcaaacatgtagaacacaaaaataatacacaaaattagttgcttttctataaattaaaaataatcaatctgattagaaagttataaaaacaattccatttataacagcatcaaaaataataaaattcttaggaataaatttaaccacagacatgaaggtcttgtacactgaaaaccacaaaatattgtggaaaaaaaatagaaacaaaaaaatttaaaaattcaagtttattaatttgaggatataatcttgtgaagatgttaataccatccaaagagaggtgaaaaatcaacgtaatctctctcaaaatcccaatgacattatttcagaaatagaaaaataatcgtaaaattcatgtggatgcttaagggacctggaatagccgaaacaatgttgaaaaagaacaaagttggaggtctcatacttcctgatttcaaatactactatgaatgacattaatcaaaacagtatgttaccagcataaaaacagatatacaaaactccagaataatatagagagcccagacatacacccttgcatatatagtcaaatgatttttgataataattctaagaccattcaatggggaaataataagtttttcaacaaattgtgtgggggaaaactggacatccacgtgaaaaataatgaagttagacccttaacttataccatagacaaagaaaattgatcaaagacctacatttaaaagcagaaactatgatactcccagaaggaagtaatatggggaaaccttcatgatattgtgtttggcaataatttcttggctatgataccaaaagcacaggcaataacacaacaaaaataggtaagttggatttcatcaaaataaaatacatttgtgcatcaaatgacactatcaggagagtaaaatgtcaatgtacagaatagaagaaaatattcacaaatcatatatctggtacaggcttaacattcaggatatgtaaaggactcctacaagtcaacagtaacaaagcaagcaacccaattcaaaaatgggcaaatgattttaatagacatttctctaaataagatatacagatgaccaataagcatatggaaagatgctctacatcactacttgtcagaaaagtacaaattaaaactacaatgagatagaactttgcatccattagaatgtctattatcaaaaccacagaaaataataagtgttggcaaagatgagaaattggaactcatgaaatgcttgtgggcatgtaaaatggtgcagctactgtggaaaacagttcctcaaataattaaacataaaattaacaaagacaacagcaattccacttctgtctatataagcaaaagaaataaaagcagtgacttgaataaatactggcacacttatgtttatagcagtattattcacaatagtaaagaaatggaatcaacccaaatgcctataaatggatgattggataagcaaattatggcctatccatacaatcgaatattattgaaccttgactaggaaggaaatttggacaattgctacaacatggatggatcttgaaacattatgcaaagtgaaataaaccagacaaaaaaggacacatattgtatgattctacttatataaagcccccaaagtagtcaaattcatagaggcagaaaacagaatggtgttgccaagagccaagaagggggaacggaaagttattgtttaattggcacagagtttcagtttgagaagacaaaaaggttctggagttggatggtgtaatagttaatataaagtgttaacttgattggattgaaggatgagggtgttgccaaagggattaacatttgagtcagtttactgggagaggcagacccaccctcttatcagggtgggcaccatctaatcatctgctagtgcagctaaaataaagcaggcagaagaagttgaaaaagagcagacttgctgtcttctggccttcgtatttctcccgtgctatttgctttctattgtcaaacatcagactccaagttctccagcttgtggactcttggacttaaaccagtggtttgccagtggctcttgggcctttggccacagactgaaggctgcactgttgagttccctacttttcaggttttagagcttggactgatccatcactggcttccttcttcctcaacttgcagatggcctactgtgggactttaccttgtgatcatgtgactcagctatccttaataagctccctttcatatatacatatatcctattagttctgtccctctagagaaccctaatacagatggtgttcatgattgcacaaaaatgtgaatgtacttaatgtcattaattgaacgccatacttaaaatggttaaaattgttaattttatgttacgtatattttaaaaataacaaaacataactgcagatttgatattgcacagagcatgatacagcatgattaaataagaattcaataacaaaaaaataactgaagtgtccaaatgtacggaaattaagcaacacaattctaggcaattcataggttaatcaataaatcagcgtaaatcttaaaatattttaaagtaaatgattataaaaatatgacaggtcacaatgtgtgagatgcaacaaaagctgagagattatttatagcttttaatgcatattttagaaagaaaaaataaattatctctgtttccaactaaaaaaagcagaaaaagcacagcaaataacacttaagaaaaataaaggaaaaagtaatgtaaatctaatgtcagaaatgtaaaacagatatacaatagagaaaattcaacaaaagcaaacatttattattttataataaaattaataaacccataggaagattgaccaagaaatagacaatgcatggattaccaatatcagaaatgaaataagattcatctttaggatcctgaatacattaaaggataaaaagagcacattataagcaactttatgtaataaagttgacacattaaataaaataaaaaaattaaagagataatttgctaaaatgaatacaaaaagaaacaaagtttaaatagtaagatgatttattaaagaaattaaatctgcacttagacaaagaaaattctaatcctggatggtttcactggtaaactcttccaaacatgtaagaaagaaataatacaaatcttacacaaattcttatagacaagagaaattaaaaataaataccttccaacagtttgtatgaagctagtataaccataatatgaaaacctgacaaagatatttcaagaaaggaagactattggccatattaaacttggatgtaaaaattcaaaatattagcaaatataatccagtggtacatataaagcatagtgcatcatgaccaagtaaaatttattcagagaatgctaggttggtttaacatttgaaaatcaatcactataattctgcacattcacataataaaggagaaaacataagattatctccatagatgcagataaaatattgagaacattgaacagctatttatggtaaaatcctcagaaaattagaagaaagacatttctttaatgtggtaaataatgtccaatgaaatttaaagatattatccattttaatggtaaaatgttaaaactccctgaggttactactaatcaaagatgccaaccattatcccttctatttattattgaataaagattatagtcaatgcaataagacattgaaaaaataataaaagaatcacagataacttgtaagtatatgtataaaatctttaaaaatctggaaactattataattagtaaaataatacagccaagtcaatgagtacaagattaatacaaaatatcagcttttccatatactggccaaataaataggaaattatatttttaaaataccatttaaaatataaaatattaaatatcttgttaatatttctacagaaatatacacaagaattctacactaaaaactataaaatatcaccaagaaaaactgataacaacctgaataaatccaaggtcatggataagaggacttcatattgttataatgtcagttctccaaaaatttatctatagattccaatcaaaatctcaacaggctttttattgtgtccagtgagctgattttaaaatttatatagaaatgcaaatggcaaagaataaccaaggcaatctggaagaacaaagctggagaatttatactacaaaagtcatggcctcttactgaaatttaataaagtttaatattgacacaagaataaacaaatagaacaacggacaatctaagagggtccacaaatagatgcatacctgtattgatcatctagtatatgataaagttgaaactacatagcactgtggaaagtatcatttttcagtaaatgagtcacagggtcaatatgatatccaacatagggattaatttttgctcttacatgacatcataaaaaggccagataaacagaggacctaaatatcaaagaatttccataaaaatagaaatatcaaagaatttctttaaaaaatagaaaatttacgtgaaagtatataaagacacctttatgactttggagtagacacatattttcaaacaagacattaagattaccaatgataaatagaaaattgataaattggactatattatgacttaaacttctgttcatcagaagacgccaataggaagagtgaatagatagcccacaaagtgggaaaaggtatttacaaaacatattcccctcaaaaaaggtttagatccagaatatataaagagcttttatcaaataaataggaaaagagaaaatctttttttaaatgagcaaaaaactcaaataagtaccttacagaaatgatatttaaattgggagtgggtgctgagcttcattagtcatcaagagaaattaaaagtaaaaccagaactttataacactacataccctgtagaatggctaaattgaaaaagaaaaatgatgctgttgtaaacattcttctactaattgggtagaaatatacagtttatctgttgggtatatacttattagtgtaaagactgtctgaaaagtacacatatgttattttttgtataaacttccaaactgttttccagtgtttataccaacttgccttcccacagttgatgagagttctagtagctcttgaaatgtgtcttgatagcattcataataagcaagcagtagataaatggattctagtatgttcacaaaatggaatgctataaagcaaggaaaatgaacaaatttcaactacacacaaaaatatggttgaatcttataaacaatatgtaaaagaatctaggcacaaaagattacatattatattattttattaatataaagtttaaaacactaatctgcattttcagaagtcaggttagtgattaccttgatggtggagggagagaagtgtatagtgaccggaagtataaattttggtaagtgcaaagaaggatgggaaaggttaaaatattattggtgaaaagtgagcatgtgagcacagactttggtgtcacagagaggaaagagcccaggctttgggtttataccaaaagggatctaagtcttcactcttttactagctggttaaccctaagcaagttacttaacactctaatattcaagtattcacttattaacacagagatgaaaatccgtgctttacattgattttctgtgcattaaggaaaatagaacttaggtaaaaagaacttagtttcatggttggcatatgataaatcgtcaacaaatggtagcagttactatttttggtaacagaaattaacgtgtcacacagcgtacgataatgttaacctggtcctgtctgttgtaaatgatgtgtgctgtagagaaaagagctatatggatagataaactgcaactagagtgtaaagggcagggataaaacttgatattttaggcactggaaagccattgtagatttttaagcatgtggacaacataattcattcttgtgttttattgcaaggttgttttggcaatgaatatacagaggagactggaaagtaggcagtggcttctgaagtttaagttggtaaaagaaacttgcacggaaatccagattgactataatcaatcctaaaactaggattatgataaggtaaatacagtggtaagacaaatatatatttggaggaagaatcaacagagttccttgaaaagatgacagagattaaatctactgaggtgactctgtagttactaatgtggtagcataattttatcctttataaaaacgtagaaaataataggtaattttggaaaagatgctaattttattttggagcatatggaatttgaagtgattagccaggagtgggttttctataagctgtcaacaaaagaattttcacataaacctcctttatgtatgtgtgtgtcttatttttcactgttttgcattctgccaagttcttgctattattttccacagcttttactccagggttttttgctgaagattatttggaaggttaagctgtatagatttggtactttttggtgtggaaattagatctgaattaacatgaggaactacttagagaggaagccccaaagactgcttatttgtgcccaaccagccagctcctgcagagcaggtctttactatacttccacaggaattgtgtcaagacttgaagatcccactgtcacatcttacactcaacatgaataaagaaagctgcttccaattccagattgcacagtctgattccacaatcacgaatattttccccattagttgctgccaaggtaaacttcacttaaaattggtttatagactgacttcaagaaacataatgtaatgatgcatgatgagccaaacaaatagatagcagatattctcttcacataccactaatacttcttggtaaaaatttgcagtttcaggaaactgcaactcccctcaaccaagtctttttctttgtttctctgtctgcaaatcagagaaaaactaaatttctcataggagtgccaccaaaacaataagcctgattgatatcaagaattcatccagagtttatcctaccatgataatgtgctatgtgttgttcgagaagcttaaagtacaaagataactacttccagtttaaaaagtccttcaaccatttcatgaaatgagattccctgttgacagaacagaaccattattgacacgcaaagagagccatctatacatctaagtggtgcatgagtatgtataaaccctataatatatatactcatcagataggcatgcttacatctcagcaaaaattgacagtcatagtcattaaaatcagcttgggaggatttttttccttacctcttagtgagattttctgctctattggtgcaatggaaacaatgcttgtgctctccaattcaatctcttttacctactccatcaccaccaccagagaccactcattatctgtagcctaaaactatatgtttcccttggggcccaaggttctttgccaaattactttaaatgtttacgtttttttcctagtataaataactgattacaacatttgataatgagtattaatgttgaaataatttaaacaatgacataggattctaccctactccctttcaaaaggcagtaccactattttgttctatctgtacattttctttggatgagtctgtgtctgtgacaaaaccatccttcttctttctccaatacaattgctaacacaacatttatatttttttctggctttagcatagctacttacctgttataggataggatgaagaaaacttggaggactgggatctgaaacaaactctacacctggatgagaaacacacatttggaccaactcagtcaatggtgctgtgaacacaatccatcatccaacgtatagcattcaaagtgaataatagctgtactttgtaacctaggcaagcatgcctgtaggcagccatgtgcttcaactaatggatggataacagctatagggtagtgatactcaaagtctgggtaagcaagaggcagagtggaagatgtccaatggatagtagagctctagtcaccgtgctaaggttcagtaacaggaattaaggcaggaagatagaaatcaaagcaaaggcaagacccagatacaagagtattaggcagactacaaagccaaatgactcaagcacaagaatatgaactaaatcatatactttaaaaaaaatcagttacaatggaggaagttcacctgtagtaggggtaaactgactaagtctcagagtgctgaaaaacagctatttgtacatgttatcatctggatagaatttgtcctagagaaactgatagagatgaatgtacaggaaggctaattttttaagacaggggtcagaaaacttttctgtaaacagcccaacagccaatattttagacctaaggacaatgcagttacaactattacactctgccatcacaatgggaaagcaagcatagatgtaaacaaacaaacttctatgactttttttttaaattttaatttaattctggaatacatgtgcataacacgcagatttgttacataagtatacatgtgccatggaggtttgctgcacttatcaacccgtcatctaggttttaaccccacatgcattaggtatttgtcctaatcctcccctggtcccccactcccagacaggcccaggtgtgtgttgttcccctccttgtgtccatgtgttctcattattcaactccctcttatgagtgagaacatgcagtgtttggttttctgttcccatgttagttcgctgagaatgatggcttccagcttcatctatgtccctgcaaaggacatgatctcattccttttcatgcctgcgtagtattccgtggtgtgtatgtgccacattttttttttatccagtttaccattgatgggcatttggactggtccaatgtctttgatattgtaaatactacagcaacaaacatgcatattcatgagtctttatagtaggatgatttctaatcctgtgggtatatacccagtaatgggattactgggtcaaactgtatttctggttctagatccttgaggaatcaccacactgtcttccacaatggttgaactaatttacattcccaccaacagtgtaaaaacattcctatttctccacagcctcaccagcatctattgtttcttaaatttttaataatcaccattctgacttgtgtgagatgatatctcattgtggttttgatttgcatttctctaatggtcagtgataatgagctttttttcatatgtttcttgatcacgtacatatcttcttttgagaagtgtctgctcatatcctttgcccactttttgatggggttggttgttttttttcttgtaaatttgtttgagttctttgtagattctgggtattagacctttctcagatggatagattgcaaaaattttctcccattccataggctgtctgttcactctgatgctagtttcttttgctgtgcagaagctttttagtttaagtagatcccatttgtcagttttggcttttcttgcaattgtttttggtgttttagtcatgaagtctttgcccatgcctatgtcctgaatggtattgcctagtctttcttctagggttttatggtttggggttttacattttaagcgtttaatcaatcctgagttaatttttgtataaggtgtaaggaaggggcccagtttctgttttctgcatttggctagccagtgttcccagcaccgtttattaaatagggaatcctttacccattgcttgttttttgcaggtttgttgaagatcagatggttgtagatgtgtggtgttatttctgagatctctgttctgctccattggactataggtctgttttggtaccggtaccatattttattggttattgcacccttgtagtatagtttgaagtcaggtagtgtggtgcctccagctttgttcttttcgcttaggattgtcttggctatatgggccattttttgttccatatgaaatttaaagtaggttttctaattctgtgaagaatattaatggtacttgggcgggaatagcattgaatatataaattactttgggcaatatggccatttttacaatattgattctttctatccattgattctttctattctttttttccatttgtttgtgtcctcttctatttcattgagcagtggtttgtagttctccttgaagaggtccttcgcaacccatgtgagatgtatttctaggtattttattctctttgtagcaattgcgaatagacgttcattcatgatttggctctctgcttgtctattgttggtgtataggaatgcttgggatttttgcacattgattttgtatcctgagactttgctgaagttgcttatcagcttaaagagtttttgagctgagttttctaaatatagaatcatgtcatctgcatacagagacaattcacttcctttcttcctatttgaataccgtttatttatttctttatttctctctcctgattacccagaccagaacgtccagtactatgttgaataggggcagtgagagagggcattcttgtcttgtgccatttttctaagggaatgcttcccacttttgcccattcagtatgatactggctctgggtttgtcatcaatacctagtttatgttccatcaatacctagtttattgagagtttttatcataaagggatgttgaattttattgaagacctttactgcgtctattgagataatcatgtgatttttgtcattcgttctgtttatgtgatggattacgtttattaatttgtatgtgtcgaaccagccttgcatcccagggatgaagtcaattagatcatggtggataacctttttgatgtgctggtggattcagtttgcctgtattttattaaggattttcatattgatgttcatcagggatattggcctgaagttttcttttttcattgtgtctctgtcagcttttagtatcaggacaatgctggcctcattaaatgagttagggaggagatccttcttttcaattgtttggaatactttcagaaggaacggtaccagctcctccttgtacctctggtagaatttgtctgtgaatccatctgaccctgggctttcttttttttttttttttttttttttttggttgttaggctattaattactgcctctatttcagaacttgtttgtctattcagggatttgatttcttcctggtttagtagtgggaaggtgtttgtgtccaggaatttatccatttcttctagattttctagtttatttgcgtagaggtgtttatagtattctctgatgttagtttgtatttatgtggggtcagtggtgatatcccctttattattttttattgtgtctgtttgattcttctctcttttcttctttattagactagctagcagtctacctattttgttaattttttcaaaaaaccagctgctggattcattgattttttggaagcattctttgtgcctctatctccttcagttctgctatgatcttagttatttcgtgtcttctactagcttttggatttgtttgctcttgcctctctagttcttttatttttatctttattattatactttaagttctgagatacatgtgcagaacgtgcaggtttgttacatatgtatacacacaccgtggtggtttgctgcacccatcaacccgtcatctacattaggtatttctcttaatgctatacttccccaagctccccattccccaacaggcctcagtgtgtgatggtcccctccctgtgtccatgtgttctcattgttcaattcccacttatgagtgagaacatgtggtgtttggttttctgttcttgtgttagtttgcagagaacgatggtttccagcttcttccgtgtccctgcaaaggacatgaactctagttcttttaatagtgatgttacagtgtcgatttgagatctttcaagctctctgatgtggccatttggtgctataaatttccctcttaacactgctttagctgtgttgtctctttgttctcattggtttcaaagaacttcttgatttccagcttaatttcgtgatttacccaagagtcattcaggtgcaggtcattcaatttccatgtagttgtgcagttttgagtgaatttcttagttctgagttctaatttgattgcactgtggtatgagagactgttatgacttttttttttaatgttcaaaaaacaggtagtgggtctgatttggcccacaggctatagtttttaaaccctcttttagggtgacatttaatgatatcaggcgaaaggagaaataagcttaacaacagtggggcaaaggccaggccaaatactcttttcactttaaacaatgaattgggcttaagaccacagtcagccttttcttttttcattccttcctaactctaccaaaggactactctcaaatactcctgttgagtctttgtaattgaataggtctgttcatttatgtaacttagaataatataattaacttaaaaagataattatctaagaaaataattgagctaataaccaaaaagcacactagattccactattttacctatctctttatatacctgtgtttcctttctctagtttcatgattgcaatgtaacaaaatccttcttcaaagaaactgcataacctttgcctgtaaattctttacaacatagctatggcctagtcctttcagatgactgtataactaggaaaatgttcttacagaaaattaaggctacttcttattttgaagctttaagtaacgtaggtcagaagatataggtcagtaaaggacacacagaaactgcaaattctcagagagccctaaaatgttttctgaataatttatttgactgaaatcatgtggtgacctataggctgcaaaatataaatcatatgatcccactatactatctcctggtttggcttaaatgtggaaaatcctgactaatatagcacgcaatgatttttaaaaatacggaatttcccagaggaaaatataataataagctctttggcttggactaaataatattgaaaatatacattttcatgctttcctaacattatacagattgtgcagccagtcaatcgatgttattccattatctcagttgcatttacttctttggagtcaagacctttgaataaagtagttatacaataaaaagagtccatcccacgctttaagtgatactggtgcttatgggagaaagccattgtgagttgacaggtttgtacctagtctttcaaccaaacagcaaccactgggagttgacaggtttgtacctattctttcaaccaaactgcaggtatcatgttcaataaagctgccagccttttcactgaaagtgtacttataggcagaaaaataactattaaaatgactccatatggagtcttggggctccatgtttattctctttcagtgatttccagatcagatttgctcagtttataagtaaaaagattttcttcctagctctcggtccaggaaattcccattaggataaaaacatagctgtattcactcaacctctgacactatcacttggaatgacatttctgcaaactgagtttcagacaaaatcatattgaagtataaaccaaaagctgcatcagttttaccaacttccccgccacttgtaatacatttgttgccttctattattatggaaatacccaccctgtccctttaccccaagtaaaaataatattttaaatgacagtgaagagctcaaattcttaaatgtgatatcatatagatcatttatcccataactcttaacacatggtagaattcagattagattcttacacataatgtaactatatttctaggaagttcttaggctatatagcatacattgaagtaatcgccaccaaagattcagttaatagttgtattagtcagagttctctaaagggacagaagtaataagatatacgtatatatgaaggggagtttattaaggagaattgattcacacgatcacaaagtgaagtcccatgataggccatctgcaagctgaggagcaaagaagacagtctgagtcccaaaacctcaaaagcaggggacccgacattgcagctttcagtctgtgactgaaggccaagagcccctggcaaactactggtataggcccaagagtccaaaagcagaagaacttggagtatgttgttcgaggacaggaagtatccagcacaggataaagatgaagtcaagaagactcagcaagtctgctccttccaacttattctgcctgctttgttctagctgcactggcagctgattagatggtgcccacccagactgaggacaagtctgcctctcccagtccactgactcaaatgttaatctcctttggcaccacccttacagatacacccaggaataatactttgcatccttcaatccaatcaagttgacactcaatattaaccatcacaatagtgttatagctaaatgtctgattgaaacttttgaaaagacctatccaaaatatgctagaccagaattattaatggcattaaatacagaatccctgcttagtggtccatatctaaaaattcagcctgatccaactttacgttccttccaccattatcccatactcttagtatccattcccatgccggttctccagatttctgcttatataaattagaaaactgaaacagttgttttggagtatagcacactttctcatgggtcactaactagtatactctctctggtccctcttttatagccagtatattatgaaatttgatgagttaaaaaggaaaaaaagtatatgtgattctttcaaattgttgttgatcttagaatttttgggctattttcacacatttacaaatactagcaataaatactttccatagactgtgatactcactctgcataacattttaaaacactggctcaaccattttatataaaaagccaactgacaatcctttaaaaaatctcaaaataaggaccatatggctgcatatggctgtacagttacttaatataactggtgtattaattttctatcattgtgtaacaaattaccacaaaatagtagcttaaaacaccactcatttattagttcataattctgtagaagtctggcaaactatgattgggttctctgggtagaatttcacaaggctaaaatctaggtatttggcttgagtttttatctggaggtgctggggggaattttcattccaagctcatgaatgttattcacagtattcagttccttgtggttttagactgtggtccccaattctttttttatatgtactttaagttctggggtacatgtgcagaatgtgcccttttgttacataggtatgcatgtgccatggtgctttgctgcacccatcaaccagtcatctacattaggtatttctcctaatgttatccctcctctagccccccacccaccgacaggccccggtgtatgatgttcccctccctacgtccatgtgttctcattgttcaattcccacttatgagtgagaacatgcggtgtttgcttttctgttcttgtgatagtttgctgagaatgatggtttccagcttaatccatgttcctgcaaaggacacaaactcatccttttttatgaccgcatagtattccatggtgtatatgtgccacattttctttatccagtctagtattgatgggaggtccccatttatttactggctgtcagctgagtgtcactctcaactactaaaggtcatttacattttttgcatcatgtccctttccatattcaagctagcaatgacatgataagatgttctcatgtttcaaaccactgacatcttttatgactagccagagaaaatgctgctttaaagggtttatgtgattatgtcaggatctcccagataatttccctatcttaaggttgactatgccatataacataatctaatcacagaagtaagattcacaatatttacatcccaggtacagtgcaggatgcgtatatggtgggggaggaggaggttagtggtaaattgtgggtgccattttagatttccatctaccacacttaggaaaattggacttagtattattaattcatttaataaatagtttgtaatcccctactatgtataaggtgctgttctatttgaggagttattactttcaaccagaaattaaggtttaccttattttataattctgtaacaatatatgacagtgtcttagaacacaactttggtatgaaacagaccagagttgaatctcacttatatcattactggctacataatcttggatgcgttatctgagcttgtttctttgtacaaaaagtgagagtaataccagtatgtatttcacagggttgctgtaagaattaagtgagataatggctgcaaagaatttattaatagtacaatcttaatatatcaatcactgaataaatggtagtaagaagtgctgttacatgacttttgaaacacatatgacaatttggctgtggggtatttatatttttttctttgcaagatcaggcaaaatatactttatattcccagttttttctttcactgtaaactccactggaaggtatgttgatattcatgtttatggcaatgccttcaggcaccagttactataatatatatcaaaattacaattagctgaggccaataatactgaccctttatctgaaaagaatggcagctctgtagtgcttggattatctcagttcaacatttctttagctaagtggtctctgaaggatcattcttcctcttattataatagaaattagaaaaatgcacacacacacacatgcacacacacgtgctcactatgctcatcataattgtacctcaatatcaaagaaggaatgatgagaatctaaccactgaatttcactaatactgaaaacaccagtctctcattttagctgatagattagaaaacttttcagtacgttttaaaaatggctactttctaccactaagcacgtagtctatgagaaatcaaatttactaaaagataagtttaacaaagttcacatttgacgaagtacagggaaatgtacaaaaggcaaggcttggcagagcaatttatgagttttcactaatggagaactattctaaaatcaaagtaatacttatacttgtttaccgtctttatacagataggccaacaaccaactgccacatcttaaactcttgaaacaaatattttccatatggccttagagaaatagagttgttacataagttaggaaggatgatcctttatatttatcctgaaatttaataacgcagaatattgatcatctaatttaaaaactgacattaaaagaaggatggatcacattattgttctcattttcatcataattttgcttaaggctgaagttataatgacggagtgtctgcagcttacatttggtggcatcagggcctattacagttttaatttgctgattgcatttatttacaacagagctattccaataaacatgtgccaatggtttgttaccagggagatggttagttaccagggagattcaaagttgataaaagtctattgaagatgatgctccaatacaatggcattaaatacatttatacatatcaatactaatgtgcaatatttgaagtgtgagtattctattgatgatagccagtctctaccccaatatcctccagatactcatagcccacttggagtcttcagataggcactgaggcgcatagacagtcaactccatatcttagtcatcaaattaaagatttggtgaataacaacagcactgcaagctatttcttgagataactctatagaatttgaggcagttcaaagcagtccctacccagtgggttagccaatctaattaagcacctaattttgaaaatcgagccctcgattttattgcatactaagcagatggcttattgcaaaatgggggtgggaagaggtgggaatgaaaacttaaaaacttaacaaaagttacttgataagtcactctgacagtaaaaactagcagaaatcagataacaatataaactatgacttaatgctgacctttgagagtggccagcacactaaaaataagtcattttaattaaatacagatgatttaagagaaatcatatgcttctggcctaacataggtggattaggaaaagggaatattattagtcattagtacttttcattaataatttctggttctccttctggacaaatggcagaattatacttcctgtctccttggaattagatgtggccttgtgactcattttgatcagtgaaatggtgacctgtggcattttcagatggaagctttaagagccagtgtgagacttactgacttctttccttttctttgctacagtgactggcaatgtttgggattgcagaggctccagtagcctgggaaggtgagaaataaactttgatactttaagccaccaaaacattgggattctttgtttccaaaatatcctcctggcctatcctgattgctacagaaaccattgagctgatttctaggcgaagaaatgataagctaactaggatgaagccttatttctacatatgaggaagatgggcacaacatccagctctttccttaactttggaccaaaaaaaaaaaaaaaaaccctcctgaatctggatccaaaagttgttgtacacacttgcacaagttgattagtgcttgtagtttatgcttttatgcaatatttgcattgcagagagagtttcaagtaaaattaagaataaaacatacagcaaatttatttaaagtcctcctcgaacattaagtcataggaccaaggtcatgcatataactgttttggttgtatcatacagctattgatttttttttcagttggtattatttaagacagaagaatctctcccatgaatagtcaataagttttttacaagatgacatcatcagctatactatcttgtcttaggatactggcctaattttatgcattaaatgtagttatggaaaacacagtcttggaaactaaatgtgtacattaaattatatttgcttattgacttccattataattttagagtttatttcctattagaaagcatgcttacttgaaaatagaatatgaactacattttcaaagcctaacattcactttgagtggtattatcttggtctatgtgcatttaactatcttatgaaatatctcacagtaagtctgccaaatggaaaagtcattccttttttctattgtttgttcactgtttcttcaactaacatctactgcatgcattctatgtactatggaagataaaaagataaataacacatggttcctaccccaggaaagatcatttcataattatttagattatatattgaatattaaaattcaccataattattttatatccttggaaactctcatttactccgttaaacttaaatttaaaattaagtcaccacattgacacttcatgcactcaacagagctcactagttaaaaaactgtcatgaatataatttccattctgaattcaagaatttttaagtgattattacgtattactagcaataatgatagtaaaatttttaagtctttggaaagtgcaaggcataatatcattccatttttcttcaataacttttactaaatagtcaataactaagtatttctattactgaaacacagaccgaaattgtgtgaacagcagcagaatagatcttactataaagaaaccaaacttcagaaagctcaaagcattaagtaacatatgtacatctaatcagatgaaaggttgagtccagggacattgtctgaggcagcaaattcagtaacaggtataggcttgtaagctgtagcatacaacaggacagacgagttaagaaaaatggttcttaatccagtctatcattgttggacatttgggttggttccaagtctttgctatcgtgaatagtgccgcaataaacatacgtgtgcatgtgtctttatagcagcatgatttataatcctttgggtatatacccagtaacgggatggctgggtcaaatggtatttctagttctagatccctgaggaatcaccacaggcctgttgtggggtggggggaggggggagggatagcattaggagatatacctaatgttaaatgacgagttaatgggtgcagcacaccaacatggcacatgtatacatatgtaacaaacctgcacgcttgcacatgtaccctaaaacttaaagtataataaaaaaaaaaaagaaaaatggttctatgaagtaaatgactatggtggtgaattatgaatgtggtatgctagctgtttaatgtctaaccactttacattcctttctattccttgcttctcactgctctcagagagagggggagctctgtaagaattcttctgaggttccacttgttaaggtaggcctgaaaaatgcaaagatagagacctgttgctaagtttcccaggatcagtcttataaaccacattttttcctcagtggataaaatcttagaggtccacccagattcatagaggtgcccccagatttcctaggtatgaaggctttcctaaacacaatatggatttctttatgcctttgaacagctactgtctaggagagtgaggagagtcacatatggactttcaagaagaggagaagaactgtatgtgaacttccacaaagggttagacattcactctggaagtgaggcctattgtatggctgtctgtaaaccacacaatgaagctctgtggcatcttgagacatggcccactttccttggtgcagggttgccactgtcatgtgaatagtactagaagtccataaaacaagagatggaaagcaggaaagttggttacagcatgaaaaattaagaatcagtgtgcaagagcacaagacttgagataagctctgaaactagaactgtggctatttgctttctgtcctattttatacgtcctgttgtatggagttaggcagggtttttcaggcaagtgtttatagccagcaggaggggctgggccctgtaggtgcagctagctactgtctaagctaagggcaaaggcacgggccttttgggaggtacttacatcagtctttaaaggatctttgccactttggcagcacctttgatggcaggagagatgctgcaggcaagattccacctggtggaagagcctgtgcatgagcacatgttagccatacagatacgtaatctcattcactgccttactttattaattgaataaaacccaaagcaaaattaaaccaatgcaaaagcatggcaaacttgtatgtttaatatcatattaatggtcttgctgataaatatttacgtcatttattcatgattaggacatctttttatatagattagaaagacatacaaatggtaaggagcatgttctcttcaaactcttgagagactaatattaagtactgcccaggtttactcaactgacattcagttgtctacattttcaacataaaagtgagtgaactaaaggcagttttaaaaatctcttctaaaatcagtgtatatcaatcagttttgggagctacaagagacttcagcttctagtatgtcaacaaccctccattgctcaaccttcatggctttggggacctgcttcagtgctcctagtctttcctgtcctaatggtacaagtggattatatcaaggaaaacttgagattgctggaggcagcactgattcatctgtggaggtcaagggctgtacagccatgactttttgcaggttgatagcgccagaatcttaataagaggacccatgttagtgaaagaaaggtgactgcagcagctattcactcaaccctgaaaggctgaaaatggggtcacctgtcttggtatttcaattagggggttacagctactgctgccattgctgcttcaatcatttgctcattttttttcctgagaaggtacttctgatcctgggtctcaggacacctttttgactgggagtcttctgactgttggtcatcagcaaattgaggagcagggggggatttgagggagaacataaagagatgctgtggatgtatttcacatcttagataaaatttcagctgtgatctgtgtaggcagtagatattgctaataaaaaattctgctgtgaaaaaaattttttagtttgttctgagtatccctggatgagtactacagagcataatttgctctgtcctcacctaatcacagtagggtttggggcttctacattgaagagtgagtgtggtccttgccaaagagcagataagggaaataatagatcatctatttccctagggcaactaacactctaggtcttctacatctcaggatcccagtttcttcaggtttaatgtctaaaatgaggtgaagctcacagtctgaatccaattatatatatatatatatatatatatatatatatatatatatatatgatatagattaatataatctctatattatattattaatataatagaatacagatattaaacatatatatatggctgtattttatatgaaaacaatcattctagaggatgttgtaagctatttctagattttttgcaaaataaaacttggtcattatataataactgacaatgataatagttacaacaataaataagatactgtttttcaatggtgactacatgtacatgccagtcactgtgtcaggctttttccctttatttgtaactaaattgcaataggagaatatatcatattatgggggtagggataactctggccatctcagaggaaaaaacagaaaaagagaggaaataaatgacattaattatgtttgctttgctgaagagtgtgtgaaacagagaagcaatccaagaagccacacatatgaagatgataatagaaacaataataaccatttactgagtacttatgtagcagttatcttattaaataacaatacataaattatattgtttacttcccaggaaactggcgttcaaggaggtgactaatctaaggtcatctagctaagtgacagagacagtattcaaactaaggtgcctctgactccaaagactattcaaacttccagactttgctaaggacttccaacaactgcattatactgataaaagttgcctgtcagaacctgcacgttgtgcacatgtaccctaaaacttaaagtataatattagtaaaataaaaaaaaagaataaagaggatgttccataactcagtctgtgagtcagacaactgaagaagcctaccttctgccacataggtaagtgaggagtgtctccaagttcatttagtaagctggagaaatattactttctgcatgaaaatactagctcagtagattttttaaaaatgtactaattacatgtttttaaagttaactctgtggtaagagaatttgtgtgtttcatacattcccatgagtgttaggaaaggataaaaagccaacaaaggccatattctcacgaacaagagagcaattcccattggcaacaaaatactgaaattcgttgcaatgatttgttacagagagtatactagcctggaatgcactgattgtcaaggaaatggatctctgaatttaaaagaccagtgccttttagggaagcagaaagagaaggtattgccctaatataacagtatcaaatctcaaaccaaagagatttatggagcagaagaagtcttgattgccttctatagaactataaaagctcaatgtgctaaagaaaacctttggcttcttttgagccactcaattgtttgattattgtcatgttcatcatcatcataactgaaatgtgttgaatacttaacacatgttgagcactatacatataacaattcatttaatccccatatcacactatgtggtaatgactattactatattattttatatttgaaggaacagtggcaattagagattagattacttgcctttggtcacaaaggtagcaaattcagatctggaattctttacttgggcaatctgacttcagagatcttctaaaccactatactacacctactcctgaaactgaaatggtaggtattattatcactatcattaacctgaagcttagtcaattttagtattagaataatattcatggttatttgtcttccttgggctggaagtgggtacatatattgaatggcagaagatatgattggcagcttccctaacatgaacagaaatgggtcaactataaacagtctgagcaaaagaaggtattaagggtacaccaatatatgcgtacaaaattaattgcttgaaagaaggaccattctattctaattgtataatgctcaaatggtctttccatctgtgctgctttttggctaagggataaaaagaaataaaaataaaagaagcagaactgcaaaaagcatcccactgcaaataactgctggaatcttaatccgaagataacataggtgtatgtattttatgaaagtgactgctactcgtatataaatcatttggaaaattatatgcattgtgattataagtttttgacataaaaataaaattcaattttacaaattctagttccactaatttgaaattatgatattgattgtcacaatttattaaattcctgctgtgatttaggtactaaactgtggagttaagcctaagttaacttctttacattttattttaaaagctacaaagtataatatgtatatgcttattttacagttaagaaacgtaggctaaaataagcaattttccaaaaatcacactactggaaactaggctttcatcttaatggggaaagaatagagtctaatacttttgacctactgtgtgcccagtactgatctaggcaattcacaaacattgtctcatttacatatatattcaggggaaggatacaaataatataatataatagatcacgatagtagctgctgactgtttacttgctggaaaaaaggtttatggtcaggtgaaatagtgaataagcaaattttactctcagagacctttcttctttggtcagactgatcaaatgcacattgacagctcctgaaacagcaaatagaacctcagaacatgtttaggtatcagcattgtgttgtacatgaaaccatgccaccttgtttaagcagtggactatgtttctgagccgcataggcacatagctcaaaaaaacactgatggccaaaccatgattcccaaaatataaatgtatacagtagagatggttttgaacatgcctagccaataatgcaagttttagttctgtccggagagacaagggttacaaagagtttctataaaatattaataattttgcatattcatgacctaacaccaaaaatatcttttctcttttttgtaattctcagagagcagtttaagaattttacctaaagtcaccgtgcaagggggatgagctccagggactgtcatttttcacaggtgtgttttggattaaatttggataccttgttaaaaaacgagttttctttttctttctgcagagcacgtgtttttaccttcgtttttatagcaagtttaagaaaccattaataaattagccatcagtgactttaaaatcaatgtgtttctggccattgagaaaacctgttcacgtgttctagtggtgattgtttgctattttggggataataaagtgttgaatttttttttttttgagaaaggaatccagcagagctctgattaaagaggactttctaataaacagcagtttgaaacaactgctctagaatttaatagcccctttgcatgcaccagaattttgagctaaagctagaatataacaaagtcataaagggcttctcctatattcaagtcacatcaagatgaacccaaaagagcaccctcgcattctttcaacatccttcctctttctcttacatacatgaaatatcccttcttcacctgctacttcaaatacccattcattggtggataatatcctctatgatttgaaactcaaaatgtggtctgtggatttacatcatcagcatcacctgagcctttgttaattacagaatctctggccatacctcagacttactgaatcagaatttgcatttaacaagatttccaggtgattcatatgcacattaaagtctgataagcacagctctataatagagtttctcaaccctggctcaccattaaaatatacatagaagaggttaaaaaaatactaatgcctggccctaaccccttctgcccttttccaccaaaattcagattaagtgtcttggtgtgaagtccaatgattcatatatatatatatatatatatatatatatatatatatatatattcagatgttcagttatttcaactatttgccctaggctatagattgtccagctttgctgtattcccattcgttcttaacttcaatttctgataccaagttgctatattttatcttatttttgtaaataatggtcaatgtctttgagagacaaattgaattcatgttgctttgtcactgggcataattgtctttaatttctgttcttaaatggtggctaccagcactctcagatctaagccctgaatatttggcatgtgactagtttgggcctagctgggatgcatccctaaaatgggcaaccaaaaaatatctgacatgacaataaactatattcagtaagagtaggatttctaattacccattcaccttgatttgacagctattaactttgttattaaaatatacctaatgatggccaagatgatatttacaaatgtatttgttagagctgccatctatacaaaatgtcattgactcttcttggttaatcatatttagtaaatcctcattagaaaaatgacaaatactcttttattaagatcactaaccacaaagttatttgttattcatattgatataataggtagttccaaaggaattatggattaagagaaactttagtcataatactagtttatagtttccatgttcattatgcaaaatttagtgcaaatgataattcccagtcatattaaatgaacaggaaaacagaaatgatcacattttcatgaaagtgattaaagtgatattttcaccttgaataaagcagaagcaatacactgacagttttcattatactcactgtatcacttctcgagtagaaataaccatctcaaagctatatatgcatgtcacttttgaaatacagtgtgtgtgtgtgtgtgtgtgtgtgtgtgtgtgtttgtatttattttttatggttttgtcgaagacaaatttttaggtaattggtacttataactgctggcatagcattgaaaatccaataatttctcatttttaaatagttaatactatatttaaataaattgtttttatttattttgttttagtttagtatttgtgttgttgttatatcacagcctcgcctctacttccactccaggaaaagtcaaagtcacaaataatacccacagaccaaattagatttagatttttttataccaagattcaaatgctaacagatcaagatttttcaggtcaccaaaagaagggacttcaaaaaagtccttaaatcatttctgttctccaaggcatggcatgtgttgtactgtgcaactctccatgtgtacatcttataatgaaagtacagaacactctgggactgtgcacaaagaagataccaactaatgagatcactgcagcatttgtctacggcatccttttggaagttgataataagcagtgaaaataacacctttagtgccccaaaacgttgtttggactgaagtaacttgcttgcagcagtcacgatcaacttgagcaaactaaacacaaaataacaaaagcttagacccagagtccttggaagcttaccaataagactctgaacttgaatagcagtttttttctcaatatagacaacttttctgctcagttttggctgcggaccaaaaactagcacagtagattccaacttacccatgttattgagttaaatcacagatgttagcacttaccagagtactaggcatgcagtaggggctcaaaaactgacttgtgaatccaatttaaaattttgtatctgaaaattgagtttgggaaatgggtaggtaggaaagggaggaattgcatttgactctaataacagtgccaattagagactggaatgctactgttggagggaccgtattgccagacgtactgagattacctgaaggcaaataatcaagtagctatgatcttgaattgttcatgtcaggaaaatctcatctgaatcgaacccctgtctttctatgattgtgggttctctctatccgatgtatactaggttcttggattctaagtggtaataagtgacaatgccatgaggatgcactagtagcccttgttatgggcctgtaaatgcacaaagctatggcaatttggtcgtgcaatatattattttgcaatgtcgttgagtctacaaggttggaggaattacttctctttgtctctttcccttgctgcttattttgactctttcttcccacttaagtcacaagcagctaagttatattcattcttggaagctgtcttgagaagcctggagtacatggaagcagatattgtggcaaatcctcagccgccccttcctctctccacctgtctttcccttgctccttccctctcttctttctttggttcagctgacacgggatggctagaagtggtgtccccacacaggcttgaaaagatctagggtgcgacataactcactgaggatccacattgtaatatgggaagaatcataatggtaatatagttacttaacctggttatgtcacaggtttcttatctctaaaatgtagataaataaaggcatctacctcaaagacttacttcttctaagcattctataagaatgtatagagtgtgcttaaaatagcatccaggcttaagtaaaatctacgtaaatatttgattttatttcaataatttctaccaaaaaaaaggtggggtcatgtggtctgagcataaagatagtcagtgacatcttaatggctttatcactgtccaaaacatccaccaaaccctggtgccttcctaggccactgaagaaataccctggctccggcgaatgttataagaagataagaggtcttcatgtctaccagccagctattcctaatccaattggtgtatcttccttctgtttcaacgattcttatatctaggtatgatcacagtgatgtaaatcacattttttgtttttctacttttaagttcaggggtacatatacagttttattatataggtaaactatcatgggagtttggtgtacagattatttcatcatcatctaagtaatatgcataatacctgatagacaggtttttatatcctttccctccttccaccctccaccctcaagtaggcccctgtgtctgttgttcccttatttctgtccatgggtactcattgtttagctcccacttataagtgaaaatatatggtatttgcttttctgttcctgcattaatttgcttaggataatggcctacagctccatccatgttgctgcaaaggacatgatcttattcctttttatgactgcatagtgttccatggtgtatatgtaacatattttctttatctaatctgtcattgatgggcatttagattgattctatgcctttgatattgtgaataatgctgcaatgaaaattcacatacatgtatctttatggtagaatgatttatattcctctgggtatatacctagtaatgatgttgctgggttgaatggtagttctgtctttagctcttcgaggtattgccatactgctttccacaatgattgaactaatttacactcccaccagcagcatataaatgttcccctttctctgcaacctcaccagcgtgttatagtagttctgactgatgtgagatggtatctcgctgtagttttgatttgcatttctttgatgaatagtgattattattgccttgcctattcaggctctttatttaatttcgttttttcatatgcttcttggccacatgatgtcttcttttgagaagtgtctgttcatgtccttgcccactttttaatggggttgctttattttgcttgtgaatttcatgttccttatggattctcaatattagacctttgttggatgcgcagtttgcacatgttgtcttcccttctataggttgtctgtttactcttgtcatagtttcttttgctgtacagaagctctctagtttaattaggtctcatttctcaatctttgttttttgttgccattattttggtgacataatcacaaaagctttgccaggtcctatgtccagaatggtatggtatttcctaggttgtcttacagactgcatttctttttttttttttttttttttttttttttttttagttttgggttttatgtttaagtctttgttctatcttgagttaattttcatatgtggtttaaggtatgggcccagtttcaatattctgcatatggatatccagttatcctctcaccatttattgaatggggagtcctttcctcatcgcttgtttttggcaactttattgaagatcagattactgtatgtgtgcagcattatttctgggctttctattctgttccatttgtctatgtgttttattttttgtaccagtaacgtgctgttttggttactgtagccctgtagtatagtttgaagttgggtaatgttatgctcccagttttgtctttttgcttagaattgtcttgcctattcaggctctgttttgattatatgaattttgtaatagtttattctagttctgtgaagaatgtcattggtagtttaatgggaatagcattgaatctgtaaattgctttgggcaatatggccattttcatactgattcttcctattcatgagcatgaaatgtttttccatttgtttgtgtaatttctgatttctttgagcagtgttttgtaattctcattgtatagatctttgaccttcctggttagctgtattcctaggtattttatttttttgtgggctttgtgaatgggattcccttcccaatttggttctcagcttgtatgttgttggtgaatgggaatgctgctgatttttgtatattgactttgtgtcctgaaactttgctgaagaagttgtttttcaattcaaggaagcttttggtagagactattgggttttgtagttagggaattgtatcatctgcaaacagggatggtttgactccctttcttcctatttggatgccttctatttctttctcttgcctgattgttctggccaggacttctagtactacgttgaataggagtggtaggagtggtgacagaaggcatccttgtcttgttctagttttcaagaggaatgtaaagcagattctttgaagagcatgtaaggcaagtgtccttggtggatttgacttctggttataatctggcctgaaaggaaatactgcaagatgtacattgttggcctggcgcatgctgatcactctgacaagaaagatctccctctatgaaaagaattcacctagggacataggggtgtgtgtgtttgtgtgggcgggggggggggtgggggaagtgggggggaagaagacaaagagatacggagacatttgttttctagcctagaaacaaatgctaagcagtcttatctatatattttccaattcagtttttcatacccacggaattcagatggttggacatgactgaaccctggtttcaacgtaaccgtgtaaaataattgctgtttttcacattttaaagaaggatttcagacttgaagacaagaagctcctttctcctcaatagtgctcactcttctttagtcaaattttaaaaggctctgagctgctaatctgtacaaatataaaatacgaaaataaaatgaaagagctgttcaattattgcccggcatcataataagaaaacatactatctatctgttaactttctctttcacctctaccaagttcaccctttcacacctatcctcccttcagtgtgtgtgatgcagttgctaaaccctattacatactgcagttcttttattaaggattgattgggaaaatctacttgccttaagatgctattatggttttgattaatttgactaaattaatatagagagttaatatctagaaagaaatataaactatctagcgtaaagaacaaaaaccatacacctggaaattaaccctccaccaggaaatattagtattaagtagcacctggtacattcttgatttaggcccttgtgattgttctacaggaagatgccaactatgtgcagaataatgtttctcaggttatatctacattcataaagcattttaatttattatgattttattttattacaaaactgcttagaattcagtaattgacagattgtttcaaacatcactaagctcaacaatgtttgcttctctccaaattattctgtatatttaagcggtgcttctttactgagctttctaaccatatttaggtggcattcaagtacttacccattgtgcagataaaatgaaataacgtgtataaaagcacaataatataatatgtttaatatgtatgtgctccaaacaatgcaagtgtgagatagcattattaccatgtggcattcatccaggtggatgcaatggagtccaaatgaacctacctgtgccttggcttaagctctgttcctatatctctgtcccctatgatatccctggaaaaaataaatgctcccagaaacctgatgtacaaagcttcccaagtgtcttaatataatgggaatttaaatggaccaccactaaatggagctattgtgaatccaagtactgcttaaccttgtttgttagtcttttcaaagttattaatgacctttaactctcttcaaaattatttaactactctatctggacatgaatacacactctgtttccccctctctctctctctgtaaaatgggaatacaagttctaactcaattttggtttcatggtgataggaagatgggtttatttttacaaaatactttgtagtttaaaaggtctattccaacattaatgagtattattagaagatggcattgcagcttaatgaagtgatgcctcaactgacactacagtttgaattcggatcagccaattttaagcccactgagtctgaatgctcagatgtccattttttcagtcagtaacagattttgctagggttcatgtgctttaacagattttttcttggctatgtttatagtaaaaatgtaatagtaaattatgagcactgtaaaacagtgttgttcatattctgattctcccattagaaatatatggtcaaaatgttagaaaaaaattgtaacagaaatgtagagttattgtctgtctaggtaaggtattatgcttaataaataagattagtattttcattaagagtaaaacattgaaagttgcttgtaaatgaatttacgtataatagtcccatttttctattgactttcactgtaaaattacagatttgtttctctgctctccacaatggtcccaatacacaataatatttgaagatgcaacagtactttaatatgattcatctaaaggaaaatgttgaattttatacaacacagtatttattacatatatttagcatatcctaaatgtagttatgaatagaatacaagttcatgagctttgaggttatcatattaatattataactaacaaaattgggaaagataaagaggaaaagttcatttattcatcttttacactagataacttctggtataaatttgtctccctgaatcttggcacattattttactttgggtgatacttagctgtattatttcctcacagttttataattaaccaaaggagaatgggagcaaatttagaaaaaatgaatgctaatactcaaactcactcacaaagtataaagtagaaaaggttgctttgatgtttgacacagcagcttaaagatcccaaaagggggggacatttgaagtaaaatggactcacaagactaaactgaaaagcactgtagcatctattagagcctcctccttccccataacctccagctagagtacacgcatctctcatttcacaggacctggtaacggattcttatttctagaaaatgaatatgttgatctaacatgaagatacataggtaaaaatagcttaatccattttggtaccagtaccatgctgttttggttattgtacccttgtagtatagcttgaactcaggaagtgtgatgcctccagctttgttctttttgcttaggattctctcggctatatgggctgttctttggttccatatgaaatttaaagtagttttttctaattttacaaagaaagtcaatggtagcttgatgggaatagcattgaatctataaattactttgggcaatacggccatgttcacaatactgattcttcctatccatgagcacagatacatagaccaatagaacagaacagagacctcagaaataacaccacacatctacaaacatctggcattacacaaacttgacaaaaacaaacaacaaggaaagcattccctatttaataaatggtgctgggataactggctagccatatgcagaaaacagaaactggaccccttccttacatcttatacaaatattaactcaagatggattaaatacttaagtataaaacttaaaaccataaaaactctagaagaaaacctaggcaataccattcaggacatacataggcatgggcaaagtcttcttgactcaaacaccaaaagcaattgcaacaaaagctaaaattgataaatgggatctaattacactaaaaagcttctgcacagcaaaagaaactaccatcagagtgaacaggcaacctacaggatgggagaaaatttttgtaatctacctatctgaaaaagggctaatatccagaatctacaaagaactcaaacaaatttacaagaaaaaaacaaccccatcaacaagtgggtgaaggatatgaccagacacttctcaaaagaagacatttatgtggtcaacaaacatatgaaacaaagctcatcgtcactggtcattagagcaaatgcaaatcaaaatcacagtgagataccatctcacaccagttagaatggcaatcatcaaaaagtccggaaacaacagatgctggtgagactgtggagaaattggaatgtttttatactgttggtgggagtgtaagttagttcacccattgtggaagagagtgtggcaattcctcaaggatctagaaccagaaataccatttgactcagcaatcccattacttggtatatacccaaaggaatataaatcattctactataaagacacatgtttattgtagcactatttacaatagcaaagacttggaagcaacccaaatgcccatcaatgatagactggaaaaagaaaatgtggcacatatataccataaaatactaggcagccattaaaaaagaatgagttcatgtcctttccagggacatggatgaagctggaaaccatcattctcagcaaactaacacaggaaaaccaaacaccccatgttctcgcttataagtgggagttgaacaatgagaacacatggacacagggaggggacatcacacactggggtgtgttggggggtggggtcaaggggagggagagtattaggacaaatgcctaatgcatgcggggcttaaaacctagatgacgcgttgaaaggtgcagcaaaccaccatggcacatatatacctatgtaacaaacctgcacgttctgcacatctatcccagaacttaaagtaaaattttttttaaaaaaaaagaaataactttatccaaacagttacaattccaggtgaagcaacaaaaaactaaacaggagtgtgtttaataaaatggcaaatggacttgaaaagtatctcaaaaacattgtcaactgtttaacgagctggaccagtatacgcatctcctaaccactgtaggacactgaggaaacaatacattcatcagagatgattaatggtgctagtatgaccgtgtataacattttcctcacattacgctgtgacacaatggtaaacacttaggcatatcaaaaaataaagggaagattcaacattgctatgagttaagcatcttgttgtaagaacttgagtattgctacattaagactcagaccactcagatattccctacaggattgcaagagaaagttgaatatggcatctactaaagaataatttttgcttcaggcaattagtcagatttgaaaatcttgacctacctcatccattaaaatcatactctgctatccctatatacataccattcaaagatacatatttgatatgtgtacataccattcaaagatacatatttcacttctatgaagtacctcaaaaccagaatcactttctataacttgagattgtttttcctatttcttgtgcatccccattctgacaataaaatcaagtaccttcaagagcaggcacccttaatatgaaagtaattagtttgcaaatattttatcccattgtgtatgttgtctttttactctgttgatagtttcttttgctgtacaggagctcttaagttaattagataccatttgttaagttttgcttttgttgctattgctttcagtgtctttgtcatgaaatctttgcctgtttctatgtccaggaaggtattgcctaggttgtcttccagcgttttatagtttggggttttacatttaagtctttaattcatcttgagttgatttttgtatatggtataaggaagtattccagttttaattttctgcacatggctagccacttatcccagcaccacttattgaatagggagtcttttccccattgcttgtttttgtcagctttgtcgaagatcagatggccgtagatgtgcagcattatttctgggctcccacaaagatctcatattcaacatttataaagaaattaaacaaacttataagagaaaaacaaacaactcattaaaaagtgggcaaaggacatgaacagacatctttaaaataagacatacacgtggccaataagcatgtgaaaaaaagctcaatgtcactgattatcagggaaatgcaaatcaaaaccacaataaataccatctcacaccagtcagatatggctgttattaaaaagtaaaaaaatgacagatactggaggttgcagagaaaaggaaacacttacacactgttggcaggggtgtaaattagttcaaccactgtggaaagcagtatggcaattcctcaaagagctaaagagaaaactaccattcaacccagcaataccattactgggcatatactcaaaggaatataaatcattctaccataaaggcacatgcatgcaaattttcactgtagcattattcacattagcaaagccatggcatcaacttaaatgtcatcaatgagggattagataaagaaaatgtggtacataaacaccatggaatactatgtagccataaaaaagatgagattacatcttttgcaggaacatggatagagctggaggccattatccttagcaaactgctgagaccagctcagtcggggacaccctaacccagcagcgctagaggaattaaagacacacacacagaaatatagaggtgtgaagtgggaaatcaggggtctcacagccttcagagctgagagccttgaacagagatttacccacatatttattaacagcaagccagtcaattagtattgtttctatagatattagactcagatactcaactgaaagtatcccttttgggaaacgaagggatgggctgaaataaagggatgggttgggctagttatctgcagcaggagcatgtccttaaggcacagatcgctcatgctattgtttgtggtttaagaacgcctttaagtggttttccgctctgggtgggccaggtgttccttgccctcattccggtaaacccacaaccttccagtatgggcattatggccatcatgaacatgtcacagtgctgcagagattttgtttatggccagttttggggccagtttatggccagattttggggggcctgttcccaacagcaaactaatgcaggaatagaaaaccaaataccactgttctcacttatgattgggagctaaatgctgagaactcatgaacacaaagaaggagacagcagcactggggtctacttgagggtagggaatgtgaggagggagaggagcagaaaagataactattaagtaccaggcttaatagctgggtgataaaataatctgtacaacaaacccccatgacatgagtttacctatataacaaacctgcatcatgcccccaaacctaaaataaaagttaaaaaaaaaaaaacaaattactcatcactggatgtctttcatgtatatatgagatatggagttaataaacttgttttctcttaaaaatatcagagtaagtagtgcaatggaaatacatatgtccttaatagattttcatttcatttgcaaaataacagacatgcctctaattgcgaaagagagattaaaggagtgcagtgacagtctcgtactcagtctggcccacgcatctaggaacatctcaaaattttaggttaaaataacaccacagatgggtgaaatacagatgggtgaaatgtgtaagcatttctagactactgaagaagtaagattagccacaaatcatattttccaagtgtgtagcatgtggagtccctaagctctttggactctgtagctacatattcatttcttggaggtgtttctatgggtttattcccaagaggacccagcttcccactcattttatcaatcagctgtcattaactaacgtagaattagtatctgtgccaaaaccttcgtgagaaatatttgacccatgttaaaatagagttcattagggttctaatatttgaattattttctttccaattctgattcaaagcctaagtaaaacaactaaacattcaaagggggcctaaagaaagtgcagctcttaatgcctctggatcagtgatttttatccccaggtcccatcttgagattcttatttagttgaagacaatctgtaaatataatacatgcagttgtagatggccagcattccagaaggttaaaaatattattttagggatctctttgagaataagatgaaaactagttaccttcttaccatataaaacaatagtttgcatataatttcagtatcctggacacctgtggtctatccaaagggaccagtttaagatttggatctatgtcagagcagatcagtagaataaaacacactgaatgtgtaagtattctagttttcttcagaaaactttcactgatttataatttaatataattgtcatcagcctttacatcttattgatataaaaattgattgcataaaaagtttgtctttcccaccaataattcctatttctccatatccatgccagcatctatcatttcttgactttttaataattgccattctgacaggcgtgagatggtatctcgttgtggttttgatttgcatttctctgatgatcagtgatgttgctttttttcatgtttgttgatcatataaatttctttttttgaaaagtgtctgttcatatcctttgcccactgtttgatggggtggtttgcttttttcttgtaaatttgtttatgtttcttgtaaaatctggatattagacgtttgtcagatgggtggattgcaaaaattttctcccattttctaggttgcctgttcactctgatgatagtttcttttgctatgcagaatctctttagtttaattagatcccatttatcaatttttgcttttgttgcaattgcttctggtgttttcttcatgaagtctttgcccattcatatgtcctgaatagtattgcctaggtttgctcctagggtttttatggttttagcttttacattgaaatctgtaatctgtattgagttaattattgtgtaaagtgtaagtaaggggttcagtttcagttttctgcatatggctagccagttttcccagaaccatttattgaataggagatcctttccccattgcttgtttttgttaggattgttgaacatcagatgcttgtagatgtgtggtgttatttctgaggtctctactctgttccattggtctatatgtctgttttggtaccagtaccatgctgttttggttactgtagccttggagtatagtttgaagtcaggtagcatgatgcctctggcttttttttttcttagcattgtctttgctttacctggtcttctttgattccataagaaatttaaggtagtttttttgttttgttttgttttttttgtgaagaacatcaatggtagtttgatgggaatagcattgaatctataaattactttgggctttgggcagtatgaccattttcacgatattgattcttcctatccatgaggatgaaaagttctgctatttttttgtgtcctctcttaattccttgagaagtggtttgtagttctccttgaagaggtccttcacatgccttgttagctatattcacaggtattttattctctttatggcaattgtgaatgggagttcattcatgatttggcgctctacttgcctattgttcatgtaaaggaatgcttgaaccattgtggaagacagtatagcgattcctcaaggatctagaaccagaaataccatttgacccagcaatcccattattgggtatgtactcaaaggaatataaatcattctactattaagacacatgcatacgtatgtttattgcagcactatttacaacaacaaaggcatggaaccaacccaaatacccatcaatgatagactggataaagaaaatgtggtacatatacaccatggaatactatgcagccataaaaaggaattagattatgtcctttgcagggacctggatgaagctggaagccatcatcctcagcaaactaacacaggaacagacaaccaaatgctacatattctcactcataagtgggaactgaacaatgagaacacacaccagggcctgttgtggggctggggggaagggagggaacttagaggatgggtcaataggtgcagcaaaccaccgtgacacatgtatgcttatgtaacaaacctgcaccttctgcacatgtatcccatggtttttcttttcagaagaaatgaaaacaaaaaataaaaaagtttgttaatttcttctgagaaaagatgcctttgtgtctacatttaccctaaatgtatcaaaatattgaggcttctagctcccaatccctgctttggaggcttgggtttacacttcccccacacaaccgatgtttgtctacagtaaatttcttcacactagtgctacttccattcctttttatatccttcactttcttccttctgtaaccttggtacctaagataataggttctcaataaatacttatatttagtataattcattattttattaattacaaaggtgtaacatgtatcttgtagaaaatgtataaaatatagaaaactgcaaaataatgaccaactgcaatctcacccattttgttttgagatttttgtctggaaatgtattttaaaaatgaatcatcccctttcctaatcccaattctattcccaggagatggccactgtgaatgatccagtatctttaaagtgttttctctatttttatccacacaaatatgtatacatgcacatatacacatctatatcctttttttacaaataggattgtactattttgtgctgcagaaattgctttcttcatcaaccaaagtactatgaaattttctcagttctgcagatttaccttactcatttgaatttaacgctatttgataagtatttttgaacatacaaattaattatttgatttggaaagaaatgtcttttggctaacatcttattttattattttagaaatcagccagaccataagtaagtggttatgactattctttcttgtaagatagtataataaaattccggaattagaatgatctatgcatccttcgttcaggtttaagatataaactttctgtttcagaagctggccatatcactactggtttccaaagatcagggaataaacatgactttgtacccccttccataactaactacatgtaaaatttcttttaaccattgtcagttctcctgcttcattttgtcagaccactagactgcaaatgtttctcaaacttcaggggtcctgtcacctgccttttgcttcagacagcaggatactgaattctattgccatcacagtaacaacaatgataagcacagcggtcaggttttaatggcaccacttaatgaattctctgagaaaagaataatagcgagaaatctcaaggtcagcagtgtttactttgagaaggacctaacaatagatctgagaagtccttcaagtgtaccaggcatctttttctgctctgcctgcagttaactgagattttctttcctttttcctcgtcttcagtattacatgtgaagcaaaccaattctagtctcagaaaagtgatagcccttgatgttaacatatcaagcttgggttcgatggaaaggttaaaagaaaacaggcaagatcacatcctaacaattctcccatagatttagggtgagaatttggaccaataaatttgtttaacacagaaaagaggatgcatcaagaatccttagtggagagtctgaaattatggaaatgattataaaagtagcttggagctacactgtgaagagagttgagggtattcattgtctctagggattatatataatattataagtcttggagtaaacaaacaaaagctgaactacttaatatgaaggataatagagtttagaatacattccttaggacagcaattaagcatggacataagtataggtcaatttcatgaggaaaagaaaactgaccatgaaataatacaaaaaagaagaaattctgaattaagataaaaactgtgtgcagagacaaaggactagatggcatgcaaattttccatgcagttaacagtttccaagtgttttaaaaaatgcaataaaatatctctaaatgcatttcatgcatctctttaagttctttctcaaatatctatcctatattgctatgaagtagtgaggggaaaatagttattactctctctgtctctctcctttgttttacgtaagagagatgtttaggaaagtttgtgtgcgtgtatgtgtatgtatatatgtgtgtgtgcacgtgtgtctgtctgtctgcctctctctgcttctgcctctctgtctataaagcaggcctccttccaataattaactatggttgatttaggggtcactcgcctaaggccatacaccatgtcaaaatatgaataaagatttcagggaggataaaaagtgtttttcagctattcaaacaaagccactgacactataccaacacaaactactagagatgaaaagtatcttagagatcgatccctcattttctgtatgaaactgaggttcagcaagttatacgccaaaatccaatgttacccaatgctttaatggaagatctggtctactttttgaacatggtaagatctgagggttgctgcagggctccttgctccaaaatatttcctacacagctttccagaggacttgaaattccaaaggtcaaaatcttgcatcagaattattaatattctgctatcccaaatgataccttggatgacctatccacgcttttatttacgttcgatgcctccttttgtgttcctcttgcctactcaggaactctgtgtcaaaaattaatcatctatgttcaatgtagtctaatttttcctctctaatggacaattcccatcagcatgcttttattattatcttatgtttttattcctcccttcttgaaaatatgtactttagaattctctcttcaccctacattcattaccagttatggtcccacttctctgctccccttagtaacaaaattccctgaaagagttgtctacatttgttattgaatttctcccttcccattctcttttcaacacattccaaacaaacagaccatactaggccattcttgctttgctataaagaaataactgaggatgagtaacttataaagaaaagagttttaattggctcaaggttctgtaggctgtacaggaagcatagtgccgacatctgctcagccttccctgaggacctcaggaagcttacaatcatgatggaaggtaaagagggaaggtaaagaggcacacctggcctgcattctaaatgtctccttttgtaactttaatatatggtaacacttggagaaatataattacttttttcaacagtgatagtaattcacactattgtgtaactccctcacgttgaaaccttattaagttgttgaccagtgacaccatattggagaagtatcatggtttaagaagcacaaggataataagaaaagaaaaaaaaatacatttgggttgtataaaatgtataggtaaattcatgaattgtagttaaaaaacctttttttttttcaaataaaatatgatccaattctgacccttctattgaagtccttagctagaattccatttggaatttcagcctcctttcccctttattgtctcaaagtggaaaataggctaaactccaattgaaatactgtgctaattggaaaaacataggtgagcaaatgacttctaaggtgtgtgctgcactctgcattgtgctttagtcataagaatatctttaaagcaaaatgagatattcaacagagtcagatggaatcccctagcttgctagacagaagcaaggaacttcaaattaattctgacacatttttcattgaattatcccagtttcatgccctcaagtcactcatgactcattattcatatgctcttttagaactatacacatcggggcctgtcagggggtgggggactaagggagggatagcattaggataaatatctaatgtagataacaggttgatgggtgcagcaaaccactacggcatgcgtatatctatgtaaaaaacctgcacatttagcacatgtaccccagaacttaagtatagaaaaaaaaagcctatatttgtcacttacttacctgcctataagacctttacttcattaattttcttgcctgtttttttgttcgctattctttaatctttattatagccacgactgaaaattgacatatacctaggattgatgcctttgtcaagaacacatattacatatgcaaaatcacttatattgatgttatattatgctaaaatatttgtttccttcaattaagactaaagtaagagtcaggaatggcagggcacatttcaaaataagcgtgatctaacttagtacaatttgagagacaaaagtgatctcagaattgatccaggctaaatacctacctacccaatgtcagaatcccctcaactgaaatctaattccctgtaatttcagaacttcaacctatttatctatcctccccctgttttttttttcttcttagcaatgtggaataaatctaaatctaccacaaaataaaagtgatttgaagtatgggaaagacatatcatactctgttcccaaaatttctcttctctaggcaaaacttccttccattaagttccttagacaacatgtcatttttagcagcaggttgctcatcttcctctgagctcaatcctttcttaaaatatgacactcaaatgctaaattccagtattcatcacactaagattgtctatgtaagagtaatttacatacatgtttgcattatggtcttcatattttaaaagtccaatctaatgagatcagatacaaagcttatgaggaatgtttctaaaacgtggcctttagtaacaatccattaattatttttgagtggagtaatcccagtattatccagcccatgtaactcaatccttttcactaagttagtaaaatcaagactaaatttaagtctggcaaacctaacacaaaagaaaacgctgtaagcttggcatgtagttacttaagtcaatgtatttgggttctagtaatcactcttctctgtttaataaattaattttaatatatggcaatggaaatcaatactgaacatgaaatctgcttttacttcttttgaaaattcatacaaacattatccaccaccacactgctgatatttctctgtgttccatgaactctcaagcatattacttttatactggaagaaattacatgttacagaaatatttcagctgggtttggaatttcaaattaatttaagtgtattaaaacctgtcaagatatactcagggctacaactacattttggacacaactacattttggtaacaagactgcagataatatcttgaatgtgtaaatttcataatataaggcaagcagcacagtggaaatagtggagtctactaatctatgggtagaagtgacagccagaaaaccaaacaccacatgttctcactcataagtgggagtcgaacaatgagaacacatgggcacagggaggggaacatcacacgctggggcctgtcaggtgttgggggagtagaggagggatagcattaggagaaatacctaatgtagatgacgggttgatgggtgcagcaaaccaccatggcacatgtatacatatgtaacaaacctgcacattctgcacatgtatcccagaacttaaagataaaaaacaacttaaagattaaaaaaatgaaaaaaatatggcaagtgacactggtgaaaataaaaaatttataaagttaaaaaaaaaagtgacagccaggaggaataattatggctagtaagttaactttattggattgcccaattcagtgctcagaaagaaaccgccaattggaaattagaattagctacagtagatttgcaaacaggtcaacttactgatattcatgatataattcactaaatataggtatctttttcatttccctttacagctctcatttcttgccaataactccagatattgtcaaataatcacaactgtaccttattgctgccagtgaaaggaaactttccaaaaacctctgtgaggatgaaagctaatgtccagcccccaattattcaattagattttgaaaaagggagctgtcattcctcaatttacttcagcaaatgcttagtgcatgcaacgcataaggaatgtatactcaattggagggattcaattaaggaactaatttaagagtgaaagccacaatgtttgtgggattttttttaaatgatataggtatattcaaaacatcaagaaccagttcaaaccaaagttatataaattgtagaagcttcataatcaaatatttatgactctctctacggtgcttgaaatattaaattattaaaagcaaatattgtagcaaacaggttatcatcaatctcaataaaagttacgttttactatcactgtcacattattactttttgcttttagtcgtttaagattgaagagaggtaacaaactgtggtaacaaatcaaactttttcagtgtaatttactttgtgagtaatttctaattgattcagactgatgagactgcacagtctgatgtactgctgaagcaggagatactttggaccaagtaaatttataagctcctcttcttgagagaaaaatggctgctatatttcatgttgtcattttttagctttaacaatgtagttgtatacctatgcggattcttaaaaaagaataccaaataatgtgtacacctgtaactgtctcacccacctatcaatattggatttggcaggcccaaccttctacttgctcaaaataaaggatttaagcaaaatgcagaattaacccaaaaagaccagtctcatatatgaaaagcaaagctgcatagcaacatcactcagccacctgcagttcaaagttcatatcttattaacatcactaaaattagaacaatgcaatggcttggttgtgtgttttggtatgattgtttgtgattctgttgagattggctctgtgctttgcttaaaaatcctgaatgttatttttccaaaacatgattctagatatagatcccagtattttgaaaatgagagttggggggaaaagattgtgcttgtctgctcaaaaggtcagaagcacttcacctcaattcagtgacaaatagccttattttacagaagatgtaacactggaatatgaaaatagccatgtctgacacacctttggatttttactcaagatccccatccaatgtgtatgtcccttggctgataaaactgttctttttgatgtgaggaaaaaataataaaaacaaccaacaagttttcctctttactcatctcatccattctgggatggaatatccccagaggcttgagtctgaagggcttttttcaaatttcacaacgtaatggagacccctctatggaactcttttcccttttcacctaggtattatgccatctggctgaggagctacttgtcatctctgctgttccctgataggccagaaacaaaaggtgtccctaggtctaggtaaaagtcaaataaaataaaaaagaaaaacaacttgaggtgcaactttagaggcctcaagcatctcaaaggctttaacaagtctagttaagtacctgtggggccatagtgggatttcaatatcctcacatgacccaggactttataattccaaacattgtcttgtcattaactgtggaactcttgctaattgagtctgagtgtctaggagacagtaagggagatgatgaaaacaattatttgtaatttagcagagtaaactatgtaatttttcttaagctaaacattttaggcattcctcattataaacaagtcaaaattcctttccatgtttcccattcttgtccatttccagactggccttctgatttttaatttccaaaatgacctccattttgaaatttaaaattcagggatcatctttgaggcatttctctttttcatctcactatcaaacttgtcattaaataattacatttctctctcttcattcccagtatgctagtccagaatatccccaaatccatatctgaattattgccactgccacttcactctttttctagaatcaaggctctcctgcctgcagtccattttacttagtgctgtcaggatgaattccttaatatacctacaagcctgaatatgccccacattgacttctacatcaagaccagatagtttggccttattatcaatactctcaacaatgaggctccaacttatctgtccaaccttaccactctcttttctgctcagctctgtctttcctttgtattcatcatgcttattcctgtacttattttatgctgcgaccctccactaaaatgtaatgagtcttaatcctcactttcttaaggttgatgatccttcaaggtccaagttaagtttcactttcacgaaaccttctatttcaattatcatttatctgtccacacataaacgtagtataattgcgagtgcttaatatttccttattgaaatattcaaatagatgcttctcccacagatctttgcaaccctcgggtcaggagataccctggtgaacccactccaccaaggccttgtatctgacacacagtgctatgcgaaatttcagcagagcagacactcaggcaggcacagagacccaggaactttacatactccagctctgggatccctggaaatggtgactggaactcaggcaaagcaggaggttagacctccgtacatatgcctaggaagggggctgaagacagggagctgagtagcattagtctgcgagcctcatttgcagggcacctcacaggataagacccattggcttggaattccagccagccaccagcagcactgttgcacttacttgggatgggactgagttccccagggaaggggcaggctgccatctttgctgtttggaagactcagccatgccagcatgcaggcttaggggagtccaaagtgttggggggtaatgctattcccattaaactaccaataatattcttcagaaaactagggaaaaaaaactattttaaaattcaaacagaaccaaaaaaagcctaaatagccaaggcaatcctaagcaaaaagaacaagattggaggaatcacgctacctgacttcaaactgtactagaaggctacagtaaccaaaacagcatggtactggtacaagaacagacacatagaccaatggaacagagtagagaaccaagaaataagaccacaaacctagaactatctgatcttcaacaaacctgacaaaagcaatagggaaagcattccctattcactaaatggtgctgggagaactggctagtcataagcagaagattgaaagtggaccccttccttacacaatatacaaaaattaactcaagatgggttaaagacttaaatataaacccaaaactataacaactctagaagacaacctaggcaatatcattcaggacataggcatgggcaaagatttcataatgaagacaacaaaagcaattgcaacaaaagtcaaaattgacaaatgggatcttattaaactaaagagcttctggacagcaaaagaaattatcaacagagtaaaaaggcaacctataggatgggagaaaatttttgcaaactatgaatctgacaaacgtctaatatacagcatgtctaaggaaattaaacaaattcacaagaaaaaaaacaaccccattaaaaggtgggcaaaggacatgaacagacacatttcaaaagaaggcatacatgcagccaacaatcatatgaagtaaagcgtaacatcactgatcattatagcaatgcaaatcaaaaccacaatgagataccatctcacaccagttagaatagctattatttcaaagtaaaatcataagagatgctggcgaggatgtgcagaaaaagaaatgcttataccctgttggtggtagtggaaattagttcaaccattgtggaagagagtgtgttaattttttaaagacctaaagaaagaaataatatccaaccaagcaatcccattactgggtatatacccaaaggaatataaatcactattattaagatacatgcccatgtatgttcattccagcactattcccaatagcaaagacatggactcaacctaaatggccattaatgatagactgggtaaagaaaatttggtacatctacaccatggaatactatgaagccacaaaaatgagtgagatcatgtctttttcagcaacgtgaaaggagctgaaggacattatccttagcaaactaatgtgggaacagaaaaccaactaccatgtgttctcatttataagagggaggtaaatgatgagaacacatggacacatacagggggaacaacacagacttgggcctatcaaagggtggagagtgggaggagggagagtatcaggaaaaataactaatggatactaggcttaatacctcagtgacgaaataatctgtacgacaaacccctatgacacatgtttactttggtagcaaaactgcacatcctgaacatgtacccctgaacttaaaatgcaagtttaaaaaaaagattccagtaaatgatttcaataactttaaatttgctgtaatattatttattatacatgaaacatatattaatatatattcatagttgtaatatgtttaggcatattttcaaaagaaaggaaagtcacagagaaacacatacacacacacacatatatatgtatgcatttatgtataggaatatatatctttatacaaaagcatagaaaaacaacaagaagtatacttgcttcaaatcataaatggtggtcacctggtcacctccagcaatgggacaatgggagcaagattgacaaaagtgttagtaaaggagatctttcaggttctactctaaatacaccaatgctgctagaaattttccaagaaatatattcaagttttacttgtgtgatttttaaaaaaaaaattatttaattaaaggggaaaaataaagttatcagcaggccatcctgaggcctcaatatatgtaaagcacccttcctcctatgtgtacaaggatatattccccttttattcatagcctgctgcatccttaaacagtattttaaaataatcttttgcttttgttgttttgttatctccccttcccttcatcccataccaacttgttcactacacaaagtcagtagaacccacaaagtcctggaaacatagttcaaacacctaaaagagctctggttttcttgatgtagttaactcaggcagtgaattaataaaaattgagcaattttcaatagaattaatttaattaagccggaaatttctctcccgtaaacctaaaattactgtcaaacataaaagtattaaaaaaattctctttttttcatcagatccatattgttatttgttttaaatatcattttagagctatagtcgtgtgccacataatgatggtttagccaacaatggaccacgtatatgacaatggtcccataagattataatgaagctgaaaagtttctattgccctagtgacattttgatgatcctgaccctctgtaagcctaggctaatgtgtatgtttgtgacttcatttttaatttaagaagtttaaaaaaaaaaaaaaatagaaaaaatagaaaaaagcttgtagaataagaatatcaagaaaaaatattttgtacagctgagcaatatgtttgtgctttaagctaagtgttattattagagtcaaaagtttatcaagtaataaagttacagaaaactaaagttaatttattattgaagaaagaaaaagatttatatatatttgggacagcctaattatacagtccatagtagtgtacaataatgtcctaggtctttacattcacgtatcacttactctctgactcacccagggcaacttgccgtcctgcaagctccatctgtggtaagtgtcctatacaggtgtactgtcctttatcttttatactgtatttttactgcaccttttctaggttaagatacgcaaatactgaccattgtgttacaattgcctacataaaccatctagttttatgtaagtacactctataatgtttgcaccatgatgaaattacctaaggatgcatctgtcagaacagattcctgtcattaagagatgcataactgtattggctttccactaaatatatgacttttaatatttttttctttgcttttagtcatggggccaaattctattttcttaattcttcttcgtcttttgtataagatacattgttcctaataaaaaatgcaatttcatttagagacattttgctttacatttaatattttagaaatgcaagatatatcaaaggataactagaagaaagaaatgcgctgtccaaaataaatgtgctatcttttccaagggcatgcaaatacattttccctcaaagattaggaggtgggtaatgctagtacctgaaattccaatttttctcctttaaatataatcagtccccaccttatgaaggggttgtatttcaaaacattgtgcttgttgagttttaggaataaattctcactagaaacaatgtttatccatggtgaacatatgaaattttcaggcaatcttaaaataaaaacttattcatttctttttgtacctgaagttatataaagttaaatacaaatggttctttcaaatctaaccaccacatatgtcaatgtttctgtagaagttaacttttttagaattttaacctagtttgttaggaacgtatctacttccactgcagggagaacagatattcacctaactgcatgccaccaataatggccataatgatctgaaagagattctaggacacattaaggttgcttattcagccattcaaataaaacatcaccactgctatatccttggacctgaaaatataactgtgattagaaaagatatatttcttgctctcagtaggaatacttagcacagagacttaaagcatgttaatatatgagccacacagctattggaggtagactatttggggcaggtgaaacagcaagtgcaaaggccctaaagagacaaagtgcctggaatacctaaaaaacaacatgtaagtcagcattttagtcagtgtttctgaagtggcagtgaaaaggggagcatttattagaatatgaaataagagaaaaagaagacatagagccttattggccatttttagggcattgagtttcactctgaatactaattggaagaacagagcagtgacataatctgtattaggttttaaccttatcattgcgggtgctgcattgaagattttctgaagtgggcaaagggtgaactcagggaaatgagttcaaaggttgttgcaatagccccaggaagagaagatggtgattggagccatgaagtaacaatgaagcagaggaaaagtagtcagtgtctggatatatttgaaagcagagccaaaagttttttgatgataagtctaagataaagagagaaatcaaggatgatcccaaggtttctgagaaaatggaagaaattggcttgtcattagttgatataaggaagaaagagaggaaagtaggtttgaaggaaatgaaaaaaaactatcctaaattcaattttggatatgctaattttgagctatcaaaatccccaaaaggagatgctgaataggtaattaaataatatgaatctggaatttaagggagaggtcaggataggtgatatgaatttgggaatcattggtacaagaaaattatttaaagccatgagactagatgttcatacatcttaacctaatatgtagagtacaattgctatagcagaaagactgggtgatattggaatgtaaacaaggtgtatctaccttataatgatagccaggtttaatagaacagttgggaatacctttggagaaaagttgacatttacactgagaacaaaaggaaccatcagaatcagctagatcaaaaggttatggagtgattcgggaatgcgcaatgtcctgaaggcaatgctgatcatggtgcagtgggaggaagtaaaaaatgttcaaactggcagcatcatagactgcaagaagtggggttctcaagaggcaagaaaataagagttgtgcaaaatgagccttgagaagaagacagaggacagttcatctcacattttgtaagccatattattaagatttaattttagaacagttttaaaaggttggtaataacatattatgtaggctaaaccttctgacaatgatgcagaatacactctctccccataaaagatgcaactctatatatctaaaaatacatttctcagaacctagtaatgagtttgctctctgcttcatttctgccaatctcaaagaatagtttcttacttccctttctactgccaatacctactgcttcaaagactccctttttgacctctatcccaagttgtatgaagtgggaagacagcaactgtggaagctttttctcatatctccttatctttatcagcatcatcatcaccaggataaagaggtgcttttccaagttggcacttgggcaacacaggaaatttttaaaagggtaggatgagggagaagcaccagggagctgccatctaggtggcgtaagatgcacagcatcatttcaaaacaaatcaaaagtcagcttacaatgcaaagctatcgcctgccaggtttgccaagaaatgcttttgaggacagaagaaaacaagaaattcatatatttaatcattattcatatttaatataaagcaaagatgatgcaaaacttgaaggtgactccatggccctcaagggatcacagaatgttaaagacagaagagatatggagatgctatcgtccaatctcctaatctcttcatttccaagataggcaaactgaggcccccccagaaatgttgacttgtaaaatctggtggtagtccttcatagtatatgttcactggctttgaattgcttttcccttttaggattatttttgaggagacagggaccaagggtccaaatgatcccagtggctagtgcttagcaataaatgtttcagaatctatactaaatacagtggcttggatgttaactgattaaaattaaaaaagacagaactcctctctgtgggttcttagacagccccattgcaatttgaagaaaatatgtttagtggtttgaggtttcaatgttgtattgtctcggtactgttcttgttatgtctttattttgactctgttggtactagacttcagaaatattgctgatatgctgcctaatccatcaaaagtcacaacaaaagctcttagggtgaaagacgttgtctttaataatgtaagttctcattattgagatttaagtgccccatgcacagtggttttgaatttacagtgtgacactagatggtcctatcagctagttcatgttatgccagaaactcaatattctctctttcctttctctgacatgtaggtgagaggattaaggatatttaaaacagaggagacaccagaatgcatccagtactactggtagagggtggaaggacagatttagaggttttctaaagtagtatttttgcactgaagtagctcttaatgcaagtattcaatgaggaattttatctccagcatgtgagagtgtgtgtgtgtgtgtgtgtgtgtgtttgtatgtgtgtgtgtgtgtgtgattatgcattgtatgttgtgtttgtagataaatagcagcattaatacctgggtgatatataaggctagggagttctatatactcatctgccctttgtgtcccatctccctaaagcacaagccgtcaaaagaatttctctaaaataattagattgtagttaacaacctaacatctggtagaattcagcagcacaggctggaggtgtatctaaagcaggaaatattcaaatacctataaaagggagtaaattatgttgaaaataattatgatgatgagacatacagatatttcaagattactaggctgttgattcctttttcaaaagccttatggaggaaaataacagtggcctctattctcctactcttacttccacacaattattacatggaaatgatatggagctttaaacaatgcctttctccagaactcctgttgaaagcatgtcattgtttcttacagtggggataatattttctatttgtacgtggagaaaagagctaataaaatgttgcatgtatattaaatggatacctgactcaggaacacattaacttaatgatttatagccatcatgagttcatcttaaatggcccctggtaaaggaaaacaacgaatatacttcaagaaaactactgaatttaatatgtatcccttttagctgacagtgaaattctagcttgtgttcctctaaagagtaaaatatttcagctacaaaaattacctccacaaactctcatgtcttagcaaaagctgctattttatttgcacatttttcataagatgaccaattaaagttaaaattaaaggagctgatttgtacacataaatatcctacatagagtttctctcttatttacaagacttgtcatttaaaaacaaatattgaacagaatctccatgcactcagtacaactcataataagtagtgaaaatatgagattgataaataaattagaaactaaataatataatcaatttatgtacaattctgttgttaaagtagtgtgcatttgtcaaaaacatttggaagcatttcccaaagaagtcttaaaaaatgactaagggtttaggacaaggtgtcccttgcagatcattcttacctaacccaagttccagcctacatttgggtgtagagttatgatcagcctccttctatcagattttgtgtcctagtgagatctctatacatcactggaaatgaagagctgcatttgatcctcatctaacagcgttctttaaaaaataaaataaaaactgaaactttgtcaatcagagctgctcacaccatttacaaagagaagcttaaatagaaaatagcagcaacaacaggtggcatggattccagaatgggctagcaaccaagaggagaagcaacactgattcatgagcatagctacagggcctggtacagagccagctccaaatccctctgcttttagaacagcttttaattttttatcatcttatgaaatgagagcgaattagatgctgatggctggcagcactgttggcctacttttgccacagggatgtttattcaggtgtatcagcagtacccatagccacatactttaaatctaatctggagaaataacctttgggatccttcatcctgacaaagtttaatatgagaccagagatgataggtctttctgccttcatgctcactcatgaatgagactggagtacatcaacttgatttcattgagatcataatgatacagcttttccaaaggagtcctttttcactttctcttaacctgagggtactacgttttgcaaacagcgtacaaatgattcattaaaagagaatttgagaatcccaaaaacgaaaattatatttcagatctgtatggcagttgcctcaatgaggagagtggatatggatatccttgtttatgtccttgaaaaaaagacactgaaagcgaagtatcacgtccaaggctctactcacaaattactacagaattatttttaagttgttggtcaatgactctaaaattcaaaaaggaaaaaagaaatagaagacttgaaactagaagtaccaaataaaaagaacaaatggaagaggaaaaagacacaaatttaatcaggaaaataggatggaattgttgctgtgtgaccttgagcaagttttgtaacccctctgtgcttcactttctttatgcctcatctataaaatagggataaagacagtacttactttagatttgatctgaagattattttcacttataaaacatatagagcactactgttcctgcctcatgctaaaaactcaataaatgtttggctgtgataataattattaattaattaaatggtaattatatgtcaggctctgtgcttgttgcaaagtagtttataatataatatttgtataatacccgcaacacttcttatgattttttacaggtgaagaaacttaagcaactctcccagggcacaggtaacaaacagcagagccaagattatcacctaggaccacctgtttcttaagattatgccctctagatcaacctatgtctattattaccaaatacttttctacattctttcttttatgtaaaaaaaagaaccattctacaaaatgtaaacaatgatatcattttggcaaattttacatatctcctttgttatgccaaatataccaatttcctcatagatattaaattagtcacaatgggttcctgcaatctccagaagatataatctgcagcttgttaaacatccactagtgcagggacattgggaagcaatatatcgtatctgtcataattcttatctgctagtaatagtaatgaactgtagctatcctaggaaataaaaaggatttgttggaaggttataatgggtactattacattggctgagaaaacagacttctaagactggaaggaacaaatgagctttggagggataagaagcaaaacaaacaaacaaataaataaataaaattaataaccttttagccagaacgacctggccaggacagagccaccaatatttttaggcctccacctcctctacgcactaccattattaccgctggacatggtaacaactgcgccaaatcaattctaatcattattccatccttgtgttatgcaatttagattcatagtctgggctgatagcatctgattagctgagcctggcttatatacccattatctggctgccagaaggcaaggaaaggagcctccagtctttgatttttgtatgaaaggtgggtactgtgttcaattagtacattacacagtgaagaattggatgatgaacagccaaaaacacacagcaaatttccactatgccgattcaggtggcccagaatcctttctcctagtggcctatatataaaagatttggttaccccataaattcctgggtataattaaaaaattggagatacaccactttgtacacactgctttttgcagtggtttcctagaactgcttgttaatcaaagggcattactcttgtgttggcatatacatcaatgagattttatgcttaaacatacacttggaaaacaagacaacatttaacacttcaaatatatgtgtgtgtgtgtgtgtgtgtgtgtgtgtatgtatatataatatatatatgtgttccaaatttccctttcacatgttttcaattgttcttttcatatcaattgaacacaaatgacatttaccagccttcatcagcctgtatctcaaaatgttggcattatttatatgttcataagggctttcaaagaccattactgacactcaacacacaaccaccttttcatctttaccatagttcatcttaagtggaggaaacaatcttgttttacttacacacttttctgctgctatcttaaatgttcataggaatcaaaattatagctaagaattaaggtatttatagacatacatgaaactttagaatataggcagatagtatagcacatagaatatcaattcagtacttagaaaagatttgggtatctactatgaagtgtctagaaacatacaatagtatttgtagtatgtcattcctcactgatttgaaaagtaaaacaatttctaatgtttatattacatgatttgttaatagtatgcctggattgtaaataatacatctcctgagaccagcatggagaaccaagatgcgtatttttttaaaataaagaatggtgagaactacaaagtgattggctcacttttggtaattcacttattaaaataataccaaacaatatctaagaaaatacactaaatactatgaatatgctaggtaggttggaattatagtacccactcaccacctgccaatgcatgatggatctgattagcatagatgaaatgccaaactctcaaagaggaatactgaagagagagaagacactcaggcgcttgggactggcttcactgtaccatttttgcttttgttgtgaccagagccactgaaaaacaaaccatcaaaaatatttcaacttggcatttgtattcagaataatttaaatggacaaagataaacttgcatgcaaagctgatttgtttatttctttgctatttgtctgcatcctccttttaaaaatgaaagatattaattaaaaagaggtatgtggaacctatcaaggcacaatatttcagcaaaatgcagccctactttctaagtattatagacagtaatcgttctgtgtacacgaataggtattcaagttgactaataataaataggattagaaaacaggggtcctacaatattcctgatagaaaattagatacgtagataattttttcttccttttagactcataagcatctccttatcaagtctaaaggaaagaagagaaggcaatgaaggtaaatacagggcagctttttcagtctgataagaaaaataacattttgggaaagagtaagactactctttattttttaaaatgctgcattatatattgctccagagtatcatggggactgtattacatttaatttagttttatttattcttggcccttacaacataaaagttgactttttcaaaagtcataaggaagtatattcattgatttctcaaaactagtatatctaaaaacaaaagatgatactgcagcccacatataagggtgaatgaaatagcaaagcagtagaaaagcagcaagtgaaaaccatatgtgatgcatttgtggaaaatatatgatcatagcagacaggacacattcatagagaaagggacttttaaataacaaagttttgagacactactcaatgaaaaaaaattaaagtttttttgcctaaaatcatggagctttacagattcaactcccatcacaaatgcataggcatttttaaaaagggcattggcagaacaaactcacgttggaaggaagctgtgcacctggctttccttattatatagatgtgtgcaatgtccaatagaaaaacaagtctagatttttaaattctggttaatatttgtttgtgattcatttcaaagactgaaatgtgagtgattatagaacaaagacagaaacatctttgtaggtatcagattaatattagccaagatatgatacgaaggtcaggacctatttgatgcaaagtgtgaagcaacatggtcaaacacagatgtaaaactctgtgtgatataaaaccaaacctacaaaaaagaatattttaccagaaccactcatttatttacccagcgtttattgaatgaacacctttgatagaccaggcagtgtggggttacaaaagtaaacaagaagcatccctgacctcctagaactcaaggtgagaggggcagacatgtaaaccaataattagagcacaacttgacaagatactcccccttactgctcccagttaattaatcctccagtgataatggattgataagtaacaccaggtaagattatttgtagttgtatgcatgtgaatggtctattttaaactttaaagaagaaaaaataccacatctgcctccagaactaatcttctgttactggcataaattctaattcagaaactatgtgaaacagattttcttcttccaaagcaagagatctcttgtatcaaggtcatatttaattcttttgacaggatattctgtcaggtatcaagctaaaatagaagccaaagaagccagatttcatcctaatttcaggaaaacaaacaaatatatatatatatatttgtttgtttgttatatatatatttgtttgttatatatatatgtggtgtgtatgtgtgtgtgtgtgtgtgtgtatccaaaataaatcaggaaaaatgtaaaagaaagaaataaatagtgaaaactaataggaaatatattttaaaatttccaatcattagcaacatcttgtcagttacagacagaaggggctgcctatagaagagctgaatcaggcatcaggaaggggattgaaaccatcaagttcatattaaataatgcgtggtggcaaccccaggaggctggcatctggaggcagccagaatgagtttttaaattacttttattggaactcctcagctgcaggtaatggcttaagggctgcagaatatgcagatttgaaagaaatgcaatcttactatttcatagctttgtctcccctgactccctggcagaaatctttgagaatgtttctgccacctgcacgcccagcacattttcttatctttcacacattttcttctcttcttcccagtatcactagatcttggaaatgtaaacttcgacttgtggctatcctatactacccttcttcatttacacaaaattttgcaattatacaaaatagcacttcaatagtacataatatacctgcaggagcatagtatttcttaaacactcaaagagctatctttcatggaaaataccttaggttcaactgtcataagttctatcattaaaataataaggaaacgaattatgtacgtaaaatttttaaaaatgcaaaaaagtttatgcaaaataatgacctgtttgtcttgattattataatgaaaacattaaactcagctacatgtgctgctgctctaattgtcagatatctcacaattgctcttgtcttagaactactcatctactgtcctgtttctatgatatctatgaagaggtagaaggcatactgaataaggaaaaataatgacaatagaaaatccctgctgcagaaccatctggatcaccccagtaactttggcatctccagtgttatgtcaacataagggaaagggtcctttcaccatctttgccaccccagccttggaggccaactcccaaatgacagtttacttggaattttgtctaaaaactgtgtcccagaacacattttcatccgtccatgcctagggaaagatatttttttttaaatctggagaaaaattagaaaatcaggactaagtgaaatagatttctttttttagtaaatgtatccaataagtagataatctgtccttgaattaggatggaccacaatttacctcttttctgaattggtttataacttgttttacaatacttatggtcttgcaaaaagaaagaaatttggtctagtgctatgtttcagttagtaagaaattcatgatgtatttaaaatgatagcagagtacacagcctataattactggttgttatctcccacccaaaactcaaaatctgaaagataagcacaatggggaagtttattttaacatcatcagtagcagctacagcaacagcatcacaaacacctgggtagtacaatagtttatgtagcacattaatatcatgatatatattaagcttcctaaaattttatgaattgacagggaaggcattatctttagcatttctagaaatgaagctctgacaaactatacatgtaatatttgtctatttttttctaccaggttgcttctcacaagtacataaaacatagtaatcaattacaaaagcattttgtagaaaaaagttgagtcagggctttgcaccaatgtgtaacatgataattcatgaccagagataaaccttgcttatctagtcatgacatagatgagtgatacacttttgattaagagagattcgaattcttcatggaaaaatgtgaaggcccaagctttcacggagccgttttgccacattgtgttcagttaagcaataagcttcttctattatattggaagagtaggggttttccagggaataaaagtgatacagtggaaagaagaaaagctccaggtaaagtaataatttgggccttaaacatttgcctggagatactatcaaaagaatgatagttagtagagactaggaagggtgtgtatgtaagtgagggataaagggaggttggttaatggatacaaacatgcatttagacagaaggagtaagttccactgttcactagcatagaagggtgactatagctagcaacaagatattatatatttcaaaatagctagaaaatttgaaatgttcccaacacaaagaactgataaatgtttgaggtgttagctatcctaaatacccggatttgatcatgacattctacacatgtatcaaaataccatatgtatcccataaatatgtacaaatattatgaatcaataaaaagtaaatatctgttactcatttacacttaatctaaaaacaattaacttttctctggaaaaagcatcttctttaactgagcacacaacttacagatagatgtacatgtgcatcaatcagaatctgggcataaaaccagtcagatcacatgaactggatattctgaggagagtttgaaagagggagtagttccaaagatatgagcagtgtatggggaataccacaagaaagtataaggcaaaatcttggagctagtaagaggtgaagagagccacttttaggtctaaataggccagagaagtggatgatgacaacaacattgagatgaagtggctatgaggcctcttgacaagatgcagctagtccatgttgaccacacagaaaaggaggatgaagaataactaacctaacctcactgtcttcccttcatctgatagaacttcttccagtcttccccattgtcctaatctaaaatgaagccagaaggcagacaagtcctttaatgtaatcataaagatcagacttccaaggcacaaggcaaggtatagagggatggaatgggaatctggagacaaaatgaaggttctaagtatatcgagggttagaaactggcaaaaaagggaaaggacaaatgtcaccagccaggccaaccgtattaactgtgacaggtaaacttaggctcaatgaagttaagtgacttgtcccactgagtaaatggcagtcctggaattataaccaagatttttatttccaaacttgattgttagtttatttcaataaagctacccatttattggcttttaaatggtttctaaatgtagctgactaaaagttaagttaatgagagccaaaacactatgtaaatcctcctggaacatctctttataatagaaatgataactatacaaacataaaggcagcaatttctagagtattcatcacttattttcccaaagtgttaatcaaaatatataaaaacaatgctgtaaattgctcttagatccccctctgtcaacttgtgaaaggatatttaatccatcatagccatcaaataatgtacctactattgaagcaatataaggaactcagtaattaaaggcctgggatttggagttcgacagacctgggtttgaaatcctacttaactgctaatttaccatgtggtttttgacaagttacctaacttctctaagctctattttcacgtctatgagttaggaataattatagcaactatttcatacagctgtgataaattatttcagatagtgttttcagtgcataaaatgccctcaatcaagtttaactgtcagtggtattcttaatagtagctcaattatatctaatcactttgtacatctaaatgaaagatgacatctccctagggaaactccttcccaaataccactcttatgaggactcaaagatccatattgagattctccaataaatacatgaccatatgtgtacttatagtttatctgtaagtcaagtctctatcactccatctgtctatactagcaatgaaaataagacaacctatctccatgatgtgtcaagaaagcaggacaattgtattaaacttttgtagtatgtaggatgggccacccaagacataatcactttgtcccagaaagtagtttttctgcatgtggtattttgttttgtactttcatgttttattttttaattgataagtaaaaattgtatatattttgcacatgatattttttatgtttcctgcagtagtgatgagcttcgttcacagcaactaaatattggagcaaaatgtttgaatctgtgattctctatagtcactgtcattcaaaaggaaattccagttagtgattcaaataggcgatctctaatatttagtactttactgagctcatatctaatcccttttagttgtaaagtacaactatcagaattttttttactatttgaggaaaaaaattagtttctattcacccagaagggctgattactctcatcaaatactctggcttatgaataatgtatgtatgtaggtaggtattatatgtatgtatatactaagtttgtatgtgtatgtgtggtaaaacccagactcccacagctcaagttctttcattcctaccccctaaaggaaagccttgctaccagtttggtttttgtccttcttgttttttctctatgattttataggcataaaatatatttatattggcattaatataaacatagacatgtttagctatagatatgtaagaatatttgttttatttacaaaaataggatcatattataattttcatttcccatttaacaataagatgtagacagcaagatctacatacatagatccagatcagcacatatagctctatttcactctaagggcatggtacatggtattccactgaatagctgtatcattcttctattaagggacatttaagttcttatagtttttgggtttttttgttttattttgttttgctattacaaacaatattccagtagcttcctttgtacataagtatttttacttatctgttttgctataatttttgtctaaatagaatcttataggtaaaacttctgagttattgcatagtatattttaaatgttaataaatacttctcaattgccttctaaaagtttgttccaatttacatgccctccctgacaacagtatgtgagaatattctgatactttactggattagaaaatatttccattacctcagagattacacttgtgaggatataatctctgttcatggagtaaacagtgtatgtgtgtgtgcttgtgtgtgtgcattcgtgtgcgtgcgtgtgtgtgtaggtttggtcatattttaaatgtgttgggagtatggtctatctctaactcaaatggtgtcaaccccatagtgacaagcattctgtggcgtcatgcattccatggacagctcagcaactgtttcccttgatgttgaaaacagcattctgccagagtctgtgctgacagacaacattagtcatccagtcttttccacagggctgaattgtttgttgaaaaaagccattaggagtaataaagcaatgtgagactaagataatttttcttgagtttgctaatgctaaacaaacacataccctgtcaaggcagccagtaagcagtatgaggcctgctgcttacctgtgctcacaggtggcagcaaaatcaattagctgcttctacccatggcaagtcagtgatattgatccactttataaagctacatgacattaaattgtttttttttgtaaaaaggcatctttcattctgtatttttcacagaacttctcacaactaactcagctctctatgcctcttcgtactaaaagaaacttgataaatagcctaattttctctaaggttcccaaaagacttttatcaaaactatctcacatctcaccatacctgagatccatatgcaaataatgtgctgatcttggagaaattatataagaccaaaaagaccagatgtcaccctcatctttaaaatgaggcaaaatatgcatgatatcatttagtatctttatatcagcatctttaaaaattttcaaaaagttgtacacaactgaaatatgcagaagttattggtagaataaattatggcacaggctaagagtggaatattttgcagtcattattagtaaaaagtgatattttggaagagtatcttatgaaatggagacttattcatggtaggctctttagtttacaaaagaagtgtgttgaaatgcaatatgtatagtaggatttaatcctgtacaacaaaatgtatttaaataacgagaaataccactgtatatcaacagattgttgctgggtagtagtattgtgagaggtttatattttcttccttaagtttttccacatattctaaaataagtagtaccaaatgtgctttatataacacataaggaagaacgttttaaccatcaaatgacgagacgttggtataggttatcaaagaaagttataaagcttccattatagggaaggagtgttgaagaagataatatatttaagcacatgttcttaactatttgcagataacttgaacctgattatttagataaactttggcatcagatctcggtacaaattcaagctctgcttcttacaagctaaattattctgaaattattctggagcagttgtatcaccagtttgagccacagttttcttgtatctattaaatgagtataataaaagcattcctgtagagcttctgtgggaataaacataatgtaagtaaaattagtatgtaacacatacctggtacatactaagtatggcagagctgggatctctgttcaccaaatccatttccctatcctcctaggcagacatctagtctatatttctcagcctcaaattacagtgaaggatgataattttatgaagtcgtggctattgtaatgtaggtagatataatgtatgccaattccaggtctggcctataaagacctcttgcgaaatccttcattctttccgtagctgctaagtggaagtcactgccactaggtgaaggtggaagagctcccaataacctgggttttaaaattactagatcaaggattctctaattccttcacctattgaactttacaagagcaacaaattctattgtgtgaagccattggaactcttaaatttatttgttatagcagttagtgttattttaactaatagagtgctcaataaatagtaactgtaaccactactaatatctcccctaattttaagatttccctacttacaactgctttaaaatacaaaggagtggggtgggcgtaggggccaaaatttaaaagatagttggtaataaagctgggacgggatttatggtgactggcatgccacctgattctaaaaataggactgtatttcagaagaaggaaaaggttatatagaaatatgatctagtgaagcaactgcttcagagaaggtgcatgacatcatagccatatccaccctaaggtctgcacaaacctcctatacaaagagaaagctgatatatttccaagaatatcttctaggtgctgttatccagtttgagtacgtgatctttttcttttatgcacggtgcagagtcaaacggttgcaaaattgaagtatgcattgcctttgcctctagaatgagtcatgaactcaaaggtctggctagttgtggtcatgaaagattccctagactcattcaccagagcaagatgcctttcagtgttgaggtaagttaattcctgcacatgtgtagtttgtaaagccctttgggatgcaaagctctctgcaattgtcagatgttctttagattattagacaggaagtcaggataaaagcgcttccaaatgctacaaatctctaaggatgtaagcagtgctgtataataaaaattgcagtaagccatgcaaaccctctgctacaggcagtatcacaaaagttcagtttttgtttgtccttcctgtgaagtattactcttatttaagcatagaatctatgtcctaagttggtatacaatgtttagatgctgatagctttaactatttttaaaaccttgatgaaaatatctctactgcttccagacacttgaagtgaacatttcaaatccccataagaatgatgtatgtaattacattactgtataataaatgcagttatgagatgaaatggaataggtttcaggagaagagtccaagaatttcagtacataatgatacattctcagttctgcagttcaaaatgagatacaatatggcacagacttccaatgatgatccacattagaggaaaaaaagccccaagcaatagactgatgggatgagtagtaacaaaaatatctgaatgctacactgtgattatcaaattctgtacttaatataagcactaccatccccaaacagggtcaaaagtttaaagggaacattgcagaaaatgaggcaccagagaaagttataactaactaggtcaaaagtgttcagagtgtcaaaactcagaacgtctataaaagggcaggaaaatgtcacaagcctacaagaagcaagcgatgactccataaaatctgattattattataaaagacaggattgttggaagtaagcaagaaaattattcccagtatttaaaatgtaaaaataaagataacatacctgtcacagaagtttctccaaaattaaatgctaaataaattaaagcaattaccaggccagtagctgtgaaaattgtaataaagaaggatccccttcctcaatactttttctccattttttctgctacctgccaggcctctaacttcctgttgtgaaattgctgcttattgtcatttgaaaacctaattgtgatttgtttaaaatgtgctttttataatttagaatgaaagctacttaattatctttgtatttctttactccttgatttaatgggtcattgctttagatttattaactaaatttcacatctttgttatttataaaagacctactttatagaaaaatcattgttttaaaagcatgtaagaagtcctctcttgctattatctacacatacagctcgtcaaatagacatatctgatcattttgaaggggacttaaaggaaaaaaataaaaatatagaagaccatttgggctaggaagctttatctggtgccagtgatcaggcaaaggaactactggggttcatgagtagtccaaataaatagcatacttcttcagcaccttaatttcctgtaaaagctattttataaaatatagcttagtttaaaaattaaacagcttcttagtgtttaacttcaaaattactttgcccttcccacccaatcttatcagaagaggactgggagaagtgtccccacgtgggagcagatgagaatgcatccactttgcaggaaggccaactgcctagggaaaagcagaagctgaataaaccttgctcaatttattggtttcaaatttaccaattaaatatgtccagcagaggaatgagttagaggaaaagaaaagtcaggaatgatatgactagtaaaactttctacatagaaaaaaaagtcagagctgggaataggcattcccagcttatagtttcaaaaataattaagcagtctttttgaagagtagccttgccaactcaaatctagaaacatcaatctccaaccatctttgctgctgccgcctgatgatgcagcactgaaaaccaaaactcagcatcttgatgtattttaacttatcagccttcaaagaacagccaagtacaatttttgaaaagacaaaaatcagtcagctgataactggcctggatggtgttccattcaggattctggtagtgacagaattcattcagatggtttaaataaacatactttaatgagggtattacttataagggtgtgggcaggattaagggaacaaacaacaaatactggggcactccaactctaataatggtaggacattagtagcactcttaggtcagaggaaaatagtttcaattacaaggggttggaaggtgaaagtaaagtgaagtagaggcatttcttcccttctccctccctgcctcagcttcaccctacctccattttccagtctcttgttgacccccattgactgaagcctatagaaactggagagtaagtgatctgaaaggacagttacttggggtcagcctcccaaggcacagagtgtgacagagatgagtgaagaatgaatctgaaggtcaaatggagaacaactagcagagacaaattttactcaagaagaaaaatataatcctagagattttatttgtggtcaatataaattctgcaaactaatttttagagtgatattgttgaaaggtcctaattccagctctaactctcagacaagctttgccccaactgatgcaaacagatggatgtctattcatccacctcataaatgtcaccaaagggaaatgctatgatttcccatagtaaaacaattgtagccattttatttcaactaatttggtagatgtttgccttttttcactccaagtagattatatggtatgcttttttatgtgtattctaagtaatttcaccactacatactctgtgtattcattttctatttctgcataatagattctcacaaaattagcaacttaaaacagcattaacttattatttcacagtttctatagatcaaaaatccagtaggatatgatcaggtgcttggttcaggataccacaggctgaaatcaatgtgttgaccaggctgagttcttattatttggagaccgtgaggaaaactcttctaccaatctcattcttcttattggcagttttgttccttgtgtgtgtaggattaagatctttgtttccttattggctatcaatcagggccactttcagctcctagaggtcacccacattccttgccacatggccccttccttcttcaagccatcaacagcgcaccaaatatttttcatgcttcaaacctctgacttcctcagtctgactcctaagcccagatttaaagggctcatatgctgaagtcaagctcatttgaatcatttttatatcataaggtcaactaaattgagaccttaattacttatgcaaaatcccttttgccatgtaatgtaacataataaagaaaattctgtcttatcacaggtttcacgtacacttattcacaggtttcacgtacactcaaggggaggaaattacacagttcacaaacaccagagggaaaaaattgggggagctatcttagaactctgcataccacactatgggatgtcagtaaatcttattaatataatctagtaattttctcccttaattctaaatttccctgtctttcaagtattcaggaaaacaaagctcattgtatcatcatcatttttaaaatgaaccattttgttcttgcaaacttcataaaccatatctcataacttttgaacctctgattaaataattccaactcctttaatgttttttcatgtttactttttcaaacacattcatatttcaatttatattctcttaatcttcttcattttttcatatccctcttacattggtgcgtcaatttttgttcttaaagtcatttacagtggaacagttctttaatatatttgcaagtcttcttgaacagctgattcttattctaataattattgctttagtcctttaaaaaggaagccatggccattagaaaactaaatttaatcattaaaaagaaatctttcattatccaggtactcaaaatattgttgaaatatagtagttgtaacagagggagtaagtagacaggggatagtgctagaaactgagaagttggaactcagttagctttcatggtgtcactcagttaccaagtgatgctggagagtgtctgagacttttgtttatcacagttacttcatccgtacaagtgattttcttgatttcctattcttgctaacacttcttaattgtccttgagataacagaaaacaaaatctatgaataggtgtattgaactcagtattttttaactaaaattaaataataagttgaaaattacctaaggtaacaattgaattatagtaaaaactaatctgaaagtagaagtttcttgtttgtctccatggatgattgataggtttatactattggctccctaggatctgtaaactagggttcaaatggtaagaaaaaataaaatttgctccagaaagtatcgaataatccaactgccaatgattacattgttctggataattgcatttgacagtccataacacaccaccccgctgtgagggaagacatgtcaagaaccgatgcactgttcttgctgttattctgcaagatttacattcatgccttgaggtgctccaaagagaaaacattcatacaaaatatttttaatgttttctaatctatttgttacaggattagcttttgttatgaaacatagggtgtcacaattaaaatcagctctaggctgggcacagtaactcacacctgtactttcagcactttgggaggctgagggggaggatcgatcacataaggccaggagttcaagacaagcctggacaacatagtgagaccctatctctacaaaaaatttttaaaaattagccagacatgatgatgtgctactgtagtcctagctacttgggaggctgaggtaggaggattgtttgagcctaggaggtcaagattgcagtgagatatgattgcaccactgcactccagcctgggtgacagagtgagatcctgtctgaaaacaaaaccaaaaataaaaaccaatcttagttgtgttttccaggctgtgttaaactattgaatgacttgagcaaaacaaaacaaaacaaaacaaaacaaaacaaaacaaaacaaaaaaggcctcttattcaaaatgcaatataaaaaatgttcagcaactcttacttgggagatttttatataaggagtatgtttgttagtaaataaatacaacataaaattgaatggaagtgtgctgagttgtttttctatagaaggcaaaagacacacaaatagatgatatgagagagagtcattaaaccgagtcatttgttcaagtccaagccagatcagtagcaaccaaaagctattactaagtgatgacatgttttgacctatgagaaataagcctgtccagttcctaagctacatggattggcactatattttggaataaatgagcacaggtacttaccatcctcctcacctctagggattgaccttttccaatggggttttggcccattgacataacaatggggaaaattgcaatgcagataacctttgtgtgacattctataggcagttgccccataagtcaaatttcagttgacccaggattatctaaaaaggttgatcaaattagtacacttaagaatgaataatgtatggtcctgtttcccaaatgaattggagaaaactttacagagagacaaaagggaaagacaaaaaaatgctaatcaatgttctagcagccacctgtgagtgactaagaatcgttaattaaaattccattcaactataaaaaatgcaattactgtaactccaattgttaactttcattagaggcaagaacaatcagaaacacacatatacagatacaaaggaaaaataacttgcttctgatctgtaaaatcgtgcatgcatgtgcacatgcacacacaaacacactgaccagatgggtttaaaatttattctgtggtaaactactattgacagattctaactctagtttgtctcattaggtcaccctaaagaaatagaaccagaagattgcagaattgcggccttcgattctcctctctaagtagactgagtacacttgaagacaacaatatgggcattcattagatggaatttggaagacaaagctgaggttaaaaattacatttcttttgactaaacttaggcaggacatttagtctagcgttcaccacaggtctcattggtccctactacctgtaccagactttccacaggcacactatatgcgtggccattaaggttttta

SEQ ID NO: 1301 - DNA, 3119 bp, Homo sapiens
gcctaaaatttgattttctgaaaaaagtatgagatgcacattttaataaaacatgttcactcttcttctgatgtgttttcatacatccattatgtctttcatagagctataggagccttcagattctgtagggacgcgtttccttgttgcttttatttcagatagttattgaaatgaatgaaaatatccttgagatttgtgaatcccatgtgatacagactttggttactactcctcaaagaatggaataagattactgcattaaaaactgggttttgtgtagaaaggaattggggactcaaagtatagaaaaaaggagactggagggggagattttcaagaacaatttcaaaaatagcaacagttcttctagtggatgccaggatttcagttttaagaattttttagtacaaaatggtatataataagtatattaatttaaagcatcggggggttacaaagatgattatgaaactctttactcacacaagatattcatagtcaaaatacaaatataatggatattgctattgaaggcagtttaaattggtacaactattcttggagagcattttggcaataggtattaagagccataaagatgttaatatactttgacagtaattccacttttaggattctgttctaagaaaatagtcttttaaatccacaagttgtatgctaaaaaagatggcatattcagtcagtgcaatatttttcagtttttataaatgacactgatgatgagttttcaataaaatatacagatatagtacttaattttataattttagttaaaaatgcaatatacaaaattgtatatacagtatgattgctgctatataaaaactatgcagaaaaagatgatgtaatacataaaaacattaagagtacttgcatttgggatgatagctacataggttaaatcattctttccagtgttctgatcttccaatttgtctataatgaatgtatcttatattttaaatgatagtaatgttggtgatgaggaaacaacgtattcactcaaggatagtttttgcaagaactattttgtgtgatagtaaaatagtgaaacagtcggtctgttgagaatgatcatgaaggagatatgttggcactttgctcccttgactcatttaggtttaaggtctcttaattagttgatcacagagtaccacatctgaccacaatttgtcaaaacatctgtcccctgacacccagggacctttccagcagggagaagagtgaggtgatttgggaggttattcttcctatctctttggaaatcacatggcccaaacttttctcattaatcaacctgtcaatgtcattgaatcacttataaaggcatattttcccccgcaaaagtgtatgggttactggcttggacacatatttgtctaaacatctcgcttctttctttttatctatgatgctgagactcctaatttaaagatatgaatttctagctttatgataattagctgatgagaacataattttatcaaagacttgccaggatttttgttcattctttgtttttcctaatataaaaccctttctaatttctgatttctttggatatgaagcatagttagattattgcactgtgtcatttgaacagataaatttaattctttgatgtgtttatcctcttatgcagcataccttttggtaagaagattttgtagaatgcatttctccaacctttattttcatctgaattgctgggtcatataacaaaatagaaagtgcacttttgttggactccttagctcactaagtatgatctaggatatgttgctgagatttcttcaacttcaattcttagtccatgaagtcgatgaattaggtgcaatgtttgagcgccctccctgcccagaagtcatgactgtttacctctttggaaagcgaactggggttttgccacaaaatgccaacctttaaaataatgctttgataggggagaaagggagatgcgaatctgctgcttaatgaagagattttaggcattgattaatcaagctttatggcctgttgggtggggaaaattcaatggtccttgcaggtaaattgtcagacttcaaaaattacttcaaagattcttgctcttcctaagagtgtttgtcttgggaaatgataaatttggtcactggtagagaacaattaaaaatacgttgttatttcttttagtctataggtaatcttgacttattttacagtaagattagcacaggttgtttacccagaacactgccaagataaacttacagcctgcttctcaaagtttgtgaaggtctttttcgtaacttcaaatttgtacatttttgttaccacaacatctgtatcctaacttcacctttgctggaaaaattataattgaaaggtcataattctggtgctttcttctggcttgcattggggttaactagcacactgaaacataatgttcattcaccctagccagtgagtccaaaccatgtgaggtgtatgagagcaaccctgtttccatccaaactgcacatatggtgtgggtaagccagtaatgtgagttttatgcaatgtttctgctcatgtacacagtctgttgctcagcaccaattattccctgccagaaacccgctaacctgctgcttttgtacctctgctggatgaagttaggtagcttaaaatgaccacaatgatatttatttaactttagcaatctttgtttgttaaagttatgtaactttaagtgcccaacacatctgttgattgatcacaattgattgcaattagaatctaagaactggaacattgttactgcagtttgtggagatacacatgtgttaattatatatatttagaaggaggaatcaaaatgtggaaatactagctttttgtttatcaaatctagttttatgtcttcaattgagatattattatttaaaaaacgatatataatattctgtttatactttggtagtcaccttgttgtcattgtttccagtttctacttttatagctttaaaaaccacaaaatcagcagggtgagaggtccatgttgggagaacaactgttccctatttcacacagccatcttttttttttttttcaaattctgttttttaattagt

SEQ ID NO: 1302 - DNA, 57414 bp, Homo sapiens
aatcctcaagagttacagttaaggtgacattagttttactctgttttagcctctaacccatatttttgtgttcagcatgtccttatcttaaaagttgctgtcgccaggatattctaagtatctatatcttacagaaatttattcttgttatatatttttggaagtaccattcattggtgatgcatcatatcaattctctgtactcttaaaaaattatctgaaatacttgatcataaaatcaaactaaggaacaaagaagttctatttgttagctccattctggagcctgtctttctgggtacctttcaatgaaagaagtcaatgaaagaagtcaaagtggcctctaaatcacaggccactttttactcttctgaaattggattacttagttttgtgttgtttttaggctcttttttgttgattacgtgaaccaagctccccattgaacctccctggtgacttgagtcagcgttgagagcccggaactgggagccctgattccctttgtggctttttgacaattacctaactttgctgtatttcttcattgacaccgttgggataattgcctttcatacctcgtgggagtattgtgagattaattaatgtttgtaaagtgttttcaggatcacgatgaaaggtattaatttataagcatgtggtattattataattattattagtaatagggatggttgtttaatgcaaattttcttctaaatgtagtgtcatattttcaaaggacaacttctttctttgtggccagatgtggatacaattaaccctttaccctttattttgaagatacaattagccaattgtgtgtgcaattagatgtgtatgcagtttttgcctgaacaactaattacagccctggtaaaacttcttttgaaaaacgctggccctttgaatgttgactctgtctatctgtgtaataagcaatttgtgctaagcatattttggggccatggaggctcctgaatattgaagaattgcttttgcagttacttgagaaagattttatgttcttcataccatagcattgtattttgccattgagcctacaagtcctctcacatggttctagtttcaaaggttttattggtttttcttaatcttgacattcagtggaaatattttccacagactgcattttgtgaaacaggtttttcttttggaatttttttttcccttgaaaattccatttcctttctgtcttcaattcaaacatgtcatcttatatcctccttactcactaaagaggactgatcctctcttcccagatatggcctggtgaaaccatttttacagggtgcttttaatcactacaatgtaacttctacttatacggaaaagtaggaagaaaaatgaggagacccagaagatagtgttatagccatttgtctccactaatctcctaagtgaaaggggaacgtttttggcttttaatggtgagtttagtaacggcctcttttaagacagctactctttaacagtgctcttcagtgatgatcattgaactctgctttgcataatgtaccatgctaccacgaagggggatccagagatggccaaagtacagttgttaacttctaggattttagaacaaactgttgacataagaaaggtgcttctgtctgcaagctgtagtaagtattctacagagtgcaggtgggattcagtggaggtggtgatcacattgattggaaacatcaggagaagcttcttcgtagttgcatttgagataggacctaatgggtcggtcagcttttcatagacaggggggaacgtttgatggaaatgagggaaagtgtttgtctgagcagaggattggatctactagaacataggttcagaaaagagtgatttgtcttgctagagttgtagttatcttgcaaaggaagggataggagatgagactggaaaggcagcttgggaccacagtgtggagggccctgaaagtttggcaggaaactttttacttaattcagctgacactgtggaggcactgcgtggttttgatggagagtgatagactagagctgggctgtgaaatcgggcaggcctcaccatgccagatgaactgcagtggaacagactacaggagaacagatacactcagcaacgttgtggaaattaagaccagagtcatctctggactgttggcattgggagtgaaaaagagagttactacacacatgaggcatactgtggtgttagtatttcttgatatcggcaactatcctgacatgtgaccaccgagggggattcagagatgggcaaagtacagttgttaacttttaggaatttagaacaagctgtagacataagaaaggtgcttctgtctgcagactgtagtaagtactctacagagtgcaggtggtcaacatgactgggaagaaagaggtaagtaccttcaattaaaataggttgtcaggaagcgggcagatttcagagaataactcttggtaattaccatactatggcacatttacacaaataggcaaagatggcaggataggaaatatagttactggagcctattaacctttacactgtgaaaaacgaattagaaaaactacacatatatgctaaatatacaaaaccatagttctatgtatgtctttaatcatggaatagcagccagaacatggtggttactttttcaggttttatttgaaatacttgaaatgaagatgccagagaggaacagtattctcctatctaatcttacaaaagtctgcttcccatcttattctgtcaagcactggtttccaaggagattccgtgggtaacctatcatgtcatcagtctcaagaatgtggagatctacccaagtatccctaacatttctttctttttcttttcttttttttttttttttttttttttgagacggagtcttgctctgtcacccaggctggagtgcaatggcgtgatctcagctcactgcaaactctgcctctggggtcaagtgattctcctgcctcagcttcctgagtagctgggattacaggcacccaccaccacgcctggataaattttgtattttttattagaggcggggtttcaccatgttggccaggctggtctcgaactcctgatctcaggtgatccacccgcctcagcctcccaaagtgctgagattataggcatgagccaccatgcctggcctatccctaacatttctagataacctgatatgatctgtcatccataaatttcctatcctatttcccaggctttttatatttttagactgcactccaccatgtcattggacactgtctcagtctgctcaggctgctgtaacaaaataccatagactgggtgacttaaacaacagacatttatttttctcatggttctggaggctggtaagtctaagatcaagattctggccaattcggttcctgatgaagaaccccttcatggcttgcagatggccaccttcttgctgtgtcttcacaggcagagaaagaactctctccctcttcttcctataaagccacaaatcccatcatgagggccctacccttatgaatttctcttaccctaattatctccctaaacacctgatcttcaaataccatcacatcggcagttagggcttcaacatatgaattgaacgtatgggtgggggtgtgtagggtagaggaagagatacacaattagtccatagcagacagtgagcttgtaattcagggagatactaccaattatttttcaggacacttacaatcagggcagaaggcgaaggggaagtaaggcatgtcttcccactgtgaagcagaagagagagagaaagcaaaggaagccacacattttaaaaaaatcagatctcttgagaactcactatcacaagaacagcatgggggagactgcccccgtgatctaatcacttctctcaatagatggggtttacagttcgaggtgagatttgggtggaaacacagagccaaaccatatcattgatcctattatgttttattcacttaatctgtcaaagactatgagaagtatattagtcactcatcattgtaattctatcattttctgtctgtatttctgcttttttattgttttgtgtgtatcttgatcttgttatttgaagcaagatttgtgacttaaattccattataggttttatcttttatcaacagcaaaaatgtctttatgtattctaaaagcattttgctgtcacttttatatgacattttcattgtaacttctgctttcttttttttttttttgctttaaaaaaaaatcttgctctgtgattttcattcattcattcactcattgaaacagcacttttttttttttttttttttttttttttttttttttttagctcttagcaatatatagaagtgagcaggacagccgtggtcctttcttgggaagtttattttctagtgtgggaaattgtacaataaataaaataattctaatagtagtaagtgctatgaagaaaacacaatagtatgctaacatgataaacatcatgataaaaggcctttaagtagcagtggagattatttgtcagttaataaagggatttaaaacaattacatttactgaaatagctgatatgtgtatgatcttacatcagttatcttattttaggttttctgaggttttgtttccatttagtttgtagtctatttagtttttagttccatttagttatgagtaatatcttgctttatttgcttgttttcttctcaattggtttggaagatgatgttatttttatttacataagtggatatttttacattcactgaaaacattctctaatctaaattttgcctttttatcaaatcaaacaattatatcttttgctttcttcctgtaacatgagaaatttaatcatccacggtcttgctattttatggtctttattaatatagtcttaaagattccatttaattaattgtattaactgtacttaataggttttcttagctacaataattataccgacttccatatttaacagcttttaatgcttactgtcaatttgtgtacaataatttaacctttctgaatttcttaattttagtggtaaacgtgtttacatattactttataaatgtcttcagtatattcttaagctcttggatatttaaaagtggttttctatggtctttacaaaggaacagtaattttactagctataaaagtcttatgttataatctttggtttgctcaaaatgatcactctatggttttctggccaacctgatttttcttcattagtagggaatatgttttatcttttctgtttcatgctataatttattttttatacctttgaagtttagaaatttactatgtatcaagataggtgtgtctcaaggccaagtgagagttagcaaaaacaggttacagagtcagatctgcaaaggtctcagatattggtatatctcatataacacaaactaaatatgtttactatatttaaataaataaaaggcaaacttaaaatattataatgatcatgagaattaaaaattaagtgtatttgggaaaaaatagaacattagaaattaaaaacagttattcaatgcataggttaaagagtatattagacataagcaaagagagattttataggctagaaaacagatctgaaggattactcagaatgtaacacagagagacatagaaatgcataatagtagcatgaaggatataatgaagaggtgtgtctaacatccatcttaatggagagacaaggtcagggaatggggcagggacaatatatgaaaattaggagctaggaattttccaaaactattaaaaaaaaaaaatctgtcttcagatttagaaagccccccaaacacaaagaagaataaatgaaagaaatccacattagacatataatagtgactcagtataacaccaaagacaaacaaaatgaccttaaaagactgccttaaaggaattaacagaactaaagctgatttgtcagtaacagcactggatccaaaggcagtcaaataatatcttcaaagtggtgagaaaatataactcaatctagaagtccatgttcagcaaaaatttgaagattaagggcaaaataatttttttcagatatataaaacctgagtgaatatgcagcaagagactctctctaaaggaaattctaagtgatgtacgtcaggctgaaggaaaatgatcccagatggaagatgtgacctacaagagggaatgacgaactaagaaagtggtttatatgagaataaatctaaactaaaattgattggtgaaacaataatgtaatggcttatagccaacaactccgtagagaagtgattagagtgaaagcattctaaagtccttgctttatgtaggaagttggttaaaacaaaaacaaaagccactgactaagtatgcatgttaacatttctagggtattcactaaagaaaagaaatagtataactctaaactagtggagatttaaaaaggaacaaaaaaagttagtcaacccaaaagcagttaaaaaaagaagagaaaaagaaagggagacgaagcataacaagatgatagaacaaatgtgaatatatcagttactatactatatgtaaattaaattttcctgttaaaaagcacagtttattagattaaattcaaaagatagactagctttaaaaatctaaatacagtactgtggtttacgtgaaaaccctacataagggtacgtaaaggttttgagaaatagggtgacataactacaaatataggtggaatgaactttaaggcaaaaggtgttaccagagatagagggtcacaagataatggtaaaagattcatttcaccaggaaaatatgacacttctaatgttgtatgcccccaataacagactaaaattatataaagtaaaaaatggacagaaacacaaggataaaaagaaaaaatgtcatcagaattggaggttggaatctacttcttttagtaattgatttattgaataaaccagggatcagcaaacattttctgaaagagaggccagataaatattttaggccttgcagggcgcatatagtctgttttgtgtattcctctttgcaccatacttagctcattgggccatacaacaacaggctaaacagattgagtccacagggtatagtttgttgacctctgaaatagagagtaaaaattagtgagggaatacatgatttgagcaacagagttaataaggttgatattgaccatacacgtatggaagagacattcttctcaaggatgcatggaagatttatgaaaataagaagcatacaggaccatagagcaaatatcaataaatggtaaaagattattatcttacaatcaacattatccagtcaactaatacaattagtaaaaccacttttagcaataatctggcatttcttcattaaatacgtgattctttcatgatccagcaagttcattcctggtcatatgctctggatgaactcttgtacactgatagacatacaagaatgatcacagtgctattcatggtagaagaagctagaaacaacacaaatatccatcatccacagaatgaataaataaataatgtttattcacaaatgaaatactcttaaggatatgaaaatagatttaaaactgcttcacatagcagtatggatgaatcttaacatagttttaagagaataaagcaaaccacagaagaataaatacaattatgaaattcaaaacatgcaaagctatccgatatattatttagagagaaatatatagatatattgatctatatatttgtcatgtagctataaagaagagcaaaacaagaataaacgcaaaattcagattagcatttactttctagcaggggaggaaaaggaatagatgggagtgagagcagactccagagttcctggtaatgttctgttccttaaattgggtggtgaaacacagctgattgttgtattttattctttatgccttacacatattatagtatctcgtcattgtttaataaatgaaataaattacacagtggggatggagtaaggaagtatggaaacagcaagggtgggcactttttttgttttttgagactgggtcttgctctgtcatcacccgttctggaaggcaggtgcataatcatggctcactgctgcctcaatctcctgggctctgccagtcctcctgcctcagcctcccccaagctgggaccacagacacatgccatcatgccaggctaatttaaaaaaaaattatttgtacacatagggtccccctatgttgcccagacggatcttgaactccggggctcaagcccttctcttgcctcggccaccaaacccggccagatgaacacttttttttgagcctttttactcttgctgtacacgagagcagagcaatagaacagtaggttggagggagacaggagtaaaagggtttctttgtaaataggacttacaatagcatgttcgaatgctaataggaatgatccgggagagagggggaaaagtcataataaggaagaagagaaggtagtttcaagaacaaagttcttaagaagcaatgcaatctacaaatgagtggtttggccttagggtcaagttgacaagtttaatggggattggggaagaatatatgttacagttgcatgtaggttggtaggtttgtttgtgggaagatgaagatcacatctagagatttatgaccataaatttaaaatgaaactagtcatcatgattctgtgctttcctccaactcatatccagctgctcaagtgcctgcaggtttgcagttggcagaaaattgggcttaactgaggttgaggttttgctagctgaaaacatggtcggaacaaacaggcaatggaattggggtgtatacaatgatgaaacagagaattcaagctggatgaagaaagaatagacatgatggtgacctagacagtgcaaaaatggaccccccattttggggggcagggcaggtcacaaaattggcagagtgtagcttccagagtatgtgaggcagattgttaggtaaatagggttctggggttagtgtagttgttagtgtcagggtctaagatgatcatgggaatacccagctcggttgaaagaaaaggattttggaggacatggaactgagaggatgaagtgttggatgggttgtatatgctcgtggtcttcaaccccgactgcacatcagaataatctgagggactttcatagaatattgatgccccggccccaccccagaccaattaaatcaggatctctgggtgtggtttctcgggaatttatattttaaaagagctccctgagtgattgtagcgtgcatttaggttcacgtagctacgtgaatgttggcattgccaagccaataaaagaagcagtagagagaactgttgtagactgggggactatgggaggaaggaggattgattcagaggatccccgactacttgaacagcacttagcacaatttattgtatatagtgtgcactcaattaatggtagctctttttatttttgttattattgtcatcatcattattattgacagtggcaatagcagcagcattatcctggggaaagtctccagatgttttatcaaaggttcttcacagaaggttaaaaagcactagttttagatgatcatcaaggaaagttcctaataaagtttggcaaaaaagctagaagttagcaatattctgaattgacgttctacagttgttgtgaagcttggaggagttgtactccatcatagcctggcttagcagtctgcacttgtcagaagccagcaggttaggagttgggtaccttcttttcttatgtcaaaaacctaaaggctaagacagctggttgctattttcctgccaataggaaccttagagccttttagttgtgtttcagtgtacctgtgccagggttgggattgggaagaggagacagggattaaacatataacattctaatattttattttacattcccaaattacttcgtgtgcatgtatacactcttactcccttctctgcaaaaggagtattatgagtcgggtaaacagtactatttaaagctaatgtgtacttgtgggtactttagtgactcccgaagatgtggttccactgaagaatgcaaggaattatagctacgaactgtcaatataacaagtgatcttttttttttttttttttgaggccaggtgttgctctgtcgccaaggctggagtgcaatggcacgatcatggctcagatttcaggctcaagcgatcctcccacctcagcctcccaagtacactgggaccacaggcacacacctccacactcggctaatttttgtattttttgtagagttgggttctccttatgttgctcaggcaggtcttcaactcctgggctcaagtgatcctcccaccttggcctcccaaagtgctaggattacaggtgtgaaccaccacacctggctcacaaattatcacatttttgtacaattgcatacgaaaatatattttaatatacattcactggatcactgggaaagctggcatgcaagcagcttagaaaagacaatatcaaagaaagaattcgaaaatatccccatttggaacattccagaatagttccgctctaatttgaagagtaatgagatacatctctctctttatatccaaccagattttagcttgctataaagagacatacctcctatattttgtttccaattgtctttgcactccataataattcatgtcagcttgcattataaatgaataaaagatctaatttaaaaacctatcatctgatatgggatgccatacacttttctccatggccctgtatgaaacaaaaataatgatgacaacattggacaatgacaccaggcagtaaacaatgtaatttctgtacagtgtctctgtcgggtatgttaggtaagcaataacagcaaactaaagtttatgttttataaaccaatcatttttgatactttcagcaacatctttgtcctcatttcaagcttgaaattcccaactgttcatttattattacgtgacactgagtggcttagttctgtgagccccagttctttctctgtaaaatgaggataactctgccttctgcgcagggatgatattattaaaagcaaatgattgtggaaatgctttgcaaattagaaatttctacacataatggtttttatcatcgtttattttttgttgttgtatttctaatccaaaacgtggaccttattttgataagcacaaccgagacctagacagctttaaaacctgatttggcattaccaatatgacacaaggtcttaagatgtcttatttccaacttgtgattgtgatctgtcaaattttagaatgacttattaaggtctaaaagagaaatattactgtattttctgataacctgtgggcagttccctgatggtattgagtaaaatgtggcaaggcaaattaagttacctttttttaaaaaaaaaaaaaactaatatgggtatttcactaagaaagcttattatctgaagaaagctattattaaaataaagagtacatcccttactcaatatgtattcttcagaatattggtcactggtgatccatccttgtttcttttagcctatcctgagaaaattctttttcaccccattcaataaatatttaagcacctgtgatatgccagccatggtactcagggaggaagacagaatacagttattgttaaaaaggtagacagtgtccatgccctcccagacctctcagtctataggggacaaaggtagttacaaaacccagtagggtctgtcctgtgactgtgaagggggacgctgtgggccaagtggatactcttgccatttcttaaataatatggttctttttgagatggttcatccagtactcttagcccttcaaagagagatttttctggacatacaaatttaagaatctagttagtgagtggattttgcagaaaataagtaaagtctctctgccactttaagaaagaaaagcagaagatgccattttaagttcactgctttttaaagttgagcatttgactgcaaagtttgtgaaaggtcaattgctttagcatgtaggtgtccctatcagggcccatgtttgtctattctgagattcactgcgaagttgaacctctttcttggctgaatcagttgctcattgggtggttctagaactaaaatgattgctaaagactggtagattctcctgtgaagaatagtaaacctgttttaaagtgaaagattgttagaacttagagtactgttcttccgattgcttagagagctttgtgtacctccctgtttatttgaactagtctttgagtggattggcaatgaagaataatattcgtattctaacacgcacataatatatgaaaggagatgaagtatactacctatagttgtcttatttattattacctaacattttattgtgctgtttatttggatagagttcaaacttgttcgtgaatatggacctagtaggctggaaataaacttaagacccagtaaaaaagagttgtaacaaaagagttgctatgttttctgcagtgaggattccttatcactttgtgattcttagataaaatcctttccatccaggaaaaattatacttccagaatttaccaaactgacagaacaactaacatgccccaggccaagtaatgtcagttctgtaatcccctaaagccattccttcccataattgcaaaaactaacagggaacccccacaccctggcccctgcacccttgcctgccatgctatatgtttaaaattgacatttgcttgcaagagtaaactgagtgagatactaattcttggtttatgacaaagtgttcctttctggcttgccagtgggaatgaaggaatgcttttgcgtaatgcctgaatacttatcctaaattcatagccgccttctacctgactaaataaaaatgtatgccaaaattattttgaggaccactctggtcgcctcttctttctcttaacaagaggctggcacagcatttcccacataccctgtatgccgtcacttgcagatgtgattattgcagaaccttaatctgaatctcagagtggaaactggttgacatgagggcacaaattctgacacagtccagaattttttttttctttttgctttcaacagcctctttgccgcagacttaccatttctcctttcaaggtggagctaaatgtttaaatactatcacataggtcctggttgttttaaagtgtcctacctagttatgcctctgctattaacttttattttgtattgttagtaggtcctcttaaaggagcccaggtgcattttatagcagtgactggcgttggtagtatcttccccaacatcactgtgttggaattggcattcattgatgttaagatcaaaatgacagctcttcttttgtatgacttcacctaacacatgattatctggattcatttttcttatcttttttccattttagttcaaagttagactgtaagaaataaagttagactctaagaacacaaggctgattcattaagtaagtacattttttcttaggcatctaccatccacaggtttctcatccctaccctccagtgccatgtaagatgctagtgatccatctaatatgttaaacacattcacataaaatattagggaccccttaatttactgtttacagcctttatgcttctaaaaagatttttagtttgcattaagaacttatctttttacaatttatactttaaaacagtagaaaagacatagataatttctgtttagtacaaaagaatccccacccaaggtaaatcttttttacgtaaaaaaatttacataaattattacataatagacttctagggctgcactgtccaatatggtagccacagtcacatgtggctattgaacatttgtaatgtgggtagtctgaattgaaacttgctgtaagtgtaaaatatgaactggatttcaaagtcttagtgtcataaaatgaatttaaaattttcattaataattttttataccaattatgttttggactgacgttttagatatattgggttaaataaaatatattattaaaattaattttagctatttccttttccttttttactgtggctactgggaaattttaaattacatatgtagttcttattaatttctatttaacaagctgctctatagggatcaagatcttctcttctaaccctgtcattttagacttcaggaaacctcatagaatttagagaatttaagtgacttgctttaggtcacatagcattttagtatagtagtaaagcttgagactagaaatttcttttaaatgttaagactagtgcccttctcagtgaaactagctttttgtgactctgacacttttattataagaggaaatgtctattcttcagaatttttcactgaactctttaaagcaaagagtctctctatactgtaggtaaatgttcctttttgtttgtttcataaatttgaaatatcagttattagctattcttaaaatggcgatggttttccctatgaaaaccttacatacagaaccgttatggcagcagaaatattttttaaatagatctagttaataccgtagtagagttttcaaatttccttgcacacttgtaatacaaatatgtcataaattacaaatttttattgggtatcttccaataacagctatcatgttagcatataactgggaaatgatgccagtaagaataaggcctccaggctatgtatttccttggtaaattgttaatactaggcaactatttattttctcttgctaagctttaacactctctttgctagtattgtgagaacagtctatctttgagtgagagatttactcaatcatagtaaagtaatccagaattcagttcttaagaacagtgtcgagtagtgctgcgtgatgtatgaactgtgaccttgggccatttatttaatgtgtctgtgtctcaccttcctatctgtaaattggggttaatactatttatctgtaaggtagttgtgcagatttcaatgacacgtgtaaagaatatatagcatgatattccataatatctcatagtgtccattttatctcaaagaaaaggtaaagatcaagtatttattcttttctttaaaatatctttagtcttctcctgttccctagaaatcctctaccactgaactaacagtttttggtcaaatctggtcatagtgacatcttattttccatagatacgtaaaaatttgtaattattacctgcaagagatattacaattcatacaacactaatagctggagatactttcattacaaatacaatgttcataaaatatcacatgtataaaataaatgtaaacagatgatactatcttaaaaagctcagctgagtagtaatattttttaattggattttcaaaatcatggtaaaattttgatatgttttgatggctattccaaatactgctattataacattgaattggattttaaaacttgatgtgtactgagagttagattgtcgaaaccaatacttttcaataataactcttccagaatttcaaatattttaacatggaagtatggaaattgagtcacataagtttacttaaaagacttttcattctattttaaaaatatatttgatccaccgcatattctcactcataggtgggaattgaacaatgagatcacatggacacaggaaggggaatatcacactctggggactgtggtggggtcgggggagggggtagggatagcattgggagatatacctaatgctagatgacacattagtgggtgcagcgcaccagcatggcacatgtatacatatgtaactaacctgcacaatatgcacatgtaccctaaaacttagagtataataaaaaaaaaaaaaaaaaaaagacagcaatgcaaaaaaaaaaaaaaaaaatatatatatatatatatatatatatatatatatatatatatatatatatttgatcataataattgttttaaagtgatacagcttagggtgaccaatgaacatggtttgcctgggactgtccagttttagcattgaaagttctgcattccaggaagccgtttagttctgagcaaaccaagatggttttcactctagctgatgcttcacagtttacatagctttgtgtatatatatatatattctcactggatctctgtgagataggaatgacagtattgtcatcaccatttcattagagaggccacatgctcagttaccctggctacctgaattagcttcaggtcccattctttatgacattgtctcctttcctccagatttcagttgaaacctcccctccccagtgagcgtttctctgaatgtgcagtcaaaatgagttgtctttttccctcttcatccctactgcccatcccatctcatttcattgcatgttactcccccttataacacttcccacagttggtttcctagtgttttgcccaagttccacactggactgtaattctcaccaaggcagcatcatgactcttcccgactctggtgccgggcacattatagggactcaaatctaaatgaagccttgctatgttgcccaggctggttttgaactcctggctcaaagcaattcttctgcctcagcctgtcaaaatgctgggattacaggcatgaggcacccaggatgcacattttttaactgcaaaaaccgaaaccattatctatacccatttggccaaatttctcaaagccacttggttttttctacatgtagctacaaaattcttaagatatttttagttgacagtcatcttttgatgtatcgaaccaatatgaattaagccaatgaggaatttttaaacttattaaataaagaagtgaattgttgaaagatacctgtagaagctcctttgaactaatgatgtattacctggcatagtattttgaaaaatgataatttttaaccattgttaacattattaatcaactacagtataacctgtttcaatttactagtctctgtttcatttttccctcaaataactgattttaacagactctgttgtactactaaatgtttcaagatatatattatggccaatctgtgttttagtttgccatctcaaaataaaatgacacatgattaatgttttcagaaagaaaacacattttagcaatttttgatacattgctgtgaaattggtaattgggctgaagttacacgagtgttggttggtttcctgcaggaagtcttcactttctatatcaacagttgatctggtgtctaaagtgttcacagtttggttaaaattatactcgataccaaagatagtacttccaccaaggagggtagagtcaaataacacttatggtgttctcaaaaatgacaatagaggatatgccaaatcaagcttactattattgaaatgtttgcttgaaaaagttatttttctgagcattgttaaaggaagggaaagggagagatttatgaaatcttgcctggaaggtgacacaggggtttgaaagccagtaaataattataaaaattataattattattcagtcatcaaacttaaaggaaaagacaaccagaaagtcaagtctgcttttaggattattaggtcaattatcagtatttttgaaggaaagaattttttaagctatccatatgctggcaattttttcatattttactgccaactttatttaaactactttctcaatttgcaaggataacaatacaatttctcttgttctttgaaaaactctatatgccacattcttaaagtattattgttctacctgttatgtaagttatggttcgattttatattacgtgcacttcttggaatgaaatatttcccttatgttgaaatttgggataatgctgagtatgatggacttgatggacatgttcaaatttcattgtagagagtgaggtaatagtgactaacatttattgattacttactgcattctgcattctgtattgaggatctttgccaacattatctcattcaatcctcacatcttacaaatagattcacttattcccattttgactgcccatcccatttcttttcattgcgtgctgctcctccttataacacttcccacagttgcttttcttgtgtttgagaataaaaagtgactgaggtacagaaacataaggtagcttttctaaggtcacacaaatggggagctgttaactactatatttatgttgtgtcctgcagttcaacacagttcactataaaagtagttgtagggttatgcacatagaagtttacccagtgtaaagctaaggagtgtggccaagagcaagacaggtactgtggtctagtgaattctgggaggtcttctgaaggaaggatagaggatgaaaccactctatgacccaaccctgcgatggtcattcaacagtatttattgagtgtctactgtataccaggtattctctcatatactgcacatacaacagagtggacagggaccctgcctcatggagtttaccatttagtaggagattcagaccaaaaactaaactaaaataaaaataggcaaacaaataaaattacatcagaccatggtaagtacagcaaatgaaataatctgtggattgaaacagcagtgtagagaatggggtgaatggggtcacatactttaagatggagtggacagagcaggcctctctgagtggttttaagctgagacttttaagagttaggaggatatgctcagtgggaagcaaggagttttagatagaactgtggagcaaaggcaaattaaaatatgatgccttttcacattcagattggcaaagattaaaaagtctgaaaacacccatttttgatgatgttgtagggaaaaggaaaaccttcatgcccagtataagtctgtacaactactctagagaccaatttggcaatagctagtaattgtgaagatacaattttgtatataaatcctagagcaattattcttaaaagaagttttaaaaactatctatccccatgacatttttaagctatcataaaacttttcctttataactttaatagttacaaagataagaattttttacaaattacaaatattgatatttaaatatgaaactcttacatcattctttcaaacatatttaataatatatccaatggaattgagatcccacagcaatttgatacattacatcatccatttaaaaaatacatgaacaagctaagctctttctcaattcagaaattttgcatcgttcctttttctccttgaactcagatttccatctacttccccccaaagaattgtatcttttatcttgaatgtcttttattgatcacaatatcatatttcttggcaacaaagaaaactgatataagttaatttaaaatatatgtatatttaccatgaccataaggccaagtgttataaaatttcttctgacttattattttaattatttctggtatataatcagtcaaaacaatataagtaattccatgttttgacaattattaaacatgaaggtaattttttaagaaacatatatcttaatgtgatggaagagcttgatatttttcaattaattcatatatctgaggacaattattactagaataatgctaacgataaaatgaagtgaaggatttgggggtcttacaaaggtgtattagtgatttttaagcaccttataagtagaatatacatttcttttaagttcatctaaatattatagatgggttgcaataaattttaaaatgaatgtggatttatgatatccaaaaatatttggggaaaaaatgaaatacttcttttatgagtctaattaagtgttcaaagatatataaaacctaacttatgaccagtatatatatttttacttgaacatgtagctttgatatgttggaagtaaaagtgaaattttcacaactaatctattctgtctcttatagatttacctattctgactggttcatacaaatggaataatataatatgtggtcttttgtgactggcttctttcagttagtgtaacgttttcaagggtcatccttgttgaagcagtactccattccttctcattccttttattgttgtataatattccattgcgtggctataccacattttgtttatctattcatcagtctatgaatatttgagttgttttcaccttttgactattgtaaataatactattctgaacatttatgtacaagtatttgtttgaatgcctgttttcaatttttttgatacatacctaggagtagaattactgggtcttatgtaactctgtttaaccttttgagaagctgccagaacattttctgaagtagctgcaccatttgcactcccaccagaagtgtgggagtgttccagtttctccacatcctgaccagaagttgttattatctgacttcttgattataaccatcctgctgggtgagaactggtatttcattgtggttttgatttgcatttccttggtgactagtaatatgcttattgggcttttgtatatctgctttggagaaatgtctactcatatccttcgcttattctttttaattcattgtcttttgagttgttgaggtttctaaaaaatatattctagatgcaagtcctttatcaaatatatactttttaaatatttcctctcattctgtgggttgccattttactttttgataatgtcctttgaagcatagaagtttatatttttgatgaggtcttatctattttttcttttgttgctcatgcttgtggtgtcatatgtatgaatccatttcaaaatgtgaggccctgaagatttacccttatgttttcttctaagagttttatatgttagcttttataggcttttgatcaactttgagttaatttttgtatatggtttgagataagggtccagtttcattattttgctgtgactatccagttgtcccagcaatatttgttaaaaagactattctttccacattgaatggtcttggcacccttatcaaaaatcagctgaccgcagatacgtggctttatttctggatgtttggaaaaactcaaactgtttttcctctactctcacatcaacataacagcagccaacacagaagatttctgtgacctcaaaatatgtggggatatcactctaccagcaagcaggcaattagttctgtagaagacacctgctgggtgtcctccagttcaattttacttcatctttttcgagatagtgtcagatcccacagattgtgggctcaatccccaagattgccccacacctcagacaacagtcacaagtccaggcccctggatcttctgacagaccagctttaagttggggttcccacaaccctctctttgggtttgactactttactagagtggctcacagaactcagggaaacatgtttactgattattacaaaggatattttaaaggatacaaataagcagccagatgaagagatacacggggtaaggtctggaagggtcatgagcacaggaactctgttcctgtggagctggcacgtgctaaccttccaacacgtaaatgagttccttcctgtcagcctccacatattcagctctgtagaagccccccgaaccctgtcctcctaggcttttatgcagacatccttggatagacaattgacaactatgtagaaatgtgactggacaaaatggatatgatctaatattaataaactgagtggggaaacccagcaagacctgtttgttcacattcttctcgcctctctgtgcagcatttctttcttcaggatatgaggcaggaccctctctggaatgagggtcgtatagcccaacattcagagtagagtcctgccttgggccatgaaaagagggcaggagaaggtcagaaagagagagtttttttctgaggcctaaagcaccccgacattatataacaaatgctgtgggagttatgagccagaaactgtggacgaaaaccagtatatatgtatatcataatatcacacaggacatttaatcgatttcattgatctatatctctctgcttatgtcaataccacagtctcatgactaatattgcctaaaattttgaaatcagagagtgagtcctccaactttgttcgttttcaagattgttttggcaattctggattcctggcaattccatatggattttaggatccacttttttacaatgaaatcagttgggattctgataaggattgcattgattttgtagcgcaatttgaagagtattgccatcttaacaatactgtcttctgatacatgagcgtgggattttttttttccatttatttaggtcttaatttttttctattatcctttgtagttttcagggtatgagttttgtacttctttcattaaatttattcctaatcatgttattatttttgatagtattgtaaatgaaattatcttaatttcatatttggattgttcattccaagtatatagaaatacaactgatttttgtatattgatcttgtactctgcaacctgctgaacttatttgttccaatagtattttaatgaattccttaggattttctacatagaaaatcatatcatctgtacatagagatagttttccttcttccttcctaatttagataactattattattgtcatcgagatcttgcttaattgccctgactagaacctctggtacaatgttgaatagaagtagcaagaatggataccttgtcttgttcctggtcttaggggaaaagcatctagtctttcaccattaataatgttgtcagctttggttttctatagacacactttatcaggttgctgaagagcccttctattctttctttgttgggtgtattagtccgttctcacgttgccataaggaaatacctgagattggacaatttataaagaaaagaggtttagccaggtgccatggctcacacctgtaatcccagcactttgggaggccaaggcaagcagatcccctgaggctggaagtttgagatcagcctgaccaacatggagaaaccctgtctctactaaaaatacagaattagctgggtgtggtggtgcatgcctgtaatcccagctactcaggaggctgagtcaggagaattgctttaacccgggaggcagaggttgtggtgagccaagatggcaccattgcactccagcctgggcaacaagagcaaagctccatctcaaaaaaaaaaaaaaaaaaaaaaaagataagagatttaattgactcacagttccacgtagctgaggaggcctcagaaaacttacaatcatggcagaagatacctctttatgaggcagcagaagagagaatgagtaccagcaagggaaatgccggacgcatataaaaccatcagatcttgtgagaactcactatcacgttaacaacatgggggaaaccacccccatgattcaattacctcccactgtgtccttcccacaacacttggatgttatgggggttacaattcaagatgagatttgggtggggacacagagccaaaccataccatcccacccctggccgctcccagatctcatgtcctcacatttcaaaacacaatcatatcctcccaacagtccccaaaagtcttaacccagcattattccagcattaacccaaaaatccaagtccaaagtctaatctaaagcaaggcaaatcccttctgcctatgagcctgtaaaatcaaagcaggttagttgcttcctagatacaatgggggtacaggcattgggtagatatacttgtcccacatgggagaaatgggccaaaacaaaggggctacaggccccatgcaagtttgaaatccagtaaggcagtcattaaaccttagagttccaaaatactctgctttgactccatgtctcatatccaggttatgctgatgcaaaaggtgggctcctgaggccttgggcagttctgcctctgtggctttgcagggtacagcccctcccagctgctttcaaggctggcattgagtgtctgcagcttttccaggtgcatggtgcaagctgtcagtgaatctaccattttggggtctggaggatcgtggttctcttctcacaactccactagacagtgccccagtgtggactctgcatgagggctccaaccccacatttcccttctgcactgccctagcagaggttctccatgagggctccacccctgcagcaaacttctgtctggacatccaggagtttccatacatcctttgaaatctaggcaaaggttcccagacattaattcttgtcttctgcatgccccaagaccaacaccacctggaagctgccaaggcttggggcttgcaccctctgaaggaacggcctgagttgtaccttggccccttttagccatagtcggagtggctaggatacagggcaccaaatcccaaggctgcacacagcagggggggccctagacccagcccaggaaaccgtcttttcctcctaggcctccaggcctgtggtgggaggagctggtgcgaagctctctgacatgccctgaagacattttcctcattgttgggtatttgcatttggcttctcattacttatgcaagtttctgcagagggtttgaatttttctccagaaaatgggtttttattttctactgtatcatctggatgcatatttttcaaactttatgctctgccacctcttgaatgctttgctgcttagaaatatcttccgccagataccctacatcgtctctcaagttcgaagttccacagatctctagggcaaggacaaaatgctgccagtctctttgctaaagcatagcaggaatgacctttactccagttcccatcaagtttcttatctccacctgagaccactcaccctggacttcattgtccatatcaccatcagcattttggtcaaagccattcaacaagtctctaggaagttccagactttactacgtcttctagtcttcttctgagtcctccaaactgttccaacctctgcccattacccaattccaaagttgcttccacattatcaggtatcttaagctatgccccactacttcaataccaatttattgtattagtttgttctcacattgttataaggaaatacccgagactgcgtaattaataaagaaaagaggtttaattgactcacagatctgcatggctgggagggcctcaggaaacttacagtcatggtagaaggcacctcctcacaaggcagcaagagagagaatgagtgccagcaggggaaatgccagatgcttataaaaccctcagatcttgtgagaacttactcactatcacaagaacagcatggggaaaaccaccccaatgattcaattacctcccaccaggtccctcccgcaacatatggggattgtggagattacaattcaagatgagattttggatggcgacaccgccaaaccgtatcattgggtgtgttttttttctttttatgaaagggtattggatatttttcatatgtttttttctgagcctattgagttgaccgtatgagatggtcatgtggttttaattttttattctattgatgtgatatattacattaattgagcttccctaaactcaagtaagccatactaggggacaatacaaagctcatgctacagaaaagcatatactttacatatattgaccatacaggtctcttttcaaaaacaaattaacttttgggtataaaaggaaaactgaaggaatagcatcagttgggcacatttttgtgcaagtcagaatagtttttatgtttccttctcactgatcgtctactcagaatttaaaaaatttttcaacttgtgatttgctttactttttatagttgatgatcccaggtattttcaataatttttcaagcaaccaccataaaattgtattttggactatatcacattattcggtttttgtttaggttttagttcaaagcaattaaataaataggaagtaaaatatacacacgggtcttttaaaaaatcaactgtactctttgagcatgaaagcaccactcttttttgcactattttgggcataaatgctgatgatgtacttccccttttcttccacagttaagggtccacccgggagtttacaactatattcagtcccggaaatgttctcattctcttttctagcctctgatataatctcttagcataattggttcaggaatcatgttaagtgggcccagatcatgtgtttcagcctgttaaaggcaaggtatattttcatttcctgagaacagattgcagcctaggtcccaaccatctggcactttcttgccattgcttgccaagtgctatgggctagagaatgtgggcagttgaatgcagtcagtccctgttactggacaactgaccacagaggacttgtctcaggaagagtcgtcctcatgaacacaggacactctgttgtgactttgagttcttaaatttcactggaatacatttaggtaaggtaaacagttatttttaaaatgtattattcagggatcacaacagtgcttttagggattaaaatagtccaaacagcctgtaatttcagggtgtctaagatccacatagaattagcatatcgagctggatataaaaatgacacataatacaacagccaacaatgtttttccccctccaaaaaaatggtgtcctccagattccatctgctttgtttgtttgttttgggagaaaacataagtatgatcattagaaaagaatctataaccctttctgaaagagaagataatctttggtctctagaaacaatagctttgcattttaaaaggcatgaagtgaaatgtccttatactctgttggatttgggaagcagcatgaaatagtggttaagcttatgactccagagttagacggtgtgacttctctgtacttcagtattccccatctgttaagtggagattaaaatagtacctacctcataaaggaaaaattaaattagactcaggtagagagcttaaaacagtgactggcaagtaagtgctcattcagtgtgaactgataacggtggtagtagaaataggcacactatcggaagcttaagaccgatttgatgtaaagttaatgaaacgaaaatcagtaacagctaatataatttatttattagtatgtatcagggctcgtattttaaaccaccttatttttaccctcaggagtgaaccataaattatttagtttcttcagagaattctgattatcaactcacctgcaaagagggcagaggagggaaaaacaaaagctctgttgggctgtaagcatagtttctatacacttaaaaacactttgggaaattatagctgttcacttttaggtcactttggcagttgaaaccatagcaatgatttctagaaggctaaaggaaaatctggtactgggttttaaaagttgactacctagaaactttggtgaaatacgtaatcatctgggtcctagagagctgtgtgatgttgcttcttcctctcagtcattccaggcttttctcttccctagttcggccatcagaaaaaccagcctgacccatggaaaagtcacatggtggccaggaaggaagtgtgtgaggttcttccctataacatccggttttccatttctgacagttagcagacggattatgctcacactttcacttcttgtaaccagtcatttccacctctagctaatggctttctttcatacatgtacatctttcttaatgcccttctctttccagattttgccactaatctcaggaaaattttactttatcaccttgctgtttatgggagtaaaacaaaaaattttaaagaacacaactcatgtatttcctagagatatttctaatgaaaataccccccagcaaactgaggccagcaatcttgaaagtgttcctaagttcctttgccagagttcagctcctccaaactaaattgccttttcaagcactagcattcaggataaattttaatttaatctaatttattgttttcctgatttcaaggcatatattataataatttttctacatctgtgtgttagaagcatataggatttttgtctctattgtgaactcattagcctaagaaaatacattctgacttcttaataattataaagattatttttaggccgtgcttatgagaagattggcacttatctgtatttttcttatttgactcctaagtgtttatgtttcttaccataatcaagaacagtgtgaagttaggtattcttccattatatgagtccttcacataacctttggaatatctttctgaattacgagtatcttttcagtaattactttctttctattgttaccatttatattgatttaagtactatttccttaagaatttttactattgcagatttgtggtctaagtctacttggaagcatggcatttgagagctggatcatctggttcaattatctcatgtttcagaggagtaaattgaaacccagaaaggttaaatgattcgcttaaggtcacacggtttaggtagaggcaggggtcattgagacttgagaccagtgctctttctactaagtcttgcagattaattttcaacttgacgtacaagtaacagaatatattctgataattacctttttcccaaaaatgctaggaatcctggaaaaagatgaccttaagaattgattatccattaatcaacttttctgttgttgatctgaaagcattttttcactagactgtattttcctttaagaaattccaggttgcttatgtaaagtttgttactttgttgaagcattataatttttgaaatttattaagctatgtgaactttaaattttcctcttatgatttttagacaccattgtggcttctcatttttaatcacttcttggtattatttactctattttattgggtagactttctccaagagcgggtaaggacatcttgtacccttataataaccacagaaaagtattgtagtgtagagttccagtgtgtgtgaaaggtcttagggattatggagctgtttcaaacaagattgaaatagtgtcaattatattcagattttaatttataaaatattaaattgaacagatttactttaattatgatttttaaagacaagcaaagagtgtattataaaaatgtacaaatttatcttacccaaataagtttataattcaaaataagcaggaaccatggtttgtgtttctctcacttcgggcccttgctaattgtcttccatctacttaaatattctgtattcctatattcatcaaatcctaatgaatctgttagacttgtttctcaacttttccaccttttacttaaaaatattgtcctggccgagcgtggtggcttatgcttgtaatctcagcactttgggaggccgaggcaggtggatcacggggtcaggagatagagaccatcctggctaacactgtgaaaccctgtgtctactaaaaatacaaaaaaaaaaaaaaaaaaaaaattagcaggcatggtggcgggcacctgtagtcccagttactcgggaggctgaggcaggagaatggcgcgaacccaggaggcggagcttgcagtgagccaagattgcaccactgcactccagcctgggcgacaaagcgagactccatctcaaaaaaaaaaaaaataacaaaaaaaataataataataataattgtcctacattagacaaaagatggaaacaaccaaatgtccattagtagataaatgaataaacaaaatgtggcatatacatacaatgaaatcttattcagccttaaaaaggaatgaaattctgatatatgctacaacatatatggaccttgaaaacattttattaagtaaaatgaccagacacaaaaggatatacattgtatggttccatttatataaggtgcctataataggcaaatatatagagacaaaaagtgtttacaaaaagcttacccagggcttggggagaggagggatggggagttgtttaatgggtatagagtttctgtttaggattctagagatggagagtagtgatggttgcacaacactgtgaatttacttaggccactgaattgtacacttaaaaatggttaagatggtaaattttatttttgtatattttaccacaataacaaactactgtcctgagttagccatgaaatgaaataatagctctgagtgtgcaccaagaagggactcagcctcctgccattctgaatggccacttcatcctcatactggggtggagaaaacacagctgtgtttacttttccaaccccatcttctattttgaaatataaccttttgcaagtgagagccaaggtcaagtgacacagctttctgctcacctcttcagtttgccaaacattgtttttctagtggagttctgggttaggtgcagcaagtgtgagtaacactatcactcatacgcccattggaatttaattagtctaccctcataatttctgtactcagtttggtatgacacatttccttactttcatctgtatatgaaaacacacagttgtgtattcaccaactatagtgtttccaagtatgtggattactctatatatcaaattcaaattacacagaaaataaggcttttcttctccaatattttcccatttcttgaagaattatttactttttgagattagagagatgtttatacatagggtgaacatgagcaattctaagtacatactaagtattagatatttatgtttttgtataataattgtagaaacagtggcaaagcatacattttcagcatatattaagagcagcagaacagattagtttttgtgctcagacaacagccttaacatgaaataactgtattcattgttgtttgtcataacatttaattatttgttcttaaaaatatatatcatacttaggttatgagaatggcaaatgttcattctatcaaagcacacaccaaaaaatccaacatgcagctggtacttaatatttttagatttactttcttcttgtatttttgactgtatcttatgccatttatttgcattcagtcgatatcatataagtgatgtcaatttatttatataaaaacaaattagtataatatatttatattttcttaccaggtttaaaatggaaagtgttccattttctttcttattgtatatgtagatgattgaagtactttatgtttcactgaaatgagtattattcccttcagtgaaattaatgttcagcaatgctgaggagatgggcaagatcatttctcattgttttccttttaaattatctggaaaaaatatgatcttgttgcattacattctgaagaagttgaatagatacttacaataaataaggctatataaatgggaagttaagtattaatagaatccagtgtgactaacaagggatatcaagttcttcagacctgtggtatacataataagcttgaagaattcgtgcacaaaagtcttaactgttttgcagccttggttgtggttagatgctgtagttttctaagctactacatgttgtaaccagcttggtagatttaacctagtaataagatgcttagtttaactgttagtttaaactcagtttctatagcggcacagtctttatttttggaccttcactttccaatccagatgacacttgtccataaagaaattgctaaacttgagacctaaaaacaaaacaaaaaacaaaaaaactacagacaagtaacctttaaaattatttcgcttgatggaaatttaccggaaggctttaaccaattcagtttgcttagactcataaagaaaattatgataatgtctaggtaaacttcagtaaaacatttttttgtgaaattatactatagtacataaaattgaaatattgctgatttaatgtaaaaaaaaagaaatcagcttggccaagttggattaccttgttagagattgcttatgtaggtggcatcgacattgttacgatctggacacaggggatacatacttgttttatagtctatatgtgactgtcattgacttggagtatgggacagggagcattggattttaagtcagaagacccaaagtgtaagtctctgccagttagtggtggtgtgatagtcactaacctctgagcctcagaagattagaatgaaataatagcttccctgtcaaatttagtgagttgtgaggttcaaattaaatacatgtgaaactactttgaaaactgtatagagcaccatacaaatgttatttgttatttttccaaggttctgatgagaacttttctgatctcttagatctaactgagttatcatgaaactttgataaaattgtaccagtatgttgtttcgtatagtactatggggcatgcacatgttttaaacccttagtttgttatattttaaatttccagatcatttaacatttgctttacttcggtttttgttttgtgttttgttttgttttggtgtggttaatgtgccttttttatgtaaatgggcagtagaagttggtgggggtcttaagtactaataaagggcactctttttccttcttgcatcaagagccaatggagaaataagatcaaagagccaccaaacagagaaacaagatacataaagctgtgggtggatagtgtaatagctaagatggacttgtgcactcccactgtcccatgtctacatctgtggggaagtttaaggcaccacaacagactctccctttggccactttttttccccagtccaagtagagagataaggagaaagagactctccctgggccttaggatattagggtttagcttagcccacctagaaatacaggcttacgcctgtcatccactgtgataagaagaaatatatatctggtctttgtctctggttcctgacactgagcttctagaacactttgaatttcctgagtaataggggtgagaggagcatcttttgttatccataacaagttcctttcaaccatgcccgattttatgcagtaaaccctctattgacatcctcgataggttcttggaagctacaactttaagcaaaacaacatataacaaaaccagttttactgtaggttgattgatagaaataagagttaagttgctatggtatatttgtggtcacaaaaaatcaccaaacttctaaataaagatcaaaacacttctaatagtaaacactgaaataaatgtgagctctacatttagaaatattaataaagacaagtaagaacattactcacccagttatttgaatttggacttgccagagcatatcccagcagctcagggtgtgagggggtacccagagctggacagggcaccatcccatcacagggcacactcatacacacccacactcaagcagatggggacaacgcagacacgccagttcttctaacatgcacagcttggggatgtgtgaggaaaccagggtacctgaagaaaacccagctagacatgaggagaacatgaaaactacacacacacacacacacacacacacacacacacacacacacacacacagtggcgtcttgaagaattgagttttttttcttatccatgttgtaacattgaataaaaacaatgttatctgaggacccactgtactaatgagatggctcttggtggtttctagatggcatcagaatgaaggaccatttgccagaggaaccaaccatgtaattagagggttggaaccatcagacccactccttaacctctgggaaggaagaagagctagagattgagttaatcaccagtggccaatgatttttatgcctatgtaataaaacctccataaaaacctctaaatagtgggttccaagagtttctggattggtgaacacattgaggtgctagaagggcgaggtcccggaaggggtgtgggagccccaaactccttcccctgatcttgccctatgcatctcttctgtttgactgttcatgagggtatcctctgtaataagccaatagtgtgaagaaaattgtttttctgggttttgtaagctgctctagcaaattatcaacctggaggagggggttgtgggaatccttgactttatagctcgtcagtcaaaagtacctgtgacctgaatttgtgattggcatctgaaatgggcgcagccttgtgagactgatccctgaacctgtggggtttgggctacctccaggaagttagcgttggaattgaattgaattgtagaacactcggttgttattcggggagttggagaattggttggtatgaggaaaaagcccatgtgtttagtgtcataagtgttgtgactaaaaacaatatagacccaccaactaggtaactcagcctacctccttggggaggaataaggggtggaggagaaggccagagttccttacagaaaaaaatccctgtttatggaaaccagagaagtagatatgaggcttttcctctaacagaggtgaacagcaattaaataaatggaattcacctgcccatccccttgcctaccctcctttgcagctctcatctctgaggctctccttccttttcagtacctacctagtcctgccaccctgttgctgttcatgtccattgtccccaagcataggctacaccacagcccctccagattataccatgtagctggagagaaacactgattcctgggagagaagagttgtgtaaggcaggttggttaaggggactttggagtagatgaggggactttggagtagatgaggctagctcagtgagaagatgggtctgtaggaaaaatctttccccaacaatttcatctacattgtggcaggaccccattaaacttcctttaggagatgtatttgtaaagctgttcatttggcaagtcaaggaataacttatctcatgcttgaggaaatggatgtagctggagtcacaaaccagtttatctctgcatttaataccatccatagtttatcatgttggtgataacgggcaaaatgggtttggtaaaatcttagaaaaacaaagaaacaaatgcaggaattgagggccaacatcctaattcctaacttatttagaagaaatgtgaatataaaatttatgaagagatttagattattcagtcattcagtaaacatgtattgattatctgttatgagccccacattgtgctggctgggaaggaaatgggaatgaaagctgtagtccctggctttgaacagcccgtaggtttgtgggggtgacagggaattctagtcgagtgtgatgtgtgctgtgagggaagtatgcataagctgttaagggaacacagggatggttacttggcccacgtttggggagttagttggggaagtctttctaaaagaggcttgtgtgacctggaagggcaaattgaaataggcaagatgaagggagtagaagagaggatgtcttaacttaggtttaagtaattcaatgagccaaggctcagaactaaagagaaagtgtgtgtacacacacatgcatgaatctacatacatgtctacttttgagggagtggaaagcagtaggcaccatgaaaaggtttggttaacagcggatagcttggtatggatgcagtaaagagtttaggaataagagtacaagaaattggaggggtaagcaaggccaggtcatgcttgtgtgtcgtgataaggagtttggtcttttttcaaaggcattgaggaatgttaagcaaggaagagaatgtgttttatatgctacaagtggtagggagagtgtagtgtagggtagtaaagctgtacatgggaaactcttgcagcattccaggaagaagaccttagtatcctgaatgaagagaatgacatgaacctgaagagaaatggatgaattaggggagatattaaaagcagaaaagtcaataggactcagtgatttattgcatggaggaagtgagagggagggaaacgtcaaagatgatacaggtttctgtgctgggcaactatataggttctcttcactgatagagaaaatattggaagattggaagagcattaagtttgaggtaaggttaaggtaaggaagggactaagctaagagccaggtttaaaacatgttgagtgtaagatgtcctgtggaatatgcaaaaggaaatgtataataggagttgaacatatggatcaggaactctagagagaaatccgagtttgagattggtatatgtgcatgtatctacatacatattacttttgggggagtggaagagtggagcagtaggcatgctccatatcagataagctcatccgaagaagtgtgttgagattaggaagagtaaaggaacagaaatggaaccctaaagaacaccatcacttgagaaatagacaaaaagaataagcagctagacatgtagaaaacaaaactaacaagtgtaccgaagccaagaactaaaaattcagagtcagtagcagtaagtgctacaaagtggtcatttcagattagcacttccaaacattttctgaatttagcaagagagtgattattagtaacctttgtgaaagcagactcagtagaggggtgcaggcaggaggcaggttgcagtgggtgagggaggcatggcagacagtgtgtgccaacaatggtctcagcctcgctgtgaaaaaaacatagaaagatagtatgggagttaggaaggtgatattccaataggcaatatagagttgagtcgaattttaaaaaatggttaattgcttctaggaaagattagcaattaggagactccccctaattgatgaagccatgtccttgaagagtttgcactgggtggatctgcagccctggaagctctggggaaggggttggatacaaatgcagatacatttgttggggggtagagcagatagaggagatcctcactcggtggttgctgttttctctgtgaagtaggaggctggcccacctgccagcagcgaggaggaagctggtgatatagggctagaggagagaagagaaaggggaaatgtgtgctgagaatcatgaggcgggaaggcctactgggaaaatatgagctgcctggacagcttacggttggagtttatgaatttctataaagcaactttaaaacaatttttaaaaaatcactgaaacagccttttgtgttttcaaaaccagtattaaataggatcctgcatttaacgcactatttcttgcctggttcctttcctgaagtgcttctctttcctctttccaccgcgcccccactctagttggctagtagagaagatttttccagcttcagacaaaccacttttccaagaatacatggaacagattacagaagcaagtaacagcctgcttacttccccttctgcacttgtatgtacgttcagctggagttctgaaaagaggaagtcgggagaacatttttttctttttaaaagaaagattggagaaccacggagcacaagcaggtagaaatattgaaggaaagagaaagaagagaaaatggaaaaaatactgaaaaaaaaaaaatcatgagccagaaggtaaaccaaaatgatgtcagagactaggaaaggaacagagaaaataatctgccttctaacctagcctcttagtttgctactgaaatacagcgttcttgaactggagccctcacttctaggcaaaactaacacctaggccacatggagatagaaatcttctgtgaattcagcttctcccccctaatttctgtatcagtgacaacatatcctgggtttttatttctttctttgacctaacctttcaattttaaaatcaagtctgagtgcctagagtatctgaaaaagaaggggaccagatctagtgccattcaaaaacatttaatgagcactttgtatatataggtgctgttctgggtactgggaacttggagaaaaagaggaaacaatctttgccgttgcaatatgatttctcccaagtgaaaggagactattgcttaggaattacataggtgcaggacaccaactctcaggcatttaatagctagacagacatttattagtgaccagcttcttataaaaaataaaaagcttgagtactgccttaactgtgccatagcttatatcaccttctcctaacctctgtcccctgatgcttctaactcagatttgcccctccacctcaccccacagtaatgcaagcagataccagctgaagccagaatagaatggatagttatctagggagataaagtgacagtgttgcttgttcaggctattgttcaaagaagcacgtcttttatttatagacattagaatttaaaggcatagacagccagagcttgatattacctcttctttttgtaacttgttttctagaaatatgcttgatacagctaccttctttgcatgtaaattgaatgtgttggaagagtgttttatacctggtttcatgttcttttaataggttctattgctgttttagttaaggctggtttctaaattttaatgcatcaatattttgcttttatagcatactactttatctctgtctgaggcataggttgcagaaaaaagcaggaggttttaaaagaagccaaatatagatgactttcatattaataaaatattcataatttagttggatatagctaagtagatgaggtctccaattgttagtgcgtctgcaaagttggcgcctcctaatagacttcatggtggttactggaattttgtgccaggaaaaatgtagttgtctgttcttaaacctgaatttccttgctttcaaacacccaagagcgaggttcacaaggatgccactaaccttctgttgctctggggaagtgacttcatttttccaaccctttgctgaaaagtgttatatgccttgtattcttggagtgtgttttttcctaagctctgagaagatttttaagattgaacctcatgaatttttacacccctctgcaagaaagggaggaacagtgcctgtaaacctctttgaattacttgaaataaagataatagaatgtaaggaatgaaaataaatttggccagtcaattttttaacaggttaactgatgaacaagaaatagtttttatacaaacatatgaaaacagcttataacagcaaactttatttgttgtaatgatataaataagaatattaactttctttgtaagattaaaaaaatctgacacggtatgctcatatttaaactaggtaagggcaaccgctaataatttgaaaaagaagtattaaagctaggtttatgaagaaactatactcagaaacattatgatagcatttctgtgaacaggattcatcacaaaaataacaaatacgctttatgaacttagtatttgaattaattttctgaaatttggctattaaccaaaaggttaattgagtcttttcttcttgctctattgtggttaacatactaattcttcccattaaagacccattttattatgcaaatgaaaaaaatcacaagactttgtgtctaagagaaagctgcttttttggaggggaactcatgcacctgtttaaacccccagcccccaccactgcttccattggctgccagacttagtgatcaggtttataggctgtagggtccttgaattttgactcacattttctttgtgacttactcttgttttggcttatatttctccccttccagctctcagcatgccaacagcagctgcatcatggcactcaccctgctgccaagagggcaggcagcctccttggagactgtaatgttgcactatagccaacagttaagagatagatgctggagtaatacttacagcacagctgaaattcacatcatcctaggaggcatttggtggaacactttgcccatcgtattgttaaactaatttttaaaaacttaattatgaaaaattttcaagcttatacaaaggtggaaagaatactatagtgcattcccacttaccttcatgtctgtttcaataattatcaactcacagacaatttttcactgtccacggtgtttttcccatggtcttatccagactgctggtagattcatttccagggataaatatatcttaaactagagttgcttttccatccttcttcagcctgtctgtaagatctgtcaccttaatgattttctcagtcctttcttctttaaggtacaaaatattagcatcttttttcttcctaaattaagccaagatatgctactttaataactgttatattttctaatgctgtaccctaaaattgttgaagcactgttcattcagtcaatcattctatccaaagcatgtctgaaatgtgcaggatcttggaatatagagctttaatggtcattgggtttgattatcagtttcaccactgacaagctgtgtaatctgggacaacttccttaacctctctgtgcctcagtttcctcttgtctttaatacgggactaataggagcacatacccttacaaggctgttgtaagacttaaatgagcaaatacatttaaacagcttagatacagcctgacacagtgttccgtatatgctagttgctgtcttgtcatcattgtcatcctagttgtcttcatcatcttcatcttttgtccctcttcactcattttacataatagtgggttgaggctcaaatgggtaaagcaacccccttcaggtcagatggcagttttatcaggataacttgaatgagaaagcatgtcccaatttttttactgtactagatatagtttgatacattcttgtcctcaaggaattacgttctcacaaataacagagaattgtcaaaaaaaaaaaagaggattaataaaaatatgaggaataaatattgctgctggagagttaagccttaggcactgcgtgtttcaagaggaagagagagaacctcagctgctggggagtccttgccacactcagtctcccaccacatcaagaatctcccctccgcagttccatgcagacctccgaaagaggagggggccttcatgtcccatcagtaaagtctgctctactcagccataaaaaaataaaaaataaaaaataaaaaaaaaaagaagttgtgtgtttagaaagcaaaatgctacaggtaatgtacaggcatacctcgaagatatttcgggttcagttctacatcactgcagtaaagtgaaaattgcattaaagtgagccacataaatttttttgtttcccactacatataaaagttatgcttacactatattgtcatctattaagtgtgcaatagcagtatgtctaaacaaatgtacatgtcttaattaaaagtatactgagctgtctcagggaagtctgaggagaggcagataggggaatggccaactagttggtggaacaatcagaacacacacaacatttatcagttaaatttgtcatcttacatgggcatggttcgtggcactgcaaaacaaatacaataatagcatcaaagatcactgatcatgcctcaccaaagcagatagaataacgaaaaaatttgaaatattgtgggaattataataatgtgacatagacacacaaagtgagcacatgctgctggataaatgactccagtagacttacttgatgcagggttgccacaaaccttcaatttgtaaaaaatggagtatctatgaagtaccgtaaagcaaagtgcaataaaagaatgtatgcctatacctccactttagtgcagaatgtgggatgtcaggaatgcttttgtttaaaaaaggagatgatttcgctaatgaaactctagaacattctatacacaaccaaaaaagaaaagaaagtttgagtgggatgagactaccagatctagggaacatttacacatgagattaagagagaaagcaagaaataaaaggagagggaaaggtattatttgaactaccagtgagtgtcaaaagagatgaatggattctaaacttcatctaaacccaaatgggatctggcatttctaaaatgttatttattcacttactttaacctgtgccgagcactgttctgcttacttataaatataactttatttaatccttgcatttaacaatcctatgaaatagctaactgttatcaatctcataatacagctaaggaaactgaggcacggagaagttaaatattttgcccaaggccatttgcttattaataaacaagagacctgggatttataccaagcagcgtggttctggaatctgtgctcctaaccactttgttctcctgctcacaggtgatcaaagccccggtgcatatggaatcttgaggttttatggtgcacccaaacgttgcttccctttcagtttttctatataaaccagtgtatagagaagccctttaaagagaatagaatggtggtgtcattactcatacctgcactcttggctgacccgaggataattagcatggtgagtcccaattagatttcaggagacaggatctgcccactgcagatgtacatctttataacaagctttatcataatagagtatgattacatttgttagttgcagtcctaaaacagtactctggtgttattttcacatgaaattataagaccactcttataggcatgtgctttttaactttactaattcgaggtcatccactaaaaaatatttcttgatggcctctgttttaggtattggagatgctttgtgacgagttccttctctataaattctctatggattttttcctttcttatgagctgtttcttattagcttataaattgtcattatttctcccaacttgaaaaacaaaaatcaaaagaaacttttcttgactacacatccctttttaactactggcccatatatgtttcttcatttacatcgtaacacctagaaaatactgtctgttctaattttctctccactttctccaccagatctcgtccagctgcagattcaaattatatccccctgcctactaacagctccacctgatgtccgctaggcactgaaacttccaaaacccaactcttgatcttcccacccattcctgctctctggtactctttcccatccctataattggtgattccatgtgtctcatcgctcaggccaagagctttggctttatccttaactgtgctcttgttctcatatccccaccgtccattccatcagcaaattgtgttccttttacccttaaagtctatccaaaatccaaccattttatctcacctttgctatccctgctctaatcgacttcataagtaatctgtcattcccagctatcttcccacttctttccccggccaccccacctctactatctgctgtcaacccagcaaccagggtgattattttaaaacatcagtcagaatatatcacctttccaacaatatgttcttcaagatttttttcatctaacatgcaacaatttagatgaatctcatccacataatgttgagtaaaagaagccagaagcaagagttcatactgtatgattgcattcatttaaaatacaaaatcaggccgggcacagtggctcacgcctgtaatcccagcactttgggaggctgaggagggtggatcacctgagctcaagagttcgagaccagcctagccaacatggtgaaaccctgtttctactaaaaatacaaaaagtagctggacattccagcctgggtgacaagagcaaaactctgtctcaaaataatacataaataaattaattaattaaaaaacaaaaccaggtaaaaccaattctgtgttgttagaaataaggatagtgattgacaggacgggggttgattgtgactgcaagagaacaccaggagggcttctgggggctggtcttttctatttcctgatctgggcgctggttgctcatgtgtattcagtttgtaaaaatttagcaagttacacccttatgaagtattttgtatttttagtacagacggggtttctccatgttggtcaggctggtctcgaactcccgacctcaggtgatctgcccaccttaacctcccaaagtgctgggattacaggcgtgagccaccgtgcccggcccagaaaattattcttctcctttagacttacagtctaagaatttgtcagcatttataaccattagcatttataaccaaagacacaacgtaccagaatctctgggacacagctaaagcagtgtgtagagggaaatttatagcactaaatgcccacgggagaaagcaggaaagatctaaaatcgacatctaacataacaattaaaagaactagagaagcaagagcaaacaaattcataagctagcagaaggcaagaaataactaagatcagagcagaagcgaaggagatagagacatgaaaaacccttcaaaaaaatcaatgaatccaggagctggttttttgaaagattaacaaaatagatggaccattaaccagactagtaaagatgaaaagagagaagaatcaaatagacacaataaaaaatgataaagaggatatcaccactgatcccacagaaatacaaactaccatcagagaatactataaacacctctatgcaaataagctagaaaatctagaagaaatggataaattcctggacacatacacccttccaacactaaagcaggaagaagtcgaatccctgaatagaccaataacaagttgtgaaattgaggcagtaattaatagcctgccaaccacaaaaagcccaataaatctttattgagcagtaggcactgatctaggcatgtggaatacagcagtgaacatgagctacaaaagcttcttggctgggtgcagtggctcatgcctgtaatcccagcattttgggaggcaggcagatcgcttgagtccaggagttcaaaaccagcttgggcaacatagtgaaatcctgtctgtacaaaaaaatacaaaaattagccaagcatggtggcatgctcctatagtcctagctacttgggaggctgagacagggaggatacagtgagccaggatcacgcactgcgccccagcctgggtgacagagcgagactctgtctcaaaaaaataacaaacaaaaaccacgtaaaagtaagttttatataagtgagaaaaggcctcattgagatggcatctgggctagcgcttggaaggagataagggaagtagccctgtgtatgtctgggagaagagcgtcctggtctgagggaatggaaagcaaaggccctgaggcagaagcaggctcggtgtgcacgagcaagcacttgcaaggagcactagcaaggagacagtgggattgaagaggaataggccagggcacacgagctggagatgagggcagaagcacacctggagccagatggcgaaggagctagtaggcctctgtaaagacttgggagtttcattctgcctgagattgagggtcaaggggggagtcatttttttgcccaggctggtttgagttaggttccaggtgcttgtagtggcaggccattcatcttcattgctgtaaataaatttcagtttattatccattcttctattgattgatatttaggtgatttgcaagacatattaattgtaaagaaattgaacaagatatatccttttttaaaaaattgcgtaacttttatgacataacaggttagttccaatgacaatcagacaatcagtactcatggtatacattagagataaattatgagtacatatatattactgtcaaatagtaaagtgtgcaaggttgaaaatacaaagatatgccagatagactgcttgccttcaaggaccctatagtctagttggagataagatatatttgcatatggaacagcaatttgcaaggacacatataggcaacaccaaataacatcttaggcaatttgccccataagcattctgaaataggcaagatcactttgtactccattgatacaagattttatagggcagctgagaatttagcagagcctgaaaacgtacataggatttggaaaagcggagacagaatttgcagacattatctgagcaagggaaataacaagaaggccagtttgtgtttaaggggtctgtgggtggtcagtctgagttaaagtttaggattcattttaaagcctaacagagatttggatgaatgtaattctaaagtaaagtaaagagctgcgttcaaatctgggaatatttatatagcccacattgctcaatcattttgatgtattaatgccacatttaccgttattcaacctcaaagttcacaaggcctaaatgttttaaatgtatgtatttttagaccaacaaagaaaattcatccagtgtgactgtatcagaccctgagatggaaaataaggcaggccagactctggagaacagctcattaatggccgagctcctgagcgatgtgccgttcaccctggccccgcatgtgctggcagtacagggcaccatcactgaccttcccgaccacttactctcctatgatggcagcgaaaacttatcacggttttggtatgatttcactcttgaaaattcagtgctctgtgattcataacctttatgtctgtttgcaccttaacagctttaaaatatgttcgcctattttatctaacctgtttgatgttctttgccgtttcactgtttaaggtcctcagcaaggatcataaagcaaagaaaatagcattatgttcactactctatttttaagaaaaaggtacatttgtatacaaattgaacttaagttctacttcctttctcccatataataaatatacaaattaggctatgaaggttttaggaaaggactcgattccttcagatggtctctcaaaatataacacctcaaatttatcttagaagaactgtgaaaaagaattgtggcatttttcagtcactacagctccgaagtctgagcaagaagtgggtgtgaagtctcctctctggtttgtaggaagttgaattggtgttattcctgcatttttttcttccacagtgtttatgaatgaattcagaaaaaaagttgccagttagcttaatttcttcagatgcattgatgtggaaatttaaaacttgtcctaaacagcagtgctagtttgctgatacaaggatgctagacctgctctgcgtgctctttctggagtggcccatttcggttttctgaaacccatggcagccctttccatcgtgaataatcgttgtgttcccacctttgttctctgcctttttgctacttcagtgtgctctctgaccagctttccaaagaactttccctgcttctgcctcggttgccatttgctctccttaccacatatgttcccagtttatgaagagatccacatttcctttcaacccctctgcctcctgaagaaaaacatctcatgatgatacatattattgctgataacacccttatttagaaatttgttggccacaatagagatggaaatgttttactgctggaaaaactgaaatcaactcatttccaattagagtataggcagaacacctagatatgacttttagttcttgaatatccattacttactttaatgaaaacagaactgccattggtcaataaactgtaaagggaagaggtaaattgtgatagagaattttctatgtcatgggaaattgaaatcacatttattttgattaccagcaatatgatttgttaactctgtgccaagttttaagtatattttttcacaaagatagagtgccatagtgaaactaaacactgtgcataaaggtacatgaattattccagttttaaagtattatgcatgtttgtttaataaatgtggcatggttttaatacaaatgctatgttatttaaaagttagaggaacatttctattgacaaaaatatgcttcatttacatataatgttaccatatggtgttaatgattaaattagatctttacatagttcttacaaagcatcagtctaggaaatatgacttattactgatgcaaacgtgaacattttgtagtagttttgtaaaagaacatccttttcaaatatctgtgttaatgtacccttgaaattaaatgcaagcacatagtcagtttgtctaattttgtgtgaaattttgtcgaaaatacctaaacatttcatctatatttgtgcctaccatgttataaatgttcataagtaccttcatgtgtctataaaaaatgttatatttaaataaatgtgaattaaaataaaatttttgattattttcagatccagaaaaatgggtttgattgcattatttatatctgaatgcaagttgttaattctttaggagccaaaaagtttaagtatatagtttgtatagtgctgggaaaaatatacgatttcctcttacatgtaagttttaaggaataacattaaaaatggtaagatccctagtcctggcttaacaggactggagggatttgagagagatgacatgagcatttctagattgataccatcatcacaacatttagtaagggccaatgttaatgatcttcttctttaaacaaaaatattgtgaaaattaccatttaattttttattctgtatataaattaatatttctatgaaacattagaaatcaatacgtcaacttcattttacccaagataaaattgaagcctagaaagactaaatgacttaaatcacttagtgataaataaatgcctactttaatagtgttagtaattataatatatgataacaaagctgtatgatatggtgggagagagttcaggcaattgaggcagccagacagagtttgtaatggctccctcctttataagctgtggggctttcaatcagtcccctaacttctggtgccctcagttctctcaattgtgaaacactaattgttcataacttgtagcgttgtgttaagttataggtggtgtatgtcaaatgcctggcagcctaaagccttgcacatcatcggtattctgggaaagggattgttataattctcgttattgaccatacacacacaatactataatgaaatgcaaaatacatattaattgaacttcttgaagagtaacataaataaaacagctacctacgttaactgtagatccccctccttcccagttatttttttccatattaaataccttactatgagaaatattcctaaaatatgttagttgactgttctgccttaactaagaattccatagtgaacatttttttctttttctcgttattacagtctttttcctaatatatgttattgttgcaaagtactatagatatggaatgtgcaggtgattttactgaatcttatttatttatttgtgacagagttttgctcttgtcacccaggctggaatgcaatggcatgatctcggctcactgcaacctcctcctcctgggttcaagcgattctcttgcctcagcctcccaagtagctgcgattacaggtgcctgccaccatgcctaattttttttttttttttttttagtagatacagggcttcaccatgttgactaggctggtctcgaactcctgagatgatccacccgcctaggcctcccaaattgctgggattacaggcatgagccactgtgcccagccttgaatcttatttttagccctaaaatatattcaagaacttgcatgtatttttttcccaagctttctttaaagacatttgcattctttcctaaaaacagaatgagagaggcgattctgaccaatttattatcctggctaattaaattttgatcaactgaacttttaaaattgtaccattaaaatgttaacaaagccacaatttttattaacaattgcaaatcaaatccgtaatagttttttaaggtaaatattcattgacgtcaacacttatttttttcttctcttaaagaaaaatggtaaattcaaaacagtatgaaaaaattcttctaaaattcccagagatttcatttctcataattctaaatgacagataaggagaagcaaggaaagaatctcactcatgttctgaaaccgtagtacatcagactacctctgtgcctcccatggtaacaattgatcaataagtgaacactgccctcagtaatctagcaaagaatatgtttctttcagagattagtgcgttatcttattaattatgtcaataactcacacaaaatataagtttattggaaatgcagttgaaggatggtttatcttttaaagtttttgggaaatacaggtttattgacattctcttttgagcatttgtcccatattactgagggcatgacctaggtattattgggaaatctaaaactttcagaataagtccaattccattcatactacagtggcttgaaggattaagtattcttatgtttcaggaaaaggactctttttgccatatggtttggcagataggcgtgtgtgggaaagagagaaagaggtattgattgacgcagggaactctgtttcagtcgatgtgacaatatgtcagtcttttaaaaatttaaataaactttttattttggaatagttttagattcacagaaaaattatgaaggtactacagagagttcccacatacccctcacttagtttcccctgttgttgacatgtcacgtaactgcagtacatttgtcacaaccgaggaatcaacaccggtacattgcaattaactacactgcacaccccgttcagatttcatagttttcctctaatgtcctttttctccttcagcagcctacctgggatagcacattacatttatttagtcgtcatatctccttaggcacctcttggcttcaacagtttctcagactttttatttttgatgaccttgacagttttgaggagtactggttaagtattttgtagaatatttctcaagtggggtttatctgatgttttcacatggttagactagggatatcggtttttggagaaatattaaaaaggtgatacccccttcagtgagattatatcgtattgagagtagtataagctatagacatgacttattactgatgatgctgactttgaatacctggccaaagtagtgcttctcaggtttctccactgcaaaagttattccccccaacctttctatactctttggaattaaatcacaaagcacagcccacactcaacgagtgggtaattaaactccacctccttgaaaggcaactatcacataaattatttggaattcttctgcatgagagatttgtctcttttccccaatttatttatcaattatttatattagtatgaactcaggaatcttcaatctttttccaagtcttaatcagtgctatccaagagacatatttacatttttatgaaagtcgataaaatttggaacattttacatggtgcagatgaataccattttatgttggatacgatagtatattctatggtttcctcaaaatttatcttcctgttaatgtcaggcatgtatctccttagcttgccacaaataactatatataccacagaccttcctttgtagggctaacagtgttgcattgtaagtggaggcctcatagatacctggccttttcctaccttattccaaagatggttgcatcttataaataatgtcattcttcagcaaatggtatggaaatgagattgtaatgtcattatttcctctttaaataatcaggacaactcatgatacaaagagctcttctctataaaaggtgggacttttttttttagtaatagcaaaaataaaattgtacctccttaatcttctacagaaagatggatttcattttcaacattaagaggtagttttaagaagcagtagaagtcagcctgggcagcatggtgaaaccccgtctctacaaaaaagttagctgggcttagtagttgcaatcccagctactctggaggctgaggttggagatcatctgagcctggggaggtcgaggctgcagtgatacagtgagccgtgattgtgccactccagcctggttgacagagtgagaccctgccaaaaaaaaagaaagggagaaggagaaggaagcaataagaggaagaagaagaaggaggaggagaaggaggaagaagaaagaagaagaaagaagaggaagaagaagaaaggaagaaggaagaaggagaaggaggagaaggagaaaaagaggaagaggaagaagaagaagaggaagaagaagaagaaaagaagaagcagcaataaaaggaaaccaatcttcttttggaggggaaaagtgcccaagaatctcataattttacttctcattagcgaaagctcactgcatgctaaaaggtaaatttgatgagtggatctcattcagtttcctttgggaaagacacaatcaaaacaaaaaacaacttatttagtctttgcaagaaacttgaatataattccttgtcaagaatttacccaatcccaattttcacccttacaaaaaataaataaataaataaatgtcttacaatcaaagctaaagcaaaggataattgcatccagaacaaaccgtcagttgcccagccccaacagagagcttgcaagtcactacccaggccagaaagggagtcagacaacagagcatttcagaggtcagttaaggagacaggttccaacttaggactgctgccagggatgtacaatccagtgtctgacatctgggttctacagctgccaaatctgccccttgtgtggccacaggtgttggctataactctgaggcacattggagaaggaacagggtaatgtcaacgtcattgtgcatatgtgtgtttatgtgtatggtttttcttttaattttttcaaaaggtacataattaattttgttttaaaatgaatgtatttctacataatggctgggaacattcgggaggctagcaaagaagaagcttttgttcaagaacaagggcaaaacaaagctgaatttttacacctacagggtacattgtacgctaacatgttgtgtgtgatattgttaacttagtcatttgaataggccttctcaggacaaaaataaataaataaatggatgccgaaacgcacacaggcagttggtataagatgaaacctaaatactcattctcttcctgtaggcttctcccctcatccttcttttggatcttcaggagaatttgtgtttatccacacatatttttgagcctggaacagactagactgtatgtagtcttctatctcacactataccagttgtagccatcaattaacacagcttaaaacaggaacactaaactttcctcttctttttgcaggaaacttagctactgtctgtaaagcaaatctggaagtttctacctcaggtagctgtttgagtttcctaaccctaaagatgtaggcaaccctaaagatgtagaagaaatgaagatgatttagagaatggaatgatcccggtaagaaacttaaagaacagatggtcagtaggttagagaaaaaaaatacaggtctatagctccacaaattaattggatatttcttccatgttttgcctattccatatcctgaaattagaaattgaacttcaaggaggaggaaggaatctacatattttatgttcatattgaatcccttctaaagagaaatgcttcagtccttgggccaatgtctgtcctgcttttaaaactaatgtgacctgcagtgttttttcactgtatcctctatatattccaccagccaagatttctgacaggttatagtttgtgttttctattacaaagatcataggtaaattgaatgcactttttcaaagattaacccccatcccctatttcacttaacaatcagtgctctgactgggcttgtgcttagcacatgataaatcctcagtcaggatttgttgaatgaatgagtgaaccaatgaaatcaatcattaagttatttatacaggagatttcccaaaagcaaaggaatagaatttaaaaacttttgtcatttctccagccttgggaagaactgtgtttgtgcagttgaaaataatgcttagctcaccaggcctctacaaattgtgccttttatctgttttgggtattttccatgtttctcaggttgtgttttcctctgcccataatgactacgtatgtcttcatgatgagtaagagctgattctagacaatacagtgtatgttggtccgaggttttatctagctgccaagtttcccttgtgtgttcttggttatggtagtgtgtattcctgtcccagaatttattagtccgatctgacctgtccttgaaaaatgttttcctttttcatttgcttgcctccaagcacatttgagtatttttaatgaccttgtttttttttaaaaaaaggtttttccaggagcagtagtgcacctttgtttcagtactctcctacatcgctgtcctacatttcctactcagccagttctatcccttcgtcatacaaacatgtttagcgctttcctgtctaactccaactatcaactcttttttctttctctttagagtcgagcttcttgagagagtggtctatatttgtgcctccagtttcttactttttattcattgtcaacttctgcaatctgattttgcgtccctcattagaacctcccctgaactggtttatactcggcccacctctaaagcctgccaaatgcctttatctctcttttttttttttgaggtgaagtttcactctgtcccccaggctggagggcaatggcacaatcgcacaatctcagctcactgcaatctccacctcccaggttcaagcgattcttctgcctcagcctcccaagtagttaggattacaggcatgtgccaccacacctggctaatttttttttttttttgtatttagtagagacgggttttcaccatgttggtcaggctggtctcgagctcctgaccgccggtgatcgactcgccttggcctcccaaagtgctgggattacaggcattagccaccatgcccaggctatctctctttgaggcaattaatcactattgattaatcctactctcttgaaattgtcttccacccttgatgtctatgacaccttttctggtgttccttccatctctgtaaccattccattttagacctttggggacttgttttcacttctacttgtaaaattttggtgttcttcagaattctgcctctgcctctcttctctaccttttcttttgcctacataatcatatccatgtcttatctgcataatcaatcttcagcccagaactctctcaagttccatatccatatacataatttgctatcaaatatctcccttgacccttgttctcagcttctataacagatcacagtagctgctatttttatttgctctacactctttttcatctctctcccctctgcccactttcctttgaggaattctgcaccactttatgtagtcctgttgggagctgtgatacttatggccatttctataccacaaggtgataaacacgtaacctagcctagtccaagtatcatccatcaaccagtacatagattttaggagaaagaaacacctattttgctgggttactactgacagccatccttccctccatgtttcatagtcttgaccatattatttgaggccctggattacccaagcaagaaatctaagaatctatccattcttctttcttacctccatactcaattgatgataaacttttgttaattatacatctaaaagatttgtctgtcaaatatgtactccagacctactactactcctgcttcagtcccggtctttatcatttcacccaactgatctccctacatccagttaagcctccctcccatccatcctctactctaaagccagatgaaatatattaagaaatacagataaattcctcagggcttctgtggtgtctctggaaaattgaggcattttaaggcaaacaagggccccccacctgcctctccagcctccgcaaatgatattgcaattcatatattctgtgttcttgccctattgagcaatgccctgcgccatttaacatgccataatttctttgattatccttatattctatttcctttccctggaatgccctgaccttcccttcttcacccagctaaatcctattacaagactttttttttctgtatcatctcctctaggagtcttcctttatttttgctgagctgcactgatctctttccatgtttttgtgctaacctgtgctcccctctttgaaggttcttgatccatagtattgtaattgtttgttccctgtctgattcataactctgaattgataccaacatatagacttctgtgcttaacatgatgcctgacatacagcgtgtgctcggtaaaatttgtccagtaggtgaatgattgagtcactattgattcaaggaaatacatgagtttatatgccatctatattagactattagatgttgcccttgtgtctgtgttggaagcctttaaggaaacctttcagatatccctattagaatatgctacatttctttaatgctcccaaacatatcttgtattctaaataaattagctttttaaatttctaccccttttgtttggtgacctgtatcagcattaatacaataaagacattttatatttattataatctttcagacagtgttaagtcttcagattaaatttttgggatgtaagttactatgaatctatgtattaatattattattttagacacagggtcttgctctgttgctcccaggctggagtgcagtggtgtgataatagctcactgcagactccaaattcctgggctcaagtgatcctcctacctcagcttccccagtggctgagactataggcacctgccaccatgcctggctaatattttaatttttgtagagatgggatctcactttattgcccaggctggtcatgaactcctggctttaagcaatcctcctgctttagcctcccaaagtactaggattataggcattgagccaccatggctggctggatctatgtattataacttcagttttattttttggtttactttattttttattttattttatttttttgaaacggagtctcacttactctgtagaccaggcaagagttcagtggtgcaatctcagcttactgcaacctctgcttcccaggttcaagtgattctcccacctcagcctcccaaagtgctgggattacaggtgtgagccaccgcgcccagctaattttttgtgtgtgtttttagcatagacgggctttccccaagttggccaaggtggtctcagactcctgacaagtgatccacccacctcggcctcccaaagtgctgggattacaggcgtgagccaccgtgcctagcctatttttttggcttattttaatatctacctgggaagacctttcttcctccttctattaaattaacattatttaatgccaattaagttacatggctcttttcaaagcatggacttgaatagatttaaatatgtaccataaaatggaatacctgattttttaatgggctgtagcattttgtttttatgtaatctaaccttactgaaggatttggaaatgttaacccttttggtgatggcccatattgaaagataagctcattttgcttttgaggaaaaataacaattatttgagaaaggaaaac

SEQ ID NO: 1303 - DNA, 9177 bp, Homo sapiens
atttcctgaagaattaaaactgaaagaataatatatatttattaaagcaatgcaggttgtatactgaaatttcagaggcttagtaaaataatatatattctgctaaaatcaccatttcctttttttctgattaagaggacttttttatgacctttcagggattatgttttctttcactttctatctgcattctctttcttcagccaactgattaaaaaaagatgcagagaagatacattttcttctcatccacacatcacttccactttctattagtcaatgtgagtagagctgagaatagctgttttctagcatgacagcaatttctcagaaataaaaacactctgaaacaaaactataaatctttcatcaaaagttaatgtattttaagcaaaataagcatatgcatcaataataaaatgcttgtggtagaatcgatttattttgttgatttctattgagttcagataagatttgaccaaaagctagcaaatatagagcagaaaaaagaatattatctgaaatcagaatatggtaaatgaagttaatttgtcaatagaaataagaatattatgacctcatgctaatagtctcatctaaagttgtacaacaccaaatgctacgttttattatagactgtattttacataagtattcaatttatatcatcctctttcactatttcaatgccttctccactttgtatcagtggaaaacaggccagctacttccaagaaagcaggcaatgctcttcttactttaacaatgatgatgaagagcacttgtttcagtgatgctcccatgccaaaaactgttattttggcggaagtactagttttctatttttctctatatttattaataataaaattcttaaccaagaggaatttatctcattcaagttttaaggaattttgtttacatttaagtgtctctgactttcctggaatattgaaatttttatgaatctaagttgagtactataaataaacaatcttttactaaaatactttttgaagtggggtgatatttataaaaacttttcataacattgaagatatgttttaaccatgttcccagtaatcactctgaacatagaattttcaattttcactgagtcactcaggggaaattgatatctttacaaatgggcaaaaaaaaaaggtgctgagtggaggtgcaacacattgcacatcaatgcttttcacatgcaactattagggtcttaatttaattgaactgtcatttgcatagctagacacttactgaatctagtcatactattttttggcaactagtgccatgtttgtcacctattagttttatacacttatttgcttgactgaaaaaaataaatcttcttttaacttactctaaattgagagactagatttacattctggagctataatagaagttgaatgtttttaatactatttttggcaaattctcatatattcacatataaattttatgaaaagatagggagttgacaaaaagtaaaaaaattcaaatacgttaagcaattttgagatctattgcacagcagggtaactatagtaaactataaaatattgtatatttcaaaatagtaaattttaaatgtactaccacaaaaatgataggtaagcaagttcacagatatgttattaaactaattattccatattttataaatatactaaaacatcacatcgtagcccataaatttatgcatctgtgatttgtcaatcaaaaatactactactttttttatgagagtgaaataagctttaagatattgcaccagagaaaaatgtgtttgttcatcttaaaattttagaaagcgtatacatacatattttttatttcaaatggcttgctcatttactgatgtacgtaaacttttaatatcatgaacagtcagaacccagcactcagaaatagactgttgatttttagtgttcaaaataatataatactttaaaagacagactctaaagcaactgtttagagtaaaattctctttaaatttttaaataaaagatttccttcacttgttagaaaaaaattttaatgtttttaaactacattgaaatttatcaaattaacataaatttattagacaataaaaaacaatatgccttcttctaattataaaactgacagacactctgcatttaaccaaatactttggtacatggattttaacgatatctctaatgacttaaaagagccactagttttaatttagaagtatattaaatttttatattaaaatctaggattagcctattattacatagaaaatttgtggtctgcatgtacatcatcagttgagtggtctacagttttggagtttcagaaacactaatataagaatacttcttccgattgagtaatttaagttttctcagtgactaaaaaagattagaattactgatcactcacttacgatgtggttttaaatgttatttaatgaagatatataaagtttcttttaaaatcattttaacaacttatttcttttgctttttcacttttattagaaaataagtatgaaaatttatgttactacaaacccataaattttatttaaatctagacatagtgttaatcttcaaagatctgatatttaaaattttggataacctatttatacttagaagataaataactgctttccagtaaatctaatggggcaattttgactctcaattataagctattaaaatattaatactatcatctaggtggaaattttaggtatctgcatgctcaggttgtttagcatataaatcagaaactataaatgtttataaactataaataataaactaaaaatataaagtatcattttttctcagttttgaaatactgtcattatttctaggtgacattaacactcaattacagaggctgtgactgttgaaattagaaatgtcatggttgattcttctttacttgctgcctttttatttcacacaaacacagcagcacaagtaaggcaagaaaggccacgctttgactgcaaacacatcagtgcccttctagggagaataaatgtgtgagcatattcacttgaaattcatggcatcttttgttcaagtacagactttcatatggaaagtaaaaaagacaataatttcacagcaatagcataagaaaagtactctaaaaataccttctgacccattatttctatttttcacaagaatgattgtgatggaatgagcatttgcagcactgtggtcttaacctccactttctgtttaattatttttggaatacgaccataagacttttgtgcttttttttttttttagaaaaaatgttttatatttctaattcagtaatttagcataattttttgtctcacactttcaaaaatagttcattctgaaaaaaatgattaaaccactacttaccactttttccccaaaaagagtagagtaacaaatgaagtctataagtctagagtacatttaattcataaataataaaggtgtaatgtgttttagctgcacacttgaaaatgaaacactttttggactatagcccaagagttttcagagaggttagcttataacatgtgaggagacctggtatagaaacattcaccccacgccttaagaggtgaaaatttgtctttcactcttaatttcaactattaacccagagctggaaaaatagaacatttcattataccaaaaacattttgtttttattttatatctaaggggtacatgtgcagatttgtaaaacatgtatactatatgatgttgaggtttggacacttaattattccattgcccaagtagtatacatcatacctaaccagattttcaatgcttgtctcccttccttcctccttctctttagaattcccagtgtttcttgttttcatctttgtttccatgtgcacccaatttttagcgtccatgtatgagtgagaacatgtggcatttgtttttctgatgcattaatttgcttagaatggccttctgctgcattcatgttgctgcaaaagatgttacttcatgctcttctgttgctgcatagtattggaggttgtataagtacatcattttttcttaaccaataaaagattcatgggtaactggtttaattctgtttttactattgtgaatagtgttgcaattaacatgtgagtgctggtgtctctttgggaaaattattttttcggggcagatccccagtaatggggttaattggtcaaatggcaattgtatttttagttctttgagaagtttccaaactgctttgcacagggctgaatcaatttgcattcccatcaacagtgtagaaagatttccttttctccacaacttcaaatcttatcttgcttttaataacagtcattcttactggtgtgaaatggtattgcactgtcaccctgatttacatctttctgataattaggaatgttgagcaatttttatgtttattggtagctctgtcttcctttgagaagctagctatttatatcatttgcttttttattaaatgttttatagattcatatattaatcctttattttctgcagtttgcaaatattttatttcatactgtaggtcatctgtttactttgttggtagtttcttttactgtgcagaagctctttggctgaattagatgccattttcaatttttatttttgttgcactcatgttagatgttagtcataaattctttccagaggccaatattttctaagtgttctcccaagatttttgtagcttgaagacccacagataaagtctttaatctgttatttttttatatagaaaaaggtagttcagttttcttccacatacaactaaccagttttcccagtattatttactgaatagggagttaattccccttttatttctgttggctttgtaaaaataacctggttgtaaagtgtagcttagctcaggactctctcctatttcattggtctatatgtatatttttgtaccagaaccatgttatactggctactctgctgcaatcttggctcactgcaacctccacctcccaggttcaagtagttctcttgcctcagcctcccaagcagctgagattacaggcacgcaccaccacacctggctaattttttgtatttagtagacactggtttcaccgtgttggccaggctggtgtcaaacttctgacctcaggtgatccatccaccttagcctcccaaagatgacaggtgtgagccatcacgctcgacacagatttattcttttagtctgaagcagtcttggctatttgagctctttaattctcttgtatatattttggaatattttctttttctaattctataaaaaagcatcatagatagtctgataaaaatagcacttaatccgtaggttgctttaggcagaatgaccattttaactatattatttgaatccatgagcatccagtatttttccatttatttgcattctctctcatttctttcagcaatgttttgtagttctctgtagagatattttacccccttgatttaatgtatttctaggtatttttttttgtggctattgtaaatagagctgttttttattttgttctcagtttattggtgtacagaaattctatgcatttgggttgattttgtattctgagatttttttgaagtctttaggcttaggagtctttcggtgaaatctttaaagtattcttggtagagaattatatcatcagtaaagataatttgacttcgttttctattcagattccttttatttctctggctacgactccataactatgttcagtaggactgtttagaatggatattcttatttttattcttatggagaatgcatccagtttttgttttagtatcatgttggctaaggatttgtcacagatgacattattttgaggtatgtttcatcagtgtctagtgtattgataatatttttgtcaatattgcattttcttggatgctttttctgcacctattgtgttaaatatttttttcttttaattatctttacatggtgaatcacactaattgacttgcctatgatgaaacacctttgtttttatggaataaagctcacgtgattgtagcaaaataacttggatttgcttttgaattcagtttgctagaatttcatggattattgttccaatgttcacccagaatattgacctgtagtttcctttttttgttatgtcttcactagattttagtttcatatatttcactgatttcatataattagttagattgaaatgccaccttgattttttggaatacattcagtaggattaggaccagcttatctttgtatatgtagtaaaacttggctgtgatttcatatgatccagggctttttatggttagtagttttattattacttgttcaaggtcactatacattttacatttttgctctgttaaagacttctgttattttctgtcaatattgggaagttttgtgtatctgggagtttgttttctctaaattttctactttgcatgcatgttcatagaagtctctgaggatatttttaaatctatgtagaattagatgtgatttctcatctctaacatttaaataaatgcagaataagagtttaacaaaattcaacatttcttcataaatttctgaaaaaagtaggtataggacaaataaacctcaagccaataaatgtcacatataacacacatataaaaagcacagctaataacatactaaacagggaaatcttgtaagcttttactctaagagcaagaagacaaaaatgcccacttttttcagtcttattagacatagtatgaactatccaagacagaaaaattagtaagtaaaatcaaagcactgagattagaaaaaatgttaaattattcctgtgtaatttttcatttctatacacaattttaagtaaacaaaagcctattactaaaaattagtaggactaataaacaaatttattaaacttgcagaatacaaaagcaacatccaagtgtccatagaatttctatacattgacaactatctttaaatgaaattaaagaaatacacaattggaaaaatattactttcataagttggcattaatattgttaaacatctgtattatacaaaattatgtacagctataatgcaacctctaccaaaataccagagacataactgacaaatttttaaaaatatatctaaaatttacaggataccagaaaaggccctgaatagccaaagcaaccaagcaatagaaaaagtgaaggtatcactctaccggactgaactgaaatatactaaaaagctatagtaaacaaacaaacaaacaaaaaagtatggtacttgaataaaaacagacacacaggcaagtagagaagaaaaaggagaccagaaatatcttgatgtttatattgatgtatttacagccatctgatttttaaataaaggtggcaatttcttagggaaaaggcagtatcttcaataaatggtgttgagaaaactttatatccacatgtagaggaatataataagaccctcaactcacaccatatataaacaaattagatacttaaaataaaaacacaaaataaattagatacttaaatgtaaggtctaaaactctgaaactactataaaaaacatagactgaaagccctgtaacattggttgggcagtcacttttagaatttgacctcaaatcccaaggagcaaattgaaaaaatagatgaatcagattattttaaatttaaaaactgctgcacggaatataatacaatcaacaggatgaggcaactaaaaaatggaagaaaatatttgcaaatcataaatgtgacaagggattaatatcaaaaccatataacaaactcaaatgactatacaataaaaaacaaatattaaaaatgagaaaaaggcttaaatatttttcagaaaaacacatacatatgaccaacagatatattttaaaaatgctcaatgtaaattattatcaggaaaggcaagcaaaaaaagaactatgagatatcaactcacttctgttagaatgactctaattaagaagaaaaagtgttggtagaattctgaagaaaagaaaatgcttgcacactatttgtttgaatgtaagtgaggacagccattatgaaaaatagagttttcttaaaaaacttaaaaatagaactaccatatgacaattgcaccactgtatatccaaaacaaaggaaattagaatgaagaaacatttgcacttctaggttgttcgcagcactcttcacacgtaaaatacataaaatcaacagttcaacatctaatgagtaaataaagacaatgtggtagatatacacaatggaataatattcatctttaaacaacaaaaattctattattttcaatcacatggattaccctagaggacattttattagttgaaataagcaaggcacagaaagattaaatgtctcatgagttcacttacacatggattctgaaaaagttaatctcatcgatgtagagagtaaaatggtgaccaccaaatgccaaggtatttagaagaaatgggggcattgaaagatgtctgtcaaggaatacataattatacttggataaaagaaataatttcaagagatttattgtacagcatggtgactatagttcataatgtatttgtatttttgaaaaatgcttacaatttcatgtggtctaaccacaaaaatgttaacaagataaagcattaattacctagaactaagcatttgataatgtatatatacttcaaaatgttaacaaaagaaatacacattttatttgtcaagttaaaaatatatttttaagacactatagaaggataacaatgtttcaaatactgtctgtctctttgctgttttctcatttgtcagtcataaccataggaactttgatgtttaacagcatgttctgaacccagcacagtgcatgggagaagccaataactttagggcttttattttaagcttggggcacttggagttactggtgcttatggtgatagtatgaaagacacgaaaacggaaggcttgcttatgctcccatgactggccactgtgtgatcacagtaaactggtttgcatgcaaactaacaggaaatgttttaatccaaaagctgccattatctccaaaagttttcagagaaaacctaggagatcgctagttaggtgactaagaatataaact

SEQ ID NO: 1304 - DNA, 76575 bp, Homo sapiens
atttcctgaagaattaaaactgaaagaataatatatatttattaaagcaatgcaggttgtatactgaaatttcagaggcttagtaaaataatatatattctgctaaaatcaccatttcctttttttctgattaagaggacttttttatgacctttcagggattatgttttctttcactttctatctgcattctctttcttcagccaactgattaaaaaaagatgcagagaagatacattttcttctcatccacacatcacttccactttctattagtcaatgtgagtagagctgagaatagctgttttctagcatgacagcaatttctcagaaataaaaacactctgaaacaaaactataaatctttcatcaaaagttaatgtattttaagcaaaataagcatatgcatcaataataaaatgcttgtggtagaatcgatttattttgttgatttctattgagttcagataagatttgaccaaaagctagcaaatatagagcagaaaaaagaatattatctgaaatcagaatatggtaaatgaagttaatttgtcaatagaaataagaatattatgacctcatgctaatagtctcatctaaagttgtacaacaccaaatgctacgttttattatagactgtattttacataagtattcaatttatatcatcctctttcactatttcaatgccttctccactttgtatcagtggaaaacaggccagctacttccaagaaagcaggcaatgctcttcttactttaacaatgatgatgaagagcacttgtttcagtgatgctcccatgccaaaaactgttattttggcggaagtactagttttctatttttctctatatttattaataataaaattcttaaccaagaggaatttatctcattcaagttttaaggaattttgtttacatttaagtgtctctgactttcctggaatattgaaatttttatgaatctaagttgagtactataaataaacaatcttttactaaaatactttttgaagtggggtgatatttataaaaacttttcataacattgaagatatgttttaaccatgttcccagtaatcactctgaacatagaattttcaattttcactgagtcactcaggggaaattgatatctttacaaatgggcaaaaaaaaaaggtgctgagtggaggtgcaacacattgcacatcaatgcttttcacatgcaactattagggtcttaatttaattgaactgtcatttgcatagctagacacttactgaatctagtcatactattttttggcaactagtgccatgtttgtcacctattagttttatacacttatttgcttgactgaaaaaaataaatcttcttttaacttactctaaattgagagactagatttacattctggagctataatagaagttgaatgtttttaatactatttttggcaaattctcatatattcacatataaattttatgaaaagatagggagttgacaaaaagtaaaaaaattcaaatacgttaagcaattttgagatctattgcacagcagggtaactatagtaaactataaaatattgtatatttcaaaatagtaaattttaaatgtactaccacaaaaatgataggtaagcaagttcacagatatgttattaaactaattattccatattttataaatatactaaaacatcacatcgtagcccataaatttatgcatctgtgatttgtcaatcaaaaatactactactttttttatgagagtgaaataagctttaagatattgcaccagagaaaaatgtgtttgttcatcttaaaattttagaaagcgtatacatacatattttttatttcaaatggcttgctcatttactgatgtacgtaaacttttaatatcatgaacagtcagaacccagcactcagaaatagactgttgatttttagtgttcaaaataatataatactttaaaagacagactctaaagcaactgtttagagtaaaattctctttaaatttttaaataaaagatttccttcacttgttagaaaaaaattttaatgtttttaaactacattgaaatttatcaaattaacataaatttattagacaataaaaaacaatatgccttcttctaattataaaactgacagacactctgcatttaaccaaatactttggtacatggattttaacgatatctctaatgacttaaaagagccactagttttaatttagaagtatattaaatttttatattaaaatctaggattagcctattattacatagaaaatttgtggtctgcatgtacatcatcagttgagtggtctacagttttggagtttcagaaacactaatataagaatacttcttccgattgagtaatttaagttttctcagtgactaaaaaagattagaattactgatcactcacttacgatgtggttttaaatgttatttaatgaagatatataaagtttcttttaaaatcattttaacaacttatttcttttgctttttcacttttattagaaaataagtatgaaaatttatgttactacaaacccataaattttatttaaatctagacatagtgttaatcttcaaagatctgatatttaaaattttggataacctatttatacttagaagataaataactgctttccagtaaatctaatggggcaattttgactctcaattataagctattaaaatattaatactatcatctaggtggaaattttaggtatctgcatgctcaggttgtttagcatataaatcagaaactataaatgtttataaactataaataataaactaaaaatataaagtatcattttttctcagttttgaaatactgtcattatttctaggtgacattaacactcaattacagaggctgtgactgttgaaattagaaatgtcatggttgattcttctttacttgctgcctttttatttcacacaaacacagcagcacaagtaaggcaagaaaggccacgctttgactgcaaacacatcagtgcccttctagggagaataaatgtgtgagcatattcacttgaaattcatggcatcttttgttcaagtacagactttcatatggaaagtaaaaaagacaataatttcacagcaatagcataagaaaagtactctaaaaataccttctgacccattatttctatttttcacaagaatgattgtgatggaatgagcatttgcagcactgtggtcttaacctccactttctgtttaattatttttggaatacgaccataagacttttgtgcttttttttttttttagaaaaaatgttttatatttctaattcagtaatttagcataattttttgtctcacactttcaaaaatagttcattctgaaaaaaatgattaaaccactacttaccactttttccccaaaaagagtagagtaacaaatgaagtctataagtctagagtacatttaattcataaataataaaggtgtaatgtgttttagctgcacacttgaaaatgaaacactttttggactatagcccaagagttttcagagaggttagcttataacatgtgaggagacctggtatagaaacattcaccccacgccttaagaggtgaaaatttgtctttcactcttaatttcaactattaacccagagctggaaaaatagaacatttcattataccaaaaacattttgtttttattttatatctaaggggtacatgtgcagatttgtaaaacatgtatactatatgatgttgaggtttggacacttaattattccattgcccaagtagtatacatcatacctaaccagattttcaatgcttgtctcccttccttcctccttctctttagaattcccagtgtttcttgttttcatctttgtttccatgtgcacccaatttttagcgtccatgtatgagtgagaacatgtggcatttgtttttctgatgcattaatttgcttagaatggccttctgctgcattcatgttgctgcaaaagatgttacttcatgctcttctgttgctgcatagtattggaggttgtataagtacatcattttttcttaaccaataaaagattcatgggtaactggtttaattctgtttttactattgtgaatagtgttgcaattaacatgtgagtgctggtgtctctttgggaaaattattttttcggggcagatccccagtaatggggttaattggtcaaatggcaattgtatttttagttctttgagaagtttccaaactgctttgcacagggctgaatcaatttgcattcccatcaacagtgtagaaagatttccttttctccacaacttcaaatcttatcttgcttttaataacagtcattcttactggtgtgaaatggtattgcactgtcaccctgatttacatctttctgataattaggaatgttgagcaatttttatgtttattggtagctctgtcttcctttgagaagctagctatttatatcatttgcttttttattaaatgttttatagattcatatattaatcctttattttctgcagtttgcaaatattttatttcatactgtaggtcatctgtttactttgttggtagtttcttttactgtgcagaagctctttggctgaattagatgccattttcaatttttatttttgttgcactcatgttagatgttagtcataaattctttccagaggccaatattttctaagtgttctcccaagatttttgtagcttgaagacccacagataaagtctttaatctgttatttttttatatagaaaaaggtagttcagttttcttccacatacaactaaccagttttcccagtattatttactgaatagggagttaattccccttttatttctgttggctttgtaaaaataacctggttgtaaagtgtagcttagctcaggactctctcctatttcattggtctatatgtatatttttgtaccagaaccatgttatactggctactctgctgcaatcttggctcactgcaacctccacctcccaggttcaagtagttctcttgcctcagcctcccaagcagctgagattacaggcacgcaccaccacacctggctaattttttgtatttagtagacactggtttcaccgtgttggccaggctggtgtcaaacttctgacctcaggtgatccatccaccttagcctcccaaagatgacaggtgtgagccatcacgctcgacacagatttattcttttagtctgaagcagtcttggctatttgagctctttaattctcttgtatatattttggaatattttctttttctaattctataaaaaagcatcatagatagtctgataaaaatagcacttaatccgtaggttgctttaggcagaatgaccattttaactatattatttgaatccatgagcatccagtatttttccatttatttgcattctctctcatttctttcagcaatgttttgtagttctctgtagagatattttacccccttgatttaatgtatttctaggtatttttttttgtggctattgtaaatagagctgttttttattttgttctcagtttattggtgtacagaaattctatgcatttgggttgattttgtattctgagatttttttgaagtctttaggcttaggagtctttcggtgaaatctttaaagtattcttggtagagaattatatcatcagtaaagataatttgacttcgttttctattcagattccttttatttctctggctacgactccataactatgttcagtaggactgtttagaatggatattcttatttttattcttatggagaatgcatccagtttttgttttagtatcatgttggctaaggatttgtcacagatgacattattttgaggtatgtttcatcagtgtctagtgtattgataatatttttgtcaatattgcattttcttggatgctttttctgcacctattgtgttaaatatttttttcttttaattatctttacatggtgaatcacactaattgacttgcctatgatgaaacacctttgtttttatggaataaagctcacgtgattgtagcaaaataacttggatttgcttttgaattcagtttgctagaatttcatggattattgttccaatgttcacccagaatattgacctgtagtttcctttttttgttatgtcttcactagattttagtttcatatatttcactgatttcatataattagttagattgaaatgccaccttgattttttggaatacattcagtaggattaggaccagcttatctttgtatatgtagtaaaacttggctgtgatttcatatgatccagggctttttatggttagtagttttattattacttgttcaaggtcactatacattttacatttttgctctgttaaagacttctgttattttctgtcaatattgggaagttttgtgtatctgggagtttgttttctctaaattttctactttgcatgcatgttcatagaagtctctgaggatatttttaaatctatgtagaattagatgtgatttctcatctctaacatttaaataaatgcagaataagagtttaacaaaattcaacatttcttcataaatttctgaaaaaagtaggtataggacaaataaacctcaagccaataaatgtcacatataacacacatataaaaagcacagctaataacatactaaacagggaaatcttgtaagcttttactctaagagcaagaagacaaaaatgcccacttttttcagtcttattagacatagtatgaactatccaagacagaaaaattagtaagtaaaatcaaagcactgagattagaaaaaatgttaaattattcctgtgtaatttttcatttctatacacaattttaagtaaacaaaagcctattactaaaaattagtaggactaataaacaaatttattaaacttgcagaatacaaaagcaacatccaagtgtccatagaatttctatacattgacaactatctttaaatgaaattaaagaaatacacaattggaaaaatattactttcataagttggcattaatattgttaaacatctgtattatacaaaattatgtacagctataatgcaacctctaccaaaataccagagacataactgacaaatttttaaaaatatatctaaaatttacaggataccagaaaaggccctgaatagccaaagcaaccaagcaatagaaaaagtgaaggtatcactctaccggactgaactgaaatatactaaaaagctatagtaaacaaacaaacaaacaaaaaagtatggtacttgaataaaaacagacacacaggcaagtagagaagaaaaaggagaccagaaatatcttgatgtttatattgatgtatttacagccatctgatttttaaataaaggtggcaatttcttagggaaaaggcagtatcttcaataaatggtgttgagaaaactttatatccacatgtagaggaatataataagaccctcaactcacaccatatataaacaaattagatacttaaaataaaaacacaaaataaattagatacttaaatgtaaggtctaaaactctgaaactactataaaaaacatagactgaaagccctgtaacattggttgggcagtcacttttagaatttgacctcaaatcccaaggagcaaattgaaaaaatagatgaatcagattattttaaatttaaaaactgctgcacggaatataatacaatcaacaggatgaggcaactaaaaaatggaagaaaatatttgcaaatcataaatgtgacaagggattaatatcaaaaccatataacaaactcaaatgactatacaataaaaaacaaatattaaaaatgagaaaaaggcttaaatatttttcagaaaaacacatacatatgaccaacagatatattttaaaaatgctcaatgtaaattattatcaggaaaggcaagcaaaaaaagaactatgagatatcaactcacttctgttagaatgactctaattaagaagaaaaagtgttggtagaattctgaagaaaagaaaatgcttgcacactatttgtttgaatgtaagtgaggacagccattatgaaaaatagagttttcttaaaaaacttaaaaatagaactaccatatgacaattgcaccactgtatatccaaaacaaaggaaattagaatgaagaaacatttgcacttctaggttgttcgcagcactcttcacacgtaaaatacataaaatcaacagttcaacatctaatgagtaaataaagacaatgtggtagatatacacaatggaataatattcatctttaaacaacaaaaattctattattttcaatcacatggattaccctagaggacattttattagttgaaataagcaaggcacagaaagattaaatgtctcatgagttcacttacacatggattctgaaaaagttaatctcatcgatgtagagagtaaaatggtgaccaccaaatgccaaggtatttagaagaaatgggggcattgaaagatgtctgtcaaggaatacataattatacttggataaaagaaataatttcaagagatttattgtacagcatggtgactatagttcataatgtatttgtatttttgaaaaatgcttacaatttcatgtggtctaaccacaaaaatgttaacaagataaagcattaattacctagaactaagcatttgataatgtatatatacttcaaaatgttaacaaaagaaatacacattttatttgtcaagttaaaaatatatttttaagacactatagaaggataacaatgtttcaaatactgtctgtctctttgctgttttctcatttgtcagtcataaccataggaactttgatgtttaacagcatgttctgaacccagcacagtgcatgggagaagccaataactttagggcttttattttaagcttggggcacttggagttactggtgcttatggtgatagtatgaaagacacgaaaacggaaggcttgcttatgctcccatgactggccactgtgtgatcacagtaaactggtttgcatgcaaactaacaggaaatgttttaatccaaaagctgccattatctccaaaagttttcagagaaaacctaggagatcgctagttaggtgactaagaatataaactgtagactaaacttcaaccactaaaacattaaaaaaagagtgataaatgtctccaaatcgtaatatcaatatggaaaataaatattattccaaatgtacagaggtcattttattgctttgcaacctttaacattcacactttaaaacagaggattttgcatggaaatgtaagttgtgctgtaagtacatcctaaataaattttaaattgctcacttactattctcttaaaaatttaatttttatgtttgttctagcaaattacatatttgccacactttgtataaaaacctaacatttttcttttacaaagaaacaccatgctgatttaatcctctcttcggtaggcagtgtatgtcttttatgttaattagccaatcttaaagttgtattcgtatgcaaaccttccagttaaaaccaatgtttcagtacatgaaaaaataccaatgctctccttaaaacctacaacataccttgtgaatcacatggcatgaaaacaacagtgagaaaactgtagccataccacagaaaaagaaggactgtgatgcatatatggtttgaatgcacataaaaagacaaaacttagataattaggacatgaatgaagcatttctctttaaattcagcaagattcagctttgcagcctggaaaaaatgttctcttcacatgaagaatcaatgttatgtctttgcaattgatattttccatctctgacttgaagttataaactaactttagcaggaatgtttatgacaaaatatggagcatctgttacacactgagcactgtcatgtttgtttgctatatttatatataaaagcatccacatgacttatgaagcttccctagtacttactgaaacaaattgactcaataaataaaatttacttatgtcacttataaaaagggaacaataacttaagaaaagtaagcttatatagggttctcccatagaagctaatggaatgttttaactaaataaaatgtaacaatacacaaattgtggaattatatctaaaaataattttgtgtgcatgatgaaattttataaaaaatattcttataactcaaatcagctcagataaatatttcataaactataaaacaaaaaaataagaaacaaaaagattgtgggtctaggccgggtgtggtggctcacgcctgtaatcccagcactttgggaggctgagatgggtggatcacctgaggtcaggagtttgagaccaacctggccaacatagtgaaaccccatctctactaaaaatgcaaaaattagctgggtgtggtggcacatgcctgtaatcccagttactcaggaggctgaggcaggagaattgcttgagcccaggaggcggaggttgcagtgagccgagaccacgctattgcacttgagcctgggcaacaagaacgaaacttggtctaaaaaaaaaaaaagattatgggtctagcatgagtatcatgcaagtaaaaaaagaaaattttcatggaaagattctaaatgataagctgttagatagtgtaataaactgaatacaaagcagagtatatacatttgcttttagcatttttgaggatttttgttttctagtaaattagacatcttattaaaatgctttgttttgtttcaatattgctcttttcttctgaaaacagttacaaacttatattcaaacacccttactccttaaacctgttatatctttagactaatagatgtgtatatttaactctatgtaagtcaaaactaaaactctattgtgtgctctcaggcagaggccacgtgttcaaaaaatacataaaaaatttttgaaaattattcaggactcagaaatatatgattttatttacgcttgtatataatttttatgatgaccataaaaataaccatgtagccaataataatttaactgtacaacttagaataactaagactgtagaattgaattgtttgtaatacaaaacataaaagccagaggttatagctaccttatttatcacaatgtgatcattatataatgtatgactgtattaaaatacgccatatatgacataaatatatacacatattatgtaaacacaaaaactaagaaaaataaatttaaatgtaaaaaaatttaacctacaggaaccatattctttaacttatttgtagtttaaagccactaaaaaagaagaatactagagatgttagtctattatgttaccaaatagtgtattgtaaccatcttttaaatatacccttgagtaaggtggaataggttaaaactagtggcataataacactttattgaatgtataacagtatttaacattataaatgttgaattgaaaaattaacacaatccaaaactttaaaaaaaagtggttttatcacataaaagtacaattagtaaaatgacatactaattattttgatttaattttaactataagaatgattttctctcataataacgcattagaatattacttagggctgggcacagtagctcacacctataatcacagcactttgagaagccaaggcaggcagatcacttgaggtcaagagttcaagaacagcctggccaacatggtgaaaccttgttttactaaaatagaaatattagctggatgtggtcaggggcaactgtaatctcagctacttgggaggtggagacaggagcatagcttgaacctgggaggaggagcttatagtgagccgagattatgccactgcactccagcctgggcaacagagtgagattccctctcaaaaaaaaaaaaaaaaaaaaaaaaaaaagaatattactcggaatgccctacatcactcaattctgtaagttaaccacaaacagcctttccacttaaattttcatcatgcatcttacatttcaatgtccttagtcatccataaggtaataaataacgaccgcctaataaagtctcccaaatctttgatgcagaattgatcacattttttttacatgtgaatacaacagaaatgaaaaaaaggcgtgaagtaatttaagagttgaattccatcattattcagtttccaaataagctgttttttttttcttttgagacagagtcttgctctgtcacccaggctgcaatgcagtagcagcatctcagcttactgcaacctctggctcccaggttcaagtgattctcatgcctcagcctcccaagtagccgggactacagatgtacaccaccatgcttcgctaattttttttatttccttttagtagacatggggtttcaccaagttggccaggctggtcttgaactcaggtgatctacccacctcggcatcccaaagtgttggccttacagatgtaagccactgtgtctgacaaaaaaaaatctgtattttcaagacaaaagtgtactttaaatgaaattataactcttcaaagatctacttcttttaaagttacatacaaataatttttctttttaccaactttagttttggattttttcctatactcagcaatctgattaagtgtaatgtctgaagtttgagacagatatttctactgtgaattctctgatatttacttaattttggattaaaattttttaatatttacttcatctgcaaacatatattttagtataaactttcgtgttttataatctgtagtttttgaaaaaatgtttttccaaattcattaaatttgcagggttattcttcaatataaattccctgatgttgagcaaagttggaacaactacctcagggttttcctgtagtacaaaatgtgtacaataaaacctgtgatacacgtaaaggtactacaactctctttatatttataatgtgtttcctcaaaataaatattcttctgtactttaagggcttatattttctgaaagatctattgacagcaactgcacttttaatgcttttatttagtatgaactctctgatgctgaataagatgtgagaagatattaatgacattcacattttttcccctagacagtctccctctgttgcccaggctagtgtaaatgctttcctttgcaattaggcatgagcattggttaaatgttttgccacattgtttattctagtagttttctccagtatgagatatcttacctacaatcaagtgtgacagccatttaaaggctttgtcacattcttcacatttctaggatttctcaccagtatgatttcttttatattcagaaaagtttcaggtgttgccaaaagccttgtcacatctttcaggtttgcagtttctctctagtatgaattagcttatgtctgttaagaattgaggatctgttagaggctttcccacattcttcacacgtgtatggtttctctccagtatgagttgtcttgtacgtagtaagccttaaggactgattaaaggctttgccacattccacacaattgtaggaattccctccagtatgaattaccttatgtttagtaaggattgaggaacagttaaaaaatttgccacattcttcacatttgtagggtttccctcctgtataaatacccttatgttcagtaagggttaagaactaattgaaagctttgccacatttttcacatttgtagggtttttcctccagtatgaattctcttatgagtagtaaggtgtgaggattggttgaagtctttaccacattcttcacatttgtagaatttctttccagcatgaattttcttatgtttgttaaggactgagacccagctaaaggctttgccacattcttcacatttgtagggtttctctccagtatgaattctcttatgttcactaagtcttgaggaccagatgaaggctttgccacattcttcacatttgtattgtttctctccagtatgaattaccttatgtttagtaaggtttgcaaccttactgaaggctttgccacattcttcacatttgtagggtttctctccagtatgaattctcttatgttccataaggtttgaggaccacttaaaggctttgccacattcttcacatttgtagagtttctctccagcatgaattgccttatgtgtagtaaggcttgaggaccagctgaagactttgccacattcttcacatttgtagtgtttctctccagtatgaattactttatgtttagtaaggctcgaaaatgtagtaaaggctttgccacattcttcacatttgtagggtttctctccagtatgaattatcttatgtttagtaagtgttgaggaccacttaaaggttttgccacattcttcacatttgtaaggtttgtctccagcatgaattctcttgtgttcagtaaggcttgagggccagctgaaggctttgccacattcttcacatttgtagggtttctctccagtatgaattaccttatgtttagtaagggttgagaagttaccaaaggctttgccacattcttcacatttgcagggcttctctccagtatgaattctcttatgttccataaggtttgaggaccggttgaaagctttgccacattcttcacatttgtagggtttctctccagcatgaattgtcttatgtgcagtaagggttgaggccttactaaaggctttgccacattcttcacatttgtagggtttctctccagcatgacttctcttatgttcaataaggcttgaggaccgggtgaaggctttgccacattcttcacatttgtaatgtttctctccagtatgaattaccttatgcttagtaaggattgagaacttactaaaggctttgccacattcttcacatttgcagggtttctctccagtatgaattctcttataagtaagggctgaggaccagttaaaggctttgccatgttcttcacttttgtaggaattctctctagtataaattcttttatgttgagataggtgtgaaagcatgcaaaatgatctgacatattctttacatttcaaaagtttctttccagtatgccttatcttatgtctttttgaatttgaacatttatgaaagatgtttgcatatttgccacattgaaatactttgctttgtgtagttgtcaaactctggttaagcttattataaccttttttgtgcaccttacactcatccacattggtacaaccaatttttaactgtaaattctcatgtccacatttttcatatcttctcaatatcactttttggaaagaatcttctctgccctgctctggccaaaggtcttgagcaaaatgagaacatataactgaaaagaaataaaaataacaaattagtccacttattagataaatatagtttccaaatttaacctataaaattattcaaactacataagcaagatgacactgcagtatgacacaggccctaattcttcacagacatataaatgtaataaaagcatacagaccaaaatacatatgtagataatttatacatgagttaagtgtgtacagtgtctgaattaagcccaatgcaaagagccacatagaaaaaaagaaaagtttgttaaatttacccaatcaactctttctgctcctcaatattacctagtcccttcagaagtaaattgtcaacttctgtttttttttctaaaggcaagtaaaatattggcacatacaatttaatttctgtcttctatgggcctttccacacactggtttctgtctcccatgacataaagtgctgaaagatatggtggtatacttagaaatgacagtttgagtctgttgagaccaaagataaatacaatgcagcagagcactgcagtgctgcaaagagagaaaaggtgtaacaagtaactacttttcagaagaaacataaataatctcttttaactaaaggtaagcacaaaatttcagacaagacaaatctgaagatgtttgagagacccacataatctctagccaagaccattgttttctgactacaccaggacaaagctatattataaatttttaaatgtccaaatctcaaagattacaatctatacaaaatagggcaatataatcccatcaaaaatattataaaattttcagaaagaaaccattaaaaatgtatatactaattttaaagattgaataatactctgagtgaaataggaacacaaaagactatagaaaatcagaaaaatgaggataagaacaaaaatatctacattgtggtgataaaaaatacaaaaagaaataactgattctaaaattaagataaaataatgtaaaaataaaaaacaagatcaaaaagcaaattaggatacacacaaatacatttataacaaaaacatatttataatcacaatttgaacagttacagacaaaaagagaatcttaggagctgcaagataaaagtgatttgcaaacatagtcttatgagataaccagtgaattgtcaacaaaagatttacaggccagaagagaactgtgtgagatagtcaaagtcctaaaaaaaaaaaaaaaatagctatcaagtgagaataataccaaatcagcaaatctgtcctaatagaaaaaaaacctttcaaaataatcaaattcacaaaaagtatatcggcactgcatatgtcttccataggaaagatgctgaaagcagttcttaccactgaaaataacgtaacataaaaaaacaacacctagcgtttgagctctgctaagggtcagactgccacctcaagtgggtccctgacacccatgtctcctaattgggaggcacctcccagtagaagctgacagacacctcatacaggagagctctggctggcatctggcgggtggcctgtgggacgaagcttccagaggaatgaatgggcagcaatctttgctgttctgtagcctcagctggtgatacccaggaaaacagggtctggagtggacctccagcaagctccagcacatctgcagcagaggggcctgactgttaaaagaaaaactaacaaacagaaaggaacagaagcaacatctacaaaaaggatgtttactcagaaccccatctgaaggtcatcaacatcaaagaccaaaggtagataaatccataaagatggggagaagccagtgtaaaaaggctgaaaattccaaaaaccagaatgccttttctcctacaaaggatcacaactcctcaccagcaaacaaacaaaactgaacagagaatgagtttgacaaattgacagaagtagtcttcagaggtgggtgggtaataacaaactcctccgagctaaaggagcatgctctaacccaatgccaggaagctaagaaccttgaaaagaggttagacgaattgctaacaggaagaaccagtttagagaagaacataaatcacctgatggagatgaaaaacacagcatgagaacttcgtgatacatgcaaaagtatcaatagctgaatcgataaagtggaagaaaggatatcagagactgaagatcaacttaatgaaataaagcaagaagacaagattagagaaaaaaagaataaaaagaaatgaacaaagcctccaagaaatatgggactatgtgaaaagaccaaatctacatttgatcggggtacctgaaagtgatggggagaatggaaccaagttggaaaacactcttcaggatatcatccaggagaacatccccaacctagcaagacaggccaacattcaaagtcaggaaatacagagaacaccacaaagatactactcgagaagagcaaccccaagacacataattgtcagattcaccaaggttgaaatgaagaaaaaatgttgagggcagccagagagaaaggtcgagatacccaaatggaagcccatcagactaaaagtggatctctctgcagaaaccctacaagccagaagagactgggagccaatattcaacattcttaaagaaaggaatttcaacccagaatttaatatccagccaaactaagcttcataagtgaaggagaaataaaatcctttacagacaagcaaatgctgagattttgtcaccagcaggcctgccttacaagagctcctgaaggaagcactaaacatacaaaggaacgactggtaccagccactgcaaaaacataccaaattgtaaagaccatcaacactatgaagaaactgcatcaactaatgggcaaaataaccagctagcatcataatgacaggatgaaattcacacataacaacattaaccttaaatgtaaatgggctaaatgcccccaattaaaagacacagactagcaaattgaatagagtcaagatccatctaagtgctgtattcaagagacccatctcatgtgcaaagacatacatagactcaaaataaatggatagaggaatagttaccaagcaaatggaaagcaaaaaaaaaaaagaaacaaaaaaaaaaaaaacaggggttgcaatcctagtctctgataaaacagactttaaaccaacaaagatcaaaagagacaaagatgggcattacataatggtaaaggggtcaatgcaacaagaagagctaactatcctaaatatgtatgcacccaatacaggagcacctagaatcataaagcaagttcttagggatctacaaagagacttagattcccacactataatagtgggagactttaacaccccactgtcaatattagccccatcaatgagacagaacactaacaaggatattcaggatgtgaactcagctctggaccaagcagacctaacagacatctacagaactctttaccccaaatcaacagaatatacattcttctcaacaccacatcacacttattctaaaactgaccacataattggaagtaaaacactcctcagcaaatgtaaaagaatggaaatcgtaacagtctctcagaccacagtgcaatcaaattagaactcaggattaagaaactcacccaaaaccacacaacatggaaacggaacaacctgctcctgaatgactacagggtaaataacaaaatgaaagcagaaataaaaaagttctttgaaaccaatgagaacaaagacacaacataccagaatctctgggacacagacaaagcagtgcctagaggaaaattcacagcactaaatgcccacgagagaaagcaggaaagatctaaaatagacatgctaaaatcacaattaaaagaactggagaagcaagaacaaataaattcaaaccctagcagaagataacaaataactaagaacagagcagaacagaaggagagacagacacaaaatacccttcaaaaaaaaaaaaattcaatgaatccaggggctgattttttgaaaagatcaacaaatagataagactgctagccagtctaataaagaagaaaggagagaatcaaatagatgcaatcaaaaataataaaggggacatcagcactgattccacagaaatacaaactaccatcagagaatactataaacatctctaagcaaataaactagaaaatctagaagaaatgaataaattcctggacacatgcacccttccaagtctaaatcaggaagaagtcagatccctgaataggccaataacaagttctaaaatttaggcagtaattattagcccatcaataaaaaatgtccaggacctgatggattcacagctgaattctaccagaggtacaaagaagagctgatcctattctttctgaaactattccaaacaatacaaaaggagggaagcctccctaactttgtatcaggccagcatcatcctgatacaaaaacctggcagagacacaacaacaacagaaaaatttcagtccaatatccctgatgaacatggatgcaaaaatcctcaataaaatacttgcaaactgaatccagcagcacatcaaaaagcttatccaccacgatcaagttggcttcatccctgggatgcaaggctggttcaacatatgcaaatcaataaacgtaatccatcacataaacaggaaccaatgataaaaaccacatgattatctcaatagatgcagaaaaggccttcgacaaaattcaataccccttcatgctaaaaactctcaataaactaggtattgatggaacgtatctcaaaataataagagctatttatgacaaacccacagacaatgtcatactgaatggccaaaaaccagaagcactccctttgaaaaccggcacaagacaaggatgccctccctcaccactcccattcaacatagtattggaagttctggtgagggcaatcaggcaagaaaaagaaataaaaggtattcaaataggaaaagaggaagtcacactttctctatctgcagatgacatgatttagaaaaccccattgtctcagcccaaaatctctttaagctgataagcaacttcagcaaagtctcaggacacaaaatcaatgtgcaaaaatcacaagcattcctatacaccaataatagagagccaaatcatgactgagctcccattcacaattgctacaaagagaataaaatacctaggaatacaacttccaagggatgtgaaggacctcttcaaggagaactacaaaccactgctcaagaaaataagagaggacacaaacaaatggaagaacattacatgctcatggataggaagaatcaatattgtgaaaatggccatacggcccaaagtaatttatagattcaacactattccatcaagctaccattaactttctttacagattttgaaaaaactaaatttaatatggaaccaaaaaaaagctcatatagccaatcctaagcaaaaagaacaaagctggaggcatcatgctacctgacttgtagtatcgaactacactacaaggctacagtaacaaaaacagtacggtactggtatcaaaacagatatatagaccaatggaacagaacagaggcctcagaaataacaacacagatctacagccatctgatctttgagaaatctgaaaaaaacaagcaatggggaaacgattccctatttaataaatggtgttgaaaaaactggctagccatactcagaaaactgaactggaccccttccttataccttatataaaaattaactcaagatggattacagacttaaatgtaacaccccaaaccataaaaaccctagaagaaaacctagacaatgccattcaggacacaggcatgggcaaagacttcatgactaaatcaccaacagcaatggcagcaaaagccaaattgacaaacgggacctaattaaactaaagagcttctgcacagcaaaacaaactatcatcagagtgaacaggcaacctacaggatgggagaaaaattttgcaatctagccatctgacaaagggctaatatccaggatctataaagaacttaaacaaatttacaagaaaaaaaaaacaccccatcaaaaagtgggcaaaggatatgaacagatacttctcaaaaaaagacatttatgtggccaacaaacatgaaaaaaagctcatcatcactggtcattagagaaatgcaaatgaaaaccacaatgagtaccatttcatgccagttagaatggtgatcattaaaaagtcaggtaacaacagatgctggagaagatgtggagaagtaggaatgcttttacactgttggtgggagtgtaaattagttcagccattgtggaagacaatgtggtgattcctcaaggatctagaactagaaataccatttgatccagcaatcccattgctgggtatatacgctcaaaattataaatcattctactataaagacacatgcatgcatacgtttattgcagcactattcacaatagcaaagatttggaaccaacccaaatgcccatcagtaatagactggataaagaaaatgtggcacatatataccacggaatactatgcagccataaaaaaggatgagtccatgtcctttgcagagacatggataaagctggaaaccatcattctcagcaaagtaacacaagaacagaaaatcaaactagcatgttgtcactcataagtgggagttgaacaacgacaacacagggacacaggaaggggaacatcacacaccagggcctgtcggggagtgggaggctaggggatgaataacattaggagaaatacctaatgtagataacgggttgatgggtacagcaaaccaccatggcacgtgcatacctacgtaacaaacctgcacgttctgcacatgtgccccagaatttaaagtataataaaaaaaatcaaaacagaatattaacaaggaaacggactacttaaaggtggtataaaacaactatttctgacagaggtatagacagcactcctcaacatcgggatatacacccttctcaatagctcatacaacatatttcttgatagaccacctcttaggccaaaaaagaagtcttaccaaattttttaaaactgaaattttatgaattattttctatgactaaactcaaatgcaagtatacaataatagaaaaaaattgaaaaaaaaatatgccaggcatgggtggctcacgcctgtaatcccagcactttgggaggccgaggtgggtggatcacctgaggtcaggagatagagaccattctggccaacatagtgaaaccctgtctctactaaaatgtgaaaaactagccaggcttggtggcatgcacctgtagtcccagctactcaggaggctgaggcaaaggaatcgcttgaacccgggaggcagaggttgcagtgagccaagattgtgccgctacactccagcctggagatagagcgagactccatctcaaaaaaaaaaaaaaaaaaatacacacacacacacacacacacacacacacacacacacatatacacacacataggaatttaacaaaacactcaagcatgctcttatgcaaatgttgtaatagttaacattgtaaagatgttcatcctggtcaatgtaatctacaaatttaatgaaatgtttttcaaatttctcattgcatttttgaagaaatagaaacagtaaccccaaaagtatatagaatttcaaaagacaataaagttcccaacaatcttaaaataataataataataataaagcaatattgcaggcattaaagttcctgatttcaaaagacattccaagctacagaattaaaacaatctggtataaggatgaaaaattagactaatgaaatagaatgcaacacatatatatactttaacatgtatggtcatatgaggagtcatttacatagcaataattattactgtaagctaataggtaaaggcaatgcaaatttctgtcaccaaatcattcagtaaatataatctgaaatataaaaatactggaatatcactcagttttcaaaaagcagaaaatgttctaccaattataaagataaatcttgataacattatgcaaaatgaaatgagtcagctgcaaaaagacaaagattatatgagatatatagctataaagcatttacactcttagaagcagataaaaagaaaaaggtgccctatttgcttaacccccaacagcaagaaagtctgtcagtcatccatgacaaaaatgtcttaatgagagaaccaggcagcatggttaatatctgtaatgacagctacatggtacagtaaggttgaagaattgcttcaggccaaaattttaagaccaacctgggttatgcagtgagaccccatctcaaaaataagtgcctttaagagagctttgagatccagggaggcaattgtgaaactttgctaaagcccaagattgaggagcacccttttcagaaggcaagctttcattcaggtggcaaactacaggacccctgctcttgactacagaccagaaaatgtcccacccaacttggtcccactgaaaattttgaacttactctgtaatcatcccaaactcctcccagccacagtctgtgagaggtcttgggtcttccagaggcctggagagtgatacccatttagagcaatgctggcaggcctgcagaccttggtcccaatagcagttccaagactcagttccagcttcctaagccacagttcatggccagttctgcctatgtagaaatccacagtgacctcagaaatcctctctggtactcagtgaaagccatactaatccacatcctaatataaagcccaccatatgcagacctgactgcagaaacctgccctagcatctaccctactgagcaaagtcctgaaggatatttactctgtccaaaaataaaatgggaattacaactacccaagccccttgtaataagctaaccctagtgcagagccagcagccttgtgaccaagctacaaccccactctactacaaacccagagggcattctatcacgctggaggcccaacaaaagatttttaccctctgaaaccagtttataaaaactttaagaggtgtttgcgccttcaaattgagacaccaatggaaaagtatattgtgcccattgtcaatgcttctattttaacacagcacttgacgtatgtggaagaaaaattagtcaaaaaaattttaaagtcattgaaattgaagacaaataagtaaaacattgctgcttgtagatcatgcagtgttctctataaaaaaaaccataaacagtacattaaaaccttttaaaatacactcagtaaattagcaaaatataaaattaacatataagttatgattccatacacttaaactatctgataaaatagaggaagaaaacaatcttatttacaatagcactaaaataataaatatccgagaacaaatttaaccgaggagctgaaaaacttttcaagtgaaagatttatcaatgaaaaatgagagaacacaaataaattgaaatatattttgtctatcgattcaaagaataaatgttaaaatgccatattatccaaagtggtctctagattcaataaactctctatcaatattccagtggttttttttcacagtaatgaaaaatacaatcataaaatttacatgaaactacaagaaactgtgaatagccaaggaaatcttgaggaaaaagaaaaaagcaggacaacatactttataatttcaaactatatttcaagactatagtaataaaaacaggatgaaatgtacagaaaaatgaacaaaaaacacccaatgatacagaaaccactactctcacatatttcagagatgatggaaaaagagaacttaaaagatagtttaacatggagtaccttaaaattatggaaatatctgtgtccacaaaaacaaaaacaaaaaaactcagattgtgcactctcttgtatgccatgaacagtactttggctgtcactgtaaacttgaaggaagattactgaagggaaaaaataattcttagaaattttaaaagcataagacagaagatgccactgtgtgagagaaaattaaaaaataaaaataaaaattaggctttccagaaactatttcttttggaacacagcttcccatatcactttaaggactggctttctccttgactttggacctctcatccatgttgtctgtattcattctcacctacctggcggttctttcaccagctcatgtctcttcatattccagggctcttttccttgctccagaaaaatgatcaggtctggcttaggggcagcaatacctgttttattaaaaatgagtaacatgcatcttgctcatattctccaattaacaacttagtaatgtgctcagtaaagaggatgtgatagaatattctaatacatttatcccaaaatactaaattacaacagaaatttctaaatatttagaaaacactctaattttgtaagttcttaattttatcacctggtactactgaattaaaaattggtggtggaaattagattttaaggtgtgagcaccagtatttatgccagtaaaattttgaaattaccattaatctaaagtgaaggacagagatcagctcaagaatgtggttaagttaaggtcaagatgaaacatcttgaaatttttttctctatggaaaaatccctatgattttcttgaaaacagaaatctgaaagcataaattaccaaaaagaaattatacaaaagagaaatgatgttgggagccgaaaggctgagggttgtgaccaactcagcattccactggaggctatatgatcaaacagcaaactgtttatcatgaatgcagaatgtgggcgaattcgcttctgctcctgccgccacaaggtacactaaggacagtcaccccctggtgccatgcttcttgaggttatctactggaacatctgcagagtactgtttaaagaatacagtcatgcagggttgtactaagtcaagcagctgaccacaacctcccccttctccctatctcctttactcaataaatatgaagggctatagaagctcagggcccttgttcactagaagcaaagagccccctggtgccgtcttccaaatatactcttttgtctgcctttattcctgcattcatcctcctttgtccaggccaataaagtccacagcaaaatgaaacctatagtgtatactaggaattgcgtattaaagttattctcacccaggaagaccaggtttctgtagttctctaacatcacattcctatataaattctgctgtgcagtgtccaggcattgccactcctccagagagaattgtatggccacatcccgaaatgtcaacgatccctggaaaacacacacaaacacacatatttaccaagtggtcatgggcagaatttttaatttgactcaaggtaaaatggaaagagtaaaaagagctcattctgacttacaggagtgactgaaatcattcaataaaatagttttcaacacaacaatattctctaatgtattctctaactctgagaaaagaaagtggtataagatccataacatcagtgtatgtatagtatttttctagataataaagtataaacttgagggcataaacactaacatgtacaattttgagtgctatatttacatcaaacagaattaattgtgtgccaggcgtggtggctcatgcctgtaatcccagcactttgggaggccaaggcgggcagatcacctgaggtcgggagttttagaccagcctgaccaacatggagaaaccacgtctgtactaaaaatacaaaattagctgggtgtggtggtgtgtgcttgtaattctagctacttgggaggctgaggcaggagaatcgcttgaacccaggaggcggacgttgtggtgagccgagatcatgccattgccctccagcctgggcaacaagagcgaaactccatctcaaaaaaaaaaaaaaaaaaaaaaaaagaattaattgtttgtatttttcagatggaaaagacatagttgtgtatattgttcagatggaatagacatgttgagttagaaggtatcactcaaattttaatgtgtacaataagctggagatcccattaatgcagattattatttttttttttcagaacatcagggataaagtctgagttgctgaatttttaaaaagctcatcagtatgccaatggttttggcccaaaaagactattttgtcaaatacccagtaattgaatgagcctgtgtttttctcagtttttctggtttgtaaacaaagattctcatcttcatttcccaaaaacagacaaatgcaaaggaaacctaagaaagaagggcagctgccagattaaatgtgttggtttgttcacatcagctgcataaagatacttaacgatgaacagaaaaataattctatagtgaaaaaatgtgtcggagagcttatcaaccaagtgatttattaacatcaactacactagaacaaatttttataatgtcctgatgcacccagaaggatacagcattactactgagatattaccccccaaaaggtaaattatagtctgaatttaaccataaggaaacattagtttaatggaaagttcaagatacagatatctcccatgttctgtaatttttaatagtgattttaaatagtctttctttagcactgtagagagcagttatctcctataaatttttttagaatttcctgggtaataaatactatactgcttcaatgagtggtttcttaatcctgtactgcatagacataataaggaacacagacaaaacctcaacattacatgttctctgccttcactaaaaaccccaggttttccccaataggaattttgagtatctacaccttcccatgttcaacagccacaaagggacattttaaatattgcagattataaaatcatagtgagatttctgcacggcatataagaagccataatgtagagaaggctctggtatatagaaaaaaatatatttttcagagactttgactattgtaagaattttttaaagtagttaagacaaactcattagggaggaaaaacacaagtagagaagtacaggtttgcaagtactaaatgtatgtttcctggaggaagcagagtggacacagatcttgatctgagacacatttagctgaaaaaaaaaaaggtcatttttttctctttctcctccttttctaggattctttctcagataaaattctctggacaaattacacctgcatcttgagaagatgcctttaaaagagtcagcaccacaggtctacctgctgtcaccacatccacaggcagaaggaccaagacagaaaaactccacccaattctgtcctttatagcagaagagatgaagaaacaatgagtagctccagagataaaaatatgcttttctttattttgtcctcgggagccatcccctgacacaggcaacagcaatttctgccacagtaatggaaatatgggccacgctgtcctgcccctaccaaatccaaacagaacaggttcttggaccaccctttaatgcaaagatggaacttaactctcatgaatgtattatgaattcctcatacttgattctggcctcaccttagagtcacatgagccacttaattaaaacaacatggatgcttccacaagaacaataaacagaatccatggaaagggcacaagtaaaaagagttctgcaaaatggccaggtgatactatttagcggcctgggctgataaccccttaactaagactaagcatttcctctcaagctctaacgagcttataaatcacttggtaattttctccccactctatgaaatgtaattctgcaggtatggaaagggtccacaaatgggtcttttaaacaagtgcgctgtcagtaatgatgttgttcccactgggcttattattacccttaattagaaaaatgaggcacaacacagagtcccttacacccagcactcttgtcacaacacaaatacttctggtacaaatgaagacaaacattcttcatcctaaagtattatattctttgctgactaaagtttacagagaaaatagaaagcagcaatttctgagtaagtctgcatttggaaaacaacatgtgcacatgtactaatgtaatttttattaagcaggtattatgtgatgttacagagtgctgtgatagcacattatgtgatttaatcctaataacaccctgtgagttgatactaagtgttcagtaattccaacactttaaaggacccagcatttttatttctatttctgtttatctgtcactgattttttcaaaaaatgcatagaaaaggtaaatatagacagatgaaagggatacagatggaaagaatttaatgcaatttagataaatttttattgtgtttatatttactttcttgtgacttgtgaatcaactactagatctgcaggaacagaaaacagttgctaaataatgtttctgcaagcactggttttaataaaaaatttgaaaagatcctacaatacatactttatatttcccgttatctgcttttgggtttcagaaaatgttgagcaccagctctaaaaaggcaacaggattcatgactcaaaactctgatttcctgtaatcagttctgtgaggcaagactccggggtagagccagacataaataaggcctccaaaaagggtgaatatgaacagggctggggcagagcgtacagccaatgtacaattctgttctctatgccactggggggtattgtcagttctttttgttaaagcttacttaagtaaacttaaatctgagtttgtataattttaatcttttttatcactgtcctgtgaattttatattatatgctaataagcaattttaaaaatcccttaaggttttctagaataattttttagaagaaaaataagtattcttagcagggtaaaataaatacaaataacaatgacgactcttctaagttcagctgtagacatcagaagccacaatataaagtggcccaaataaagcccaagtttttgcacacagctatttattgtacccaccatatgatgtataattcaaccatatttccagttgctagtctagactaaaactgccaggatggtaggaaccatgactgcttcatctatttttcttttctttttccttttttttgagactgagtctcactttgttgcccaggctggagtgcaatggtgtgatctcggctcactgcagcctccgcttcccaggttcaagcgattctcctgcctcagcctcccaagtaaccaggactataggcatgagccaccacaccaggctaatttttgtatttttagtagagacgggatttcactatgttggccaggctggtctcgaactcctgacctcaggtgatccacccaccttggcttcccaaagtgctgggattacaggtatgagtcactgcaccccacctgcttcatctattttttttttatgactatatgaaatggaagcaattagtttatctgtttgagcccaattagtttatctgtctgagcctcgagacctcctgattttttacccgagtacagggaacttgaaaaactctcttctgggtaccaaccaaagatacttcttgtataaggggagaaacaaacacaagatgactcatttctctcacaatgggacagaagcagaatttgtcactcttatcagcctgacacaattctgttctggacattctcaaatgtctcaaagattcagaggtgattgtgagagggttccccatgaccctgggctgatggtccactgataagccaggcagagaagactcgggatgattctaaataaaaaatggaactgccttggttgaactcccaaacctgggtcatccatcctgatttgctagctgtcctgatttgctagctggtgggtaagtagaaggacaagaatactttactccagtatcacattttacaggtagatatagttgtggtcatggctctggatactttgtggccttaagatgcttgtttacacttagagattctgccatcagattctatttactccgggagcctctcacatacctgtggcagattaatgaagaagatgtgaaaaggtcaaaaagccacactctcaaaagaggaatttaaaatgtctatgttgatatctcacaatgcagaaaatgcctcctgttggttttctgtaaattctcaatccaaagtctggccctgccttgtaaatcccaggcagaggccagccagatcttatttgcagattctaggtgaaatcaacctcactctgcatttttgggtgttacagcaagtagagtgaaatcaaaggagagattccctcatagaggctgctctagaacattctaaataatattttaccttaaaaaagctgacacaacatgaacataagcagacagtttatttgggtcaagcttaaggattttaacttgagaccaaatattcaagttgcctggaatccacgctttcattagcagcacttacaagtggatttgcaaaggcaaaaaaaaaggaacagtgagtgagctgatacaaaattggttgcgagaaattcttatttatgtaaagaaataactttaataattaattggatatacattgttaaggttaaggatatggaatacagtgtccagtgtggaattattagtttaatttatagctacttgtggcaatagtgaacagtttcaagagatacatagctgaaaaaaagggagaaaaacatgattgtgctctcattttaatgcctctctgagtctgataactaaaaggacttgcattcctcagacaaaaactttttttttcttctcaattctcaagacctagatttagaatttggagctgcaaattcaggtcctgcatgggtaaaatagcagcaagtgttacctgaacatttgtgggcattttagcatgaggagggagggagaagtggattctcatgtctacaggtctgctcaatgcacatattttactctgattgggccccatggtcactgaatcagtttcaggtctgaggacacaagagtcactgaaagaggtaaaatggctaatatctgaccaatgaagtctgtagaaatctggtctagcctctctaaaagtgactctagacatgatagataccaagtaggcagacgcacaattccacctgcatatttaggggacagcatgcacttcacagcacaattgtgaactgactggaagccgaaaaggcccatctagagtaaagcttagttggcaccttatgtgtttacattatgtctggtaattctagacaggatttggaaaatataattaaaagcaaaattttcttcagccccagaggaactgcacagtaacagaacagaaagaaaactgttttattacacaattacatgtgaatgtgacatgcattacagtcaatttgctcaagagattgcaaagacagaaagacagtgaccataatcagtctacaagtagaatttacagcaccatgtcatacatagttcatcctaaattcatctggtagttgggaaggccatccatgtatgctaattggttataatcaatgacaaaataaacttttcacatcttcatgactggaggtagttttgcaacttgaaccccggtgcctgctgaaggtaggctttgactcttctacaaaaattgttgattcgggtgctatctttttggctctttacattttaaagcaataggtctctactccctgagcactgggcttgagtactcctgtttccctctcctggtggctagtgtactctcttgacccctaccatctgccactgaggcacagcccacagcacagggctcacagctggaaactcacatcttaggtgaaccccaattgccacagcagcactccagtgccacatcagacagtgaagcctgagcagcaggaggagagcttgcaggcctcctgggtagaattgcaccttcacaataatagaaaagggagcactgtttcagcctcagtttttatttataatggtggcatgaaaaaaatactgctgggttttggcatgagtccagatagagatagctctgagagttctcactgtgacagcccacgtctttcacagacaccatgggactaatagggtttctgaaacagacacacaatgcatttgagagaaaaacagctctcattctgagaaagattatattgaaagaaaaaagttaaaagtgtcttaagaaaaaactgagattggatataagattgatcaagtcagccagaaaatatctccctaagaagaatttctctccaaacacccaagtgcatagctactctcagcaagagaaacaggagcattattgaataaagggggcatattctcagcagaatttttttttttttttgagatggagtttcaatcttgttgcctaggctggagtgcaatggcgtgatcttggctcactgcaacctctgcctcctgggttcaagtgattctcctgtctgagcctcacaaatagctgggactataggcacgcgccaccacacccagctaattttgtattttctgtagagacaaggtttcactatgttgtccaggctggtctcagactcctgacctcaggtgatccacccaccttggcctcccaaaatcctgggattagaggcatgagccactgcacccagctctcagcagaattttaaaagatttatcttccatctctgctgctctcttatttcctaaccattgaatgtgagatctatattggaatatatctgacaacttccagtagcacttttttataaaaaattgaaatctgtgttaatatagtagaatatattagagcttgcaacatagctaactggagagctattatggtttttgggtagccatatcatctgtctttatttgtcctgtaatagcagcataccaatttggtaaaatataagacactaaaattatgcttacctataattattcccactggataaattaatagcatgtcagactaatatctactgcaacgatttaatggtaaatttttttggatatcagatataaatatataagtatgaataattttatgtactagtcataaggtatgtaatattttaaaaaattatctgaactgtaattcagttgaaacactgtatttcaaaagtatgaataacaatattaaaataactaaggaattcaatcaaagtaaatattgtggccttatattcatactattgtagaaaatactgtttaatttatatgaatgcaggttgtctacaaacactacacataactatactaactgtactgaagtaacccaagtacaacagactccactgttcagtttatacactgaactcttctggcttttgcagtgtaagtatgtcagcctgcaaataatcaccttggataatcaggtttctgccaaagaacttactcagtatcttttagtctatattattctgcattgctaaatttattccgatctttgtgctcaacttttttatgctcttgaaatgaagtttactctgaacaaatctgtgtctagtttaaagactaaagaaagataaaaaaatataaccttttgccaagacaaaaagaaagcaatgaatctcaggtcccagataaagacaattctgagtcaaaaagaatgacaaaaggtttgtttcattgttaatatgatttacatatacttcaaaaagcagaagaaatatatacatataatctaaacttttttttaaaaaattaacaagttatcctcccttattttcacatatgagaataaaacctcttattgctaatttatattttctcttacaacagccaggtctctggacaagttcttgaactcttggatctctgaattttgcacagtgtgtgcacttgaaaggatgtttatggggggaaaagcagaagagagaaagatgttattaagaaaccccatgggttcacatgaataaagcaagttcttagagacctatgaagagacttagaatctgacacagtaataatcagagactacatctgacaagcactaatggacagatcattgaagaagaaaattaacaacaatattaggacctgaactcaacacttgaccaaatagtcctaatacacatctacagaactcttcatctaaaaataccataatatacattcttctcatcaccacgtggcacatactctaaaactgaccacacaatcagaaataaaacaattctcagcaaattcaaaaatcccaaaatgacacaaaccacacacacgggctacagcttaagaaaaatataattcaataccaataaaacaactggaaaccatacaattaaataaaaattaaatggcctacacctacacttgaataactttttggtaaataatgaaattaaagcagaaaccaagaagtgttttgaaacaaataagaacaaaaatacaaaataccagaatccctgcaatacagctaaggcagtgttaaaagaaaaattcatagcgttaaatcctcacatcagaaagttagatctcagtttaacaacctgatatcataaataaaagactgagagcagtaaaagcaaatcagtccctaagctagcaaaggcaagaagtaaccaaaatcggatctgaactgaaggagatttagacatgaaaaactacaaaatatcaagaaatcctggcattaaatctatttaaaaaaaaaaaaaaggaaataaactactagctaggttaatgaagatacgaataaacacaattagaaatgagaaaaagagacattaccactaacctcacaaaaatatactgaagtctgctatgcacataaaaaaaaatctagaagaaatgaaaaaattcttcaaaggacacaaatgtggctaacaagcatataaaaaaatgctcatcactgatcattagagaaatgcaaaagaaaaaccacaacaagaaatcatctcaaaccagtgagaacggccattattataattcaaccattgtgaaaagcagtgtgttgattcctcactaaactaaaaacaaaattaccatttgacccagtaacctcacaattgggtatatacctaaaaatatataaattattctatcataaagacacatgcacaatcacattcattgcagcactattcacaacagcaaagacacggaatcaacctaaatgcctatcaatggtagactggataaagaaaatatggtatggttgggcatgatggcacatgcctgtaatccagcactttgggggccaagccaggtggattgcctgagctcaggagtttgagaccggcatggacaacatagcaaaatcccatctataaaaaaaaaaaaaacataaagaaaaattagctaggcatggtggcacaagactttagtcttagctacttgggaagcttaagtagaagaggactgcttgagcctgagaggttgagagtcagcacagaccctgattcagggctcagtcccacaacattgtcctcactgcagatgccagtcacaaacttcatgggctcatctatgcttctgacctactgtttaaaaattggggactcccataacctttctgaaattcaataatctgatagagctactcacagaactcagcagaacactgtagttatatttacaggtttcaaataaaatatacaacccccaaaaagtcaaatggaagaaaagtatagaaccaagaaaagaggtgggaaaagatgaagcatatagataataaatagctgtgattaataaaattctctatcctctgtgttctccagtaacactttatgaaaagaaacacccttcccattatgacttagatggtactctctttacttacctaatacacagccaggaaaacactctgcatattttcttctttttctcattaaaaaagcagctgagtttgtcttcagtggtcaacataaaatacttcttaatcaaaattcacttgtttattttcttcccacaggctcctgaactctgagctatgctcagtctgagccaccatacaacctcattttatgtccctactaagaacacacagactttagggtaaaacattgtctgatctaaaatctgattatttcacccttcatttaaacattcccctcaccttttttctaatcttatttgcttttccctaggaaaaaaagcccttttctacctaatctttgcaatccttaaagatcttatagttggtacttcctcctgttgcaatactcctttggaattcttttttttttatatatacatctaactggtttattttaaaatctctcaaaactgcctcaaaaaagtaacaattttatcttcagtaagacactcccaaaccccttctatcttaaccttaactgcatctgtctgtggggccccagctttccaaggctctgtagcttctctcactatagaggcttcttccatggctggggtaagcaggctgggacatctgcaggaaaggctttccagaaggaactaactgggcctttaataacctccttttgccggctcaaaattaaccttcgctcgcagtcattgggctcaagctttaattaccatgtcagagtcattcacttagtttttgaaaataagtgtttgaaaaatccagcaaaatgattcaaaaacatataagaaaattttaaggtgcttacattttgtacctcagtaagagaagcaaatgtatttatttcttttggacaataaagtattattttattttttgtattaaaaatcatgtggtaaacagttacatgggaacacttctaggaggtaccaaatttcatcagataaaatttagcattaaactcagaaattgaaataacaggatatagaacaaagatatttactttagcaagtttaccctgcaaaaaaagaaactgatgttttcatgaaactatgtaactcaccaattatctaccacattttcttgtggaaatacattaattctctacagccgaaatggaagaaaaatttttcttattttttttccttggtagctaacattctaaaagctagatggaattctgtttgaaatcattcagccataaaaaacacacctgaaggccaggcatggtggcttacgcctgtaatcccagcactttgtggggccaaggcaggtggatcatgaggtcaggagatcgagaccaccctggctaacatggctaatatggcgaaaccccgtctctactaaaaatacaaaaaaattagctgggtgtggtggcgggcgcctgtagtcccagctactcgggagactgaagcaggagaatggcgtaaaccctggagacagagcttgcagtgagccgagatcccaccattgcactccagcctgggtgacagagcaagactctgcctcaaaaaaacaaaaaaacaaaaaaaaaaacaccagagaaaactcctaaattcactctgagaaagaaaaaggtgaatgagaattttcaacaaataaaatatacagatattattttctgaaactcacctttttatgctctttgtaaatattttcttacctttcaagccctactaataaaatgcaatttacagttaaaaaactgaggtcagccgggcacagtggctcacacctgcaatcccagcactttgggaggccaaggtgggcagattacttgaggtcagaattttcagctcaaacagcctggtcaacatggcaaacccccatctctactaaaaatacaaaaagtagccaggtgtggtggtgggcacctgtagtcccacctacttgggaggctgaggcatgagaatcacttgaactcgtgatgcagaggttgcagtgagccaagattgcaccactgcactacagcctgggcgacagaggaaaacactgtcaaaaaaaaaaaaaaaaaaaaccaaaaaaaaaaaaaccctgaggtcaaaataagtgaacaatgcatttaatcatgtcaaggtacggatatgtctgactcatgtgtcaagtcaggccatccaattacttgagagattctcccaccccatcctgttcacttaagtgctcaataatcattctctcaggagactctgaactatgccccagagtgccccaggtatattttactttgcaagtttttgcaccatctcactggggtcagttgtttttgtctttggagtgctattttatttcacaaaccttttaccatttttatttcactatttttctgtcccctaagagaatgcaggggcaaaaattattttggtttccccttcaataccagcatctgattgtctgaacagcaatgtgtctccaagaaatggaagctgggttgggtaaagacaatattaatatctcaagggagtagctttccaaaaaaacagcacaccagaagatgactcagccacagtgcattcacctgctctcttgagaagctacgcttcatatctcaggttgtcttatgggagatcagaggctacactccatacctcaggttgtcttatgggagaaaaagacccaggagctgatattcactagacactctcacagacatagccatggcgggtatcttggtttttccccagacagtactgaatctcaagtccaagaaaaaactgaagggtggctgaggacacatctccctataaagtttccaaagggaaatcttgacccaaaaacattgtgatatctgtgtctacggaaaacagaagaaaaaatatttacaaacagaaaacaaatctttttaaatgtgccatcaaatgctttgtcaaaaaatgattaaaataggtatcaaaatgtacactaaactatttgttgataatatgaataagggaggggaaattggcatttgggaatgtcagaaggaagtgaaaatcaagtattttactgcaagccagagtcaggccggagaaataggggatgggggatggacttgaggccctacttgggacacatgtgaaaaatgcaaggaaacagcagttccctgtggggtgtgaaaataattaagtggctggcagttagactgaggaggctgtagttcctaatttctacttttaaaaaatctaattcggccaggcgcggtggcttacacttgtaatcccagcactttgggaggccgaggcaggtggatcacttgaaatcaggagttcaagaccagcctgaccaacatggtgaaaccccatcgctattaaaaatacaaagttaacggggcgtggtggcgcatgcctgcaatcccagctacctgagaggctaaggcaggagaatcgcttgaacctgggaggcggagattgcagtgagcccagacggcgccattgcactccagccagggcgacagagtgagactttgtctcaaaaaaactaattcaaatgcattttttgtaaattactatattgggggaaaaaattcaggcttaacaaactataaactgccaattaacctctgattacataaccaagaaatttccatcttgatagtacgaattaagaaactacgtaactgtacctaaccaattatcgaatttggttttcttcattaggcaccttataaaactcttccgtcaaacctcttcaatagaccataaactacaacccatagctgggtgctctacaattttggaatcactctttggttaaattatttaatatttgtgcggtgacttctgcaaatttttaataggagaaaacaggggctgggaacctcacggaccaaagctctttccattcttgaacccacacgccgagtcaggattctcctgtgacgaccctcccatgctccctgcacatctgagagagactccgcgctgcgggtgcagagcggccccaagagggctccaggccagggcacaatcacagcgcagggaaaagacaggacgcccggggaccgggtgtcagcgcagccgccatcttatgcctgaagcggactgaggtcgagctaggcaaggagaacacggggcacagattgtggagctgactgagaggaggcctgagtcccgccacagccacttcccaccggttccaaccagcggctgccactctctcgggatgtcggacccggctgactcaccatttctaggcttccgggggtcctggcgacttagttgtgaatctcccaatacctgcaggtcacagggccatagaagctgggcctttaggagcggacgacacacagcagtaaggacgacaccttgacctccgcgtgcagcgagagccaacggtcctaccacatcccggaagccgccctgtccgctccagctgcgtgcctgattggacggtcccagtccagcgtccctgattggataatgtttaaggccccgccccttcaggccctgagtgacggaagatgttatcagatgctgggctgactgaagaaagagtgccagcccagtctgccgcaaaggccgggcgtgatggcttacgcctttaatcccatcggtttgggaggcggaggcggggggatcacctgaggtcagaagttcaagactagcctggtcgacctggtgaaactccttctctactaaaaatacaaaaattagttgggcgtggtggtgggcgcctgcaatcccagctactcaggaggctgaagcaggagaatcatttgaacccaggaggtggaggttgcagtgagccgagatcgggccattgcactccagcctgggcaacaagagtgaaacgccatctcaaaaaacaaaacaaaaaaccctaattttagtaaaatcttataaataaatccatcaaatttgtcatttttgaacgctctagattttcatatatattttataatctcttttttttatttgtttatctttttgagacagtctccctctgccgcccaggctggagtgcagtggcaggatctcggctaactgaaagctccgcctcccgggtgcaagtaattctcctccctcagcctccccagaagctgggattacaggcgcccgccaccacgccctgctaatttttgtttttttagtagagacagggtttcaccacgttgaggccaggctggtctgaaactactgacaggcaatccgcccaccttggcttcccaaagtgctgggattacaggcttgagccacggcgcccggccttataaacgcttataattttttaactctttcgattttattagacttttttttttaacttgaaacaacctttattttattttatttgagagtcttgctctgctggccaggctacagtgcaatggcatgatctcagctcactgcaacctccccctcttgggttcaagcgattctcctgcctcagcctcccgagtagctggattacaggcgccctccaccacacccagctaatttagcatggtggcctgaacctgtagtagcagctattcaggggctgaagtaggaggattgcctgagcccaggaggttgtgtctgcagtgagccctgatcaagccactgcactccattctgggtgacagagtgagaccctttctaaaaaaaaaaaaaaaaaaaagccaaagcatataaacttaaacttatgagagtttgggggttttatttttgtcttaaattattatatttcaatagttttggggtacaggtagtatttggttacatggataagttcttttgtggtgatttctgagatttcggtgcaccaatctcccaagtagagtgcgctgtacccaatgtgtactctttcatccctcatcccctctcccacccttcccactgagtgcccagagtccattatgtaattctttttaatttttaatttttttttttttgagacagagtttcacttgcctcggcctcccaaagtgctgagattacaagcgtgagccaccgcgcctggccccattttgtaatttttatgcctttgcatcttcatagcttagctcccacttataagtgaggacatacaatatttggggttttatctctttttttcttttcttttcttttttttttgagacggagtttgctgtaattacaggcatgagccaccatgcctggcctagtttttgatgttttgattatggtcttttctgtttgtttgtttgtttgtttttgatggagtctcgctctgtcgatctcggctcactgcaacctccgcctcctgggttcaagcgattctccagcctcagcctcccgagtagcagggattacagacccatgccatcgtgccctgctaatttttgtatttttagtagaggcggggttttaccatgttggccaagctggtctggaactcctgacctcaggtgatccaccagtctcggtctcccaaagtgctgggattacaggcatgagccaccatgaccagccaattatggtcattcttgcgagagtaaggtggtatcacgttgtggttttgatttgcatttccctgatcattaatcattagtgatattcagcattttttttctatgttggctatttgtatatcttcttttgagaattgtttaagtcccatctgtctttgtttttgttgcatttgctttggggttcttgttcgtgcactctttgcccaagtcaatgtctggaagagtttttccaatgctttagaattcgggtggtttcaggtcttagattaaagtatttgatccatcttgagttgatttttttataaggtgagagatgaagattcttttttttttttttttgagacggagtctcactctgttcccaggctggggtgcagtggcacgatctctgcctcccgggttcaagcaattatctgcctcagcctcccgagtagctgggattacaggcacccgccaccacacccggctaaattttttttgtagttttagtagagacggggtttcaccatcttggccaggctggtcttgaactcctgacctcgtgatccacccacctcgacctccctaagtgctgggataacaggtatgagccactgtgcccagccgaagatccagttttattcttcaatatgtggcttcccaattatgccagcatttattgaattgggtgttctttctccactttgtatctttgtttactttgtcaaagatcagttggctgtaaatatttgggttcatttctggtttcgctattctgtttcattggtctacatgtctatttttatacccatacaatgctgttttggtaactatagccttgtagtatagtttgaagtcatataatgtaatgccttcagatttttgtgtgtgtgtttttggttttattggttttttttttcttagtcttgctttgactttggaagctctctttttattttacataaattttaggattttttttagttctgtgaagaatgataatgttattttaatggaaattacattgaatttgtagattgtttttggtaggttgatcattgtcacagtaggattgctacccatccataagcatgaaatatgtttccatttgtttttgttgtctatgatttcttttagcagcattttgtagtttttctcatagagatctttcaccaccttggttagacatgttcctaattattttttttttttgcagctattttaaaatgagttgagttcttaatttaattcttagtttggtcactgttagcgtacaccagtgccactaacttgtgcacattgattttgtatcctgaaattttactgaatttatgtatcagattgaaaagcctttttttcttttttctttttgagacaaggtcttactctgttgcccaggctggagtgcagtagcatgatctctcggctcactgcaacctctgcctcctgggttcaagtgattctcctgtctcagcttccctagtagctggaattacagcctcttgccactgcgcctggctaatttttgtattcttagtagagacagggttttaccatgttggctaggctggtcttgaactcctgacctcagatgatccacctgcctccacctccccaagtgctgggattacaggcttgagccactgcacctggccctaaaagctttttagatgagtatttagggtttcccagctatacaattatatcattggtaaaaagtgacaatttgacttcctctttaccaatgttgtttattttttgctttactctgattgctctggccaagacttccattactatgttgaatagaagcggtgagagtgggcattattgtcttgttccagttctcagaaaaaatcctttcaactttttcccgttcagtgtaatgttggctgtttatcatagacagctttttttttcttttttctttctttttttcagacagagtcttgctctgtcgcccaggctggagtgcactggcacgatctccactcactgcaatttctgcctcccggactcaagcgattctcccgcctcagcctccccagtaactgggataacaggcacccaccatcatgcctggctaacttttgtagttttgtacagaccaggtttcaccatgttggccaggctgatctcaaactcctgacctcaggtgatttgcccaccttggcctcccaaagtgctgggattacaggcataagccaccgcgcccagcctgtcatagatggcttttatgaccttaaaatatgttccctctatcccgattttgctgaggattttaatcgtaaagggatgctggattttgccaaatgatttttctgtgtattttgagataatcatataatttttggttttaattctgtttatttgatgtataacatgtattgacttacctatgttaaatcatctctgcatccctggcataaaatgttctcgattatggtgtactatcttattaatatgctgctgtgttgggttagctagtattttatcgaagatttttgcattcatcaggaacattggtgtgtagttttcttttattatgtcttttcctgatcttggtattagagtgatattggcttcacagaatgacttaggaaggattgcatttttctctctcttttggaatagtttcagtaggactggtcccaattctttaaatgtcaggtagaattgagctacgaatccaccttgtcctggactttttttgttggcagtttgttttttgttttttttttcttgagtcttgctctgtcacccaggctggaatgtaatggtgcaatcttgactcactgcaacctctaacttctgggtttaagtgattctcctgactcagcctcccaagtagctgggattacaggccagcttgtgacctggctaatttttgtattttaagtagagatgggttttgccatgttgatcaggctgatctcaaacccctgacctcaaatgatccacccacctcatcctaccaaagtgctaggattacaggcatgagccactgtacccagccagcaattttttattattagtttaatcttgctacttgttattggtctcttcagggtttttatttcttcctggtttaatttaggagggttgtatattttcaggaatttatcgaactcctctaggttttctagtttgagcatgtaaaggtattcatagtagctttgaatgatcttttatttctaattgagcaaatttggaccttctgcttttctgggttaatctcactaatagtctgtcagtttggtttatcttttcaaatgactagcttattgttttatcttttatattttttaaatttcaattttatttagttctgctctgatctttgttattttttttttctgctgggtttggtttgttcttgtttctcttgttccttgaggtgtaatcttaggttgtttattgtggttttttgcactttttgatgtatgtatttcatactatgaactttcctcttagtactgcttttgctgtatcccagaagttttaatatgttgtgtcactattattcagtttagagaattatttaatttccatcttgatttcattgtgaacccaataatcattcaggagcagtttatttaattttcatgtatttgtatggttttgagtgttcctattggaattgatttctaattttattccactgtggcctaagacagtacttgataaaattttgatattcttaaatttattcaggggctgggcatggtggctcatgctttaatcccagtactttgggaggccaaggcaggcagataacctgaggtcagaagttcaaaaccagcctagccaacatggtgaaaccccatctctactaaaaatacaaaaattaggaacgcatggtggcacatgcgtgtaatcccagctacccagaaggctgaggcaggagaatcccttgaacctgggaggcagaggttgctgtgagctaaaattgcaccattgcactccagccttggtgacagagcaagactctgtcacacacacacaaaaaaaaaaaaaaaaaaaaaattcagacttgtcttgtgacttatcatatggtctatcttgaagaatgttttgtgtgctgatgaaaagaatgtatattctgcagttgctgggtggaatattctgtaaatatctgttaagtccatttgttctaaggtatagtttaagcccattgatttttgtttgtttcactttctctcctgatggcctgtctaatgctgtaagtaaagtataagtctcccactgtttttgtgttgttgtctatctcattgcatttcttaagggacaacttaggtgaaacaagaaaatttgtatttctgaagcatagagttaatattttaggctaaaatatatttttttctttgagacagagtcttgctctgtcgcccaagctggaatgcagtggcatgatcttggctcactgcaacttctgcctcccaggttcaagtgattcttctgcctcagactcttgagtagctaggactgtaggcacccaccaccatgcatggctaattgttctgtttttagtagaaacaaggttttaccatattggccaggctggtttcgaactcctgacctcaggtgatctgccctccttggcctcccagagtgttgggattatgggtgtgagccactgctcctggccttaaatgtaccatttatggtttttttaatatataatattatatgatctgcaaacatcaactctttacttacttgtcatcaatttcagtggctttaaacaatttttttttttgcctaactcttctgctacatacttccagggttatgttaaaatggaagcattgacaatggggacaatatagttttgcattgcattggtttttgtaaatttcattgaacgaaaacctcttcaagtttatataaagtggttacaagaggtaaagatcccatatttataggatgccctcttcatttgtaatagacagaggtggtaggttggtcacaaggctgctggttctacatagggtttacctttagttggcttgttaaaaaaggcttgggtagttgtaattcccattttattattggacagactgaatatccttcaggactttcatctgtagagcagacactaggggaagttgttgcagtcaggtctgcatatggtggggcttacatcaggatgtggatgaggattcctttcactgagtactagagagggtcttcccaggtcactgtgtgggattctaccaaggcagaattgtccatgaactgtggcttggaactagaagtaaaacattaaactgtatggctacaaatgggaatcttcctccaggtctctggaagagcaggagctctcccaggctgtggctgggaggagtttggaatggttataaggtaagttcagaattctcagtgggagcaagttgggttggctattttttggtctgtagccaagaagagatgtcctgtagtttgccaccttaatagaagcctgtctcctgaaaagaacatacctcaatcttgggctttaggagagtttcacaactccatccctggatctcaacttaccttttaccttagaaggaatatcttgacaggccctagaccactggacccctagaaattttactgaggtagaaggtccctaaattttagtcagttttattttccatcctctagaatgtaaatgtctcataaataagtccagtgtgtttgctatttcttgctcattggattcaatcagcataatgtcatcaatgtaatggaccactgtaatatttgcaaaagcaaaaagtgacagaggtctctttgaataagattatgacacaaagccagagagttgatatatccttgaggtagaacagtaaaggtatattgccgactttgccagctgaaagcaaattgcttctggtgggccttatggacagcaatggagaaaagggcaattgctaagtcaatgtctgcataccaggtacaaagagatgcgttaatttgctcaagcaacgaaaccatatctggtacagcagctgcaactggagtcatcacttggttaagcttacaataatccactgtcattctccaaaatccatctgtcttctgtacaggccaaacgaaagagttgaatgaggatgtggtaggaatcaccgcctctgcatcctttaagtccgtgatggtggcactaatctctgcactccctccatggatacaatattggttttgatttactattttcataggtagaggcagatctaatggcttccatttggcttttcccaccataatagccctcaccctactagtcagcaagccaatttgggaattctgccatctgctaagtatgtctatgccaattatgcattcgggcactggggaaatgaccacaaaatgagtcttgggactcactggaccaactctaagttggacctgtgctaaatctctattaagtacctgacctctataagcccctattttaactggaggaccacagtgatgttttgggtccccaggaatcaatgtcagctcagagccagtgtttagtagtccccaaaatatccaatcatttcccttttcccagtgcactgttacccccataaaaggccagagatctacttggggaaagatgggagaaagattcactggataaattgttggtagtgtagtggggttgctcttcaagagaatccagcctcccctttattcaaggggttctgggtctgtaaactggctcaagtctggaaattgattgaggggccatgattctctgtttttatatttcaaattagtcttctgcccattcaacctagaatttttctgcttgtataaattaagtaggaatgcagtaggtttcctatcaattttacttctaggaacatcgtgatgaatcagccaatgccagaactctacacaagtcagactgttctgattgccattttgcctctgctgtccattacagtagctatgcccaccttgcctttgatggtcgagtgccaccacttggcccctgccacctcgggatccaattattcccattgtatttacattttttagctgagtgactgcggttcccattgttggacctgacatgcaaagaagagcaattacagggctcttcaaagattcaggtgctgccctcacaaatctattttgcaaggcaatggtcaagggtatatattttggaccttccctgctggaattagtaggtctaaagtgactaatccactccagtatcgcaatctccctaagccttttgatctctccctctacattaaaccaagggacatcaggcatttccagctcactcacagtgggctatcatttttttttttttttttttttgagacagagttttgctcttgttgcccaggctggagtgcaatggcacaatctcggctcactgcaacctccacctcctaggttcaagcgattctcctgcctcagcctcccgagtagctgggattacaggcatgcaccaccacacccggctaattttgtatttttagtagagacagggtttctccatgttggtcaggctggtctcgaactcctgacctcaagtgatccacctgcctcagcctcccaaagtgctgggattacaggcatgagccaccacacccggccagtgggccatcttttaatccatatttcagctaaccaagcaaagaaactattagaaacttgtttaactccccaacctgcaacattaaatgcagtgttcctatttagtggggcctaataaataaattctgcctgattcaaccctatgttccttccaccattatcccacacccttaacattcatctccaagcctgttctccaaatttctatttatataaattagaaaactcaagcagttctttttgagtgcagtacaccttctcatggggaacactctcaacctcacctctgaaggtccactgggactttagtctacttatatgccaagaagcaaacatgggtgttgaggttggctcctgagaagaatcaacattattttgcctgggaactgcctcagggaaggccatcactgttgcctcaggcagtgcagggtttatttcaaaggtggaaaggcagcagggatcagaaaggggatgttaccactactggggatggggaagctctttcttctaacagaaaaggttcatcggagtttgcaaactcagtcaccccggcttcatcagggtccttccacacatccccattccaagtggcagggtcccattcttttccaataaatgccctcactttaatagtagacacctggcgaggttgcccatacaccttttgttgcagatcagccactagcacaataacagtttgtgtctgtttttccacaatttcagctctttctctacaggagatgagactctcactcagggtgatcttagcagatttgaggctcagtatctgcttctaaagccaaaagatagaatccctgagttcatcattttatatcatctctctgtccactgaacttaggacaaccagcttcattatgttcctttgttctccacatatggtcaaaggttgtttttgttttgttttgttttgagatagactctcactctgtcaccaaggctggagggcagtggtgcgatctcagttcactgcaaactccgcctcccgggttcaagcaattctctgcctcagcctccggagtagctgggattacaggtgcctgccaccacacccagctaatttttgtatttttagtagagatggggtttcaccatcttggccaggctggtcttgaactcctgaccttttgatccacctgcctcggcctcccaaagtgctgggattataggtgtgagccactgcgcccggctggtcaaaggtattatgtatagagtcactaaactccttgcctcccatgagtgatagtgtcatatgcatttattttacataacttcttaaactgttcatcccaagggctatcagtgttctccatactattagaagtagagtctttagcatttttgggtctaatcatattaagcagccaactccagaaaccccagaatcaaaaaagaactctatacttaatattcttttcctctagaatcactcctggtaccaaaatctgtattagtcagggttctctagagggacataagtattaactcacacaatcacaagatcccacaatagactgtctgcaggctgagaatgaaggagagccactccgagtcccaaaaatgaagaacttggaatctggtgttcaagggcaggaagcatccagcacaggagaaagatgtaggctgggagactaggccaatctctcttttcacatttttctgcctgcttatattctaaccatgctggcagctgattagattgtgcccatccagattaagggtgggtctgccttttccagcccactgactcaattgttaatctcctttggcaacaccctcacagacacacccaagattgatacgtcgtatccttcaatccaatcaaattgacactcagtattaactatcacacctagttaaaagagtcaaccaacatccctccatttggctgaatccaggtgaaacagtcatcaccatttttctaagctgaatccagaaatgagtcagcattccacctatgggcagactcacatatcacagtcacaattccaatggtgaatttttttgatgtgtgagatttagaaccttaccagtgggctctgtttatatgtgaaggtgacaatactgttagctttgtttgtgtattaaagggtcaatctcacctgtgtgctgggcctgtgataaaactttgtactgccagagggcttcatgtaatttccattaactgtaataatcttctgtgagtctcatacaggtaggagaccaaggaccataccagtttcctcaagcctagctataatagtcaacatatcttttattggctggatccaggtatgagagttatcaatgtgcctgtgagctaactttataaataggtcaacatcacacctgtggctggatctacatatgacattccaactgcggactgtgtccatgtacaagattcaagacctaaccagaggtctctgtccatgtgtgagggtgacactcataacttttggcaggatgagcatacgagatacttcacctgtgtgctgggtgcagttatatgtcaaaatcccacctgtggaaaagaaacaagctaagagagtcacatattttaaattctaggctaaagatatgttaaaatatgccttgcaggcggggctcaggaaagagagttacatcacctgagtgctgtgacgggtgatatgtcacaatgccttctatgggcatggctcaggcaggagttttacattatttttgtgttggccctatgatatgtaacaatccccctccatttgcatgacctagagaaaatagaagagtcacagcacctaaattatgaccatagagatctatcatgatacctcctatgggcagagcctaagatagagggtcacatcacctgcaaactgggctcagtacaatgtttcaatctcccctgaggccagagcccaggcagaagaggagagttatatcacctaagtgcttgggcctgtggtatgtcacagttcatttttggggggtggcagaatgcaggcaaaggaggagtgttacatcacctaggtaatgggttcagaagtatttcacaatacctactgtgggcagggcccaggcagtacagtcacatcatggagatgctgggctcagtgatatctcacaaagactttgtggacagggcccaggctgaaaataagagtcacatgacctaagtgctgggcccagtgaaatttcacaataccctctgtaggtagggcttaagcaagagagtcacatcacaatcttttctgagagctgggcccaggcagggaagtaaaatcactcaggtgctaggcaaaagtatatgtcacaatcatacctgtgggaagatctagggctaggattcacaattccacacatgtcccagcttcaggtaaaaagcgtcaacacctcctgtgagttgcatccaagtacatgagtcacagtatcaatgatgaactggatccatgcatgagagtcccaattccacctgcagactgtgtattatgttggctttatgatatgtcaaaatccgcctccatttgcatgacctagagaaaatagaagagtcacagagccttctgtgactggtatcagagtcaaagccttctaggtgtgttgaatcctggtcttagagtcaccatccacctgtagacaaaatccagtaaaacaattacaatcccaactttcgactgcatccgagtgtgagattcagaagctcaacagttttctgtatccatgcaggagggtgacaatttttactaggcgctagaagtgcatatgagaattaaaatctcagcttgttctgggtcctcttatgacactctctgtaccaccccgagggctttacattgtttgggtgagagtcatcatctgctgtgagacattagtgctggtataaattcatgatcttgcctattgccctaagcttaggtatgaaagtcaacatctctcctattgtctgggtccaggtatgaaagtcattgctgtgcctcttagttgggttttatgagtcaccctcccacctgtggttggatccacacatgacattaaaaattccaactgtggactgcatctgtaagtgagtttcaggacttcacaagtgggttctgtccatatatgtgggggacaattcttactgtttgctgggtgtgcatttgagagtcacaatctcaaattttgctgagttatgtaatgacactttttgtacaacctgagggcattatacaatattagtgagtgtagtaatcctctgtgacatttatacaagtagaaaacccaaaaccttacctgttgccctaagcctaagtacaagcatcaacatatcttctattggctgggtttattgtgcaagtgaattgggttcagaaatttgccaccatccaaccggcggaataggttcatgtgtgaggttcaggacctcaccagtaagctcagtctacatgtgagggtggcaattcaaactgttggttaggtgtgtataggagagtcacaatctcacctgtgtgctcagtcttgtaatgacactctgtattgcccaaaagctttatacaatatgtgtgagtgtcataatcttctgttaccttcctacaagtaaaagacctagacccctaagcctagctaccagagtcaacatctctcttattggctgggcccatgtttgacagtcatcaccatttctgtgagctgaatccagaaatgaatcaccatcccacttatggcaagatatacatatgacagtcacaattccagctgttgactgcattcactcatgagactcaggacctcaacagcagtctttgtccatgtgttatagtgacaatagtaactgttgtatgggattgcatacaagaataaaaatctcatctgtgtcctggaccacatcatatttcacaatcttatctgtgggaaaggttaaaaaatgagagtaacatcacctgaattcttcacctggaatatgtctcaatctcctctatgggcaaggcccagactggagaattggatcacttgcatgcagggtccggtgacatattataatattttctctaggcacagctcaggcaggagagtcacaacatttgggtgctgggctcagagatatgccacaatcccttttttgggcatgtctcctgcaacagagaagaggcacattatgtagaaaattggtacagggatttgtcacaatgtccccttttggtggtgcacaggcaggtgaggagagtcacatcacccagataatgggcctagcaatatatcacaatgccccctgatggaagggcaaagacaagaaagtcacataacctaggtgagaaaacctgacataggtcacaatgcatgttatgagtagggatcatggaaaagaggagagtcatataacctggaggctgcactcagataaatgtcataatcatcccagtgggcagggcctaggcatgagaggagagtcacatcacataaatgctaggcctagcgatatgtcatagtccccactgtgtacaggtcccagaataaagtaaagagtcacaccatctacatgttgggaccaaagatatgtagcaattacacctgtgggcaggggtcaggcagaagagccacagcacctgtgtgctggaccctgtgataagttttttttttatttatctgttggcatggcccagtcagaagaggcaaatcaaaccacctgggttctgggcccagtgatatgtcacaatgtcttccataggcaaagcccaggtaacagaggagactcacatcaaataattgatggacccagagatatttcacaatgcccgctgtgagcaagagccaggcaagagactcacatcacttttgtgctgggccactatcttttgtgtgagcagaacataggaaaaagagaagcattggccgggcgcggtggctcatgcctgtaatctcagcactttgcggggctgaggagggtggatcacctgagatcaggagtttgagaccagcctgaccaacaaggtgaagccccgtctctactaaaaatacaaaatacaccaagtgtgatggcaggtgcctgtagtcccagctgctcaggaggctgagacagaagaatttcttgaacccaggaggcagatattgcagtgagccgagatcgtgccactgcactccagcctgggtgatggagcaagactccatctcaaaaaaaaaaaaaaaaaaaaaaaaaaaaaaaaaaaaaagagagagaagcatcacatcagcagagtgctgagcccagatatgtcccaatccccctgtgagcagaatgcatgcagaagagagtcaacatacatggatgatgggcacagagatatttcataatgtccactgcaggaagggcacaggaagaagtgtaacatcacttgagtgttggacagtgcaatatgtcaaaatagccaatgtggtcagggcacaggcagaaatcacataacctgggtgcagggcctgacagtgcatcacagtgtcctctatgggcggagccaaggcaggagaataggtcacatcagctaagtgcttggccaagtgatacgtcataatccctactgggggctggaccgaggctgggaagtcaaatcgctcagattctgggcagaagcatacatcagaattacaccagcaggaaggtcctgaaatgaaattaacaatcccacacatgtcccagtttcaggtatgagagtcaacaccttctgtaggtttggtttaagtacctgagtcacagtttcaacaatggactgaatttgtacacaaaagacccaatcccttctgaagactgtgtccccttattgaagccacagcctcacagccatgaggaatcttggtctgagagtaaccaacccacctatggatcagatccacatataagagttaattattcaacttcccattgcctctggttgggagattcagagcctcaacagtgggctgtgctcatgtgaaaggatgacaatatttgctattggctacctgtgcataagagtgtcacaatattacctgtgtgctgggtgctgtaaggacactttctctaccattcaagggctgtatatgctatgcatgagagttagaatttgctctgagacctccatgctagtatgaacccatgattgtcacccgtggccctaagctcatgtatgagactcaacatctctttaattgacttggtccagataggagattcctcaactgcctatgagatggctttagaaatgagtcgccatctcaattgtggttggatgtttacatatgacagtcacaattccaactgtaaactgcatccgtgtatgaagttcaagacctcaccagtaaactgtgtccttgcatgaatgcaataatcctaataattggtggggtgtacacacaatataaacaatctcacctgtgtgttgggcactgtgaagacactctctgtatcacctgagggctttatacagtatgtgagggagtggaaattctctatgacctttctacaaaaaggagactcaggatcttacccatttctctaagcttagctacaagagacagtatctcttctggtgactgttatgagagttattattgcacctgtcagccaggccaagatgtatgttacaatcccatttgtcagtagagagtgagcaggatggtcacatcacatgagtgctgggaaagggttatgtcacagtcatttttgaggccagggaccagggataaaagaaatatcaccttagtgctaggccaagggttatgttccactgttttctgtgggcaaggtgcaggcaaaacaaactcatcaccttgttactgggcccagtgatatgtcacaattttcactgagggcaaagtggaggctaaaaacaagggtcatatctcttaggtcatgatgcagagatacatcacaaggcctcccgtgggcaggccacaggtagaaatcaccaatttcctaggtgttggagcctgtgatatgtcaaaacacacaatgtatgcagggcccatgcaggagagaagagtcacataacttaggtactgagcctagcaatacatcccaatttcttcttggacagagcccaagagatagaagagtcttattacccaggtgttgggtctagctatatgtcaaaatattctctgaagggagagatcagggaggagtgtaacctcacctaggtcagaagcccagagatgttgccgattctgtgtaagtctcaggaaaaagagaagagtcaggtatcctagaaactaggctacattatatgttgcaattatccaagtgggagggttctcatgagaagagagtcacaacatgtagctgctgagctaaacgatgcatcacaattcccactgcgtactggtcccagaaagaagaggagagtcccatcatctaggtgatgggtccagaaatatggcatacgcatcctgtgggcaagcaacaggcagaggtatctcagcatgtctgtagtaggcccggtattaagttactctcccttgtatgggcatgatccaggcagaagaagtcacatcacctaggtgctgggcccagagatatatcacaatatcttttgtgggaaaagacaaggtaaaagaagagacatcaaatagttgatgggtctagagatatgttacaatctttctgtgggcagggtctaggcaggagactcagtcactgtggtcctgggcacagcactatgtaaaaatgctttattttggaagagccaaggcagaagaatatcacctgtctgttagcccagcgacttgtcacaatatcccctgcaaactgaaccttgaaagaagattagagtaatgtcagctaggtgctggccccaattatttgtcaaaatccttcttttgaaaagaaattggtagaagaggattatcaaaacacaaagttgattggtgcatagatatgtcacaaaaatccttgtaggcagggccaggcaggagagttacatcacctgggtattggacccagcaacatgtcaaaattgcccatatgggcagggcacaggcaggggactcacataacctgaatgtggtgccaagtgatatgtgacagtgccccctgtgggcagcatgaaggcagaagagactcacatcacctggatgcaaggccaagcaatatgtcacaatgttcccttttggcaacgctaaggcaggagtatgcagctgcatcacctaattgttggttttgatgaaattttataatttcagctgtgggctgggcccagggagtagagttaaatcactcaggtgatgggcagaatctatgtcacaatcatatctgcaggaatatccaggtatgtgattaacaatcccatatatgtctaggttctaggtgtaagattcaatagccggccaggcatggtggctcacgcctgtaatcccagcactttgggaggccaaggcagacagatcacctgaggtcaagattttgacctcagatggccaacgaggtgaaactccgtctctactaaaaatacaaaaattagccaggtgtggtgccaggtgtctgtaatcccagctactctactcaggaggctgaggcaggagaattgcttgaatccaggaggtggaggttgcagtgagccaagatctgccactgcactccagcctggggaaaaagagtcaggctccatctaaagaaaaaaaaaaaaaaaaaaaaaaaattcagcagctcatgtatgttggacctaagtaaaggagtcacaatctaagtggtagaataatctgtccatgagacccttaatccctcctgtgacctgcttctccttagtgaagtcacagcctcagacttgtgttgaatctgagactcaccatcccacctgtgaatgggatccaggtatgatagtcaattttctaacttttgactgccttcgagtctgagattcagaagctcaatcactggctgtttcatgagacagaatgacaatctttactgttgactgggtgtgcatatgagtggcacagtctcacctgtgtgctgggctctgttggaacacattctgcaccgcctgagggctttatgcagtgtgcctaaaagtcacagtctgctctgagacctttctgcttttatagacccatggtcatacctgtgaccctaagttcaggtgtgagcatagttggcagggttcaaattagagagtcctcactctctagtcagcagggtctagactggagagtcgtcacccacctgcgcactggatttattaatgagtcaccaccttaattgttgccggatgttaatatatgacagtaacaattccaactttgaaccatatccacctgtaagattcaggacctcaacagttggctgttgccatgtgtgagggtgacaatcataacagttggcagtttgtgcattgtagaaacaatctcacctgtgtgctaagccctgtgaagacactctttgtggcacccaaaagtttatagaacacactaaagattggtaattcattatgacattcatacaaagagaaggcccagggtcttgtttcctaatctacactacaagagacactatctcccctattggctgattccaggtatcatcatagcacctatgagttgggccaggatatttgtcacaatctcacctgtaagtagaaaatgagcagaagagtcacatcacctggatgctgtatgaggaatgtcacaatattttctggaagcagggcacaggcagaagagtcacataacctggtggctgagcccagtgatgtttcacaatgctccctgtgggaaaagacctgccagaaaagacacatcacctggttactgggcagagctatatgtcacaatcttctctatgtgcaggctgcaggcagaaaaagagtcacatcacttaggcgatagatgcagacatatgtcacaaggccgcctatgggcagggcttattcagtagcctctgatccaatcctgtaggtgttgggtccagcgacatgtcacaataccaaaaatatgcatggctcagcaaaagaaaagatttacatcatctaggtactggatccagtgatatgtcacaatcttcttttttggcatagctcaggaagaagtagagagtcacatcaccaaggtgttggatcaagccatatgtcacaatacacaataaatgcagggctcatgaaaagatgagagtcaaatctcttaggtgtggaacagtggtacatcacaatttctcctttgtcagagccacatcacctaggtggctggcccagtaatatgtcacaattcccttgagaggtgagcccaggcaggagagtcacatcatttcggtgagaaccccacagatgtgtcattattttccctgtgaatagggctcaggaagaaaatgacagtcacatcatttaaatgatgggcccagagatagattacaatggctcctgggtacaaaaaccaggcagaagaattacatcacctgtgtgctgggcccagtgataagtcactttcccttgtgtgggcatggcttcagcaggagagaagcgtcacatcactaaggttctggttccagagatatgtcacaatctctcctattgacaaagcatgggtaggagaggagagtcaaatgaagcagttgatgggcccagagatatgtcacaatgccccccccccccccgcccgtaggcagagtacaagcaggtacctcccaattctttagatgttgtggccagggacatgtcacaatacttaaaaaatgcaggacacaggcaataaaacaaagtcacatcacctaggtgctaggttcagcgatatatcacaatccctaattcaagaggggagataaaaagattcacgtaaccaaggtgttaaatgtaaagatatgtcataatattcctgtgggcagagaccattcaggagagtcacattaccttaatgttggacccagccatatatcacaatacacagcatatccagagttcaagcagggaagaaaaatcacatcatctagttgctgggtttgataatatgtcacaatcacttgtttttgtagaacccagacagaaaagaagagtcacatctcctggttgatggatgcagagataagccaaaagactccttgtggccaggacccaggcgggaggttctcatgccctaggtgtttgtctcagccatacgtcatattaccaaatatatgcagggcccaggcaaacaaggagagtcataacaccttggtgctaagtttagtgatatgttacgatccccacttttggcagggccgggacacacacacacacaaagtcacatcacctaggcagtataaaaaaagatatgtcataatacccctgtagacagggtccattcagaagagtctcatcacctagcttttagactcagttatttgtcacaatacacaatttatgcaagactcagtcaaaagaggaaagtcatgtaacctaggtgctgggtccagtgatacattacaatctctccttgggtaaagtccaagcactagaaaagagttacattacctaggtacttggtccaggaatatgtcacaatacctcctgaggaaagagcccaggaaggggagtcacatcacctaatcgtggggtccaaagatatttcccagtgcttcttgtaggtagagctgaggataagcaaaagagtcacataacctaggggctgggcccagctatatgtcacaactaccccaggtggcaagtctctggtatgaaaggagaatcacatcacatagatactgggccaagcaatatgtcacaatctccactgtaggaaggtcccaggaaaagagaagagtcacattatctgggtgacgggcacaggaacatatcataattaccctaagcatatgtgttactgtcatgcgcaaccgcgtgaagagaccaccaaacaggctttgtgtaagcaataaagctttttaatcacctgggtgcaagcgggctgagtccgaaaaaagagtcagcgaagggagataggggtggggccgttttaaaggatttgggcgggtagtggaaaattacagtcaaagggggtttttctcttgcaggcaggggtgggggtcacaaggtgctcagtgagggaggttctgagccaggagaaggaatttcacaacattaatggctcagttaaggtggggcaggaacaaatcacaatggtggaatgtcatcagttaaggcaggaaccagcaattttcacttcttttgtgattcttcacttgcttcaggccatccgcatgtattcctgcaggtcacaggggatatcatggcttagcttgggctcagaggcctgacagttaggtcacctgtgtgtgaggcccagtgataagccactcttccttttgtgcacagggtctaagcaaaagatgaaaagtcacatcacctaggtgctgggcttacagaattgtctcaatctctcctatggtcaaagccaatttaagagacataaatcatattagctgctctgcctatggagcagccatctttttgtttctttacttctctaataaacttggtttcactttactgcatggactcaccttggcttctttctttcttgcatgagatccaagaaccctttcttggggtgtgaatcaaaagccctttccagaacagctttttggcaaactataaagggactatactgatgagaaacctgacccaaaggaaataactacagcaccaattagcctgctttgggtaactagtggggtacatttttttcacacacgtccatgtgaagagaccaccaaacaggctttgtgtgagcaataaagctttttaatcacctggatgcaggtgggctgagtctgaaaagaaagtcagtgaagggagataggggtagggccattttataggattcgggtaggtaatggaaaattacagtcaaagggggttgttctctggttggcaggggttgggggtcacaaggtgctcagtgggggagcttttgagccaggatgagccaggagaaggaatttcacaaagtaatgtcatcagttaaggcaggaactggccattttcacttcttttgtgattcttcacttgcttcaggtcatctggatgaatacgtgcaggcatgggctcagagacctgacatttattaatattttcttatattaataagaaaaataaaatagtgttgaagtgttggggcagtgaaaatttttgggagtggtatggagagataatgggcgatgtttctcagggctgctttgagcgggattaggggcagcgtgggaacctagagtgggagagattaagctgaaggaagattttgtggtaaggggtgacattgtggggttgttagaaggagcatttgtcatatcgaatgattggtgatggcctggatgcagttttgtatgaattgaaaaactaaacagaagacacaaggtctgaataagagaaggagaaaaataggtattaaaggactaagaattgggaggacccaggacatccaattagagagtgtccaagggggttcagcataattacttgctttgctggcaagtttttgagctctatccttgacagagtcctcctttttaagttggaggttgagtttgctgaggtgtgtttttaaaaaaccattagtctgttctacctttcctgatgattgaggacggtaaggggtatgaagtttccactgaataccaagagcctgaaaaactgcttgggtgatttgactaataaaggccagtccgttattggactgtatagaggtgggaaggccaaaccaaggaattatgtcttacagaagggaagaaatgaccatggtggccttttcagaccctgtgggaaaggcctctacctaaccagtgaaagtgtctacccagaccaagaggtattttagtttcctgactcgagacacgtaagtaaagtcaatttgccagtcctgggcaggggtaaatccctgagcctgatgtgtatggaagggaggggacctgaaaaatccctgaggagtactagaatagcagatggaacactgagaggtgatttccttgaggacagatttccacaatggaaaggaaatgagaggttctaagaggtgggctagtggcttgtaacctacatggaagaggttatgaaatgttgatggaatagaataggcctgtgaggctggaaggacatggacatattttccttggtctaagaaccatttgccttgtgtgggaagagattcataggtggaagtttcagtgggggagtaggtgggagtgaccgatgagaaggagaaaaactggccatgagggacagaagttggaatgctagctgcttctttagctacctcagcagcataagcgttgtcctgagctatgagatctgacgtcttctgatggcccttgcagtgaatgactccagcttcctttggaagtaaagcggccttgagaagagtttttattaaagaggcattaaagatggaggacccttgcatagcgaggaaacctttttcagcccatataacaacatggtggtgcaggatatggaaggtatatttagagtcagtatgaatattgacacatcatcaatatttgtgagagtgagggttcaagttaaggcaatgagttcgacttgctgagagctggtggagggggcagagtggtagcctcaatgatagatgtggaagatactatagcatagcctgcctttgctgatgagcggcgagtaggcctggtggaactgccattgataaaccaagtgtgattagagtgaggaacaagaaagaaggaaatatggggaaatggagtgaatgtcaggtggatcagggagatatagtcatgggggtcaggtgtggtatccggaataatgtgggagcctggattgaagtctgggccaggaacaatggtaattgtgggaggctcaacaaagagtgagtatagctgaaggagctggggagcagaaagtatatgtgttagctgtgaggaagaaaatagattttggaagttatgagaactgtagagagtgagttgagcatagtttgtgattttgagggcctctaaaatattaaagcagcggcagccacagcacacagacatgagggctaggctaaaacagtaaggtcaagttgtttggacagaaaggctacagggcgcagtcccagctcttctgtaagaactctgaccacacagccctgcacttcagctgtgtgtaatgaaaagggagtgatgagttagggagagctagtgtgggagctgtttttcaaggaatggaaaggggagtggggaaaggatttaggatctatggggtaagctaggtttgcttttctgagtttatataatcgtttagtcaggatggtaaaactaggtatccaaaggcagaagtacctaaccatgcctaagaaggaaaggagttgttgttttatagaaagggttggggttcagaagattagccagacatgattagcagggagagcttgtgtgttttcatgaagaattatgccgagataggtaacagatggggaataaatttgggcttgacttaagtaatgggggctgtccgtgaagccttgtggcagtacagcccaggtaatttgctgagcccaatgggtgtcagggtcagtccaaatgaaagcgaagagaggctgggatgaagggtgcaaaggaatagtaaagaaagcatgtttgagatccagaacagaataacgggttgtggaggggttgtggagggaggtattgaggataggagagtatatgggtttggctccacggagtggataggcaaaacaatttggttgataaggtgcagatcctgaactaacttgtaagacttgcccagtttttggacaggtaaaatgggggaattgtaagaagagtttataggctttaaaagaccatgctgtaacaggtgagtgataacaggctttaatccttttaaagagtgctgtgggatgggatattggcattcagtggcataagggtggttaggttttaacaggatggtaaggggtgcatgttcggttgccaaggaaggagtagaggtgtcctatacttgtggattaaggtggggagaaacaaggggaggaggcaaaggaggctttgaactgggaaaaagggtagcaatgaggtgtggctgtagcctaggaatagtcagggaagcaaataatttagttaaaatgcctagacctgataagggaactgggcaggtggggataactaaaaaggagtgcataaaagaatattgtccaagttggcaccagagttggggagttttaagaggtttagaagcctggccatcaatacccacaacagttatggagacaagggaaacaggcccttgaaaagaaggtaatatggaatgggcagcctctgtgttgattaagaaggggaaggacttaccctccactgtaagagttactcaaagtgtctatgatggtccaggaggcttccgaggtgatcagagcagcatcagtcttcagctgctaagccgagaagatatgggaaagagtcagtcagagccttgggccaattggacagtccaatttccagtggggtcccacacagatgggacatggcttaggaggaatcctgggctgtgggcattccttggcccagtggccagatttccagcacttgaagtaagatcctgggggaggaggtcctgaaggaacacctgactgctgtggcttaggcgttttgaagttcttgtgtgctggagatgtggctggggtttctctcacagcagaggaaagtaattgcaactcttctctattattgtacaccttgaaggtgaggttaattaagtcctgttgtggggtttgagggccagaatataatttttggagttttatttaatgttgggagcagattgggtaataaaatgcatattgagaataagatggccttctgacacttcagggtctagggctgtaaagtgtctaagggttgttgccaaacaggccatgaactgcgctgtgtttttatatttgatgataaagagcctaaacgctaactgatttgggagaggtcagataaagaaaaaggagcattaaccttgactatgcctttagctccagccacctttttaagaggaaattgctgggcaggtgggggagagctagtcacgaaacaaaactgtaagccagaccaggtgtgagcaggggaggtgataaaggattatagggttggggaagagaggctgaggaagaatcaggacctgactcggcctggcaaggagcagtctggggaggagaggtcagatgggtctgtagaaaaggattcaaaagactcagtgacacttggggttgggactgaagggacaggtgggagggaaagaaggaggatttgggatgagttgcattgggaacggagactagggagggaccgatgtgtaaaagaatgcctggacatcaggcacctcagatcatttgcccatttttcaacaaaaatcatccaggtcttgtaaaatggagaaatcaaaagtaccattttctggctatttagaaccattatcgagtttgtattggggccaaacagtgttgcagaagaaaataaaatgcttaggttttaggtcaggtgagaattgaagaggttttaagtttttgagaacataggataagggagaagaagggggaatggagggtggaaggttgcccatagtgaaggaggcaagcccagagaaaagagagggtagagacacagagaaggggtgggtagtgagcagccctgggctgcaatgtgggtgagcagccaaagcaggcatccccacaattgacttgccactaaggaaatgtgggtgaatgaccaaggcaggcatcccagtggtgatcagacacaaatggagtgtgggtgaataattaggcaggcatcccagcagtgattaaacaccaagggaagactgtcttcccgagtctgtgactggcgctggagttttgggtccacggataaaagtgtctcctttgtctctactagcgaggaaaaagaactggaattggaaggacagggagattgaagggtagcaagagaggctggagaagagagtgaaaagacagcttacccaatttgaaattggtgagatgttgcttgggctggttggtctgaggacccgaggttgtaggtggatctccttatggagtgagggcgaggacaggggaccggtctcccaaaggagtcctcctatcctgggtcttcggcaccaaatgtcacgtgcatctgtgtaaagagaccaccaaacagtctttgtgtgagcaacaaggctatttatttcacctgggaacaggctggctgagtccaaaaagagagtccgcgaagggagataggggtggggctgttttataggatttgggtaggtagtggaaaattacagtcaaagggggttgttctctggcggtcaggggtgggggtcacaaggttctcaatgggggaggttctgagccaggagaaggaatttcacaaggtaatgtcatcagttaaggcaggaacaggccattttcacttcttttgtgattcttcacttgcttcaggccatctggatatatacatgcaggtcacaggggatatgatggcttagcttgggctcagaggtgtgacaaaaatcaagaaaaatacttcagtccgctgagaaaaattctttttccaacaaaacaacatccaagaaagaaaaacattaaggccttttttttttttttttttttttttgagacagagtctcactgtgtcacccaggctggagtgcagtggcacaatcttggctcactgcaacctctgcctcctggattcaagcagttctcctatctcagcctcctgagtagctgggactacaggtgcatgccaccacacccggctaatttttttgtatttttagtagagatggggtttcaccatattggtcaggctggtctcaaactcctgacctcaggtgatacatccgcaaggccttttaaatatacttataacttggatgtccacttttaattaagctgatcgctctttaagaaaattcttttaactcccttattacttaactttagccatgccaagcagccattatttctggcttccaaattttattagaagttcagagaaaggagaatcgaaggcagttcataaaggaaaaaagaattagcaaaaagcaaaagtcacacagacatcaaaccagaaagaactcattttctaagccaggattaaaccccagacaaccattgtaaaatcgcaaaggctagaacaaaacattatcatcgtcaggcctctgagcccaagctaagccatcatatcccctgtgacctgcacgtatacatccagatggcctgaagcaagtgaagaatcataaaagaaatgaaaatggacagttcctgccttaactgatgacattaccttgtgaaattccttctcctggctcagaagctcccccactgagcaccttgtgaccaccgcccctgcccgccagagaacaaccccctttgactgtaactttccactacctacccaaatcctataaagaggccccacacctatgtcccttcactgactctcttttcggactcagcccacctgcacccaggtgattaaagcgctttattgctcacacaaagcctgtttggtggtctcttcacacagacgtgcgtgacaaccatgtggtggttgtgacttaaaaccggatggaggcctgcagcaaagtttgctacagaccatacagcacacaaagcacaccagattggctacttaagatcaagctcacaaatttttcctacaataaaaactctacagaagatataaacagtgatgttcatcattcctggatcaacagaatgtcctccaaagagaaaaaaaagaaaacacgcttaaaagtcaactgctggctatgtgcgtggctcatgcctgtaatcccagcactttgggaggccaaggtgggtggctcacctgaggtcaggagtttgagaccagcctggccaacatggcaaaaccctgtctgtctgtactaaaaatacaaaaattagccaggcgtggtgatgcacgcctgtatcccagctactcatggaggctgaggcaggagaatcacttgaactcgggaagcagaggttgcagtgagccaagatcacaccactgcactccagcctaggtaacataagtgaaactctatctcaaaaaaaaaaaaaagaaaagtcaaccctgacaaggtagaaaaaaaagaaaagatgcctggggaagaacgtcttattcttatgcaaatgggcttctctaccagagagagaaacttcattgctccctaataaagtgggatcttttggctgggggagggcaagcctctatggatgcatggcagggagtgctggccagcctggcatcgggcaccctgtaaccatggactccagccctagttgggagtggtgtggggaagctgccattccctggtccatcctccacatacctgcagccattggggtggggtggggtgcactctcaaaggaggtctgaagagaaaaaggcttagaaataaaaggaaagaaggtttttgagtttgtatggtactcacccttcctcaagccccatgtctggaaaccaaaaatgttataggaaaaaaaccagtttcttgtaaaattaccaggaaatattaggttcacagacacatagaggggcgaggagcagaatttattaggcaaaaaggaagaagaaaacaactcaataaaatgagatggggtcctgctaacaagctctccacctcaccgattgaattccaggtccccatacaggaacaggagaggccaggaaactcctcctgcagacggtgtgaacttcctgaggctctgccccatcctcccagtgcataggccggtttgagattctctgaggactcatttttacttggctgtctcaatacataggcattagccttggcaactgacttctagaaatctgctatgcaattagagctttacaaacattaagcaaatattttatcatttaatctctgtggttttcttttcttttttttttcctttttcttgagagagactatctctgtcactcagggtggagcgcagtggcgtgatcacagctcattgcagcctcaacaatctaggctcaagcacttttgctacttcagcctctgagcagcagagaccccaggcatgtgccaccatgctcagctaatctcccatttttctttttgtagagataagctctccctatgtagcataggctggtctcgcatgtcattcacatagcccgtgaaaaagctggccctcctactttagccttttaatatgcaaaggcagggcgccatggatgttctacacacgtggagatatgtgggggtggccatgttgccaggaacatttggtgcaagggcaagaaggccacgagggaatcaccaaattgggtggaccaagtttctaagggcctgcatttgtatatcaaaagttgccagcctggctctaagagctggggctttaaaagaaacttttccagagatactttaaaaaatgaaaacttcccaaggacctattttcctctaatccacgtaaaataatttcttaataactcctaccacacagggctaggattacaggcatgagccactacatgcagacagaggttttatttttatatcaaaatataaaaatagcattagccaggcacggtggctcacgcctgtaatcccagcactttgggagcccaaggcaggcagttcatgaggtcaggagttcctagaccagcctgaccaatatggtgaaatcccgtctctactaaaaatacaaaattagtcaggcatggtggcacacacctgtaatctcagctactcaggagggtgaggcaggagaattgcttgaacctgggaggcagaaatggcagtaagccaaaattgtgccactgcactccagcctgggggacagagcaagacaccatctcaaaaaaaaaaggaaaaaaaaaaaaagaaaaaattagctgggtgtggtggcacatgcctgtaatcctagctactctggaggctgaggcagaagaatcacttgaacctggaaggcggaggtttcagtgagccaagattgcaccattgtactccagtctgggtaacaagagctaaactccatctcaaaaaaacaaaacacaacaaaaaaaaagaaagcaaattcaaataaataaaaataacaaaatatcatatagtatagataatatgaccagaaagaaaaaaaaaagcttagctttcctgactttaagctgcattagtactatagtactaatagaatatccttagtgaagactattctatttccataaaaaattcaacataagataattttcaggttttagaaattgatgaataacataatatagaaaggcagcaatgtgttcccatgatgtagtattgttgtgggacaatcagagatgggagagaccgaacagagttcaggaaagcctttattaaggtgatcacctggctcagtaggactagagtccaggaaagtgagccccagacaaagaaagcagccaccttttaagcagtcagcagccgggagctacgtgatgcaggaagcatacttacagaagtgagaacagaggcagttgatcagtcttttacatttatctatactatgtgttccacatccttgggaaaccatgtttctgtaacatatgcttaccaaccttgtaactgcagctgcgctagggaggtgaagcagaaactcactgagcctcaaggaatgtgaaactggtgagtacagataaggctctctgagcacagaaggaaaaacaggcagttagtattcttctctaacttagactttgttggggggctacactacacttagcttttgaaggaaaaaataaaaatttcttggttgtctttgattacacttgtaaaattcatgattccttctttagtattacttgaaataaaaactgagcaaatacagcaaaatacattttaaagttaatctcatgtcaaaataggtacagaagttctaataaaataataaatggaatccagaaatgtattaaaaataatatgttgtatatatatgtattgtattagaatgtcaatgcaattaaagatggaaaatgtgttgtttaattacatgaaaagtttaaaaagtgaccattctctatgattctgaaaacaggaattgtctcaacagatgtgttttcgcatctacatttacctacacatattttatatgacatctatctattctttatccattcatagaatgtataaaaaaagaatggatttaaaatgaatagcatctgataaaagaagcacttaaatgtattatgaaagttactttattacatagtgtccagatacttatatgttccctcagaaattataaaataagattgtatcaactcttccaggtaatttaagaaaatattttaaaaatatgtggataaggttattagctgaaaataagagagaatacattcatttgcacagataaagagaacactttttaaatacaaaaagtatcacgaaaaatgcagataatgtacattatctaaaaaatactaaatctaaaaaacaactcagtgctataagatttatgcagcatagagaaattatatataaatatcaactgtttatatttacttttttgagagagggtctcactccattacccaggctggagtgcagtggcttgatcatggctcactgcagcgtcaactccctgggctcaggtgattctcccatcccagcctcttaattagctgacactacaggtgtatgataccacacccagctagttttatgtacttttttgtagaaatgaggtttcgccgtgtttcccaggctgaactcgaactcctgagctcaagcaacccgcctgcctaggcttcccaaagtgctgaaactacaggcattagcaaccatgccctgcctgaatatggatattttaaataacttcagtgtgaaatactaaacacagttcaaaatgtattttacttatatgcaatgagttgaacaaacattcaagagctaaatgatgagtaaatataaggcccaacaaccaggggcatgataatgcaaacagctaatgtgtggagcactcttgctttgccagcctgtgtttcaaagcattttaaatatttttgctcattaaatcctcatcagcaaaaactctgtaagtttaattattccccatgtcacagacaagtgactgaaggaaaaaaaattcagggacttgtccaaggccacccatatagggagtggttgagctaaggtgtgctctgacttactcctctctgcttctcttgaatagaaagtgctataattcattgattaaaaaaactactcttggccggacatggtggcacatgcctataatcctagcactttgggaggctgaggcaggtggatcacaaggtcaagagatcaagatcatcctggccaacatggtgaaaccctgtctctactaaaaatacaaaaattagctgggtgtggtggcacatgcctgtagtctcagctacttgggaggctgaggcagaagaattgcttgaacccgggaggtggaggttgcagtgagccaagatcgtgccactgcactccagctgcgtgatggagcaagactctgtcaaaaacaaaaacaaaaaaactactctttgagcacctgccatggaccaagcactgtgattggcactaggaacatagtggtaaactagacacagctcccaggag

SEQ ID NO: 1305 - DNA, 2283 bp, Homo sapiens
ataattcccagtaaatgggaatgattgttcagcagaaaactgatccctttgggaaagttaacgtggggagaatgtggcctggctctatggtccttgacaccaccgtgaaagaccaggtcaccctctgcccattgcccttccagaagaagcttgtcctccctgccccagctccgagtccaccacagtctcccactcaggcagctgcaaggcatgctgggagtgagtggccactggggctgggggctgtcgggggcagaaaggaggagcagattcctccctcctggcacctacaaaagtgtgtccaccagacagggctagatcaagtccaggtccccgcaatggaatgggaaggagcaggcagcagtggggtctcaactgccgatgaggaggcatgcagggctggaaacacagtctttctatttccttgagcggccttcagcctccccggagcctcttctccactcagccttgacctttgagtgtctgtgcccgtctctgcattgcccagctgtagcaaaaatcctgtcaagtcagtttagccagaatctccacccttggtatctgatcaaatccctcctctcccaccacctgccaggtgccctctgatcactcttgcctgccttcagccaggatcctgggagtcagttcaaccacaacctcccactccttcgtatttttccacccacccactcccctccaacctgctcctaggctggaagtctccacttgtccctgctgtattcagaattgagcccagttctatactgaggtctcttttccctattgcaatagttcctgaataaaatctgttttttaccgttttaactactgtccagctttgttttctttttcttttttttcttgagacagggtctcagtctgtcgctcaggctagagtgcagtggcaccatcatagctcactgcaggctcaccctcccgagtagctggaactacaggctcgcaccaccatacctggctaattttttctactttttgtagagacgaagtctcactatgttgctcaggctgttctcgaactcctgggctcaagtgatcgatcctcccaccttggcttcccaaagtgctgggattacaggaataatatggtttggatctgtgtccccacccaaatctcatgttcaattgttatttatttatttttggagactgagtctccctctgtcacccaggctggagtgcaatggtgtgatctcagctcactgcaacctccacctcctgggttcaagagattctcctgcctcagcctcctgagtagcggggattataggcactcgccaccactcctagctaatttttgtatttttagtagagacggggtttcaccaggttcgccaggctggactcaaactcctgacctcaggtgatccacccactttggcctcccaaagtaccgagattacaggcctgagccaccattcctggcctctcaagttcaactgtaatccccagtgttagaggtggggcctggtgggagatgattggattatgggggcaatttctcatggtttgataccattccccctggagctgtcaccacgacagtgagttcttgtgagatctagttgtttacaagtgtgtggcacccctcccttctctctcattcctcctgctgccaccatttgaagtgctggctcccccttcaccttttgccatgactgtacgtttcctgaggcctccccagccatgctttctgtataggctgcagagacatgagccagtgaaacctcttttcttaaattacctagtctctggcagttctttatagcaataggagaaccgactaacacgaaacatgagtcaccgctcccagcctcacctatggttttaatagcagcactactgccttcagcccactccaggcacacagaggctccgtgggggcatccatcagcatccttctgtgccaggctccctgccagcccctggtgtgagagctcaggaggagcccaggagggcttcctgcaggaagagacagctgaggaagtcccgagagccgagtgaaggggagctctgcccagtcaatgttcagtccctgcaggtgggtctgtgcagatacggggcaggcccatgtacttgaacggagatgctctcggcctcacagaattccaaatgccccagatgcctgttaacttttcacataccctgtgtccctgccagtgagacacacgaaggctgaagcatagaacaagcttcatgccaatcactgggtgggctggcaccctcctcactgccagcacccaccgtggaggatgggcaggagcc

SEQ ID NO: 1306 - DNA, 1690 bp, Homo sapiens
aaaaaaattgaatcaagggttgtgcatgacaatagcaggtaatttagggatgaatacaatttgcttgacttagagcccaactagctctgaaactctcttagaaaccaaaacacactgggtttccaaagcttactgcaaatgagaactttgcatacgtggagaaattttgactagaaaagtcttactggggaagatagagtgtctgaggaagtgatcaaattggctgacaggaactcctctttcctcatggccttaattggttgaggtggctaccacttgtgaaaggaagctgactgactgccacctacagccacctcatccttagtggttgatatagtttctttcataaagtctggagagaatctttctcccacaggtgtcacaatgctttggggttcttttgaagttgctctttgtctttcagttttttaaaatccagtacaagtttccccagaactaggtcagagaatatcaagatgactcaagccaaagttgctcccaagagtccccatctcctctgaaaatcaaccacagtcccagcaagctcttggttctctatccactcctcccatcacccattctcaggttgagcatgtgcctcccatccctctctccttcaagtttatcccacagttttaattcctgggtcccaaatacttgttaaaaatatcattcatcttttacaaagagagaaagaaaaagtattttagaatgtgtcctctttactgtctcttgcaaaaagccctaatgtttctcagtgactctggtcacttctgtggagatagattggtctcttccttggaccatttcatctcatatgaaataagtgatgccacatttatctctttagccttatattcttctatgaaaagtggtcttttttagcagtagcaagggatatgttggtgaaattgcttttggccactgaacataatgattcaggatacttctgggttttttaaaaaaataccctgttatggatttattatccactaattaacttacactgaacttaaccatggtgtggcttccttcatgcaattataaaactcatttcaacaatagaaatggaagtgcagtggcctctcctcatcttgatggactcggtaggctcccccaggtgtatcaagctagagctatttttctatttttctgtttttctattttctgatctctaaaccctgcctattggtccagaggttaaattcagagtgatctatagaaacatggcccagtttcccaaaaacatagttgagatttgggacagatttcccatggactgggaaccaagatgtaaaatcttgtgtttgtaaaatcaaattttgcaatttgaaattcaaataggcatacaaaatcatgaaaatataaggatgtagggtgaatttcatgtggttcacaggtagaaacaaatggtgaagtgaagcagaaccctcaaataaacattttttttatgagagaaagaaaatgttatgagataaaatataaatgtggtgttgaatgaaatccccaaatggaaaagggaggagaggagcagagaggttctgaggagacaagccaagattgtgaggctgtgaggggctgggaaccagccacaagttcaggccacagaagagaatggaaggggtagtaagtactccacaacttgagccagcttctacatcaaccacttggcttcgactccgtgtaaaaa

SEQ ID NO: 1307 - DNA, 9097 bp, Homo sapiens
tgttgaaggatgcagaagtttaatcaaattctctgtatagacgaagagccctattctgaaaactataaaatggctatacacacgcgtgcacagatgcacacacacacacatcagtcctaggttaaaacaaattaagcaattttctatatcagatcttgctagatgtgagaacactctcttctaatatggaaatgctgaattttttaattgttgcctgtggacatgtgatatttcattcacatgaacacaattttggtaagctttaccatgtaagtgaaagtgaatttttcaattgtttttaaaggagagatattgtgttttaggattttcacctgcatgatccacaaaatggacattatcaagtgtctatttagaataaataaacaaacaattatttatctagataaagcataaatgctttttcacagagctggatctcccttacaaatacgcctcctcagccattgtttgggccaatcgtaaaccacaggaatgcagggatttcagtttgtcatttccctgacacatcactcgcccccagagatgctggtttaccacacctgttggaactttgtaactaaagtataagaggagctttataggcatgttaaatcaagtgaaagaaaattgtccatagttagtagctaatggtcaacaataaaaatatggccattagaaaaaaatgttcagaaggaagcaaacatgagaagagcataaaatgcaataagacaagtaaaggaaataaaagatatatagattgaaaaggaagaaattaaactatctttgcagatgacataattttttatatacaaaatctcaaataattgaccaaaaaaaccccagaatgaattaccaattataacaaagctgcaggatacaaggttaatctacaaaaatcaattgctttcctacatacaaacaatgaacaactataatttgaaattaaaaacacaacacgatttataccaaaaaataaaatgcttaggaagttacttaaatacttggatataaacctaacaaatacgaatatttataaagaaaacaataaaactttgatgaaagaaatcaaacaagatctaaataaataaagaaatattccatgttcatggatagaaaggcaatattatcaagatgtcattcttcacaacacagcaagttcttttgtgaatattggcaaatgaattccaaagcttacatgaagagtcaaaagacccagaatagccaacccattattgaaaaagaagaacaaagttggagcattgacagtactcaacttcaagacttactataaagctacagtaatcaagacagtgtggtactggaaaaataacaggcaaataaatcaataaaactgaatagagagcacaggaatagatctgcagaaatatagtcaactgatctttgacaaaatagcaaaggcaattcaatggagaaggggtggtcttttcaatgaatggtggtgaaataactggatatccacatgtaaaaaaaaaagtgtagacacagaccttacacccttcacaaaaattaactgaaaatggatcatagacctaaatgtaaaacacaaaactataacatttctagaagataacatcagagaactcccaggttatactttaggtttggcagtaagtttttagattcaacaccaaaagtatgatccacgaaagaaaaaatttgtgagaagaactttattaaaattagaaaattctgtctatgaaagacactgttaaataatggaaaaaattccacaaaaatttgcaaaatgcatatctaataaaggacttatatccaaaatatacaaagaatgcttaaaactcaataagaaaataaacaactgaatttaaaaatgggaaaaagatgtgcagaattcaagtcaccaacgtaacattggccagggggcccagcaatctccacatgtactcattgcagtcgtatttaaccactgacattgtgactttgctttgtgacttttcctcttctgggtaccgagatgctataaaggcagctgataaagatgcattatgtgtcataggctgatgccactacctgatttgtttacttgcaatttgagccatttaaagaccaataaacttcctttaaaaaatgagcaagagaccttctaaacagacacctcagcaaagaggatatatagacaccaaataaacatatgaaacaatgctcaacatcacatatcatatgtcattaaggaattataaattaaaacaacaaggagataccactacacacatattagaatgaggaaagtccaaaacaccaacaacaccaaatgctagtgaggatgtggagctataggaactctcattcatgcaaaatgaaacagcgattttggaagacagtttggcagtttcttacaaaactaatatactcttaccatacaatgcagaatggaatacttccttggcattcttcaaaatgaattgaaaacttatgtgcacccaaaaaccagcacatggatgtttatagcagccatattcataatcgccaacacttggaagcaaacaagatgcttttaataggttaatggataaacaatctgtgatcccttcatacaatagaatattattcagtgctaaaaagaagccaggaaaagaagtggatgaatcttaattgcatgttgctagcattaaaagccaatctgaaaaatgctgcacattgtatgactccaactatgtaacatcctggaaaaggcaaaactatagagaatataaaaagagtagtggttgccagcgtttgggtttgggatacagagggaggaatgaataagaggaatgaataagcacagaggatttttagggcagtgaaactattctgtgtaatacagtaatgatgaacacatgtcatacatttgtcaaaattcatagaattgtataatacaaaagtgaaccctaatattaactatggacttcagttaataataatgtatcaatattggttcatcaattgtaataaatttaccacactaatgcaaaatgtagtaatagggaaactatgtgtggggaggagggtagagggagtaaatgagaactctgtatttctgctcaatttttctgtaaacctaaaacttctcaaaaaagaaagtctattaattaaaaaaattgaatcaagggttgtgcatgacaatagcaggtaatttagggatgaatacaatttgcttgacttagagcccaactagctctgaaactctcttagaaaccaaaacacactgggtttccaaagcttactgcaaatgagaactttgcatacgtggagaaattttgactagaaaagtcttactggggaagatagagtgtctgaggaagtgatcaaattggctgacaggaactcctctttcctcatggccttaattggttgaggtggctaccacttgtgaaaggaagctgactgactgccacctacagccacctcatccttagtggttgatatagtttctttcataaagtctggagagaatctttctcccacaggtgtcacaatgctttggggttcttttgaagttgctctttgtctttcagttttttaaaatccagtacaagtttccccagaactaggtcagagaatatcaagatgactcaagccaaagttgctcccaagagtccccatctcctctgaaaatcaaccacagtcccagcaagctcttggttctctatccactcctcccatcacccattctcaggttgagcatgtgcctcccatccctctctccttcaagtttatcccacagttttaattcctgggtcccaaatacttgttaaaaatatcattcatcttttacaaagagagaaagaaaaagtattttagaatgtgtcctctttactgtctcttgcaaaaagccctaatgtttctcagtgactctggtcacttctgtggagatagattggtctcttccttggaccatttcatctcatatgaaataagtgatgccacatttatctctttagccttatattcttctatgaaaagtggtcttttttagcagtagcaagggatatgttggtgaaattgcttttggccactgaacataatgattcaggatacttctgggttttttaaaaaaataccctgttatggatttattatccactaattaacttacactgaacttaaccatggtgtggcttccttcatgcaattataaaactcatttcaacaatagaaatggaagtgcagtggcctctcctcatcttgatggactcggtaggctcccccaggtgtatcaagctagagctatttttctatttttctgtttttctattttctgatctctaaaccctgcctattggtccagaggttaaattcagagtgatctatagaaacatggcccagtttcccaaaaacatagttgagatttgggacagatttcccatggactgggaaccaagatgtaaaatcttgtgtttgtaaaatcaaattttgcaatttgaaattcaaataggcatacaaaatcatgaaaatataaggatgtagggtgaatttcatgtggttcacaggtagaaacaaatggtgaagtgaagcagaaccctcaaataaacattttttttatgagagaaagaaaatgttatgagataaaatataaatgtggtgttgaatgaaatccccaaatggaaaagggaggagaggagcagagaggttctgaggagacaagccaagattgtgaggctgtgaggggctgggaaccagccacaagttcaggccacagaagagaatggaaggggtagtaagtactccacaacttgagccagcttctacatcaaccacttggcttcgactccgtgtaaaaaaaccctagacatcatgactatataacctgagagaatctccatatctaggtgtgtggattctagatttttatttcaaaataatcttgggcacttactccctgatactgggctccttctcttacctcaccccactgatccctgggcccaggctactacagttgcctcatgtcacatacaatctgtgcttgcctctgtttaggaggatgccaaagaccattaggacctaaataaggttttcttattaagtaagtaaaaaattggaaataaagaaacattggagggaaatctgaagttttcgtgttggggaaggactgcttcatttctgtgcttctctggaccctttcctctgagatgggggaggtgaacctgagcctcacgtttgtttggattgtgaagccccaggggcttctgaacagactgttcttgattctaaggcaggactgctgagagtgcaaagttcagccttaaaaataacatctctatctctcaactgggcaaagggccttgcactttggaatgagacaaaaggtaaccatgggattttgaacttgagcaaagagagggggattgtgggttctgggaagctgcttttttggggctttttttttttaaaggagaaaaattgacagtttataaattggccaacttgctagcagataatcagttattattgtcacttgtagatagtgtctggcaaaatagagagctggtaagaactaatgattgctagggactctggaaccaacctggtgtctctccctcaatttcttttcatttttcacagagcccatttcaattaaggtaattaaaaggctattataatttgtgaaagcctgggcaaattatttatatttcttagtcagtttcctttctgtaaatcggggctaaaggagccttgatgtgagaaataaataagatctgactgtaaaaaccctgacacatagtaggcatgccataagtgctagtgccttcctctctccatctcatttattggctgacttctttattcctttctctaggtaaagactgacaggtggaaaggaagtaagaatgatatgaggaaggtctacctactgatttgtcccgataaaagagaaagatttatttaataaatgttcactgagcccttttcatgtgaatgtgcatgctgggcagtagggaaatgatgaaattgtacattatacatttgatgccctcaaggagtttttagagtagtagagaggctgagacaagattagataagggttctataaactggtaaataagaagcactctgggaacgggtaggaaatgtaaagtcatttctggttggattcatcgtggtgttgggaacagaatggaagcagcactaacagtgcttctcaagtgccgacagcgtgatgaagagcatgcgtgtatgatcttatgcaatactcacagcaattctgtgtagtacacattcttagattcattttacatgttaggaaatcgaggctaagttaaggaacttatctgagatcaagtaattagtaaatggtagagttggggctctaaaccagttatctgacttcttaactctttttccctatcccacattgcttcaaagtattagggacaaaagataattctagacaaaatgaccactgttcataggtggagatggaagagggttctttcttttgcaggtgagggaagaacatgaagaaagtcctgaagcaggacaatttattctcacttttggctatgtgatcttttcaaagcagtatttccatgaggcagatccatcaaacaattagatgtattgtaccatgagggcaatttaggagcaatgtagggcttatatagaaatgccactgattaattacaaaaatggagaggacttctgcttggtacagtcacctgaaagccaaatcccaattctggctctgccattgacttcctgcagttccaaggctctaggaatagcgactgtcctcacgtgtctcagctaccttcctctttgtagtcatctaggcatcaaatgaaaggctttttttttttttttaaagaaatcttgttgaattgtctccatattgttgctctgttcagactccagggacacagagtttctgggcaatctggagcttctccaggaatgctaaccttctctgaagggggttgctctgaagaggcgaaatgcttgcctttcaaaaatacatccttagggaggctatcagctgcttcatttttgcacagtcagggaaattttatcctctggtaagggatttgagaacagttggctgtggttgcctaaaagactccacaaggacaaatgtccagagcacagtcacccccattacccagaggccaaggtctctttgtttatacctcttgtagcttttcctgcattcctgtcctgtctgtcccaatcttataccctgttctgagtctagagagagtcacagtcattggaagtgactcctataagaagccaatatgtggtgtaacttcttccttcattcattaatttgttagtttgttcattcattttaggagaattttctattgttaagaaacacttgttacataacatcaatgttttcctaactatgagtcataaagaggatactagctgcctttgttttgttcctacaaagacacatgaaaatagggtttctaaaaaattaagtactttgacaaatggcattttttgcccccttaccccaatcaagtggttggaacccatttactgtggaaatttttgacactaaaggtgaaccagttttaatcttaactcttccctcaagacccgtgaaagatcaaagaggaatttagagaatttaaacaccaatggttcaggtccatgtgtgcagctggaatccacctctatctggtatccactaggaatagagtctccttctggcaaactcactcttctgaaggctgtggattggtctagtttgggttgtgggtgggtctgaagatacaagtcacctgggacatctttctcagtctctatgtctccatcaatcaaatgatagcatcatatagtgtttatatattaataaaagttttgttccttattatgtcattaatcctacctcaagtagattaggatatataatatcctagatgtaataaagactgtgaagagggttcatcaagaacttcattaccaatggtgtatcaggtagaaagagagcatcccctgaaggggataagggagattttatactcatgtatcaaaccaaatgtcagccagaataccagcatgaaacaggaatgactcagtggagtgagcaggccccagacaaatgtgtaaaatagctgcggttgccttttgatatcttccatgctccttgtttctgcctttctctcattccaactttaacagtactgtcactagcccatactcatctctctctccctctctgtctctctttttctttatcaaatctccaatatccagacatgatctgaaatgtattccctctaggggctagaagtgactcaatttgatatttcactcatgagacattgaatgtaataaaaaaaggatggaggtctaaatatggacttttatacatctgggagctgagtggaagtgtcttaagggatgagagctttgtggagacactggagtcaagtgatataggtgatttaatttaccctgttagacttctcagcagcatatgacatgttgacaacctccctgtttttgaaggcaaatttttattttttttaaaattatatttacttatttatttatttatttaatgttgcccaggctggagtgcagtggcttgatcatggctcactgcagccttgacctcccaggctcaagtgattctcctacctcagcctccagagtagctggggctacaggcacacaccaccatgcctggctaatttatttgttttatagagatggatctcattatgttgcctgggagaattattcttatttttctgtacagaaaactcaacagtgtatggttaaccaagtttagtagcaagtgtttcagcttttgccttttcctgcttggcaatgtaagccacagatttaggacccaggacattgctttcccagtggtggcagatctcatcatatctgtcattgtcattggtcctgatagcttccatcagcttcatcaaaactcctctgtcttcccagttaaactgtgtgaaggcgacagtggtgcaggtcttcctgtggactagacgtcccagtcttgccttccccttgataaggcagtaagggacccatattttacaacacagggcaggcagaaagacaaccagcttgatgggatcctcatcgtgttcagtcaccacca

SEQ ID NO: 1308 - DNA, 33873 bp, Homo sapiens
gatgtggagtggccctctttgtcacatcctacactcgtaaggcatgacatgtagtgcagttgctactcctaaacagtatatctcacttcagcttccttctgtctttgagaccagggtcttagggacacacacttatgtccttgcctttaacacagtccccacctaaacccctcagggtaactgactacatccaattcacagggctgtccctgcactagaactcccaaggtttgtattcatttcactgtgacttcagcttcttcagagccctcatcctcccttttggaacagtcgcagtggggcaccttcttgtctaagtgccatgggggcccaaggggtttgccgaaatggggaataaaggatcgccaatgtcccaggaggccttgggaggtttccaactgctttggtgtggtgggacatgagtagacctgcatcttatcttatctatgatgaaatatggaataactatagtcttatgtaaccagatgacaccaagtatttgactgataagcctggaccctggactttgtccgcattgacctcccattctctgttcaccaagtgagacagcaaagcaggggctgcagagcaagaacctttatggactcatcctaaccttcatctccttcccactggagctctacatcggacgccaggacttaggctcccaggatgacgtagtcatagtagtcctaatgcattggtgtggcagtcagcaacactttaaatggcctaccaaataaacaatggtctccaatttgctatcctatccctacaggcggcatctcattatagttacaactgttctcgtggctgacacaccctagcctgtgcaatgagctctgcctcagtggttgctcagagtgcagtcaggagtggccaacagctgccacagctcaggaatctgactgtcactttgtcacattgtcacatccacctcaggcaacaggtcctccagaacttttggcattttggaggcatccccgtacacatgcagcgggccccatccatcaaggattgcagctgttgggcccacagagatgtgcatggcctgcctgggatttccccacaggtctccccttccttgacactgttgtctaagagcttgcaggattttctttgaccttgttctgggcctaccagttgtcatgctagacccctattgactgtaataggcatggcaccatgtccaaaaggctgaagaggagacctggagcccatgaacaagacctagggtgtattgaggacttgcatacaatgtggcccaggaaaagtgtgttggacaggaaaaccactaccatttgtaaaacacgtgtagtttatattatgattttcacttagcaccctctacctagcaacctccagatttaacaaagagcatcaatcacctggacatcctgtgttccaagggataggccagggattcagatgtccttcacagacaaggaataaacttctgggttgacagctcctggatttcttagctcagagctctgaacatacattcttcataaactatagggtcattctcacagtgtgcttaaattaacgctgccaggcatttctggcatacatagatctgaacacacacctcataaaacaatgtataaaaaagtgttcatcaagactttgtattaagaatatgtatatttaaaacaaccattaaatactgctactcatttactataatattacaacggctgcacagcaaagcattagtgaatactgacaaggctccagaaaagaaaatcttattcactgttggtaggaacgtaaaatggcacttcctttttggaaaatattttcagtatttctttggagttaaacatgttaattgaacagatgactctaaggtactttattcaactgtttttttgttttgttttgttttgttttgttttgagatggagtttcactctgtcgcccaggctggagtgcagtggcgtgatctcggctcactgcaaccttcacctcccaggttcaagcaattctctgcctcagcctcccgaatagctgcgattacaggcacccaccaccacgcccagctaattctttgtatttttagtagagaaggggtttcaccatcttgggcaggctgatcttgaactccttaccttgtgatccacctgcctcggtctcccaaagtgctgggattataggcgtgagccaccatgccttgcctattcaactgattttaatacttacttctacacagatactttcatgggaatgccggtatcagctttcttcagtagagcttttcctcctccatgaattttgcttatagggtgataattatataaacaattcccatataattgggccaggcgcagtggctcacgcctgtaatcccaggactttgggaggctgaggagggtagatcacctgagatcagcagtttgagaccagcctagctaacatggtgaaaccccgtctctactaaaaatacaaaaattcaccgggcatggtggcgggtgcctgtaatcccaactactctggaggccgaggcaggagaattgcttgaacctgggaggtggaggttgtagtgagctgagattgtgccgttacactccagcctgggtggcagagtgagactctgtcacaaacaaaccaaaaaaaaaaaaaaaaatgaaaaaactgaaaaaacaaagttcccatataattagagtatatacttctattgttactttttttcaatttattaatgacatactgtaaacaacattaaaaataataatccctttcatttctcagccccagcacagctgcctcctcccttgggtttctgacaccctcaggatgtgggttttcacactgtgtctctcgcacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctcctgtggagagaacacagaagtggatgagatctccctggactggactcaatctctttctcatcactgggactagggagcctcttacctgtggctgctgccaccaagaagaggatcctccaggtccagtccatggtgaggaacggagctctcaggggattctctagaggacagatgtggttgctgggtgatgctctcagggcacaggacagatctgtatttacttcagtaaatctcaggttatttgcatattcatgagggatactatttcatagctctagacttgatccaagatgagaaagagaacacacataatttatgggccatgcaacagtgggacgctgaagtccctgtcccaatccttgtttaatgatgtgtgtccccttgtatgcccagaactctgctaaaatagattgtctgctgaaaacaagttcccgcagaacatggtcctccaagtgaacccatacttaaatggcactttgacaccttcatacttttctgggctttgctttctgcatgtcttactactgtctctgttaagattggcaagcactgaattaataaaaccatcccttttctccatctcctacctattaagatatctgaaaatcctagaaatttctccttttacatgtgattctcattgacttgttaggttagataaatcctacaaatagaactgtatactgaaagacacaaagacacatcaatagtctttactaaagtcttgtttaacttattaaagcatgtttgtccgagaaaaggaagacatcagaccctgggaggaacccctccccagcctcccttgcacctgctccagggctgcagcctgtgctgggcgaggccctagcgctccctgccacccagaccttgcactgcagggagcttcccattgggtctcacagagcatttttctctcagcctctgtagctcactaggaagtgactgtgccctggctcagaatgctccttcagtgacaacatgagctgatggcaccacttcttgaaatagtgaatgggcctttggaaacccaatgtcctcttcagggtggctccaagagaagaatcgctaaaatcaccagggagtccacttcctggaggtctagatgcactggatcactggaaacaaagggaggctaaaactctgggggggttggaggtggctcttttctcatttcggctcttgcagatgaatactgcatctgagaatacctgaagctgcagatggatgtggattaaagctcactccacgtccgctgttccaataactcctactcaaacacacagaaacacaaacacaaacattctcacacacactgtggctgattttcacagttatggacccctaatttttccttcttcgtagtatcttactcacgggaagtgccgccgaccctgaccctaggcctcagtatgtgactttctttctcaaacagatctaaagcaatcacactgccctctttaatccatattaatgatgctgttgaggaggtaatgtgtggggcaggggagcatggtatgttcttacagttgactctccctggtttggttgccctcttctcctgagcagtgaccttcacaaggaatctccagtgatacagctgattttctctctttcctcccttctgcagatgctgcacccagggctaccgccttgaatctgactcctcttggctaattttatcatttgcgtgatagaggaaggctgaggaggaggggtctgtaatttggaagtatttccttcccccacataaactaagattttggagaataccttcccttggatgagctttctagaaaagtctttttgtgcatcttttctccgtgattactcctccccagttcatggctatagggaatctattttaattgcttccacgagaacctgaaggccctggagggcaagtccacacaagtgtggggtgtacagcctctaggagtgctcaccctccccctagtccacatttgtcctccagacattcagcataatcaccaggtaaatgttctcaccaatgtgtctccaggagcttctcttccaagtcagcaagtctctgctgtgactgtggatgtgcctgtctctacagcttttggagggagtagttttttcagcaatttcagctcttagatggattaaaaaatacttgatatttagatggtttggagatatatatatatcaaaatatatatgtgtaatatatatcaatatacatattatataatatatgaatatacatattatatattatatatacatattatatatcatatattgatatgtatgtataatatataaaaatatacatatatattatataaaatatatatatgatatataatatatatttattatatatatatatatatatatatatatataaattttttttttttttagatggaggctcactctgtcgcccaggctggagtgaagtggtgcgatctcagctcacttcaatctccacctcctgggttcaagcaattctcctgcctcagcctttcaagtagctgggattacaggctagtgccaccacgcctggctaatttttgtatatattttttagtagagacggggtttcaccatgttcaccaggctggtctcaaattcctgacctcaagtgattcctctgccttggcttcccaaagtgctgggattacaggcctgagcctatgtgctcctttggttcagatgttttttgatgtagaaatggagctaatgacttttaagatcatcacatatgtcagcaaaaccctgaagtcccctaagaggtcatgtgtgttctggtactggaagcagaaccctaatctccctacacaaaagtgacatctggacagacacaactgaacatgtggggacaaagggaatggcacagcaggacacttatgaggaagtttcaacagtttcctttttattcagaggaagctgcagcaggtgagagctggttatacctcaggcgatgtcattttctggaaggctgttcttgctcttgtgctggatcaagtggatgcacctgggccctcacacctggaacaggaactctcattccttaacacaaggtgctcggtgagacagttgcttccagctgaagtgcagagaaaggggagagaaggagttgtctctggtgtcccaggatgtgtgtcaactctaggataaggtcaccttggaggggcagtggtctaccttaggggattacatcagttctgccttcaataacctgtggctgtggtcaggagtgtgactcatccccttctgctcctcctacctgcctttcattaaatgtgcaatgaatgagtgatccctcaccagagagtgtcatggtctaaacatcatgatctcacacaataacatccccacacccaatctcaaatacattatagaccccactcaatcagcaattggcaaataatttgctcttgtagatttggtgaatacatttgctcagcgttcatttcaacagcctctcagccacatttagcaaagtgattgacaaaaatgaacatgtctctatcagcaaatagaaaatataaaatcaccgagttggttgaaacgtacactattaactctgaacaaatataataagaaattaggcatatcacaatggcacacagtttgttttaccctaaaaatatcccctgagctttgccaagtcagtctcttgtctttccccaaaagccctgcctatcacaaacctgtttttaaaatccttttaattttactgtatttagcaggtctcatgaatggaattgtacaatacttagtctcttttgtccatcttccttcacttagaaaaaatgttaaaatgttgtcttctgaattaataacccatagtttttatgactgatagtattccactgtatgagtatacaaatatttgagaatcaattctgttgaaatacatcatgtttacttttgtatttggtaaatatgagtatcagtttatgacaattgatactgaacaattttatatattcttattttcagataacattttttcttggtgaggtgtttgttcagattttcactcattttagaattctgtttatattatgctttctgttgagttttacaaattctttttatagcctagagacaagaccttacaaacagtaaaaagaaatagtttctgattttgaatagattcaatatacatacataatttttaattgttataagcacataatagtatatatatttctatttgttgggtatatgtgatgttttggtacaggcatacaatgtgtaatgaacaaagtaaaaaaaaactacaataaatctataaaacattgaggaaataaagaggacacaagatggaacaatattccatgtttatgaattcaaagattcaatattgttaaaatgtccataatacttaaagcaatctacagactcagtacaatccctatgaaaacaacaatgatattcttcacagaaatttttaaaaaatcctaaaatatatgtggaaaaacaaaagatgcagaacagcccaagccattctgagcaaagagaacacaactagagaaatcacattacctgacttcaaaatttatatttttattattgttaattatttgatctaaaagttatgtttcaaacaatgagaataacaatacgttaaatgagtctgatgtatgtatacttgaaattaatggcatcaattttatgaatgatggaggtaattgagaatgttctgtgtgaggcacctgcactagatttgatgtggaataatgtcattttgaagatggagacagattagttacacacgcatattgtaggccatggtgcaaagcaggctcaccatgcaaaagtgaccaaaacgaggccacgtgggttgtacacctcagcagctgtgttacccactgggacaaagctctgaaggacatcctgcctccaggggagagaagaacaaagcccagggtgtccctggctgtttttccctaactcaagattttatatcctctaggagaaacaggaacaaacctgagctgttccagacagacaggatgtccttggctctgtgcacgttcaggaacaagatcaactcgttctgagtctctattcagtgatttaggttcggggaaataagaatgcagatctgaaattatggagctttcagaaggttttcatgtgtctcagtgcaatttcttcatgtgttattttggcttatggtattgataggcccacaaaaactagatttaattcaataattcaagtgatagagcaaaactgaaagagctgaggggttttctagcaggatttagaaagtttaaaatacttcatcttagaaaatgtatttgctggacattgatgggactggagtagagatggatgtgggggagcccaaggattgtgctttcacacacaccacaatgacttctgctgtcccttccttccctctctccctctctctctttctttctttcttttctttccttccttcttccttcttctttctttctctttctttctttctttctttctttctttctttctttctttctttctttcttctttctttctttctttctgtttctttctttctctctttctttcttttcttcttttctttctgctgagtgagcacagaagtacacacaggtataaaactcactgaatcaccattagctgttcttccttttgcctcccacccaggtcaggaggaattacaagtcctacggaattctagttctaagagagtgagaatctttatatggctgattattccagaattttctataatgatgcagctgttgtttcttttagccagtttttattgaattctgttcttttccattgagtcgtaaaacttatttctatattctgttgcaagtttgttttaagatatatatatatatatataaaatattcttgaaatctgaaagtttctgttcattttcttaatgtaattatttaaatatgaaacttattttattataaattacaaataatttttgcatatatttatgacatatgttgtttagttatgatacatgtatacattatgaactgggtaactcaagccgcttatattcatcacctcacaaatttatcatttcttagtggggaaattctaatgtttatttttttagtaattttgaaatatatactaccttatcagctatagttgacatgctgtgcattagaaaggcataacttatacctccggtctaactggaacgttgtgcactttaacccacatctccctttcccagtccacccctctaggccctggtaaccaacattctactctacctctgcaagtctactgctttaatatatacagtgaaatcatgaatgactcttcctctgttcctggcttgtttcacttggcataaggtcctctagattcatgcatgctgtcacagaggcagggtttccttcttatttaaggatgaacattactctgttgtgtctgtatgcattttctttattcattcatccattcatgggaatttaggatgtttccatatctttactattttaaataatgctgcaatgaacgtgaacatggagtgcagatatctctttgacatgttgatttcatttcctttggatacatagccagcagtgagactgctggattctacagtagattttgtttctttattttttgaggaacatttatagtattctccataaatagctgtattcatctacattttcactctccatattctgagttctgtttctgtcatttcagccatctcagccccattcagaactgctgttgaagaggtgctgtggttgtttggaggaaagagggcgccctttttgttttcaggacttttgcactggttctttctcatctttgtgggcttatccaccttcaatctttgaagttgctgacctttggatacatttttattttcttttaccctattggatgaccttgagggtttgattgtggtataaggtggattcagccaactggcttcatttctggaaaaatttaggtggccagtgctcagctcccaacacctagactgtgtgctctgactctgggggaagttatactagtccctgacttggttctccggctccttaaggttaggaatccactgtcctgggctgttggaggtgtggcagctgtggcagagtgctagtgggtgtctgggtgcctgcctccctgcaggtgttcgccacagtggcagaggcattgcgtctgtggggccctgttggtgactgtgttcaaggtcacactggaggaggtgttggctcagggatgggacacttgtgggcacaggcccgggtgccgtattcatgccccacaagcaggagtgatttctgaatgtgtgagatgatctgctattctctgtgcagaattagcgcaagtgcgggacgctgacaggagcggccctggctttttccccaccaaagcttcctctgccatggtggttggggtggggggaggggactgcactccacgcaatggtgggacaagaaaagcaaaacccacctatacagacatgtgactgcaaagtgatgtgggaagttacgtgggcctgggtgaacctacagtattcggaggaagtgtgtaagctggtgtgtgcacatgagggctgcccgattggagctctccaccagtcaggcatgttctgccagggcagaaattttggtgcgggatcccagggcgtccaagactgccctgcaagaaggtgtggccaggctagggccccaggagaggccagtagatggaggggcactcaggtccctacattatttgagaatgtggccatgttttatgtgaatgagtgatgacttgattgtaatgcagcattttattccagtacacaaacatatctcaaattgtttaacattcacctgtaatggatattcaatgtgttctctcagtttctggcttttatacggaaagcagctattcagtgtgggaatgtgaaaaaaatgagaaaactgtgattttattctgacctcattaacaacgaagctgaacagctacaaataaaagagagaaaaaacattcaacatatctgagttgatttcaccaagcaaacaagaaaactgaaatctgagaagataggagcctgcagagagaaccaggacctacctgctagtgtacgtagggcaggtgccactggatggcatttgagatagaaacagactaacctagaaatacttaatgacttttttttttttagtatgcatgtactaatggtgttagattggcctagtgcttgcaagcttttcctagagaacttgaaaaatccacggacaacttcctcatctggtgtcttgtggtgttgactggggaaaagaacagcagctcctgtggaatgcctgaatgcacctccactacctccaggggaaatccaccaaagcatgtgtcatatgagctgtggtgaagtcaacagaaacaaaaggaaacagacgacaccaaggaaacttgatccagaaacacctcccatctccttcctcaggaaagaaatccttactctttagggtaaggatagtgggtaaaaagctggggacactggtgaaaaacagttgtgtctgggaaaagacgttccagccctggggaaagagttaaggacaggacaatgtggaaggccactccccagaactatgcttactactcctgcataagaaggagactcagtcagaaggttggaggaagtcccgctttgtccaacctccttcaccacacagtcatcaatttaaactgtcagtagggtgcactttccacagctgaaacagacagcctccctggggaaaactaaatataaagacccaggatcaaacagggacacaaaagcaagtatcatgggaggaacttgaaatctctgtggacagcagaagctgacttcaactctgataattgtggcatccataaattgcaaatatagccctgaatagatacacacaaatatctataatgaaggcccagcagaatggaatgtgtgaccatcttcaggaagaaaataatgaatacatgagtacaagaaaataaattacaaattaaagtcaaactggaattctatatatattaaaaatttcatttaaagcgaaagtcaaatgaataccctgtaagacaaatcgattctgagaaaatttattgctagtgcattcatccttcagtaggtgctttggcaaattttctgccagggtgagtagccatatgatatacatccgaaacatgaatctatccaaataaaacatgtggtcaagaatgaaaaaatgaagttgaaatgtagtttttatatttttaattgttctaatatatgtctatgtaatgataaaaatgcacatattatattttatagcacatataagtgcaaactgagaataaactaagacaacggatgagaaagagtgtttagaagaataagttataatagctctacaacctatgaagaggttttacgttatttgaattagaatctgattatacacaattcttattgtatatcttagggccaatacaatattcataaaagatgaactaaacaataagttaatagagaaataaacatgatcataaaatgccaaattaaaacagaaattaacagaaaaatagtaataccagttttaaaatagaattattatagttgatttaaaaagcaagacccaactactagctctgtacagaaatttgctctacatagaaaagttaaatacaggaaaacatggaccatgaaaatatgaacgaaaagaaagcgtgcttagctatgttaaattcagacaaggtagacataagactttcaggaatcaaggggcatattacatagggtaaagggatcagttttctaaaaggcatcaccaaagatttaaccaatggatctgggatagaaaataggctaacatctataacagatagcgaattcgacacttactgtgattgacaaaacaaacgtgataaaataggtaaatatataagtgaccagaatcaacttatttgactagtttcatttatagaatattcaatgggaagacagcaggaacccaaactgtgattaaccagaagatatgagaggaacatggtgactgaatttgatgtggttacgtgggttgaacaaagaaacaaacaaaaagcaataggaaagtgacaccttatctcaaaaagaaaagaaaaaggaaaaaaggaaactgttaaaaattggcaaaattcaaataaatcccagagctgaataaacagaaacttatcaatgtaaatatattagtcccatgtcccatgttttttttgacatattaactttagtgaaaacttggagatggatgtgaacacactgtattttccttacaattgttctgataacctataattattccaaataaaaagtgtgtaaaatataaagtaacaatcataaaaataatagttcaaagaccttataaaataggcttctgaaaataatattgttactaaaattattatggataattatttcagaggataatcctgaaatgatcatcgaagtggtggacagatgtttatttatttcagaaaaagatgtgaggcatctcatattaaacgctagtgatggaagtgtttatagagttgttttatcatctataatatgatggatgaaaagcattatcataagcatttgatggatgaaaagcattactatcataagcatttatgtagccaatatcatgaacgtattataatttcctcagttgtgcaccatttttgtgttaataccatgtgaacgttttctactgcatgtgtcatatctaaacatttgaactagtttgtttgttattaatgtgactcttgtaaatgctgtaggcattgctgatgttctctgtaatttctctactggtgtttttttcctaatattttaacatgataaatttggattaatataactacgtaatttaataatatattttaaacttcatagttgtacacacagacacacacacacacgcacacatacacaacagcccagcaatgacacatatacccgtccatgcaaaaatgaatgtatattaaacaccaaaacaacacacccatttttttctatattattttaattatttaattgaatgtaactcgtatttgcagtttcatttttgaatgaatgtaaatgccattcttgccaaatatattacttaagtgtacaatggtatttacttttttttttttttgagacagagttttggtcttgtcgcccaggctggagtgcaatggcgtgttctcggctcaccgcaacctccgcctcccaggttcaagcgattctcctgcctcagcttccccgccacgcccagctaattttgtatttttagtagagagggggtttctccatgttggtcaggctggtctcgaattcccgacctcaggtgatccacccacctcaccctcccaaagtgctgagattacaggcgtgagccactgcgcccagccagtatttactttttaaatatcagtcagttattaataaattgaataactaataagacaaacatcacttaaatttttattaaatcattgattaaagtaacattgtatttttttaaactaggcaggatagaacttttctatttgaaaaactttttaaaaaactttttggcgttaattttcaatacaaactctagtcgttatttgccaatatgcctttataataaagaacatccagcaataggaaactgaaagcagcccatgctttgcaggattcaatcacaatggcagcttgctggagggtggtctgagagtgggcaaacacattagggatttggacttcatgaaagcactactgagcccctgggctgagcacacagagggtagcataagttgcagagcctagtctgtggtacttagggaaaaagaggaatgggtgggggttatgtctgcaggaccctagaaaagtgtgatgagggcagagggtctgcaggtagagtgtattctaaggagaactgttactctcctaaacttggttggcttcagtgatcatgaaaagaagtgaactgatttaccagacatggaggacaggaagtaaaaggacttcctgtttcctgcatggagactgaggaagataaaatattttgacagaaaaagagaagatggagaaagtttgagaagcagaacaccaggggccaaagtggaggacaggagcccttaaagtggtgtttcatctgcacaaacagccgatgaaaggaaaagaaactggaccccatgcatatgctgagttgttagaaaagcatttacaatagtgtgtctgacagcacagaaaacaaaaaaattgtgcatagagccagactttggattgaatatacacaattaaaaaaaatatactgagatatatcattgctagtataactctgaaaataggcagagttaaaagttgaattgaacccctgttctaagttaatgttttataggtgaaagaaaccatgagttacaaggaagacatcgtaagagatcctggggaagacttttgcttgaccaggtcaggaatcaccaaggtggaaaaggaaacctcatcctccccaggtacctgatatggagctgcctccaaagagccccttggaggtcctgagtgctccctggtgtcctgagccattcttgctgtcctgaacacccactggtggttcctgagtgccccctggtggttctgagcaccccctggttttctgagcgacctctggtgtcctgagccccccctggtggttcctcagtgcctactagtgtcctgagcgccccctggtggttcctcagtgcctactagtgtcctgagccccccctggtggttcctcagtgcctactagtgtcctgagcgccccctggtggttcctcagtgcctactagtgtcctgagcgccccctggtggttcctgagcgccccctggtggttctgagcaccccttggtgtcctcagtgccccctggtggttcctgaacctcccctggtttcctgggcaccctctggtttcctgagcgacccctggtgtcctgggtgacccctggtggttcctgagcgccccctagtgtcctgagcatcccctggtggttctgagaccctactagtgtcctgagcgtcccctggtggttcctgagcgcccctagtgtcctgagcatcccctggtgtcctgagcgccccctggtggttctgagcatgccccggtggttctgactgccctctggtgtcgtgggcgccccctggtggttcctgagcatcccctggttttctgagtgtcctccggtggttctgagcacccgctagtttcctgagcatcccctggtggttctgagaatcctctggtgtcctgagcaccccctggcagttctgagtgccccttggtgtcttggtcacatcctgtggttctcagcacccccttgccacagtctcatgagtgccctttggtgtcctgagcgccccctggtgcttctgagcaccctctggtgttctgagcaccccctgcttcttctgagcgccccttggcggttctgagtgccccctagtgtcctgagtgccccctggcggttccgagtgccccctggtgtcctgagctatccctggtggttctgagtgctcccttgtgtcctgagcgccccctagtgattcatagcacctcctagtgttctgagcgccccctggtgtcctgagcacctcctggtggtcctgagcccctcctggtggttctgtgcaccctccctgatggttctgagtgccccctggtggttccgagtgccccctggtgtcctgagggcccccttgtggtcctgagcgccccctggtgtcctgagcccctcctggtggttctgtgcaccctccctgatggtcctgagtgccccctggtggttctgagcgccccctagtgtcctgagcgccccctggcggttccgagtgccccctggtatcctgagctatccctggtggttctgagtgctcccttgtgtcctgagcgccccctagtgattcatagcacctcctagtgttctgagcgccccctggtgtcctgagcacctcctggtggttctgtgcaccctccctgatggtcctgagtgcctcctggtggttctgagcgccccctagtgtcctgagcgccccctggcggttccgagtgccccctggtgtcctgagctatccctggtggttctgagtgctcccttgtgtcctgagcgccccctagtgattcatagcacctcctagtgttctgagcgccccctggtgtcctgagcacctcctggtggtcctgagcccctcctggtggttctgtgcaccctccctgatggttctgagtgccccctggtggttccgagtgccccctggtgtcctgagggcccccttgtggtcctgagcgccccctggtgtcctgagcccctcctggtggttctgtgcaccctccctgatggtcctgagtgccccctggtggttctgagcgccccctagtgtcctgagcgccccctggcggttccgagtgccccctggtatcctgagctatccctggtggttctgagtgctcccttgtgtcctgagcgccccctagtgattcatagcacctcctagtgttctgagcgccccctggtgtcctgagcgcctcctggtggttctgagcaccctctggtgtcctgagggccccctggtggttctgagcgccccctggtgtcctgagcccctcctggtggttctgtgcaccctccctgatggtcctgatgccccctggtggttctgagcagcatctaccacatagtcccctcctgtctccctgcggtgagctttgtgtctgggctcacacagggtttccctcactgtgtcactcacagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgaacacagcaaacagactgagaacagccccgtgaggagaagccacagctggacctgatttacgaaggacactaatattgacggggatgagaagagaatccagatcaatgcagaccccacggtgtggacactgaggaagggcacagacatggggtggctcctcgccagggcctgagggaacaggggatgagctgcctttcatgagaagtggaggggacacatttccacgtctttctttttgtggtcatgggtgcactgctcagcattgctcatccatcctctgtgtctacatttcagggaagtcaaggtcaaaggatttctgggtctggatgcacagagttaatctgcccattactattttttattctctaatgtggacactgttggggtatcttcataatagcaaacattatcaacaaatatgtccagtaagaacataaaaatacgtttccagagaaaatggacacctgtctctaattggtatatttagagctgcaaactactgttcttgacaataaggcaaagttaggttgcaatgaaaaaaatacagatctatgccttgtcagggagggggtttatgattatcattatcttgagatcattttgccacagaacaattcgacattggatatatgtacttgtgtaaggaaacagtcaatgtggacatatgtgtacttatgtgagtgaagagttcacatggagacatgtttgcttgtctgagacaagagtccacatgaggaaatgtctgttttctgaggaaagagtaaatgtaagaacatatgtggtagtctgaggaaagagtccacgtggggacatgtgtgtttgtctgagagaagaatccacgtgagtaaaggtgcgtttgtctgacagaagagtccacatgttgacaggtgtgtgtacccatctgagggtaaatgcccattcagggacagtgtatgcctgaactgagctgaagtttggggaaatatttctcaaccaaggaaagaaaataatcctgtgggttatttgcttgtcaagagaaaaaaacctgggtcacatagaaaattgatttaaaaaaaaaacaatttaaaaaattaaaggtctttagtgaatggcaacatcttatatgcaaatcaggaaaattacctcattctttgttgcatacatctcatgaaatctccaccctcacaaaataagtaatgagataattttatacaatctgcatttgatccttgggttaatgaactgctaaatttttttttaattgtatatatttaggtttatattttccatcacaaaactatgtgcttagacaaattaattgtgtcatatctgaaccattgcatatcactaaaaataattttaatcttcttaaacagtgtctttttaacttattttataccagtctctaaactcctcgaatatcctctatatgttgttgttcacttgactacagttttggcttttatagaatttcaaataaatcaaattatacagtgtcattgaaatgacctcactgaagaaagtggaaaatgaagttgctgacctaaggaactttgaaaatgaggaaactctgtaagtttaaagtgtaaagaaactgaacataagcactctattctagtagataaacatgtttcctacaagggtacagctttacatttctgatactgctatgcatgtgtcctgaaattgtgcagctaagtaataaaatggcatatggttggatggggttcctcattttgcagtgagaggttatagacagtcaaggaaggaaggctagaaagatccatgtggtagcataattgggtagagagaccagtgtgttctcatttttaatgtaatcacattacagaaggttagatacatagtttactaggccagttggttgagaggtcctgcaagtacttataccacattaacaatgcacatacccagtattacaattttttaaatactattctttaacatcagaagcaagcaatctttagaaaaatggctgattctatgtatgaaaaagataatatagaaaatgagtttagaatttattataatagcaggaaacagggaagtgttcaaaaacaaaagcatgaggtgagctgtaaggatgcaggatccaaactcaatgagctcccagcacataataaagccgtggtggtttgaaaaataaaatgaataatgtagcatggatcttcttcagagtatgaaatagacatccataaaccaatacacatattaataagtgatcaaataaagaaataataggaagaggaacacatctttttacagaagtattccaaatatgttaggttgatagtcctctaatcaagtaggtgaagcttaaacactcatgagttgattgtagcctgagattagagacgtggaaaaagtaattgctattactgtattttataatgagatttcagatataataccaaagacatgatctgtggatgaataacattttacattttttaaatctaaatttgtataaacacacacacacacacacacacacacttttctgcaatacatactgataagggagtaaaagacagccgcagacttggagaaaatacttccaagtcacatatttgttaaatgaattcttttaatttgttaaatgattttataatcaatatgcaagtaaacttacaactaatcaaaagaaaacaatgcagttaaaaatgaaccaaatatgagaagaggcatcttggcaaaaattatatgaaaattgttaaatgtgaatttttattagggaaatgtgcatttaactaaaaattagataccattactcacctattagaatggttaaaacacacaattctcataatgataaatggcaatatgaatgtggaaaaccaagaactatcatgcattgatggtgggaattcaaaatgctacatgcacaaaatgagtttttttggcatttttaaaaatagagataaaagtagagataaaatgtgatttgtgtgtgtgttccaaaatatttacaacactgattcagaaattgatgtttacacagatacctacagaggaagttctgtatcagttttattaattcaatccctgaaatttgcttgcagaataaatattgtatgaaaaatctctcaaataattaaaatttctcaaatacacgtttatattgttccttttccttaatgacttaatatcattttctgagaaagtcttcaatctaataatctttgtcatttcctccatgccagcacagctgcttcccccctggggtttctgacactctcaggatgtgggttttcacactgtgtctctcgcacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacacctgtagagaagacacaggagtggatggaagcccccttgactggcttcgatcccttcctcctcactgggatttggcagccccttacctgtggctgctgccaccaaaaagaggatcctccaggtccagtccatggtgaggagttgtgctctgggggcttctgaggagggatgtggttgttgggtgatgctctcagggcacaaagatatctatagtcatctcagttatttgcatattcatgagcgatgctatttcatacctaacacagcatgagaaagagtggagagatgacacatggattacccaacaggaggatgctaagggttcaagctataatccccttagaggccatgtgtgccctgccatatccctaaactgtatgttgacagagcttctcccactggagaacaattttccctagaacaggacttcactgggaacccacacttgaatagctcagaggtaatttaaaatatttctaggctttaatacatgaatgtgttatttgggggatgagtgtgtttctccaaaagttgcacttatttatataaaataaaagcttaattgacctccagatgcttactattaagatatgtagcagggttagaaatctccagtgtaaattgataaattcttgcagttgaataggatatttatggactcttcagcagtttttgtcaaatacttattttagatttttttagaagaatgacacagatcttaaggggactccatccgcagcctcctgtgcacctgctctggggctggagcctgtgctgggtgggccttgagcgccccctgcagcccagcccttgcactgcagagaggctcctgtctgggctcccagagcattttccccccagtatgaagtggctgtgtcctggctcagaatgctcctttagtgacacgtgacaccatgtgctgctgacgccatcgcttgcaatggtaaattggtcgtaggaaagccagtgaactctgcagaaacaccccaagcaaggattctatgaaaccaccagggagccccttctgtggagctctggaagcactggatcagtccacactcacagtgagtccaggagcttccaggggctttgggagaacacctaatctcttgtcggttcctgtggatgaacatctcatcagataatttctaaacctgcaagatcatgggtctcagaggccactgcaaaactcctaatacacacacacacacacacacacacacacacacacacacggtggttagagtccccacagtaatggacacacacacacacacacacacacacacacacacacacacacacacactgtgtctagtgtcctcacagtaatgggagggaactgtgccttactccctgtgtctcgcgcattggtcgtgcgcccacagtgcccctaggcctggggatatgcccttgtcaacagagcgacagcaaacactttactggagatggggccctgcacacactgtggcttccctgttctcccagaacctgggatcctgcagatacccctaagaagagtccaggctccccctgggagggtcagccacagcccagccccaccgagtcggtgcagcctgcactgagccgctgacctgtggagagggtcacgccagacccacagcccagccagccccactcccagaggcacatcaaggaagggggcagaaccctggggactcttgatgggcatcttttcaggagcagacacacgaactgttccaggaacaggggacctgggaaggtcagtagctggtcagggtttctgaggaccagcgtcagtgatgggacctgcctgtcccttctcatatgggatgtctctcctggggatcctgcactgtcttatttgtgcaggttcactctgtgggacttgtctttataaatctcaaatctcaggaacaggagagctgtgcttcaaaagcccccatagagaagacacattcccatcctgctgtgactgaaacagctccatcctgggcatggggagggctcatgtgtcccacctgggatgagcagcagcagccacacgtgagctgaggaggactcaaggctgcttcccagcacttccccacagagtgaaatttgtgtgtttgccccaaatccaggctggccctgtgacttgcttctttcaaacttcttggcctggaaagtgcaggcaccagctgtcactgtcaccactattgtgacagtgtacacagcaccaggacaggatcccagggatggggctgaggacagacactagctaagtggacccattgaaaacgtgcggatctgctgaggttcacactcctggaaggacagatcttggagggtttggaggaggaagcagccactgtcggtgactcaggatctgctgctctgcgggtcacctcgttggcaagtaacagtgggcaggtgagtgtggttcatcccctacagggacaccaggcttccaaatgcccctcttcaccaggaaagaaagtggctttgttcatactggttgctccagccgtctggtcatcctgtcttcctgaccttcttcccgtgtccctcagggctgtgacacatggacaaagacactttctactccaaccattgattccccaagccagctccctctagaaaagccacgatgtcttcctggttctgtgtccctggctgaaccagaatggacacacatggatataccaaagtgtcaaagtggaggagaggaatcttggcaaagatcactcaggaaagagaaaggaattcatttctgtgcaatgagagggtgtggggcatgtctggaggctgcaggagccagaagcttcatatttttttagtgacctcggttttgtctcccctgttgttgtgaggcttccctgagttctcctcctcagatagactctgtgccttttcacgcaatgacctataggagatgtttacaccaaacaaaaagcctcaaacctggtttatattctgatctaaattttcaaaagataaacccaagagagattcaaagaagtgattataaaatatcaggatatagcacttggctgagaaaaccttaaactcatattatttttatgaaccatatgcataacaaaactgcccaattcctccactttatcagagactgcctgcaggatgaatttcaatgccacctaatttagagtaggagcaaaacttaaaatcctctgtaggtctgagtgccactaataacaacaacaacaaaaaatttcaaccattatgaagttttaagagatgccacaatgacagcctgggttgataggtgatggcattttccctgggcatattctgtgaagagtgattacggtagctttttcttctaatgaggagaaagcaacagagaaagtaaaaaataataataataacaataatcacaaaacagaaaaaagtggtccaaattatttaacaaaaaaagcactagaaactgacacaaattaaaaggagatacattgattacctagcagaaaattcaaagtaaaccttataaatatgttcactgagctaggagaagaatgcacgcacaacatgaaaatattaacagggacaaaaaagggagagaaatgagatacgatgatttgtggcttaacagtagggatacattggccaggcgcagtggctcacgcttgtaatcccagcactttgggagggcaaagtgggtggatcatgtaggtcacgagctcaagaccagccagggcaacatggtgaaatcccatctctactaaaaaatagaaaaaaagaattagctgggcgtggtggttcatgcctgtaatcccagctactcggaaggctgaggcaggagaatcgcttgagcctgggaggcggaggttgcagtgagccaagattgtgccactgcactccagcctgggtgacagagtgagactccatctaaaaaaaaatgaaaaacagtaggaatacatctgaacaatgtgtccttaggcaatttgtcattgtgcaaggatcatagagtgtgtttacacaaacctacatgaaataccttgctacacccaggctgcgtgggatagcatagtgctcctaggtaacaaatctgtatgtcatgtaagtgtagtgaatactgtgggcagctgaatcaccatggtagatgtttatacagatgaacatatctaagcatggaaaaatgcggtgaaaatacagtattataatctaatgagacctttgtcctgtaggtggcctgttgttcaccgaaatatcatgatgtgcatgattctgttcaagttgctgaaaataaaaacaaagccaagaaacttccaaataaatacgttacatggattaaagcttttcttcaataatgcaggaggtttgagaagttccccaaaaaagtaaaaagtggacaagttcatcaccactagactggccttacaggaatgctaagtgtctctggcaggtttccagaacaaggaagtagctgcatcagctccactctgttatctgccaattgatagatttgcatagttttaaattttaatttatcttctttttttttccctccataaactccttctcccttcctttcataattctgtctattaatgcaactcttatttagctgaaaatgctggggtcattggaataaatttctatttttcctccaccaaatctaataagctgtctccaggggtgtccatctccattttcttttctgccattcccatgggataatttccttgttcctatgtgagtccagccctcaacaccatgggccatccaaccatcatgcacccaggaacagcttcaggaaatgtaccctgccagctgcctatcatcctccacctgcacagtgatcattccttcagctttcactcatgctggagggctttccacacaaaagggcgtttcacacccactcccagcacagttctgggaccctgtatacctcccagagacaggtacatatccttcccctttgttgttaattttgtttaatttatttaaaattcactgggaaatcactgatgatgggagtgaccagcctgtccattccatctgacggccccacctgtaaggttggccaccctagtgtgctgtgctcatggggccatctggacacacacaaacaccaggtgtgtgagttattagaggagacccggggtcagcagctgtctgtgccccacaggacacaggtctgtcctgcagtagagcctgcatgacctggaatcatacatgtgcatgacccggaatcatacatgtgcatgacccgtggtctcagcacatcagttgaggccagcttcaggcaattcctgtgtaacctgccctgagtgcccacagaggacagatgcatgacaaggatgtaagggaatgatgtgggttaggggaactgaagctcaatctttactgaggctttactcagcacctggaccttatggaagactaagaagaagagaacaagagcccggccccaaatatctcctggtttaaggtcagctttagtgggattttagagagtagaagacacaggggtgacgctggagtggttttctttgggatacttggggagcagcagaaggtgggccgggatcaggactccatctggctggttctcatgatctacatggattctcatagtggaaagtgagagacatgacctagaacacagccccccagggctgatctcagagaagcctgctaagtgaatgactcagcagaaatgtggtggggttttcatcttggatctatttttctttataaaaataatctgagagatgtgtcagcctcggtgggctgcttctccctccaggagacggagctaacacaattgtatctgtgaatctgcttggctttccatcagaagataccacagactaggttgtttcaaataacaaatattaattttcttattgttctggagccttgacgtccaagatctgggtgaagaaagggttagttttttgagaggccacttccaggcttgcaaagggccaccttctcatgcagcgcgtccccacatggcctctcctctgtgtgcatgtggagagagaggcctctgatgtcttccacttcccataaggacaagagtcctagtggattagggtcccacatttatggccacagttaacttatttgccttcttaaaatccctctctccaaatacagagccactgggattggggtttcatcacatgaatttaagagcaggacacgatgcagccgatgacgccaatcaagagatggtgagaagccttgaaatactttgtcaagaaggtaaaatgggccttgtgggaatttgttgaaaaaaaggtgccagtgactgttaaaaccttaatggtaaacagagaaatttctcccttctttcttgcctgcagcgaggatgtgaggaagcagaaccacagataataaagaaagaggaggcctggggacagctgaggtcctggcgaggagggagagcactgagctgatgaggaagccccgccctccctgcacctgctcctgacccggcctcttgctctgtgggccccgcgcgccccctgctggtcttgagcagcacctgcgccggtcccctccgcctccctgcagggaggtttgtgtctgggctcacactcacctcccctcactgtgtctctcgcacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtgaacagagagacccacagtgagccctgggatcagaggcacctcccatatccccatgtctgcagccttgagacactcacatctgggagctgccaccagcaggaggaagaaccacaggtgtttcatgttcttgtgcaggaggtccatgagtctcagaaagtatttcccatgtgagctggaccctgaatttaaggaaatgtgtggtggtttcctgtgggtgcctgagtgaggatttgcatgtaggtggtgcctttgtataaagaggtgaaaagggatgagggaggccccagtcttttaggctcaccctgggatgaggatgcttgctttgccctttgagaactcagttctcttcctggggcctcaactagccatgccctggctcctcttttcccaggtgaggaagtagattggaacagcagcttaacgtaataatcatgtgagttcagacacaccaggattcacttaatgtatagttcgggacctccatcatgtttagagggaatctctctgttctagggagtgggccattttttaaaaatttttaaattaaaataaattttttagatgaacttttgctcctttgcccaggctagagtgcagtgtcctgatctcggctcaccgcaacctccgcctcctgggttcaagtgattctcctgcctcagcctcccgagtagctgggagtacaggcatgcacaaccccccccgtctaatttttatatttttagtagagataaggtttcaccatgttggccaagctagtctcaatgtcccgacctcaggtgatccacctgccttggcctcccaaaatgctgggattacaggcctgagccaccattttaactaaggcactgggagctgccctctgagaccttttgagtcctggaattctttctgagaccttaggaaaaactcgtgggacatatcttcatcattctcaatgtgtgaccctgaggatgtgtcctgacctctgtacacttctgtgtgaaagagtagattgtgaattgcagtgaaaatttcatatgtaaactctataataggtcagcactggaggatattctcattaccaagattactgcagttacctttcctggaaaccagagaggaattctgtgagccctcacctctgagtgcacaaggaaccctggtcctgtctgacaggtctcacatgtgacatgggggaaaacagatacattcaagtccagtgttttcacccatatattgaccaatctagcctgatctatctgtctctgaaaagccttttccttcactgaatgcatgaacatacccttgggtatggggtattgcaatgtgggtatttggtatttgtttagtgaattatgtaattaataggctacctccatgaatgtgtgtaacagtagagttatcagaagttggatgagtcatattatcaggacaaacctggactctcttcttgggacctggacaagtggccaatcttctgtggtaaagcaaaggggaagagacagatccaacatccagaagcagggtagctcctcacttactagctggtgtctgagcatttgttagaacagatgaaaaacgacctaccttcaccttcagggaaatgatgaacttcgtatgaaattgaggttaattttcacttacagagaagaaaatgtcataggcatgtatatatctatgtgggtgtgtacgtgtttccaggatgtgttcatacacagaaaagaagcagctatatttgctgggaagacaaccgaagagcttctgaatttgtaggtgttgttaaccacaaatgtgtcatgttactacatcgtgtcatagtgctggcggtaaaacctcccaaaattgtcatggagacaaatgcaaagaaataaagattcaaatcagatgcctttgatctgtaatgaacagaccaagaaatcaaccattatggaaagagtgatagttaaatgtagcagtaaattccacgctgaggtgagagggaagttccatctgacagctcactttcacctctgggaagacttcagagcacagactaagagcagagagtcaacttagggcaagtgggggccagatgtttgaggaggatggagagtgagctggagtccttgtgagccattcagagaagcagcagtgtgcaagggtgtattgagtcctcctgagttaacaggtgctgagcagataccagtttcactgccctcattttgatttatcctcaagagtctattggatttctagatttgaacactggaaaagttgatgaaactcaacatgactaggaatatttctgggaagatttatgtaatgatgtgagtgtatttaaaattacattatgaaaatttcattatctaaaatgttggtatcagtatctattgatttgttctttttttcttagagacagggtcttgctctgtccctcaggctggaatgcagtgtcatctatgaattttatagtattaaaaatgatcaccctgattaatgttaccgtattatccccttgagggattttgctccatgtgtgcctgtgacatagttctagtcacagatgcaggagaagtggtctgttgaggcaattcttcctcctcagaggagaatataaactatcatctcctctccttgcttattccattttcagaattgcacacgacctttgggaatggtgtcgccatgtcttacacggtgggagtcaactgtggcatgaagctggaatggagatgtgtaattttgggaaaatacagaacctgggcacataaagttttgaattaattgggcctggagccactcacatcctggcatcttgttgaattgtttgtcattttaaattctggttatttagttcaagtttccttgattctctttctgctaaaatagtcattcataatcatctaaataaattaaattggaaaaaaattactaatttgaaaattaatcccgtttctgctgaggtcaaaattagtttgcggtgcacagagtgatgggcatggacatagaagattaccaagattgcactcacagcctaggtaatcactacattttatttaaattaggaaacacttctgtacattccttatatttattaaactcctgttgagaaacttcaactgttatatgttgatggatcctgcccaataataaaactaaatgtttttaaacacgaattcctattacaatgttagctttactttaggacacatttcttcacctcatttcaaattggcccagatgcactgattagagcgtgtcagttaagaaacgaccaggaaatgagatcacgtttctggagcaggacatggctttgggatgctttgcaaacaaagtggtttctcatgtcttcttgaaaatccattgaaatgggcaagttaaggacctcttagaagcactcttccatcccatatacttgactaataaaaaggtggaagtcagtgcggaaaaatagataacatgaaagctaaagtaagatttgtaccagttcattgcgccaaacatgtaatcttaacctagagtaggatcttatctgaaccctcaggaggtaaatttcctgagagattcaaagatgtctttataaaataacaacacttagcccccgattttatgttaaaataatggaaaactcctggtaatctacttcactcagtgtaaatcagttaaaaacaaaattctggaaaacctgagaaggtgggacttgccgaggaactgagccttgggggcctttggacacttctagttggattttcttcagctttgactctccatggaatttgaacaagtttcgtttactgtctgctgtttttctgaatgacttgaagtaattccttgacaaaagcctacaaccttctcagttgatagacatattttatgttttcaacctgtgacatgcagatgttttcatcaggtaactgaagcaacccactacaggaagcaactgttataaagtgattctgtaaggtgtttccattactcaaatgctaaactgctattaccagcaacaatattctgtaaatgttgaaaaaaatggcattgctacgtagaattaatcacaaattttaaaactttttcatatatttattgtttaaattcataagcatggaatgtttatttttccatttatttgttttatctctgatttttttcacatgtgttttgctgtttttctggtagagatatttcatctcattggcttaactctattcctaggtattccactgtcttggtggctattgggagagcatgttcttgattccactctcagccagaacgttgttggtgactagaaatgttactgtgattttcgtacattgattttatatcctgaaacattcctaaacgaatgtatcaatactaggagacttttggcagagccttcaatattttctacatatagaatcatattatcagtgaaaacagagggtttgcattcttctttttcttttatttggatgccttttatttctttctcttgcctgatctggtgaatacttccagtactaggctgaatagaagtggtgagagcgggcatccttttcttgtttctgttcttaaggaaaatgcttccagtgtttgcccattcagtatgatgttggccatgggtttgtcatagacggctcatcagattgaggtgtgctccttcaatgtctataattttgagggtttttatcatgaagcgttgttagattctattgaaagcttttttcctgcatctgctggaatactcacatggtttttgcttttgattctgtttagtagagcatcacatttattgctttgcataggttaaagcacttgtacagtgctggatggaatgtgaattagtccaagcactgtggaaagcagttaaagcagccttgcttttgcagaatgtagcctacttgattgcagtgtgttaactttttgataaactactggatttgatttcctacgttgagaatttttaagcctatgatcatgagaagtatttgtcttgagttttcatctcttctcaggagcagacacaggcactgatcaggaactggggacctgtgaaggtgagtagccggtcagggtttctgaggatgagtgtctgtgatgggacccgcctgtcccttctcttatgggatgtctctcctggggatcctgtactgtcttatttgtgcaggtccactctgtgggacttgtctttataaatctcaaatctcaggaacaggagagctgtgcttcaaaagcccccatagagaagacacattcccatcctgctgtgattgaaacagctccatcctgggcatggggagggctcatgtgtcccccgcactgggatgaacagcagcagctgcacgtgagctgaggaggactcaagg

SEQ ID NO: 1309 - DNA, 35830 bp, Homo sapiens
gatgtggagtggccctctttgtcacatcctacactcgtaaggcatgacatgtagtgcagttgctactcctaaacagtatatctcacttcagcttccttctgtctttgagaccagggtcttagggacacacacttatgtccttgcctttaacacagtccccacctaaacccctcagggtaactgactacatccaattcacagggctgtccctgcactagaactcccaaggtttgtattcatttcactgtgacttcagcttcttcagagccctcatcctcccttttggaacagtcgcagtggggcaccttcttgtctaagtgccatgggggcccaaggggtttgccgaaatggggaataaaggatcgccaatgtcccaggaggccttgggaggtttccaactgctttggtgtggtgggacatgagtagacctgcatcttatcttatctatgatgaaatatggaataactatagtcttatgtaaccagatgacaccaagtatttgactgataagcctggaccctggactttgtccgcattgacctcccattctctgttcaccaagtgagacagcaaagcaggggctgcagagcaagaacctttatggactcatcctaaccttcatctccttcccactggagctctacatcggacgccaggacttaggctcccaggatgacgtagtcatagtagtcctaatgcattggtgtggcagtcagcaacactttaaatggcctaccaaataaacaatggtctccaatttgctatcctatccctacaggcggcatctcattatagttacaactgttctcgtggctgacacaccctagcctgtgcaatgagctctgcctcagtggttgctcagagtgcagtcaggagtggccaacagctgccacagctcaggaatctgactgtcactttgtcacattgtcacatccacctcaggcaacaggtcctccagaacttttggcattttggaggcatccccgtacacatgcagcgggccccatccatcaaggattgcagctgttgggcccacagagatgtgcatggcctgcctgggatttccccacaggtctccccttccttgacactgttgtctaagagcttgcaggattttctttgaccttgttctgggcctaccagttgtcatgctagacccctattgactgtaataggcatggcaccatgtccaaaaggctgaagaggagacctggagcccatgaacaagacctagggtgtattgaggacttgcatacaatgtggcccaggaaaagtgtgttggacaggaaaaccactaccatttgtaaaacacgtgtagtttatattatgattttcacttagcaccctctacctagcaacctccagatttaacaaagagcatcaatcacctggacatcctgtgttccaagggataggccagggattcagatgtccttcacagacaaggaataaacttctgggttgacagctcctggatttcttagctcagagctctgaacatacattcttcataaactatagggtcattctcacagtgtgcttaaattaacgctgccaggcatttctggcatacatagatctgaacacacacctcataaaacaatgtataaaaaagtgttcatcaagactttgtattaagaatatgtatatttaaaacaaccattaaatactgctactcatttactataatattacaacggctgcacagcaaagcattagtgaatactgacaaggctccagaaaagaaaatcttattcactgttggtaggaacgtaaaatggcacttcctttttggaaaatattttcagtatttctttggagttaaacatgttaattgaacagatgactctaaggtactttattcaactgtttttttgttttgttttgttttgttttgttttgagatggagtttcactctgtcgcccaggctggagtgcagtggcgtgatctcggctcactgcaaccttcacctcccaggttcaagcaattctctgcctcagcctcccgaatagctgcgattacaggcacccaccaccacgcccagctaattctttgtatttttagtagagaaggggtttcaccatcttgggcaggctgatcttgaactccttaccttgtgatccacctgcctcggtctcccaaagtgctgggattataggcgtgagccaccatgccttgcctattcaactgattttaatacttacttctacacagatactttcatgggaatgccggtatcagctttcttcagtagagcttttcctcctccatgaattttgcttatagggtgataattatataaacaattcccatataattgggccaggcgcagtggctcacgcctgtaatcccaggactttgggaggctgaggagggtagatcacctgagatcagcagtttgagaccagcctagctaacatggtgaaaccccgtctctactaaaaatacaaaaattcaccgggcatggtggcgggtgcctgtaatcccaactactctggaggccgaggcaggagaattgcttgaacctgggaggtggaggttgtagtgagctgagattgtgccgttacactccagcctgggtggcagagtgagactctgtcacaaacaaaccaaaaaaaaaaaaaaaaatgaaaaaactgaaaaaacaaagttcccatataattagagtatatacttctattgttactttttttcaatttattaatgacatactgtaaacaacattaaaaataataatccctttcatttctcagccccagcacagctgcctcctcccttgggtttctgacaccctcaggatgtgggttttcacactgtgtctctcgcacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctcctgtggagagaacacagaagtggatgagatctccctggactggactcaatctctttctcatcactgggactagggagcctcttacctgtggctgctgccaccaagaagaggatcctccaggtccagtccatggtgaggaacggagctctcaggggattctctagaggacagatgtggttgctgggtgatgctctcagggcacaggacagatctgtatttacttcagtaaatctcaggttatttgcatattcatgagggatactatttcatagctctagacttgatccaagatgagaaagagaacacacataatttatgggccatgcaacagtgggacgctgaagtccctgtcccaatccttgtttaatgatgtgtgtccccttgtatgcccagaactctgctaaaatagattgtctgctgaaaacaagttcccgcagaacatggtcctccaagtgaacccatacttaaatggcactttgacaccttcatacttttctgggctttgctttctgcatgtcttactactgtctctgttaagattggcaagcactgaattaataaaaccatcccttttctccatctcctacctattaagatatctgaaaatcctagaaatttctccttttacatgtgattctcattgacttgttaggttagataaatcctacaaatagaactgtatactgaaagacacaaagacacatcaatagtctttactaaagtcttgtttaacttattaaagcatgtttgtccgagaaaaggaagacatcagaccctgggaggaacccctccccagcctcccttgcacctgctccagggctgcagcctgtgctgggcgaggccctagcgctccctgccacccagaccttgcactgcagggagcttcccattgggtctcacagagcatttttctctcagcctctgtagctcactaggaagtgactgtgccctggctcagaatgctccttcagtgacaacatgagctgatggcaccacttcttgaaatagtgaatgggcctttggaaacccaatgtcctcttcagggtggctccaagagaagaatcgctaaaatcaccagggagtccacttcctggaggtctagatgcactggatcactggaaacaaagggaggctaaaactctgggggggttggaggtggctcttttctcatttcggctcttgcagatgaatactgcatctgagaatacctgaagctgcagatggatgtggattaaagctcactccacgtccgctgttccaataactcctactcaaacacacagaaacacaaacacaaacattctcacacacactgtggctgattttcacagttatggacccctaatttttccttcttcgtagtatcttactcacgggaagtgccgccgaccctgaccctaggcctcagtatgtgactttctttctcaaacagatctaaagcaatcacactgccctctttaatccatattaatgatgctgttgaggaggtaatgtgtggggcaggggagcatggtatgttcttacagttgactctccctggtttggttgccctcttctcctgagcagtgaccttcacaaggaatctccagtgatacagctgattttctctctttcctcccttctgcagatgctgcacccagggctaccgccttgaatctgactcctcttggctaattttatcatttgcgtgatagaggaaggctgaggaggaggggtctgtaatttggaagtatttccttcccccacataaactaagattttggagaataccttcccttggatgagctttctagaaaagtctttttgtgcatcttttctccgtgattactcctccccagttcatggctatagggaatctattttaattgcttccacgagaacctgaaggccctggagggcaagtccacacaagtgtggggtgtacagcctctaggagtgctcaccctccccctagtccacatttgtcctccagacattcagcataatcaccaggtaaatgttctcaccaatgtgtctccaggagcttctcttccaagtcagcaagtctctgctgtgactgtggatgtgcctgtctctacagcttttggagggagtagttttttcagcaatttcagctcttagatggattaaaaaatacttgatatttagatggtttggagatatatatatatcaaaatatatatgtgtaatatatatcaatatacatattatataatatatgaatatacatattatatattatatatacatattatatatcatatattgatatgtatgtataatatataaaaatatacatatatattatataaaatatatatatgatatataatatatatttattatatatatatatatatatatatatatataaattttttttttttttagatggaggctcactctgtcgcccaggctggagtgaagtggtgcgatctcagctcacttcaatctccacctcctgggttcaagcaattctcctgcctcagcctttcaagtagctgggattacaggctagtgccaccacgcctggctaatttttgtatatattttttagtagagacggggtttcaccatgttcaccaggctggtctcaaattcctgacctcaagtgattcctctgccttggcttcccaaagtgctgggattacaggcctgagcctatgtgctcctttggttcagatgttttttgatgtagaaatggagctaatgacttttaagatcatcacatatgtcagcaaaaccctgaagtcccctaagaggtcatgtgtgttctggtactggaagcagaaccctaatctccctacacaaaagtgacatctggacagacacaactgaacatgtggggacaaagggaatggcacagcaggacacttatgaggaagtttcaacagtttcctttttattcagaggaagctgcagcaggtgagagctggttatacctcaggcgatgtcattttctggaaggctgttcttgctcttgtgctggatcaagtggatgcacctgggccctcacacctggaacaggaactctcattccttaacacaaggtgctcggtgagacagttgcttccagctgaagtgcagagaaaggggagagaaggagttgtctctggtgtcccaggatgtgtgtcaactctaggataaggtcaccttggaggggcagtggtctaccttaggggattacatcagttctgccttcaataacctgtggctgtggtcaggagtgtgactcatccccttctgctcctcctacctgcctttcattaaatgtgcaatgaatgagtgatccctcaccagagagtgtcatggtctaaacatcatgatctcacacaataacatccccacacccaatctcaaatacattatagaccccactcaatcagcaattggcaaataatttgctcttgtagatttggtgaatacatttgctcagcgttcatttcaacagcctctcagccacatttagcaaagtgattgacaaaaatgaacatgtctctatcagcaaatagaaaatataaaatcaccgagttggttgaaacgtacactattaactctgaacaaatataataagaaattaggcatatcacaatggcacacagtttgttttaccctaaaaatatcccctgagctttgccaagtcagtctcttgtctttccccaaaagccctgcctatcacaaacctgtttttaaaatccttttaattttactgtatttagcaggtctcatgaatggaattgtacaatacttagtctcttttgtccatcttccttcacttagaaaaaatgttaaaatgttgtcttctgaattaataacccatagtttttatgactgatagtattccactgtatgagtatacaaatatttgagaatcaattctgttgaaatacatcatgtttacttttgtatttggtaaatatgagtatcagtttatgacaattgatactgaacaattttatatattcttattttcagataacattttttcttggtgaggtgtttgttcagattttcactcattttagaattctgtttatattatgctttctgttgagttttacaaattctttttatagcctagagacaagaccttacaaacagtaaaaagaaatagtttctgattttgaatagattcaatatacatacataatttttaattgttataagcacataatagtatatatatttctatttgttgggtatatgtgatgttttggtacaggcatacaatgtgtaatgaacaaagtaaaaaaaaactacaataaatctataaaacattgaggaaataaagaggacacaagatggaacaatattccatgtttatgaattcaaagattcaatattgttaaaatgtccataatacttaaagcaatctacagactcagtacaatccctatgaaaacaacaatgatattcttcacagaaatttttaaaaaatcctaaaatatatgtggaaaaacaaaagatgcagaacagcccaagccattctgagcaaagagaacacaactagagaaatcacattacctgacttcaaaatttatatttttattattgttaattatttgatctaaaagttatgtttcaaacaatgagaataacaatacgttaaatgagtctgatgtatgtatacttgaaattaatggcatcaattttatgaatgatggaggtaattgagaatgttctgtgtgaggcacctgcactagatttgatgtggaataatgtcattttgaagatggagacagattagttacacacgcatattgtaggccatggtgcaaagcaggctcaccatgcaaaagtgaccaaaacgaggccacgtgggttgtacacctcagcagctgtgttacccactgggacaaagctctgaaggacatcctgcctccaggggagagaagaacaaagcccagggtgtccctggctgtttttccctaactcaagattttatatcctctaggagaaacaggaacaaacctgagctgttccagacagacaggatgtccttggctctgtgcacgttcaggaacaagatcaactcgttctgagtctctattcagtgatttaggttcggggaaataagaatgcagatctgaaattatggagctttcagaaggttttcatgtgtctcagtgcaatttcttcatgtgttattttggcttatggtattgataggcccacaaaaactagatttaattcaataattcaagtgatagagcaaaactgaaagagctgaggggttttctagcaggatttagaaagtttaaaatacttcatcttagaaaatgtatttgctggacattgatgggactggagtagagatggatgtgggggagcccaaggattgtgctttcacacacaccacaatgacttctgctgtcccttccttccctctctccctctctctctttctttctttcttttctttccttccttcttccttcttctttctttctctttctttctttctttctttctttctttctttctttctttctttctttcttctttctttctttctttctgtttctttctttctctctttctttcttttcttcttttctttctgctgagtgagcacagaagtacacacaggtataaaactcactgaatcaccattagctgttcttccttttgcctcccacccaggtcaggaggaattacaagtcctacggaattctagttctaagagagtgagaatctttatatggctgattattccagaattttctataatgatgcagctgttgtttcttttagccagtttttattgaattctgttcttttccattgagtcgtaaaacttatttctatattctgttgcaagtttgttttaagatatatatatatatatataaaatattcttgaaatctgaaagtttctgttcattttcttaatgtaattatttaaatatgaaacttattttattataaattacaaataatttttgcatatatttatgacatatgttgtttagttatgatacatgtatacattatgaactgggtaactcaagccgcttatattcatcacctcacaaatttatcatttcttagtggggaaattctaatgtttatttttttagtaattttgaaatatatactaccttatcagctatagttgacatgctgtgcattagaaaggcataacttatacctccggtctaactggaacgttgtgcactttaacccacatctccctttcccagtccacccctctaggccctggtaaccaacattctactctacctctgcaagtctactgctttaatatatacagtgaaatcatgaatgactcttcctctgttcctggcttgtttcacttggcataaggtcctctagattcatgcatgctgtcacagaggcagggtttccttcttatttaaggatgaacattactctgttgtgtctgtatgcattttctttattcattcatccattcatgggaatttaggatgtttccatatctttactattttaaataatgctgcaatgaacgtgaacatggagtgcagatatctctttgacatgttgatttcatttcctttggatacatagccagcagtgagactgctggattctacagtagattttgtttctttattttttgaggaacatttatagtattctccataaatagctgtattcatctacattttcactctccatattctgagttctgtttctgtcatttcagccatctcagccccattcagaactgctgttgaagaggtgctgtggttgtttggaggaaagagggcgccctttttgttttcaggacttttgcactggttctttctcatctttgtgggcttatccaccttcaatctttgaagttgctgacctttggatacatttttattttcttttaccctattggatgaccttgagggtttgattgtggtataaggtggattcagccaactggcttcatttctggaaaaatttaggtggccagtgctcagctcccaacacctagactgtgtgctctgactctgggggaagttatactagtccctgacttggttctccggctccttaaggttaggaatccactgtcctgggctgttggaggtgtggcagctgtggcagagtgctagtgggtgtctgggtgcctgcctccctgcaggtgttcgccacagtggcagaggcattgcgtctgtggggccctgttggtgactgtgttcaaggtcacactggaggaggtgttggctcagggatgggacacttgtgggcacaggcccgggtgccgtattcatgccccacaagcaggagtgatttctgaatgtgtgagatgatctgctattctctgtgcagaattagcgcaagtgcgggacgctgacaggagcggccctggctttttccccaccaaagcttcctctgccatggtggttggggtggggggaggggactgcactccacgcaatggtgggacaagaaaagcaaaacccacctatacagacatgtgactgcaaagtgatgtgggaagttacgtgggcctgggtgaacctacagtattcggaggaagtgtgtaagctggtgtgtgcacatgagggctgcccgattggagctctccaccagtcaggcatgttctgccagggcagaaattttggtgcgggatcccagggcgtccaagactgccctgcaagaaggtgtggccaggctagggccccaggagaggccagtagatggaggggcactcaggtccctacattatttgagaatgtggccatgttttatgtgaatgagtgatgacttgattgtaatgcagcattttattccagtacacaaacatatctcaaattgtttaacattcacctgtaatggatattcaatgtgttctctcagtttctggcttttatacggaaagcagctattcagtgtgggaatgtgaaaaaaatgagaaaactgtgattttattctgacctcattaacaacgaagctgaacagctacaaataaaagagagaaaaaacattcaacatatctgagttgatttcaccaagcaaacaagaaaactgaaatctgagaagataggagcctgcagagagaaccaggacctacctgctagtgtacgtagggcaggtgccactggatggcatttgagatagaaacagactaacctagaaatacttaatgacttttttttttttagtatgcatgtactaatggtgttagattggcctagtgcttgcaagcttttcctagagaacttgaaaaatccacggacaacttcctcatctggtgtcttgtggtgttgactggggaaaagaacagcagctcctgtggaatgcctgaatgcacctccactacctccaggggaaatccaccaaagcatgtgtcatatgagctgtggtgaagtcaacagaaacaaaaggaaacagacgacaccaaggaaacttgatccagaaacacctcccatctccttcctcaggaaagaaatccttactctttagggtaaggatagtgggtaaaaagctggggacactggtgaaaaacagttgtgtctgggaaaagacgttccagccctggggaaagagttaaggacaggacaatgtggaaggccactccccagaactatgcttactactcctgcataagaaggagactcagtcagaaggttggaggaagtcccgctttgtccaacctccttcaccacacagtcatcaatttaaactgtcagtagggtgcactttccacagctgaaacagacagcctccctggggaaaactaaatataaagacccaggatcaaacagggacacaaaagcaagtatcatgggaggaacttgaaatctctgtggacagcagaagctgacttcaactctgataattgtggcatccataaattgcaaatatagccctgaatagatacacacaaatatctataatgaaggcccagcagaatggaatgtgtgaccatcttcaggaagaaaataatgaatacatgagtacaagaaaataaattacaaattaaagtcaaactggaattctatatatattaaaaatttcatttaaagcgaaagtcaaatgaataccctgtaagacaaatcgattctgagaaaatttattgctagtgcattcatccttcagtaggtgctttggcaaattttctgccagggtgagtagccatatgatatacatccgaaacatgaatctatccaaataaaacatgtggtcaagaatgaaaaaatgaagttgaaatgtagtttttatatttttaattgttctaatatatgtctatgtaatgataaaaatgcacatattatattttatagcacatataagtgcaaactgagaataaactaagacaacggatgagaaagagtgtttagaagaataagttataatagctctacaacctatgaagaggttttacgttatttgaattagaatctgattatacacaattcttattgtatatcttagggccaatacaatattcataaaagatgaactaaacaataagttaatagagaaataaacatgatcataaaatgccaaattaaaacagaaattaacagaaaaatagtaataccagttttaaaatagaattattatagttgatttaaaaagcaagacccaactactagctctgtacagaaatttgctctacatagaaaagttaaatacaggaaaacatggaccatgaaaatatgaacgaaaagaaagcgtgcttagctatgttaaattcagacaaggtagacataagactttcaggaatcaaggggcatattacatagggtaaagggatcagttttctaaaaggcatcaccaaagatttaaccaatggatctgggatagaaaataggctaacatctataacagatagcgaattcgacacttactgtgattgacaaaacaaacgtgataaaataggtaaatatataagtgaccagaatcaacttatttgactagtttcatttatagaatattcaatgggaagacagcaggaacccaaactgtgattaaccagaagatatgagaggaacatggtgactgaatttgatgtggttacgtgggttgaacaaagaaacaaacaaaaagcaataggaaagtgacaccttatctcaaaaagaaaagaaaaaggaaaaaaggaaactgttaaaaattggcaaaattcaaataaatcccagagctgaataaacagaaacttatcaatgtaaatatattagtcccatgtcccatgttttttttgacatattaactttagtgaaaacttggagatggatgtgaacacactgtattttccttacaattgttctgataacctataattattccaaataaaaagtgtgtaaaatataaagtaacaatcataaaaataatagttcaaagaccttataaaataggcttctgaaaataatattgttactaaaattattatggataattatttcagaggataatcctgaaatgatcatcgaagtggtggacagatgtttatttatttcagaaaaagatgtgaggcatctcatattaaacgctagtgatggaagtgtttatagagttgttttatcatctataatatgatggatgaaaagcattatcataagcatttgatggatgaaaagcattactatcataagcatttatgtagccaatatcatgaacgtattataatttcctcagttgtgcaccatttttgtgttaataccatgtgaacgttttctactgcatgtgtcatatctaaacatttgaactagtttgtttgttattaatgtgactcttgtaaatgctgtaggcattgctgatgttctctgtaatttctctactggtgtttttttcctaatattttaacatgataaatttggattaatataactacgtaatttaataatatattttaaacttcatagttgtacacacagacacacacacacacgcacacatacacaacagcccagcaatgacacatatacccgtccatgcaaaaatgaatgtatattaaacaccaaaacaacacacccatttttttctatattattttaattatttaattgaatgtaactcgtatttgcagtttcatttttgaatgaatgtaaatgccattcttgccaaatatattacttaagtgtacaatggtatttacttttttttttttttgagacagagttttggtcttgtcgcccaggctggagtgcaatggcgtgttctcggctcaccgcaacctccgcctcccaggttcaagcgattctcctgcctcagcttccccgccacgcccagctaattttgtatttttagtagagagggggtttctccatgttggtcaggctggtctcgaattcccgacctcaggtgatccacccacctcaccctcccaaagtgctgagattacaggcgtgagccactgcgcccagccagtatttactttttaaatatcagtcagttattaataaattgaataactaataagacaaacatcacttaaatttttattaaatcattgattaaagtaacattgtatttttttaaactaggcaggatagaacttttctatttgaaaaactttttaaaaaactttttggcgttaattttcaatacaaactctagtcgttatttgccaatatgcctttataataaagaacatccagcaataggaaactgaaagcagcccatgctttgcaggattcaatcacaatggcagcttgctggagggtggtctgagagtgggcaaacacattagggatttggacttcatgaaagcactactgagcccctgggctgagcacacagagggtagcataagttgcagagcctagtctgtggtacttagggaaaaagaggaatgggtgggggttatgtctgcaggaccctagaaaagtgtgatgagggcagagggtctgcaggtagagtgtattctaaggagaactgttactctcctaaacttggttggcttcagtgatcatgaaaagaagtgaactgatttaccagacatggaggacaggaagtaaaaggacttcctgtttcctgcatggagactgaggaagataaaatattttgacagaaaaagagaagatggagaaagtttgagaagcagaacaccaggggccaaagtggaggacaggagcccttaaagtggtgtttcatctgcacaaacagccgatgaaaggaaaagaaactggaccccatgcatatgctgagttgttagaaaagcatttacaatagtgtgtctgacagcacagaaaacaaaaaaattgtgcatagagccagactttggattgaatatacacaattaaaaaaaatatactgagatatatcattgctagtataactctgaaaataggcagagttaaaagttgaattgaacccctgttctaagttaatgttttataggtgaaagaaaccatgagttacaaggaagacatcgtaagagatcctggggaagacttttgcttgaccaggtcaggaatcaccaaggtggaaaaggaaacctcatcctccccaggtacctgatatggagctgcctccaaagagccccttggaggtcctgagtgctccctggtgtcctgagccattcttgctgtcctgaacacccactggtggttcctgagtgccccctggtggttctgagcaccccctggttttctgagcgacctctggtgtcctgagccccccctggtggttcctcagtgcctactagtgtcctgagcgccccctggtggttcctcagtgcctactagtgtcctgagccccccctggtggttcctcagtgcctactagtgtcctgagcgccccctggtggttcctcagtgcctactagtgtcctgagcgccccctggtggttcctgagcgccccctggtggttctgagcaccccttggtgtcctcagtgccccctggtggttcctgaacctcccctggtttcctgggcaccctctggtttcctgagcgacccctggtgtcctgggtgacccctggtggttcctgagcgccccctagtgtcctgagcatcccctggtggttctgagaccctactagtgtcctgagcgtcccctggtggttcctgagcgcccctagtgtcctgagcatcccctggtgtcctgagcgccccctggtggttctgagcatgccccggtggttctgactgccctctggtgtcgtgggcgccccctggtggttcctgagcatcccctggttttctgagtgtcctccggtggttctgagcacccgctagtttcctgagcatcccctggtggttctgagaatcctctggtgtcctgagcaccccctggcagttctgagtgccccttggtgtcttggtcacatcctgtggttctcagcacccccttgccacagtctcatgagtgccctttggtgtcctgagcgccccctggtgcttctgagcaccctctggtgttctgagcaccccctgcttcttctgagcgccccttggcggttctgagtgccccctagtgtcctgagtgccccctggcggttccgagtgccccctggtgtcctgagctatccctggtggttctgagtgctcccttgtgtcctgagcgccccctagtgattcatagcacctcctagtgttctgagcgccccctggtgtcctgagcacctcctggtggtcctgagcccctcctggtggttctgtgcaccctccctgatggttctgagtgccccctggtggttccgagtgccccctggtgtcctgagggcccccttgtggtcctgagcgccccctggtgtcctgagcccctcctggtggttctgtgcaccctccctgatggtcctgagtgccccctggtggttctgagcgccccctagtgtcctgagcgccccctggcggttccgagtgccccctggtatcctgagctatccctggtggttctgagtgctcccttgtgtcctgagcgccccctagtgattcatagcacctcctagtgttctgagcgccccctggtgtcctgagcacctcctggtggttctgtgcaccctccctgatggtcctgagtgcctcctggtggttctgagcgccccctagtgtcctgagcgccccctggcggttccgagtgccccctggtgtcctgagctatccctggtggttctgagtgctcccttgtgtcctgagcgccccctagtgattcatagcacctcctagtgttctgagcgccccctggtgtcctgagcacctcctggtggtcctgagcccctcctggtggttctgtgcaccctccctgatggttctgagtgccccctggtggttccgagtgccccctggtgtcctgagggcccccttgtggtcctgagcgccccctggtgtcctgagcccctcctggtggttctgtgcaccctccctgatggtcctgagtgccccctggtggttctgagcgccccctagtgtcctgagcgccccctggcggttccgagtgccccctggtatcctgagctatccctggtggttctgagtgctcccttgtgtcctgagcgccccctagtgattcatagcacctcctagtgttctgagcgccccctggtgtcctgagcgcctcctggtggttctgagcaccctctggtgtcctgagggccccctggtggttctgagcgccccctggtgtcctgagcccctcctggtggttctgtgcaccctccctgatggtcctgatgccccctggtggttctgagcagcatctaccacatagtcccctcctgtctccctgcggtgagctttgtgtctgggctcacacagggtttccctcactgtgtcactcacagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgaacacagcaaacagactgagaacagccccgtgaggagaagccacagctggacctgatttacgaaggacactaatattgacggggatgagaagagaatccagatcaatgcagaccccacggtgtggacactgaggaagggcacagacatggggtggctcctcgccagggcctgagggaacaggggatgagctgcctttcatgagaagtggaggggacacatttccacgtctttctttttgtggtcatgggtgcactgctcagcattgctcatccatcctctgtgtctacatttcagggaagtcaaggtcaaaggatttctgggtctggatgcacagagttaatctgcccattactattttttattctctaatgtggacactgttggggtatcttcataatagcaaacattatcaacaaatatgtccagtaagaacataaaaatacgtttccagagaaaatggacacctgtctctaattggtatatttagagctgcaaactactgttcttgacaataaggcaaagttaggttgcaatgaaaaaaatacagatctatgccttgtcagggagggggtttatgattatcattatcttgagatcattttgccacagaacaattcgacattggatatatgtacttgtgtaaggaaacagtcaatgtggacatatgtgtacttatgtgagtgaagagttcacatggagacatgtttgcttgtctgagacaagagtccacatgaggaaatgtctgttttctgaggaaagagtaaatgtaagaacatatgtggtagtctgaggaaagagtccacgtggggacatgtgtgtttgtctgagagaagaatccacgtgagtaaaggtgcgtttgtctgacagaagagtccacatgttgacaggtgtgtgtacccatctgagggtaaatgcccattcagggacagtgtatgcctgaactgagctgaagtttggggaaatatttctcaaccaaggaaagaaaataatcctgtgggttatttgcttgtcaagagaaaaaaacctgggtcacatagaaaattgatttaaaaaaaaaacaatttaaaaaattaaaggtctttagtgaatggcaacatcttatatgcaaatcaggaaaattacctcattctttgttgcatacatctcatgaaatctccaccctcacaaaataagtaatgagataattttatacaatctgcatttgatccttgggttaatgaactgctaaatttttttttaattgtatatatttaggtttatattttccatcacaaaactatgtgcttagacaaattaattgtgtcatatctgaaccattgcatatcactaaaaataattttaatcttcttaaacagtgtctttttaacttattttataccagtctctaaactcctcgaatatcctctatatgttgttgttcacttgactacagttttggcttttatagaatttcaaataaatcaaattatacagtgtcattgaaatgacctcactgaagaaagtggaaaatgaagttgctgacctaaggaactttgaaaatgaggaaactctgtaagtttaaagtgtaaagaaactgaacataagcactctattctagtagataaacatgtttcctacaagggtacagctttacatttctgatactgctatgcatgtgtcctgaaattgtgcagctaagtaataaaatggcatatggttggatggggttcctcattttgcagtgagaggttatagacagtcaaggaaggaaggctagaaagatccatgtggtagcataattgggtagagagaccagtgtgttctcatttttaatgtaatcacattacagaaggttagatacatagtttactaggccagttggttgagaggtcctgcaagtacttataccacattaacaatgcacatacccagtattacaattttttaaatactattctttaacatcagaagcaagcaatctttagaaaaatggctgattctatgtatgaaaaagataatatagaaaatgagtttagaatttattataatagcaggaaacagggaagtgttcaaaaacaaaagcatgaggtgagctgtaaggatgcaggatccaaactcaatgagctcccagcacataataaagccgtggtggtttgaaaaataaaatgaataatgtagcatggatcttcttcagagtatgaaatagacatccataaaccaatacacatattaataagtgatcaaataaagaaataataggaagaggaacacatctttttacagaagtattccaaatatgttaggttgatagtcctctaatcaagtaggtgaagcttaaacactcatgagttgattgtagcctgagattagagacgtggaaaaagtaattgctattactgtattttataatgagatttcagatataataccaaagacatgatctgtggatgaataacattttacattttttaaatctaaatttgtataaacacacacacacacacacacacacacttttctgcaatacatactgataagggagtaaaagacagccgcagacttggagaaaatacttccaagtcacatatttgttaaatgaattcttttaatttgttaaatgattttataatcaatatgcaagtaaacttacaactaatcaaaagaaaacaatgcagttaaaaatgaaccaaatatgagaagaggcatcttggcaaaaattatatgaaaattgttaaatgtgaatttttattagggaaatgtgcatttaactaaaaattagataccattactcacctattagaatggttaaaacacacaattctcataatgataaatggcaatatgaatgtggaaaaccaagaactatcatgcattgatggtgggaattcaaaatgctacatgcacaaaatgagtttttttggcatttttaaaaatagagataaaagtagagataaaatgtgatttgtgtgtgtgttccaaaatatttacaacactgattcagaaattgatgtttacacagatacctacagaggaagttctgtatcagttttattaattcaatccctgaaatttgcttgcagaataaatattgtatgaaaaatctctcaaataattaaaatttctcaaatacacgtttatattgttccttttccttaatgacttaatatcattttctgagaaagtcttcaatctaataatctttgtcatttcctccatgccagcacagctgcttcccccctggggtttctgacactctcaggatgtgggttttcacactgtgtctctcgcacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacacctgtagagaagacacaggagtggatggaagcccccttgactggcttcgatcccttcctcctcactgggatttggcagccccttacctgtggctgctgccaccaaaaagaggatcctccaggtccagtccatggtgaggagttgtgctctgggggcttctgaggagggatgtggttgttgggtgatgctctcagggcacaaagatatctatagtcatctcagttatttgcatattcatgagcgatgctatttcatacctaacacagcatgagaaagagtggagagatgacacatggattacccaacaggaggatgctaagggttcaagctataatccccttagaggccatgtgtgccctgccatatccctaaactgtatgttgacagagcttctcccactggagaacaattttccctagaacaggacttcactgggaacccacacttgaatagctcagaggtaatttaaaatatttctaggctttaatacatgaatgtgttatttgggggatgagtgtgtttctccaaaagttgcacttatttatataaaataaaagcttaattgacctccagatgcttactattaagatatgtagcagggttagaaatctccagtgtaaattgataaattcttgcagttgaataggatatttatggactcttcagcagtttttgtcaaatacttattttagatttttttagaagaatgacacagatcttaaggggactccatccgcagcctcctgtgcacctgctctggggctggagcctgtgctgggtgggccttgagcgccccctgcagcccagcccttgcactgcagagaggctcctgtctgggctcccagagcattttccccccagtatgaagtggctgtgtcctggctcagaatgctcctttagtgacacgtgacaccatgtgctgctgacgccatcgcttgcaatggtaaattggtcgtaggaaagccagtgaactctgcagaaacaccccaagcaaggattctatgaaaccaccagggagccccttctgtggagctctggaagcactggatcagtccacactcacagtgagtccaggagcttccaggggctttgggagaacacctaatctcttgtcggttcctgtggatgaacatctcatcagataatttctaaacctgcaagatcatgggtctcagaggccactgcaaaactcctaatacacacacacacacacacacacacacacacacacacacggtggttagagtccccacagtaatggacacacacacacacacacacacacacacacacacacacacacacacactgtgtctagtgtcctcacagtaatgggagggaactgtgccttactccctgtgtctcgcgcattggtcgtgcgcccacagtgcccctaggcctggggatatgcccttgtcaacagagcgacagcaaacactttactggagatggggccctgcacacactgtggcttccctgttctcccagaacctgggatcctgcagatacccctaagaagagtccaggctccccctgggagggtcagccacagcccagccccaccgagtcggtgcagcctgcactgagccgctgacctgtggagagggtcacgccagacccacagcccagccagccccactcccagaggcacatcaaggaagggggcagaaccctggggactcttgatgggcatcttttcaggagcagacacacgaactgttccaggaacaggggacctgggaaggtcagtagctggtcagggtttctgaggaccagcgtcagtgatgggacctgcctgtcccttctcatatgggatgtctctcctggggatcctgcactgtcttatttgtgcaggttcactctgtgggacttgtctttataaatctcaaatctcaggaacaggagagctgtgcttcaaaagcccccatagagaagacacattcccatcctgctgtgactgaaacagctccatcctgggcatggggagggctcatgtgtcccacctgggatgagcagcagcagccacacgtgagctgaggaggactcaaggctgcttcccagcacttccccacagagtgaaatttgtgtgtttgccccaaatccaggctggccctgtgacttgcttctttcaaacttcttggcctggaaagtgcaggcaccagctgtcactgtcaccactattgtgacagtgtacacagcaccaggacaggatcccagggatggggctgaggacagacactagctaagtggacccattgaaaacgtgcggatctgctgaggttcacactcctggaaggacagatcttggagggtttggaggaggaagcagccactgtcggtgactcaggatctgctgctctgcgggtcacctcgttggcaagtaacagtgggcaggtgagtgtggttcatcccctacagggacaccaggcttccaaatgcccctcttcaccaggaaagaaagtggctttgttcatactggttgctccagccgtctggtcatcctgtcttcctgaccttcttcccgtgtccctcagggctgtgacacatggacaaagacactttctactccaaccattgattccccaagccagctccctctagaaaagccacgatgtcttcctggttctgtgtccctggctgaaccagaatggacacacatggatataccaaagtgtcaaagtggaggagaggaatcttggcaaagatcactcaggaaagagaaaggaattcatttctgtgcaatgagagggtgtggggcatgtctggaggctgcaggagccagaagcttcatatttttttagtgacctcggttttgtctcccctgttgttgtgaggcttccctgagttctcctcctcagatagactctgtgccttttcacgcaatgacctataggagatgtttacaccaaacaaaaagcctcaaacctggtttatattctgatctaaattttcaaaagataaacccaagagagattcaaagaagtgattataaaatatcaggatatagcacttggctgagaaaaccttaaactcatattatttttatgaaccatatgcataacaaaactgcccaattcctccactttatcagagactgcctgcaggatgaatttcaatgccacctaatttagagtaggagcaaaacttaaaatcctctgtaggtctgagtgccactaataacaacaacaacaaaaaatttcaaccattatgaagttttaagagatgccacaatgacagcctgggttgataggtgatggcattttccctgggcatattctgtgaagagtgattacggtagctttttcttctaatgaggagaaagcaacagagaaagtaaaaaataataataataacaataatcacaaaacagaaaaaagtggtccaaattatttaacaaaaaaagcactagaaactgacacaaattaaaaggagatacattgattacctagcagaaaattcaaagtaaaccttataaatatgttcactgagctaggagaagaatgcacgcacaacatgaaaatattaacagggacaaaaaagggagagaaatgagatacgatgatttgtggcttaacagtagggatacattggccaggcgcagtggctcacgcttgtaatcccagcactttgggagggcaaagtgggtggatcatgtaggtcacgagctcaagaccagccagggcaacatggtgaaatcccatctctactaaaaaatagaaaaaaagaattagctgggcgtggtggttcatgcctgtaatcccagctactcggaaggctgaggcaggagaatcgcttgagcctgggaggcggaggttgcagtgagccaagattgtgccactgcactccagcctgggtgacagagtgagactccatctaaaaaaaaatgaaaaacagtaggaatacatctgaacaatgtgtccttaggcaatttgtcattgtgcaaggatcatagagtgtgtttacacaaacctacatgaaataccttgctacacccaggctgcgtgggatagcatagtgctcctaggtaacaaatctgtatgtcatgtaagtgtagtgaatactgtgggcagctgaatcaccatggtagatgtttatacagatgaacatatctaagcatggaaaaatgcggtgaaaatacagtattataatctaatgagacctttgtcctgtaggtggcctgttgttcaccgaaatatcatgatgtgcatgattctgttcaagttgctgaaaataaaaacaaagccaagaaacttccaaataaatacgttacatggattaaagcttttcttcaataatgcaggaggtttgagaagttccccaaaaaagtaaaaagtggacaagttcatcaccactagactggccttacaggaatgctaagtgtctctggcaggtttccagaacaaggaagtagctgcatcagctccactctgttatctgccaattgatagatttgcatagttttaaattttaatttatcttctttttttttccctccataaactccttctcccttcctttcataattctgtctattaatgcaactcttatttagctgaaaatgctggggtcattggaataaatttctatttttcctccaccaaatctaataagctgtctccaggggtgtccatctccattttcttttctgccattcccatgggataatttccttgttcctatgtgagtccagccctcaacaccatgggccatccaaccatcatgcacccaggaacagcttcaggaaatgtaccctgccagctgcctatcatcctccacctgcacagtgatcattccttcagctttcactcatgctggagggctttccacacaaaagggcgtttcacacccactcccagcacagttctgggaccctgtatacctcccagagacaggtacatatccttcccctttgttgttaattttgtttaatttatttaaaattcactgggaaatcactgatgatgggagtgaccagcctgtccattccatctgacggccccacctgtaaggttggccaccctagtgtgctgtgctcatggggccatctggacacacacaaacaccaggtgtgtgagttattagaggagacccggggtcagcagctgtctgtgccccacaggacacaggtctgtcctgcagtagagcctgcatgacctggaatcatacatgtgcatgacccggaatcatacatgtgcatgacccgtggtctcagcacatcagttgaggccagcttcaggcaattcctgtgtaacctgccctgagtgcccacagaggacagatgcatgacaaggatgtaagggaatgatgtgggttaggggaactgaagctcaatctttactgaggctttactcagcacctggaccttatggaagactaagaagaagagaacaagagcccggccccaaatatctcctggtttaaggtcagctttagtgggattttagagagtagaagacacaggggtgacgctggagtggttttctttgggatacttggggagcagcagaaggtgggccgggatcaggactccatctggctggttctcatgatctacatggattctcatagtggaaagtgagagacatgacctagaacacagccccccagggctgatctcagagaagcctgctaagtgaatgactcagcagaaatgtggtggggttttcatcttggatctatttttctttataaaaataatctgagagatgtgtcagcctcggtgggctgcttctccctccaggagacggagctaacacaattgtatctgtgaatctgcttggctttccatcagaagataccacagactaggttgtttcaaataacaaatattaattttcttattgttctggagccttgacgtccaagatctgggtgaagaaagggttagttttttgagaggccacttccaggcttgcaaagggccaccttctcatgcagcgcgtccccacatggcctctcctctgtgtgcatgtggagagagaggcctctgatgtcttccacttcccataaggacaagagtcctagtggattagggtcccacatttatggccacagttaacttatttgccttcttaaaatccctctctccaaatacagagccactgggattggggtttcatcacatgaatttaagagcaggacacgatgcagccgatgacgccaatcaagagatggtgagaagccttgaaatactttgtcaagaaggtaaaatgggccttgtgggaatttgttgaaaaaaaggtgccagtgactgttaaaaccttaatggtaaacagagaaatttctcccttctttcttgcctgcagcgaggatgtgaggaagcagaaccacagataataaagaaagaggaggcctggggacagctgaggtcctggcgaggagggagagcactgagctgatgaggaagccccgccctccctgcacctgctcctgacccggcctcttgctctgtgggccccgcgcgccccctgctggtcttgagcagcacctgcgccggtcccctccgcctccctgcagggaggtttgtgtctgggctcacactcacctcccctcactgtgtctctcgcacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtgaacagagagacccacagtgagccctgggatcagaggcacctcccatatccccatgtctgcagccttgagacactcacatctgggagctgccaccagcaggaggaagaaccacaggtgtttcatgttcttgtgcaggaggtccatgagtctcagaaagtatttcccatgtgagctggaccctgaatttaaggaaatgtgtggtggtttcctgtgggtgcctgagtgaggatttgcatgtaggtggtgcctttgtataaagaggtgaaaagggatgagggaggccccagtcttttaggctcaccctgggatgaggatgcttgctttgccctttgagaactcagttctcttcctggggcctcaactagccatgccctggctcctcttttcccaggtgaggaagtagattggaacagcagcttaacgtaataatcatgtgagttcagacacaccaggattcacttaatgtatagttcgggacctccatcatgtttagagggaatctctctgttctagggagtgggccattttttaaaaatttttaaattaaaataaattttttagatgaacttttgctcctttgcccaggctagagtgcagtgtcctgatctcggctcaccgcaacctccgcctcctgggttcaagtgattctcctgcctcagcctcccgagtagctgggagtacaggcatgcacaaccccccccgtctaatttttatatttttagtagagataaggtttcaccatgttggccaagctagtctcaatgtcccgacctcaggtgatccacctgccttggcctcccaaaatgctgggattacaggcctgagccaccattttaactaaggcactgggagctgccctctgagaccttttgagtcctggaattctttctgagaccttaggaaaaactcgtgggacatatcttcatcattctcaatgtgtgaccctgaggatgtgtcctgacctctgtacacttctgtgtgaaagagtagattgtgaattgcagtgaaaatttcatatgtaaactctataataggtcagcactggaggatattctcattaccaagattactgcagttacctttcctggaaaccagagaggaattctgtgagccctcacctctgagtgcacaaggaaccctggtcctgtctgacaggtctcacatgtgacatgggggaaaacagatacattcaagtccagtgttttcacccatatattgaccaatctagcctgatctatctgtctctgaaaagccttttccttcactgaatgcatgaacatacccttgggtatggggtattgcaatgtgggtatttggtatttgtttagtgaattatgtaattaataggctacctccatgaatgtgtgtaacagtagagttatcagaagttggatgagtcatattatcaggacaaacctggactctcttcttgggacctggacaagtggccaatcttctgtggtaaagcaaaggggaagagacagatccaacatccagaagcagggtagctcctcacttactagctggtgtctgagcatttgttagaacagatgaaaaacgacctaccttcaccttcagggaaatgatgaacttcgtatgaaattgaggttaattttcacttacagagaagaaaatgtcataggcatgtatatatctatgtgggtgtgtacgtgtttccaggatgtgttcatacacagaaaagaagcagctatatttgctgggaagacaaccgaagagcttctgaatttgtaggtgttgttaaccacaaatgtgtcatgttactacatcgtgtcatagtgctggcggtaaaacctcccaaaattgtcatggagacaaatgcaaagaaataaagattcaaatcagatgcctttgatctgtaatgaacagaccaagaaatcaaccattatggaaagagtgatagttaaatgtagcagtaaattccacgctgaggtgagagggaagttccatctgacagctcactttcacctctgggaagacttcagagcacagactaagagcagagagtcaacttagggcaagtgggggccagatgtttgaggaggatggagagtgagctggagtccttgtgagccattcagagaagcagcagtgtgcaagggtgtattgagtcctcctgagttaacaggtgctgagcagataccagtttcactgccctcattttgatttatcctcaagagtctattggatttctagatttgaacactggaaaagttgatgaaactcaacatgactaggaatatttctgggaagatttatgtaatgatgtgagtgtatttaaaattacattatgaaaatttcattatctaaaatgttggtatcagtatctattgatttgttctttttttcttagagacagggtcttgctctgtccctcaggctggaatgcagtgtcatctatgaattttatagtattaaaaatgatcaccctgattaatgttaccgtattatccccttgagggattttgctccatgtgtgcctgtgacatagttctagtcacagatgcaggagaagtggtctgttgaggcaattcttcctcctcagaggagaatataaactatcatctcctctccttgcttattccattttcagaattgcacacgacctttgggaatggtgtcgccatgtcttacacggtgggagtcaactgtggcatgaagctggaatggagatgtgtaattttgggaaaatacagaacctgggcacataaagttttgaattaattgggcctggagccactcacatcctggcatcttgttgaattgtttgtcattttaaattctggttatttagttcaagtttccttgattctctttctgctaaaatagtcattcataatcatctaaataaattaaattggaaaaaaattactaatttgaaaattaatcccgtttctgctgaggtcaaaattagtttgcggtgcacagagtgatgggcatggacatagaagattaccaagattgcactcacagcctaggtaatcactacattttatttaaattaggaaacacttctgtacattccttatatttattaaactcctgttgagaaacttcaactgttatatgttgatggatcctgcccaataataaaactaaatgtttttaaacacgaattcctattacaatgttagctttactttaggacacatttcttcacctcatttcaaattggcccagatgcactgattagagcgtgtcagttaagaaacgaccaggaaatgagatcacgtttctggagcaggacatggctttgggatgctttgcaaacaaagtggtttctcatgtcttcttgaaaatccattgaaatgggcaagttaaggacctcttagaagcactcttccatcccatatacttgactaataaaaaggtggaagtcagtgcggaaaaatagataacatgaaagctaaagtaagatttgtaccagttcattgcgccaaacatgtaatcttaacctagagtaggatcttatctgaaccctcaggaggtaaatttcctgagagattcaaagatgtctttataaaataacaacacttagcccccgattttatgttaaaataatggaaaactcctggtaatctacttcactcagtgtaaatcagttaaaaacaaaattctggaaaacctgagaaggtgggacttgccgaggaactgagccttgggggcctttggacacttctagttggattttcttcagctttgactctccatggaatttgaacaagtttcgtttactgtctgctgtttttctgaatgacttgaagtaattccttgacaaaagcctacaaccttctcagttgatagacatattttatgttttcaacctgtgacatgcagatgttttcatcaggtaactgaagcaacccactacaggaagcaactgttataaagtgattctgtaaggtgtttccattactcaaatgctaaactgctattaccagcaacaatattctgtaaatgttgaaaaaaatggcattgctacgtagaattaatcacaaattttaaaactttttcatatatttattgtttaaattcataagcatggaatgtttatttttccatttatttgttttatctctgatttttttcacatgtgttttgctgtttttctggtagagatatttcatctcattggcttaactctattcctaggtattccactgtcttggtggctattgggagagcatgttcttgattccactctcagccagaacgttgttggtgactagaaatgttactgtgattttcgtacattgattttatatcctgaaacattcctaaacgaatgtatcaatactaggagacttttggcagagccttcaatattttctacatatagaatcatattatcagtgaaaacagagggtttgcattcttctttttcttttatttggatgccttttatttctttctcttgcctgatctggtgaatacttccagtactaggctgaatagaagtggtgagagcgggcatccttttcttgtttctgttcttaaggaaaatgcttccagtgtttgcccattcagtatgatgttggccatgggtttgtcatagacggctcatcagattgaggtgtgctccttcaatgtctataattttgagggtttttatcatgaagcgttgttagattctattgaaagcttttttcctgcatctgctggaatactcacatggtttttgcttttgattctgtttagtagagcatcacatttattgctttgcataggttaaagcacttgtacagtgctggatggaatgtgaattagtccaagcactgtggaaagcagttaaagcagccttgcttttgcagaatgtagcctacttgattgcagtgtgttaactttttgataaactactggatttgatttcctacgttgagaatttttaagcctatgatcatgagaagtatttgtcttgagttttcatctcttctcaggagcagacacaggcactgatcaggaactggggacctgtgaaggtgagtagccggtcagggtttctgaggatgagtgtctgtgatgggacccgcctgtcccttctcttatgggatgtctctcctggggatcctgtactgtcttatttgtgcaggtccactctgtgggacttgtctttataaatctcaaatctcaggaacaggagagctgtgcttcaaaagcccccatagagaagacacattcccatcctgctgtgattgaaacagctccatcctgggcatggggagggctcatgtgtcccccgcactgggatgaacagcagcagctgcacgtgagctgaggaggactcaaggatgtttcccagcacttcctccaagaaggaaatttgtgtgattaccccatatcccggctggccctgtgacttgcttctttcaaacttcttggcctggaaagtgcaggcaccagctgttactgtcacccctgttgtgacactgtacacagcaccagggcaggagcctggggatggggctgaggagagacactagctaggtgaatccattgaaaacttggggacctgctggggttcccactctgagaagcacagatcctagagggtttggaggaggaggaagtcaccatcagtgactcaggagctgctgctctgcaggtcacctgattggcaggtagcagtggcaggtgagtgtgcttcatccctacagggacacgaggcttcgacctgcccctcctcaccaggaaggaaactggctttattcatcccggtttccccagctgtctggtcatcctctcttcctgacctcctgcccagggccctcaggcctgtgatgcatggacaaaggcactttctactccggtcgttgattccccaagccagctccctctagaaaatgcatgatgtcttcctggttctctgtccctggctgaaccagagaggacacacatggatataccaaagtgtcaaagtggaggagaggaatcttggaaagcagtctggagagaggctgcggagaacaggaaacacttgtacagtgttgggtggaatgtgaattagtccaagcactgtggaaagcagtctggagatttgaaaagtatttgaagcagagctgccacttggcccggccatctcatatgtgggtatatgcacaaaagaaaataaatcagtctaccaaaaaatacacccacttacatgttcattgctatgctactcttaatacctaagacataaatccaacctatgtgtccattcatggtgaatttgatcaagaaaatatggtacatgtatacaatggaacactatgcattcacagaaaaagaataaaatcatgtcttttgtggcaacatggatgcagctggaagtcaacattctaagcaagctgatgaagaacgagatgatgagagtcaacgggagatgaagctgacgttttgggtttgcctgtgtgtaaaatggagaaaagaaatcacctgggcacatagactcttaaaatagccaagtctggagccactcatatcccagtttccatttcattaggttttaatctttgtcatttttagcgagttaaatttggttttctttactcttggctaaaataaccacacgtcctgaattagaggcattgcaatcaaaaggtcatatttgaagcttacaagtcccaagtcaggtcaaagttagtgtgggattcagtgtgatagataggagacatggctggatactaagaatgggctcagggttattttacctaagttaggaaaattttttgacatcccttctgttagatttcattggaaacctttgttctaataccatctctgatagattatacctcaataattaagctggaggttatgaattagtaatttaaattaatagtggaagcctccatctagaatatatttctctaccaagtgtaaagttagctcagacggcagaaataactgcactcagcagagcttgtcagtaaggcaaagacatacacaaacacatttattgcaagggtagtgcatgacttggaagtgatccacacacaaaggattctcgcattgtctagaacacgtcaaaatggacaagggaagggattgtaaatgcactcctaagtcctggagacctgactaacataacataggaagaaaaggcaaagaaaaaagtagcataataactaaaatacatctgtaactctatctatctatgtatttatgtttgcaactatatctctatcgaggtacgtatgtatgtatgtatgtagccatctatcatctatctatttaaagcaagcagccctaaaattgtttgtaata

SEQ ID NO: 1310 - DNA, 39632 bp, Homo sapiens
gatgtggagtggccctctttgtcacatcctacactcgtaaggcatgacatgtagtgcagttgctactcctaaacagtatatctcacttcagcttccttctgtctttgagaccagggtcttagggacacacacttatgtccttgcctttaacacagtccccacctaaacccctcagggtaactgactacatccaattcacagggctgtccctgcactagaactcccaaggtttgtattcatttcactgtgacttcagcttcttcagagccctcatcctcccttttggaacagtcgcagtggggcaccttcttgtctaagtgccatgggggcccaaggggtttgccgaaatggggaataaaggatcgccaatgtcccaggaggccttgggaggtttccaactgctttggtgtggtgggacatgagtagacctgcatcttatcttatctatgatgaaatatggaataactatagtcttatgtaaccagatgacaccaagtatttgactgataagcctggaccctggactttgtccgcattgacctcccattctctgttcaccaagtgagacagcaaagcaggggctgcagagcaagaacctttatggactcatcctaaccttcatctccttcccactggagctctacatcggacgccaggacttaggctcccaggatgacgtagtcatagtagtcctaatgcattggtgtggcagtcagcaacactttaaatggcctaccaaataaacaatggtctccaatttgctatcctatccctacaggcggcatctcattatagttacaactgttctcgtggctgacacaccctagcctgtgcaatgagctctgcctcagtggttgctcagagtgcagtcaggagtggccaacagctgccacagctcaggaatctgactgtcactttgtcacattgtcacatccacctcaggcaacaggtcctccagaacttttggcattttggaggcatccccgtacacatgcagcgggccccatccatcaaggattgcagctgttgggcccacagagatgtgcatggcctgcctgggatttccccacaggtctccccttccttgacactgttgtctaagagcttgcaggattttctttgaccttgttctgggcctaccagttgtcatgctagacccctattgactgtaataggcatggcaccatgtccaaaaggctgaagaggagacctggagcccatgaacaagacctagggtgtattgaggacttgcatacaatgtggcccaggaaaagtgtgttggacaggaaaaccactaccatttgtaaaacacgtgtagtttatattatgattttcacttagcaccctctacctagcaacctccagatttaacaaagagcatcaatcacctggacatcctgtgttccaagggataggccagggattcagatgtccttcacagacaaggaataaacttctgggttgacagctcctggatttcttagctcagagctctgaacatacattcttcataaactatagggtcattctcacagtgtgcttaaattaacgctgccaggcatttctggcatacatagatctgaacacacacctcataaaacaatgtataaaaaagtgttcatcaagactttgtattaagaatatgtatatttaaaacaaccattaaatactgctactcatttactataatattacaacggctgcacagcaaagcattagtgaatactgacaaggctccagaaaagaaaatcttattcactgttggtaggaacgtaaaatggcacttcctttttggaaaatattttcagtatttctttggagttaaacatgttaattgaacagatgactctaaggtactttattcaactgtttttttgttttgttttgttttgttttgttttgagatggagtttcactctgtcgcccaggctggagtgcagtggcgtgatctcggctcactgcaaccttcacctcccaggttcaagcaattctctgcctcagcctcccgaatagctgcgattacaggcacccaccaccacgcccagctaattctttgtatttttagtagagaaggggtttcaccatcttgggcaggctgatcttgaactccttaccttgtgatccacctgcctcggtctcccaaagtgctgggattataggcgtgagccaccatgccttgcctattcaactgattttaatacttacttctacacagatactttcatgggaatgccggtatcagctttcttcagtagagcttttcctcctccatgaattttgcttatagggtgataattatataaacaattcccatataattgggccaggcgcagtggctcacgcctgtaatcccaggactttgggaggctgaggagggtagatcacctgagatcagcagtttgagaccagcctagctaacatggtgaaaccccgtctctactaaaaatacaaaaattcaccgggcatggtggcgggtgcctgtaatcccaactactctggaggccgaggcaggagaattgcttgaacctgggaggtggaggttgtagtgagctgagattgtgccgttacactccagcctgggtggcagagtgagactctgtcacaaacaaaccaaaaaaaaaaaaaaaaatgaaaaaactgaaaaaacaaagttcccatataattagagtatatacttctattgttactttttttcaatttattaatgacatactgtaaacaacattaaaaataataatccctttcatttctcagccccagcacagctgcctcctcccttgggtttctgacaccctcaggatgtgggttttcacactgtgtctctcgcacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtgggctcctgtggagagaacacagaagtggatgagatctccctggactggactcaatctctttctcatcactgggactagggagcctcttacctgtggctgctgccaccaagaagaggatcctccaggtccagtccatggtgaggaacggagctctcaggggattctctagaggacagatgtggttgctgggtgatgctctcagggcacaggacagatctgtatttacttcagtaaatctcaggttatttgcatattcatgagggatactatttcatagctctagacttgatccaagatgagaaagagaacacacataatttatgggccatgcaacagtgggacgctgaagtccctgtcccaatccttgtttaatgatgtgtgtccccttgtatgcccagaactctgctaaaatagattgtctgctgaaaacaagttcccgcagaacatggtcctccaagtgaacccatacttaaatggcactttgacaccttcatacttttctgggctttgctttctgcatgtcttactactgtctctgttaagattggcaagcactgaattaataaaaccatcccttttctccatctcctacctattaagatatctgaaaatcctagaaatttctccttttacatgtgattctcattgacttgttaggttagataaatcctacaaatagaactgtatactgaaagacacaaagacacatcaatagtctttactaaagtcttgtttaacttattaaagcatgtttgtccgagaaaaggaagacatcagaccctgggaggaacccctccccagcctcccttgcacctgctccagggctgcagcctgtgctgggcgaggccctagcgctccctgccacccagaccttgcactgcagggagcttcccattgggtctcacagagcatttttctctcagcctctgtagctcactaggaagtgactgtgccctggctcagaatgctccttcagtgacaacatgagctgatggcaccacttcttgaaatagtgaatgggcctttggaaacccaatgtcctcttcagggtggctccaagagaagaatcgctaaaatcaccagggagtccacttcctggaggtctagatgcactggatcactggaaacaaagggaggctaaaactctgggggggttggaggtggctcttttctcatttcggctcttgcagatgaatactgcatctgagaatacctgaagctgcagatggatgtggattaaagctcactccacgtccgctgttccaataactcctactcaaacacacagaaacacaaacacaaacattctcacacacactgtggctgattttcacagttatggacccctaatttttccttcttcgtagtatcttactcacgggaagtgccgccgaccctgaccctaggcctcagtatgtgactttctttctcaaacagatctaaagcaatcacactgccctctttaatccatattaatgatgctgttgaggaggtaatgtgtggggcaggggagcatggtatgttcttacagttgactctccctggtttggttgccctcttctcctgagcagtgaccttcacaaggaatctccagtgatacagctgattttctctctttcctcccttctgcagatgctgcacccagggctaccgccttgaatctgactcctcttggctaattttatcatttgcgtgatagaggaaggctgaggaggaggggtctgtaatttggaagtatttccttcccccacataaactaagattttggagaataccttcccttggatgagctttctagaaaagtctttttgtgcatcttttctccgtgattactcctccccagttcatggctatagggaatctattttaattgcttccacgagaacctgaaggccctggagggcaagtccacacaagtgtggggtgtacagcctctaggagtgctcaccctccccctagtccacatttgtcctccagacattcagcataatcaccaggtaaatgttctcaccaatgtgtctccaggagcttctcttccaagtcagcaagtctctgctgtgactgtggatgtgcctgtctctacagcttttggagggagtagttttttcagcaatttcagctcttagatggattaaaaaatacttgatatttagatggtttggagatatatatatatcaaaatatatatgtgtaatatatatcaatatacatattatataatatatgaatatacatattatatattatatatacatattatatatcatatattgatatgtatgtataatatataaaaatatacatatatattatataaaatatatatatgatatataatatatatttattatatatatatatatatatatatatatataaattttttttttttttagatggaggctcactctgtcgcccaggctggagtgaagtggtgcgatctcagctcacttcaatctccacctcctgggttcaagcaattctcctgcctcagcctttcaagtagctgggattacaggctagtgccaccacgcctggctaatttttgtatatattttttagtagagacggggtttcaccatgttcaccaggctggtctcaaattcctgacctcaagtgattcctctgccttggcttcccaaagtgctgggattacaggcctgagcctatgtgctcctttggttcagatgttttttgatgtagaaatggagctaatgacttttaagatcatcacatatgtcagcaaaaccctgaagtcccctaagaggtcatgtgtgttctggtactggaagcagaaccctaatctccctacacaaaagtgacatctggacagacacaactgaacatgtggggacaaagggaatggcacagcaggacacttatgaggaagtttcaacagtttcctttttattcagaggaagctgcagcaggtgagagctggttatacctcaggcgatgtcattttctggaaggctgttcttgctcttgtgctggatcaagtggatgcacctgggccctcacacctggaacaggaactctcattccttaacacaaggtgctcggtgagacagttgcttccagctgaagtgcagagaaaggggagagaaggagttgtctctggtgtcccaggatgtgtgtcaactctaggataaggtcaccttggaggggcagtggtctaccttaggggattacatcagttctgccttcaataacctgtggctgtggtcaggagtgtgactcatccccttctgctcctcctacctgcctttcattaaatgtgcaatgaatgagtgatccctcaccagagagtgtcatggtctaaacatcatgatctcacacaataacatccccacacccaatctcaaatacattatagaccccactcaatcagcaattggcaaataatttgctcttgtagatttggtgaatacatttgctcagcgttcatttcaacagcctctcagccacatttagcaaagtgattgacaaaaatgaacatgtctctatcagcaaatagaaaatataaaatcaccgagttggttgaaacgtacactattaactctgaacaaatataataagaaattaggcatatcacaatggcacacagtttgttttaccctaaaaatatcccctgagctttgccaagtcagtctcttgtctttccccaaaagccctgcctatcacaaacctgtttttaaaatccttttaattttactgtatttagcaggtctcatgaatggaattgtacaatacttagtctcttttgtccatcttccttcacttagaaaaaatgttaaaatgttgtcttctgaattaataacccatagtttttatgactgatagtattccactgtatgagtatacaaatatttgagaatcaattctgttgaaatacatcatgtttacttttgtatttggtaaatatgagtatcagtttatgacaattgatactgaacaattttatatattcttattttcagataacattttttcttggtgaggtgtttgttcagattttcactcattttagaattctgtttatattatgctttctgttgagttttacaaattctttttatagcctagagacaagaccttacaaacagtaaaaagaaatagtttctgattttgaatagattcaatatacatacataatttttaattgttataagcacataatagtatatatatttctatttgttgggtatatgtgatgttttggtacaggcatacaatgtgtaatgaacaaagtaaaaaaaaactacaataaatctataaaacattgaggaaataaagaggacacaagatggaacaatattccatgtttatgaattcaaagattcaatattgttaaaatgtccataatacttaaagcaatctacagactcagtacaatccctatgaaaacaacaatgatattcttcacagaaatttttaaaaaatcctaaaatatatgtggaaaaacaaaagatgcagaacagcccaagccattctgagcaaagagaacacaactagagaaatcacattacctgacttcaaaatttatatttttattattgttaattatttgatctaaaagttatgtttcaaacaatgagaataacaatacgttaaatgagtctgatgtatgtatacttgaaattaatggcatcaattttatgaatgatggaggtaattgagaatgttctgtgtgaggcacctgcactagatttgatgtggaataatgtcattttgaagatggagacagattagttacacacgcatattgtaggccatggtgcaaagcaggctcaccatgcaaaagtgaccaaaacgaggccacgtgggttgtacacctcagcagctgtgttacccactgggacaaagctctgaaggacatcctgcctccaggggagagaagaacaaagcccagggtgtccctggctgtttttccctaactcaagattttatatcctctaggagaaacaggaacaaacctgagctgttccagacagacaggatgtccttggctctgtgcacgttcaggaacaagatcaactcgttctgagtctctattcagtgatttaggttcggggaaataagaatgcagatctgaaattatggagctttcagaaggttttcatgtgtctcagtgcaatttcttcatgtgttattttggcttatggtattgataggcccacaaaaactagatttaattcaataattcaagtgatagagcaaaactgaaagagctgaggggttttctagcaggatttagaaagtttaaaatacttcatcttagaaaatgtatttgctggacattgatgggactggagtagagatggatgtgggggagcccaaggattgtgctttcacacacaccacaatgacttctgctgtcccttccttccctctctccctctctctctttctttctttcttttctttccttccttcttccttcttctttctttctctttctttctttctttctttctttctttctttctttctttctttctttcttctttctttctttctttctgtttctttctttctctctttctttcttttcttcttttctttctgctgagtgagcacagaagtacacacaggtataaaactcactgaatcaccattagctgttcttccttttgcctcccacccaggtcaggaggaattacaagtcctacggaattctagttctaagagagtgagaatctttatatggctgattattccagaattttctataatgatgcagctgttgtttcttttagccagtttttattgaattctgttcttttccattgagtcgtaaaacttatttctatattctgttgcaagtttgttttaagatatatatatatatatataaaatattcttgaaatctgaaagtttctgttcattttcttaatgtaattatttaaatatgaaacttattttattataaattacaaataatttttgcatatatttatgacatatgttgtttagttatgatacatgtatacattatgaactgggtaactcaagccgcttatattcatcacctcacaaatttatcatttcttagtggggaaattctaatgtttatttttttagtaattttgaaatatatactaccttatcagctatagttgacatgctgtgcattagaaaggcataacttatacctccggtctaactggaacgttgtgcactttaacccacatctccctttcccagtccacccctctaggccctggtaaccaacattctactctacctctgcaagtctactgctttaatatatacagtgaaatcatgaatgactcttcctctgttcctggcttgtttcacttggcataaggtcctctagattcatgcatgctgtcacagaggcagggtttccttcttatttaaggatgaacattactctgttgtgtctgtatgcattttctttattcattcatccattcatgggaatttaggatgtttccatatctttactattttaaataatgctgcaatgaacgtgaacatggagtgcagatatctctttgacatgttgatttcatttcctttggatacatagccagcagtgagactgctggattctacagtagattttgtttctttattttttgaggaacatttatagtattctccataaatagctgtattcatctacattttcactctccatattctgagttctgtttctgtcatttcagccatctcagccccattcagaactgctgttgaagaggtgctgtggttgtttggaggaaagagggcgccctttttgttttcaggacttttgcactggttctttctcatctttgtgggcttatccaccttcaatctttgaagttgctgacctttggatacatttttattttcttttaccctattggatgaccttgagggtttgattgtggtataaggtggattcagccaactggcttcatttctggaaaaatttaggtggccagtgctcagctcccaacacctagactgtgtgctctgactctgggggaagttatactagtccctgacttggttctccggctccttaaggttaggaatccactgtcctgggctgttggaggtgtggcagctgtggcagagtgctagtgggtgtctgggtgcctgcctccctgcaggtgttcgccacagtggcagaggcattgcgtctgtggggccctgttggtgactgtgttcaaggtcacactggaggaggtgttggctcagggatgggacacttgtgggcacaggcccgggtgccgtattcatgccccacaagcaggagtgatttctgaatgtgtgagatgatctgctattctctgtgcagaattagcgcaagtgcgggacgctgacaggagcggccctggctttttccccaccaaagcttcctctgccatggtggttggggtggggggaggggactgcactccacgcaatggtgggacaagaaaagcaaaacccacctatacagacatgtgactgcaaagtgatgtgggaagttacgtgggcctgggtgaacctacagtattcggaggaagtgtgtaagctggtgtgtgcacatgagggctgcccgattggagctctccaccagtcaggcatgttctgccagggcagaaattttggtgcgggatcccagggcgtccaagactgccctgcaagaaggtgtggccaggctagggccccaggagaggccagtagatggaggggcactcaggtccctacattatttgagaatgtggccatgttttatgtgaatgagtgatgacttgattgtaatgcagcattttattccagtacacaaacatatctcaaattgtttaacattcacctgtaatggatattcaatgtgttctctcagtttctggcttttatacggaaagcagctattcagtgtgggaatgtgaaaaaaatgagaaaactgtgattttattctgacctcattaacaacgaagctgaacagctacaaataaaagagagaaaaaacattcaacatatctgagttgatttcaccaagcaaacaagaaaactgaaatctgagaagataggagcctgcagagagaaccaggacctacctgctagtgtacgtagggcaggtgccactggatggcatttgagatagaaacagactaacctagaaatacttaatgacttttttttttttagtatgcatgtactaatggtgttagattggcctagtgcttgcaagcttttcctagagaacttgaaaaatccacggacaacttcctcatctggtgtcttgtggtgttgactggggaaaagaacagcagctcctgtggaatgcctgaatgcacctccactacctccaggggaaatccaccaaagcatgtgtcatatgagctgtggtgaagtcaacagaaacaaaaggaaacagacgacaccaaggaaacttgatccagaaacacctcccatctccttcctcaggaaagaaatccttactctttagggtaaggatagtgggtaaaaagctggggacactggtgaaaaacagttgtgtctgggaaaagacgttccagccctggggaaagagttaaggacaggacaatgtggaaggccactccccagaactatgcttactactcctgcataagaaggagactcagtcagaaggttggaggaagtcccgctttgtccaacctccttcaccacacagtcatcaatttaaactgtcagtagggtgcactttccacagctgaaacagacagcctccctggggaaaactaaatataaagacccaggatcaaacagggacacaaaagcaagtatcatgggaggaacttgaaatctctgtggacagcagaagctgacttcaactctgataattgtggcatccataaattgcaaatatagccctgaatagatacacacaaatatctataatgaaggcccagcagaatggaatgtgtgaccatcttcaggaagaaaataatgaatacatgagtacaagaaaataaattacaaattaaagtcaaactggaattctatatatattaaaaatttcatttaaagcgaaagtcaaatgaataccctgtaagacaaatcgattctgagaaaatttattgctagtgcattcatccttcagtaggtgctttggcaaattttctgccagggtgagtagccatatgatatacatccgaaacatgaatctatccaaataaaacatgtggtcaagaatgaaaaaatgaagttgaaatgtagtttttatatttttaattgttctaatatatgtctatgtaatgataaaaatgcacatattatattttatagcacatataagtgcaaactgagaataaactaagacaacggatgagaaagagtgtttagaagaataagttataatagctctacaacctatgaagaggttttacgttatttgaattagaatctgattatacacaattcttattgtatatcttagggccaatacaatattcataaaagatgaactaaacaataagttaatagagaaataaacatgatcataaaatgccaaattaaaacagaaattaacagaaaaatagtaataccagttttaaaatagaattattatagttgatttaaaaagcaagacccaactactagctctgtacagaaatttgctctacatagaaaagttaaatacaggaaaacatggaccatgaaaatatgaacgaaaagaaagcgtgcttagctatgttaaattcagacaaggtagacataagactttcaggaatcaaggggcatattacatagggtaaagggatcagttttctaaaaggcatcaccaaagatttaaccaatggatctgggatagaaaataggctaacatctataacagatagcgaattcgacacttactgtgattgacaaaacaaacgtgataaaataggtaaatatataagtgaccagaatcaacttatttgactagtttcatttatagaatattcaatgggaagacagcaggaacccaaactgtgattaaccagaagatatgagaggaacatggtgactgaatttgatgtggttacgtgggttgaacaaagaaacaaacaaaaagcaataggaaagtgacaccttatctcaaaaagaaaagaaaaaggaaaaaaggaaactgttaaaaattggcaaaattcaaataaatcccagagctgaataaacagaaacttatcaatgtaaatatattagtcccatgtcccatgttttttttgacatattaactttagtgaaaacttggagatggatgtgaacacactgtattttccttacaattgttctgataacctataattattccaaataaaaagtgtgtaaaatataaagtaacaatcataaaaataatagttcaaagaccttataaaataggcttctgaaaataatattgttactaaaattattatggataattatttcagaggataatcctgaaatgatcatcgaagtggtggacagatgtttatttatttcagaaaaagatgtgaggcatctcatattaaacgctagtgatggaagtgtttatagagttgttttatcatctataatatgatggatgaaaagcattatcataagcatttgatggatgaaaagcattactatcataagcatttatgtagccaatatcatgaacgtattataatttcctcagttgtgcaccatttttgtgttaataccatgtgaacgttttctactgcatgtgtcatatctaaacatttgaactagtttgtttgttattaatgtgactcttgtaaatgctgtaggcattgctgatgttctctgtaatttctctactggtgtttttttcctaatattttaacatgataaatttggattaatataactacgtaatttaataatatattttaaacttcatagttgtacacacagacacacacacacacgcacacatacacaacagcccagcaatgacacatatacccgtccatgcaaaaatgaatgtatattaaacaccaaaacaacacacccatttttttctatattattttaattatttaattgaatgtaactcgtatttgcagtttcatttttgaatgaatgtaaatgccattcttgccaaatatattacttaagtgtacaatggtatttacttttttttttttttgagacagagttttggtcttgtcgcccaggctggagtgcaatggcgtgttctcggctcaccgcaacctccgcctcccaggttcaagcgattctcctgcctcagcttccccgccacgcccagctaattttgtatttttagtagagagggggtttctccatgttggtcaggctggtctcgaattcccgacctcaggtgatccacccacctcaccctcccaaagtgctgagattacaggcgtgagccactgcgcccagccagtatttactttttaaatatcagtcagttattaataaattgaataactaataagacaaacatcacttaaatttttattaaatcattgattaaagtaacattgtatttttttaaactaggcaggatagaacttttctatttgaaaaactttttaaaaaactttttggcgttaattttcaatacaaactctagtcgttatttgccaatatgcctttataataaagaacatccagcaataggaaactgaaagcagcccatgctttgcaggattcaatcacaatggcagcttgctggagggtggtctgagagtgggcaaacacattagggatttggacttcatgaaagcactactgagcccctgggctgagcacacagagggtagcataagttgcagagcctagtctgtggtacttagggaaaaagaggaatgggtgggggttatgtctgcaggaccctagaaaagtgtgatgagggcagagggtctgcaggtagagtgtattctaaggagaactgttactctcctaaacttggttggcttcagtgatcatgaaaagaagtgaactgatttaccagacatggaggacaggaagtaaaaggacttcctgtttcctgcatggagactgaggaagataaaatattttgacagaaaaagagaagatggagaaagtttgagaagcagaacaccaggggccaaagtggaggacaggagcccttaaagtggtgtttcatctgcacaaacagccgatgaaaggaaaagaaactggaccccatgcatatgctgagttgttagaaaagcatttacaatagtgtgtctgacagcacagaaaacaaaaaaattgtgcatagagccagactttggattgaatatacacaattaaaaaaaatatactgagatatatcattgctagtataactctgaaaataggcagagttaaaagttgaattgaacccctgttctaagttaatgttttataggtgaaagaaaccatgagttacaaggaagacatcgtaagagatcctggggaagacttttgcttgaccaggtcaggaatcaccaaggtggaaaaggaaacctcatcctccccaggtacctgatatggagctgcctccaaagagccccttggaggtcctgagtgctccctggtgtcctgagccattcttgctgtcctgaacacccactggtggttcctgagtgccccctggtggttctgagcaccccctggttttctgagcgacctctggtgtcctgagccccccctggtggttcctcagtgcctactagtgtcctgagcgccccctggtggttcctcagtgcctactagtgtcctgagccccccctggtggttcctcagtgcctactagtgtcctgagcgccccctggtggttcctcagtgcctactagtgtcctgagcgccccctggtggttcctgagcgccccctggtggttctgagcaccccttggtgtcctcagtgccccctggtggttcctgaacctcccctggtttcctgggcaccctctggtttcctgagcgacccctggtgtcctgggtgacccctggtggttcctgagcgccccctagtgtcctgagcatcccctggtggttctgagaccctactagtgtcctgagcgtcccctggtggttcctgagcgcccctagtgtcctgagcatcccctggtgtcctgagcgccccctggtggttctgagcatgccccggtggttctgactgccctctggtgtcgtgggcgccccctggtggttcctgagcatcccctggttttctgagtgtcctccggtggttctgagcacccgctagtttcctgagcatcccctggtggttctgagaatcctctggtgtcctgagcaccccctggcagttctgagtgccccttggtgtcttggtcacatcctgtggttctcagcacccccttgccacagtctcatgagtgccctttggtgtcctgagcgccccctggtgcttctgagcaccctctggtgttctgagcaccccctgcttcttctgagcgccccttggcggttctgagtgccccctagtgtcctgagtgccccctggcggttccgagtgccccctggtgtcctgagctatccctggtggttctgagtgctcccttgtgtcctgagcgccccctagtgattcatagcacctcctagtgttctgagcgccccctggtgtcctgagcacctcctggtggtcctgagcccctcctggtggttctgtgcaccctccctgatggttctgagtgccccctggtggttccgagtgccccctggtgtcctgagggcccccttgtggtcctgagcgccccctggtgtcctgagcccctcctggtggttctgtgcaccctccctgatggtcctgagtgccccctggtggttctgagcgccccctagtgtcctgagcgccccctggcggttccgagtgccccctggtatcctgagctatccctggtggttctgagtgctcccttgtgtcctgagcgccccctagtgattcatagcacctcctagtgttctgagcgccccctggtgtcctgagcacctcctggtggttctgtgcaccctccctgatggtcctgagtgcctcctggtggttctgagcgccccctagtgtcctgagcgccccctggcggttccgagtgccccctggtgtcctgagctatccctggtggttctgagtgctcccttgtgtcctgagcgccccctagtgattcatagcacctcctagtgttctgagcgccccctggtgtcctgagcacctcctggtggtcctgagcccctcctggtggttctgtgcaccctccctgatggttctgagtgccccctggtggttccgagtgccccctggtgtcctgagggcccccttgtggtcctgagcgccccctggtgtcctgagcccctcctggtggttctgtgcaccctccctgatggtcctgagtgccccctggtggttctgagcgccccctagtgtcctgagcgccccctggcggttccgagtgccccctggtatcctgagctatccctggtggttctgagtgctcccttgtgtcctgagcgccccctagtgattcatagcacctcctagtgttctgagcgccccctggtgtcctgagcgcctcctggtggttctgagcaccctctggtgtcctgagggccccctggtggttctgagcgccccctggtgtcctgagcccctcctggtggttctgtgcaccctccctgatggtcctgatgccccctggtggttctgagcagcatctaccacatagtcccctcctgtctccctgcggtgagctttgtgtctgggctcacacagggtttccctcactgtgtcactcacagtaatacatgaccttgtccttggctttcagattggtcattgtaaggcagactgcacttaaaagggtgttgcttgagattgttaatttatttgtactcatggaaagtaaccctgagaattcatacttgatcactcactgttggcacccacacctatccctgttgtgaagcgtgctggaccaagctcatgctgtaaccagtaaaggtgaaaccagaggctttgcaggagagtctcaccactgggctgtaaattttttccccctctgactccatcagtaaacttcacacaggacttccgtgaacacagcaaacagactgagaacagccccgtgaggagaagccacagctggacctgatttacgaaggacactaatattgacggggatgagaagagaatccagatcaatgcagaccccacggtgtggacactgaggaagggcacagacatggggtggctcctcgccagggcctgagggaacaggggatgagctgcctttcatgagaagtggaggggacacatttccacgtctttctttttgtggtcatgggtgcactgctcagcattgctcatccatcctctgtgtctacatttcagggaagtcaaggtcaaaggatttctgggtctggatgcacagagttaatctgcccattactattttttattctctaatgtggacactgttggggtatcttcataatagcaaacattatcaacaaatatgtccagtaagaacataaaaatacgtttccagagaaaatggacacctgtctctaattggtatatttagagctgcaaactactgttcttgacaataaggcaaagttaggttgcaatgaaaaaaatacagatctatgccttgtcagggagggggtttatgattatcattatcttgagatcattttgccacagaacaattcgacattggatatatgtacttgtgtaaggaaacagtcaatgtggacatatgtgtacttatgtgagtgaagagttcacatggagacatgtttgcttgtctgagacaagagtccacatgaggaaatgtctgttttctgaggaaagagtaaatgtaagaacatatgtggtagtctgaggaaagagtccacgtggggacatgtgtgtttgtctgagagaagaatccacgtgagtaaaggtgcgtttgtctgacagaagagtccacatgttgacaggtgtgtgtacccatctgagggtaaatgcccattcagggacagtgtatgcctgaactgagctgaagtttggggaaatatttctcaaccaaggaaagaaaataatcctgtgggttatttgcttgtcaagagaaaaaaacctgggtcacatagaaaattgatttaaaaaaaaaacaatttaaaaaattaaaggtctttagtgaatggcaacatcttatatgcaaatcaggaaaattacctcattctttgttgcatacatctcatgaaatctccaccctcacaaaataagtaatgagataattttatacaatctgcatttgatccttgggttaatgaactgctaaatttttttttaattgtatatatttaggtttatattttccatcacaaaactatgtgcttagacaaattaattgtgtcatatctgaaccattgcatatcactaaaaataattttaatcttcttaaacagtgtctttttaacttattttataccagtctctaaactcctcgaatatcctctatatgttgttgttcacttgactacagttttggcttttatagaatttcaaataaatcaaattatacagtgtcattgaaatgacctcactgaagaaagtggaaaatgaagttgctgacctaaggaactttgaaaatgaggaaactctgtaagtttaaagtgtaaagaaactgaacataagcactctattctagtagataaacatgtttcctacaagggtacagctttacatttctgatactgctatgcatgtgtcctgaaattgtgcagctaagtaataaaatggcatatggttggatggggttcctcattttgcagtgagaggttatagacagtcaaggaaggaaggctagaaagatccatgtggtagcataattgggtagagagaccagtgtgttctcatttttaatgtaatcacattacagaaggttagatacatagtttactaggccagttggttgagaggtcctgcaagtacttataccacattaacaatgcacatacccagtattacaattttttaaatactattctttaacatcagaagcaagcaatctttagaaaaatggctgattctatgtatgaaaaagataatatagaaaatgagtttagaatttattataatagcaggaaacagggaagtgttcaaaaacaaaagcatgaggtgagctgtaaggatgcaggatccaaactcaatgagctcccagcacataataaagccgtggtggtttgaaaaataaaatgaataatgtagcatggatcttcttcagagtatgaaatagacatccataaaccaatacacatattaataagtgatcaaataaagaaataataggaagaggaacacatctttttacagaagtattccaaatatgttaggttgatagtcctctaatcaagtaggtgaagcttaaacactcatgagttgattgtagcctgagattagagacgtggaaaaagtaattgctattactgtattttataatgagatttcagatataataccaaagacatgatctgtggatgaataacattttacattttttaaatctaaatttgtataaacacacacacacacacacacacacacttttctgcaatacatactgataagggagtaaaagacagccgcagacttggagaaaatacttccaagtcacatatttgttaaatgaattcttttaatttgttaaatgattttataatcaatatgcaagtaaacttacaactaatcaaaagaaaacaatgcagttaaaaatgaaccaaatatgagaagaggcatcttggcaaaaattatatgaaaattgttaaatgtgaatttttattagggaaatgtgcatttaactaaaaattagataccattactcacctattagaatggttaaaacacacaattctcataatgataaatggcaatatgaatgtggaaaaccaagaactatcatgcattgatggtgggaattcaaaatgctacatgcacaaaatgagtttttttggcatttttaaaaatagagataaaagtagagataaaatgtgatttgtgtgtgtgttccaaaatatttacaacactgattcagaaattgatgtttacacagatacctacagaggaagttctgtatcagttttattaattcaatccctgaaatttgcttgcagaataaatattgtatgaaaaatctctcaaataattaaaatttctcaaatacacgtttatattgttccttttccttaatgacttaatatcattttctgagaaagtcttcaatctaataatctttgtcatttcctccatgccagcacagctgcttcccccctggggtttctgacactctcaggatgtgggttttcacactgtgtctctcgcacagtaatacacagccatgtcctcagatctcaggctgctcagctccatgtaggctgtgctcgcggatgtgtccctggtaatggtgactctgccctggaactcctgtgaatattttgtgttaccattgccagcgttgctccatcccatccactcaagcctttgtccgggggcctggcgcacccaatgcatagcatagctagtgaaggtgtatccagaagccttgcaggaaaccttcactgaggccccaggcttcttcacctcagccccagactgcaccagctgaacctgggagtggacacctgtagagaagacacaggagtggatggaagcccccttgactggcttcgatcccttcctcctcactgggatttggcagccccttacctgtggctgctgccaccaaaaagaggatcctccaggtccagtccatggtgaggagttgtgctctgggggcttctgaggagggatgtggttgttgggtgatgctctcagggcacaaagatatctatagtcatctcagttatttgcatattcatgagcgatgctatttcatacctaacacagcatgagaaagagtggagagatgacacatggattacccaacaggaggatgctaagggttcaagctataatccccttagaggccatgtgtgccctgccatatccctaaactgtatgttgacagagcttctcccactggagaacaattttccctagaacaggacttcactgggaacccacacttgaatagctcagaggtaatttaaaatatttctaggctttaatacatgaatgtgttatttgggggatgagtgtgtttctccaaaagttgcacttatttatataaaataaaagcttaattgacctccagatgcttactattaagatatgtagcagggttagaaatctccagtgtaaattgataaattcttgcagttgaataggatatttatggactcttcagcagtttttgtcaaatacttattttagatttttttagaagaatgacacagatcttaaggggactccatccgcagcctcctgtgcacctgctctggggctggagcctgtgctgggtgggccttgagcgccccctgcagcccagcccttgcactgcagagaggctcctgtctgggctcccagagcattttccccccagtatgaagtggctgtgtcctggctcagaatgctcctttagtgacacgtgacaccatgtgctgctgacgccatcgcttgcaatggtaaattggtcgtaggaaagccagtgaactctgcagaaacaccccaagcaaggattctatgaaaccaccagggagccccttctgtggagctctggaagcactggatcagtccacactcacagtgagtccaggagcttccaggggctttgggagaacacctaatctcttgtcggttcctgtggatgaacatctcatcagataatttctaaacctgcaagatcatgggtctcagaggccactgcaaaactcctaatacacacacacacacacacacacacacacacacacacacggtggttagagtccccacagtaatggacacacacacacacacacacacacacacacacacacacacacacacactgtgtctagtgtcctcacagtaatgggagggaactgtgccttactccctgtgtctcgcgcattggtcgtgcgcccacagtgcccctaggcctggggatatgcccttgtcaacagagcgacagcaaacactttactggagatggggccctgcacacactgtggcttccctgttctcccagaacctgggatcctgcagatacccctaagaagagtccaggctccccctgggagggtcagccacagcccagccccaccgagtcggtgcagcctgcactgagccgctgacctgtggagagggtcacgccagacccacagcccagccagccccactcccagaggcacatcaaggaagggggcagaaccctggggactcttgatgggcatcttttcaggagcagacacacgaactgttccaggaacaggggacctgggaaggtcagtagctggtcagggtttctgaggaccagcgtcagtgatgggacctgcctgtcccttctcatatgggatgtctctcctggggatcctgcactgtcttatttgtgcaggttcactctgtgggacttgtctttataaatctcaaatctcaggaacaggagagctgtgcttcaaaagcccccatagagaagacacattcccatcctgctgtgactgaaacagctccatcctgggcatggggagggctcatgtgtcccacctgggatgagcagcagcagccacacgtgagctgaggaggactcaaggctgcttcccagcacttccccacagagtgaaatttgtgtgtttgccccaaatccaggctggccctgtgacttgcttctttcaaacttcttggcctggaaagtgcaggcaccagctgtcactgtcaccactattgtgacagtgtacacagcaccaggacaggatcccagggatggggctgaggacagacactagctaagtggacccattgaaaacgtgcggatctgctgaggttcacactcctggaaggacagatcttggagggtttggaggaggaagcagccactgtcggtgactcaggatctgctgctctgcgggtcacctcgttggcaagtaacagtgggcaggtgagtgtggttcatcccctacagggacaccaggcttccaaatgcccctcttcaccaggaaagaaagtggctttgttcatactggttgctccagccgtctggtcatcctgtcttcctgaccttcttcccgtgtccctcagggctgtgacacatggacaaagacactttctactccaaccattgattccccaagccagctccctctagaaaagccacgatgtcttcctggttctgtgtccctggctgaaccagaatggacacacatggatataccaaagtgtcaaagtggaggagaggaatcttggcaaagatcactcaggaaagagaaaggaattcatttctgtgcaatgagagggtgtggggcatgtctggaggctgcaggagccagaagcttcatatttttttagtgacctcggttttgtctcccctgttgttgtgaggcttccctgagttctcctcctcagatagactctgtgccttttcacgcaatgacctataggagatgtttacaccaaacaaaaagcctcaaacctggtttatattctgatctaaattttcaaaagataaacccaagagagattcaaagaagtgattataaaatatcaggatatagcacttggctgagaaaaccttaaactcatattatttttatgaaccatatgcataacaaaactgcccaattcctccactttatcagagactgcctgcaggatgaatttcaatgccacctaatttagagtaggagcaaaacttaaaatcctctgtaggtctgagtgccactaataacaacaacaacaaaaaatttcaaccattatgaagttttaagagatgccacaatgacagcctgggttgataggtgatggcattttccctgggcatattctgtgaagagtgattacggtagctttttcttctaatgaggagaaagcaacagagaaagtaaaaaataataataataacaataatcacaaaacagaaaaaagtggtccaaattatttaacaaaaaaagcactagaaactgacacaaattaaaaggagatacattgattacctagcagaaaattcaaagtaaaccttataaatatgttcactgagctaggagaagaatgcacgcacaacatgaaaatattaacagggacaaaaaagggagagaaatgagatacgatgatttgtggcttaacagtagggatacattggccaggcgcagtggctcacgcttgtaatcccagcactttgggagggcaaagtgggtggatcatgtaggtcacgagctcaagaccagccagggcaacatggtgaaatcccatctctactaaaaaatagaaaaaaagaattagctgggcgtggtggttcatgcctgtaatcccagctactcggaaggctgaggcaggagaatcgcttgagcctgggaggcggaggttgcagtgagccaagattgtgccactgcactccagcctgggtgacagagtgagactccatctaaaaaaaaatgaaaaacagtaggaatacatctgaacaatgtgtccttaggcaatttgtcattgtgcaaggatcatagagtgtgtttacacaaacctacatgaaataccttgctacacccaggctgcgtgggatagcatagtgctcctaggtaacaaatctgtatgtcatgtaagtgtagtgaatactgtgggcagctgaatcaccatggtagatgtttatacagatgaacatatctaagcatggaaaaatgcggtgaaaatacagtattataatctaatgagacctttgtcctgtaggtggcctgttgttcaccgaaatatcatgatgtgcatgattctgttcaagttgctgaaaataaaaacaaagccaagaaacttccaaataaatacgttacatggattaaagcttttcttcaataatgcaggaggtttgagaagttccccaaaaaagtaaaaagtggacaagttcatcaccactagactggccttacaggaatgctaagtgtctctggcaggtttccagaacaaggaagtagctgcatcagctccactctgttatctgccaattgatagatttgcatagttttaaattttaatttatcttctttttttttccctccataaactccttctcccttcctttcataattctgtctattaatgcaactcttatttagctgaaaatgctggggtcattggaataaatttctatttttcctccaccaaatctaataagctgtctccaggggtgtccatctccattttcttttctgccattcccatgggataatttccttgttcctatgtgagtccagccctcaacaccatgggccatccaaccatcatgcacccaggaacagcttcaggaaatgtaccctgccagctgcctatcatcctccacctgcacagtgatcattccttcagctttcactcatgctggagggctttccacacaaaagggcgtttcacacccactcccagcacagttctgggaccctgtatacctcccagagacaggtacatatccttcccctttgttgttaattttgtttaatttatttaaaattcactgggaaatcactgatgatgggagtgaccagcctgtccattccatctgacggccccacctgtaaggttggccaccctagtgtgctgtgctcatggggccatctggacacacacaaacaccaggtgtgtgagttattagaggagacccggggtcagcagctgtctgtgccccacaggacacaggtctgtcctgcagtagagcctgcatgacctggaatcatacatgtgcatgacccggaatcatacatgtgcatgacccgtggtctcagcacatcagttgaggccagcttcaggcaattcctgtgtaacctgccctgagtgcccacagaggacagatgcatgacaaggatgtaagggaatgatgtgggttaggggaactgaagctcaatctttactgaggctttactcagcacctggaccttatggaagactaagaagaagagaacaagagcccggccccaaatatctcctggtttaaggtcagctttagtgggattttagagagtagaagacacaggggtgacgctggagtggttttctttgggatacttggggagcagcagaaggtgggccgggatcaggactccatctggctggttctcatgatctacatggattctcatagtggaaagtgagagacatgacctagaacacagccccccagggctgatctcagagaagcctgctaagtgaatgactcagcagaaatgtggtggggttttcatcttggatctatttttctttataaaaataatctgagagatgtgtcagcctcggtgggctgcttctccctccaggagacggagctaacacaattgtatctgtgaatctgcttggctttccatcagaagataccacagactaggttgtttcaaataacaaatattaattttcttattgttctggagccttgacgtccaagatctgggtgaagaaagggttagttttttgagaggccacttccaggcttgcaaagggccaccttctcatgcagcgcgtccccacatggcctctcctctgtgtgcatgtggagagagaggcctctgatgtcttccacttcccataaggacaagagtcctagtggattagggtcccacatttatggccacagttaacttatttgccttcttaaaatccctctctccaaatacagagccactgggattggggtttcatcacatgaatttaagagcaggacacgatgcagccgatgacgccaatcaagagatggtgagaagccttgaaatactttgtcaagaaggtaaaatgggccttgtgggaatttgttgaaaaaaaggtgccagtgactgttaaaaccttaatggtaaacagagaaatttctcccttctttcttgcctgcagcgaggatgtgaggaagcagaaccacagataataaagaaagaggaggcctggggacagctgaggtcctggcgaggagggagagcactgagctgatgaggaagccccgccctccctgcacctgctcctgacccggcctcttgctctgtgggccccgcgcgccccctgctggtcttgagcagcacctgcgccggtcccctccgcctccctgcagggaggtttgtgtctgggctcacactcacctcccctcactgtgtctctcgcacagtaatacacggccgtgtccgcggcggtcacagagctcagcttcagggagaactggttcttggacgtgtctactgacatggtgactcgactcttgagggaggggttgtagttggtgctcccactggtatagatacgcccaatccactccagtcccttcccggcgggctgccggatccagctccagtagtaactactgatggagccaccagagacagtgcaggtgagggacagggtctccgaaggcttcaccagtcctgggcccgactcctgcagctgcacctgggacaggacccctgtgaacagagagacccacagtgagccctgggatcagaggcacctcccatatccccatgtctgcagccttgagacactcacatctgggagctgccaccagcaggaggaagaaccacaggtgtttcatgttcttgtgcaggaggtccatgagtctcagaaagtatttcccatgtgagctggaccctgaatttaaggaaatgtgtggtggtttcctgtgggtgcctgagtgaggatttgcatgtaggtggtgcctttgtataaagaggtgaaaagggatgagggaggccccagtcttttaggctcaccctgggatgaggatgcttgctttgccctttgagaactcagttctcttcctggggcctcaactagccatgccctggctcctcttttcccaggtgaggaagtagattggaacagcagcttaacgtaataatcatgtgagttcagacacaccaggattcacttaatgtatagttcgggacctccatcatgtttagagggaatctctctgttctagggagtgggccattttttaaaaatttttaaattaaaataaattttttagatgaacttttgctcctttgcccaggctagagtgcagtgtcctgatctcggctcaccgcaacctccgcctcctgggttcaagtgattctcctgcctcagcctcccgagtagctgggagtacaggcatgcacaaccccccccgtctaatttttatatttttagtagagataaggtttcaccatgttggccaagctagtctcaatgtcccgacctcaggtgatccacctgccttggcctcccaaaatgctgggattacaggcctgagccaccattttaactaaggcactgggagctgccctctgagaccttttgagtcctggaattctttctgagaccttaggaaaaactcgtgggacatatcttcatcattctcaatgtgtgaccctgaggatgtgtcctgacctctgtacacttctgtgtgaaagagtagattgtgaattgcagtgaaaatttcatatgtaaactctataataggtcagcactggaggatattctcattaccaagattactgcagttacctttcctggaaaccagagaggaattctgtgagccctcacctctgagtgcacaaggaaccctggtcctgtctgacaggtctcacatgtgacatgggggaaaacagatacattcaagtccagtgttttcacccatatattgaccaatctagcctgatctatctgtctctgaaaagccttttccttcactgaatgcatgaacatacccttgggtatggggtattgcaatgtgggtatttggtatttgtttagtgaattatgtaattaataggctacctccatgaatgtgtgtaacagtagagttatcagaagttggatgagtcatattatcaggacaaacctggactctcttcttgggacctggacaagtggccaatcttctgtggtaaagcaaaggggaagagacagatccaacatccagaagcagggtagctcctcacttactagctggtgtctgagcatttgttagaacagatgaaaaacgacctaccttcaccttcagggaaatgatgaacttcgtatgaaattgaggttaattttcacttacagagaagaaaatgtcataggcatgtatatatctatgtgggtgtgtacgtgtttccaggatgtgttcatacacagaaaagaagcagctatatttgctgggaagacaaccgaagagcttctgaatttgtaggtgttgttaaccacaaatgtgtcatgttactacatcgtgtcatagtgctggcggtaaaacctcccaaaattgtcatggagacaaatgcaaagaaataaagattcaaatcagatgcctttgatctgtaatgaacagaccaagaaatcaaccattatggaaagagtgatagttaaatgtagcagtaaattccacgctgaggtgagagggaagttccatctgacagctcactttcacctctgggaagacttcagagcacagactaagagcagagagtcaacttagggcaagtgggggccagatgtttgaggaggatggagagtgagctggagtccttgtgagccattcagagaagcagcagtgtgcaagggtgtattgagtcctcctgagttaacaggtgctgagcagataccagtttcactgccctcattttgatttatcctcaagagtctattggatttctagatttgaacactggaaaagttgatgaaactcaacatgactaggaatatttctgggaagatttatgtaatgatgtgagtgtatttaaaattacattatgaaaatttcattatctaaaatgttggtatcagtatctattgatttgttctttttttcttagagacagggtcttgctctgtccctcaggctggaatgcagtgtcatctatgaattttatagtattaaaaatgatcaccctgattaatgttaccgtattatccccttgagggattttgctccatgtgtgcctgtgacatagttctagtcacagatgcaggagaagtggtctgttgaggcaattcttcctcctcagaggagaatataaactatcatctcctctccttgcttattccattttcagaattgcacacgacctttgggaatggtgtcgccatgtcttacacggtgggagtcaactgtggcatgaagctggaatggagatgtgtaattttgggaaaatacagaacctgggcacataaagttttgaattaattgggcctggagccactcacatcctggcatcttgttgaattgtttgtcattttaaattctggttatttagttcaagtttccttgattctctttctgctaaaatagtcattcataatcatctaaataaattaaattggaaaaaaattactaatttgaaaattaatcccgtttctgctgaggtcaaaattagtttgcggtgcacagagtgatgggcatggacatagaagattaccaagattgcactcacagcctaggtaatcactacattttatttaaattaggaaacacttctgtacattccttatatttattaaactcctgttgagaaacttcaactgttatatgttgatggatcctgcccaataataaaactaaatgtttttaaacacgaattcctattacaatgttagctttactttaggacacatttcttcacctcatttcaaattggcccagatgcactgattagagcgtgtcagttaagaaacgaccaggaaatgagatcacgtttctggagcaggacatggctttgggatgctttgcaaacaaagtggtttctcatgtcttcttgaaaatccattgaaatgggcaagttaaggacctcttagaagcactcttccatcccatatacttgactaataaaaaggtggaagtcagtgcggaaaaatagataacatgaaagctaaagtaagatttgtaccagttcattgcgccaaacatgtaatcttaacctagagtaggatcttatctgaaccctcaggaggtaaatttcctgagagattcaaagatgtctttataaaataacaacacttagcccccgattttatgttaaaataatggaaaactcctggtaatctacttcactcagtgtaaatcagttaaaaacaaaattctggaaaacctgagaaggtgggacttgccgaggaactgagccttgggggcctttggacacttctagttggattttcttcagctttgactctccatggaatttgaacaagtttcgtttactgtctgctgtttttctgaatgacttgaagtaattccttgacaaaagcctacaaccttctcagttgatagacatattttatgttttcaacctgtgacatgcagatgttttcatcaggtaactgaagcaacccactacaggaagcaactgttataaagtgattctgtaaggtgtttccattactcaaatgctaaactgctattaccagcaacaatattctgtaaatgttgaaaaaaatggcattgctacgtagaattaatcacaaattttaaaactttttcatatatttattgtttaaattcataagcatggaatgtttatttttccatttatttgttttatctctgatttttttcacatgtgttttgctgtttttctggtagagatatttcatctcattggcttaactctattcctaggtattccactgtcttggtggctattgggagagcatgttcttgattccactctcagccagaacgttgttggtgactagaaatgttactgtgattttcgtacattgattttatatcctgaaacattcctaaacgaatgtatcaatactaggagacttttggcagagccttcaatattttctacatatagaatcatattatcagtgaaaacagagggtttgcattcttctttttcttttatttggatgccttttatttctttctcttgcctgatctggtgaatacttccagtactaggctgaatagaagtggtgagagcgggcatccttttcttgtttctgttcttaaggaaaatgcttccagtgtttgcccattcagtatgatgttggccatgggtttgtcatagacggctcatcagattgaggtgtgctccttcaatgtctataattttgagggtttttatcatgaagcgttgttagattctattgaaagcttttttcctgcatctgctggaatactcacatggtttttgcttttgattctgtttagtagagcatcacatttattgctttgcataggttaaagcacttgtacagtgctggatggaatgtgaattagtccaagcactgtggaaagcagttaaagcagccttgcttttgcagaatgtagcctacttgattgcagtgtgttaactttttgataaactactggatttgatttcctacgttgagaatttttaagcctatgatcatgagaagtatttgtcttgagttttcatctcttctcaggagcagacacaggcactgatcaggaactggggacctgtgaaggtgagtagccggtcagggtttctgaggatgagtgtctgtgatgggacccgcctgtcccttctcttatgggatgtctctcctggggatcctgtactgtcttatttgtgcaggtccactctgtgggacttgtctttataaatctcaaatctcaggaacaggagagctgtgcttcaaaagcccccatagagaagacacattcccatcctgctgtgattgaaacagctccatcctgggcatggggagggctcatgtgtcccccgcactgggatgaacagcagcagctgcacgtgagctgaggaggactcaaggatgtttcccagcacttcctccaagaaggaaatttgtgtgattaccccatatcccggctggccctgtgacttgcttctttcaaacttcttggcctggaaagtgcaggcaccagctgttactgtcacccctgttgtgacactgtacacagcaccagggcaggagcctggggatggggctgaggagagacactagctaggtgaatccattgaaaacttggggacctgctggggttcccactctgagaagcacagatcctagagggtttggaggaggaggaagtcaccatcagtgactcaggagctgctgctctgcaggtcacctgattggcaggtagcagtggcaggtgagtgtgcttcatccctacagggacacgaggcttcgacctgcccctcctcaccaggaaggaaactggctttattcatcccggtttccccagctgtctggtcatcctctcttcctgacctcctgcccagggccctcaggcctgtgatgcatggacaaaggcactttctactccggtcgttgattccccaagccagctccctctagaaaatgcatgatgtcttcctggttctctgtccctggctgaaccagagaggacacacatggatataccaaagtgtcaaagtggaggagaggaatcttggaaagcagtctggagagaggctgcggagaacaggaaacacttgtacagtgttgggtggaatgtgaattagtccaagcactgtggaaagcagtctggagatttgaaaagtatttgaagcagagctgccacttggcccggccatctcatatgtgggtatatgcacaaaagaaaataaatcagtctaccaaaaaatacacccacttacatgttcattgctatgctactcttaatacctaagacataaatccaacctatgtgtccattcatggtgaatttgatcaagaaaatatggtacatgtatacaatggaacactatgcattcacagaaaaagaataaaatcatgtcttttgtggcaacatggatgcagctggaagtcaacattctaagcaagctgatgaagaacgagatgatgagagtcaacgggagatgaagctgacgttttgggtttgcctgtgtgtaaaatggagaaaagaaatcacctgggcacatagactcttaaaatagccaagtctggagccactcatatcccagtttccatttcattaggttttaatctttgtcatttttagcgagttaaatttggttttctttactcttggctaaaataaccacacgtcctgaattagaggcattgcaatcaaaaggtcatatttgaagcttacaagtcccaagtcaggtcaaagttagtgtgggattcagtgtgatagataggagacatggctggatactaagaatgggctcagggttattttacctaagttaggaaaattttttgacatcccttctgttagatttcattggaaacctttgttctaataccatctctgatagattatacctcaataattaagctggaggttatgaattagtaatttaaattaatagtggaagcctccatctagaatatatttctctaccaagtgtaaagttagctcagacggcagaaataactgcactcagcagagcttgtcagtaaggcaaagacatacacaaacacatttattgcaagggtagtgcatgacttggaagtgatccacacacaaaggattctcgcattgtctagaacacgtcaaaatggacaagggaagggattgtaaatgcactcctaagtcctggagacctgactaacataacataggaagaaaaggcaaagaaaaaagtagcataataactaaaatacatctgtaactctatctatctatgtatttatgtttgcaactatatctctatcgaggtacgtatgtatgtatgtatgtagccatctatcatctatctatttaaagcaagcagccctaaaattgtttgtaatactatctaaaaatggaaggaactacaatcactcatataacacagaataatactgtctacagctttctggaaatgttgaaaaaattgtaacccttaaattaaaattttcaaaactttaagaaaatctcggctgggtgtggtggctcacgctgtaataccagcacttcgggaggccaaggcaggaggaccacttgaggtcaggagtgcgagatcatcctggccagcatggcaaaaccccgtctctactaaaaatatgaaaaacttagctgggtgtggtggcacatgcctgtaatatcagcttttgggaggccgaggcaggaatcgcttgaatcagggagacagaggtcacagtgagtcgagatcgcaccaccgcactctagcctgggcaacagagtgagactctgtctcaaacaacaacaacaaaaaaaaaaaaaaaaaaaaaaaaaaaggaaaaggaaaagaaaatcttggacttccttggccaaagtttctccccgtggtgttacggtattatagtcagctcctccagagtatgtccgttattacactattatttggtggctgaaagatcgtacctttagagactttacactcagtgctcaccgctgtcttattgcatgcatgcatgtgttacaaaatattgaaagtgatttctgtattataccaactccattcaccaacagattaaggctactttggtacttcatcttttcaacagtctctcatgtgtctattgcaaataaagtcatgagaaaatactgctcttgaacctcatttcaaggactcttgccaagtacttttagccaaaacaaaggagtgacttttagaatgtcaatacttaggtccatatttataaactttaaactaaaagtaaaatttcagtcaccccatgagattgagtggttccccctcttggccaaggaggcaccaaaaacacctaaaaactgagttcccagctgggcagaacaagagatcagacacacctcattatacccactcccttttgtggttcagagacaacatggaccaacactaacattaaaatggagatcataagactgacagaacagattctccggggcaataagatgccccgttataaacaagacctaaggccatgccaggcaggggttacatccctcaccccaactcttaaagaataaactgttattttcttctgtagcagcaaaataagcactgatcctgagataagcacgatttaaccaactgcagctcatcccctgactaactgaccccccattccacagccataaccccagcttggatgggacaccagattgatttcaggaattttctcctgatcagagaccactgaccatggcctggttctggccatttatggaggctgcgctctgagggtctttgtgcccctgctccagcttttggcacttagggcctaactgtaacacatttaaatgctaagtccccactgctaagtgggtcacatgtgacgtgtatgtttgctcccatattcatgtgtcatgaccacctttatgaacacgcatagcccctcctgtaatccgttgattatgtctgtttagccaacacgttcagcataaagtttctgccccaccgctcctccttgggagtgcctgtctctcgtcttcaccaatggctgtgcttcccagcctgtgaaatggctgtaatcttttataaaaagtaaaggcttattttttaaaatttgtagattgtgtgatttttcatgtaatgcaaccgaggaattaattcataaacccacccagttgtaaggctgctcaagtacgaaggggagacctgcccctccacacctgtgggtattcctcgtcaggtgggatgagagactgagaaaagaaataagacacagaaacaaagtatagagaaacaacagtgggcccagggaaccggcactcagcataccaaggacctgcaccagcactggtctctgagttccctcagtttttattgattattattttcattatttcagcaaaaaggaatgtagtaggagaccagggtgataataaggagaaggtcagcaaaaaacatgtgagcaaaagaatctatgtcgtaattaagttcaagggaaggtactatgcctggacatgcacgtaggccagatttatgtttctctccgcccaaacatctcagcggcataaagaataacaaggcagcattactgcaaatatgtctcgcctcccaccataaggtggtttttctcctatctcaaaattgaacaaatgtacaatcgggttttataccaagacattcagttcccaggggcaggcaggagacagtggccttcctctatctcaactgcaagaggctttcctcttttactaaccctcctcagcacagaccctttacgggagtcaggctgggggacggtcaggtctttctcatcccacgaggccatatctcagactatcacatggggagaaaccttggacaataccccgccttcaagggcagaggtccctgcggctttccacagtgcactgtgcccctggtttattgagagtagacaatgcggatgacctttatcaagtatactgcttgtaaacattttgttaacaaggcacgtcctgcacagccctagatcccttaaaccttgattttatacaacacatgtttttgtgagctccaggttggctcaaagtggctgggtcaaaatggctggggcaaagctacaaattaacaacatctcagcaaagcaattgtttaaagtacaggtctttttcaaaatggagtctcttatgtcttccctttctatatagacacagtgacagtctgatttctctttcttttccctagtgaaggacaccaagctgagcattcccatgtatcctgtaaggcctgagatatattgaagaaggacttgacccgagaccctcagagcaagctgatgatctcacagagtgaagagcttccacccaggacattggtccaagatccctgttcaatttgttcttctctttctttttgttatgtgcttacacttaaaaaaactctattttctgcagacctatttgctgtccacccagagtgaacacttacctcatttttcactcatttgcttaagttgctaagtagaataagtcatcagactctattttgatgcctcattactgatgacaggattaatccttttccttcacttttgtcccccacacatgggaaatttagtagaaaatcatggaagtgtcctcactggatgccagtattaggttcaaattatacaagctccttccccttagtaggaagccccaccattccttcaacaccaaaccatcataaaaaccctgaggcagcttctttcctgctctattgagccagtttggactttattgagaggcctgtgcagccctcagcagacgcctcaataatggagttggtaaatctttccatattcacgtggtgtgtgaatgtggcaccatcagactcgacatccacactaaacattggtgagggtatctcttcctttgcatggggtcacctgcaattggagctgtgagcttgggtcctgacagtgaccaccacgggcactttcttctcttgcactggatactaactccttccgccccagtgtctggcatgcaccgtatcctgcctgctgcttgctggccctttcagtgctgtcatgctgggctgcagtgttgagttaaacaaagtgtcttttatagatttagctgatttacttcagaagcattgataattgacatttaaagacaagattaagcgactgtaggaaactgtcttttacacatgtgagaagatttttcttttattaaaacaaacattttcatt

SEQ ID NO: 1311 - DNA, 2697 bp, Homo sapiens
gaaatgttagcaattaacaaccgtcaggagaattttctaagtgctgctctcttataaggcctgcggtatggagcactttgatgacatctcagattcaaagccatgtgtgactggtttgaacaccattggaatcccaggccaggcagctcatcctgtctctggacccagggttcttgtgtgggtcggctttcctgcatgcatctttgggttctaatgcgtatcaatctattgacacgcagagtgctgactcttactagtgaattcaatcataaatagcatgaatattgtgtagttttagccaatattgtgggaaaggatattggactctaaagggtagggtaatcattcctttatgttggccaaattcttttcctgtattttttttttttttagagacagggtctcattctgtcacccaggctggagtgcagtgacatgatcatagctcactacaacctcgtgctcctggtctcaagtgatcctccagccttggcctcctgagtagctgggattacaggcatgcgccaccatgcctggctgtttctcattttttatttttgtagagaggagggtctgactgtgttcccaggttggtctcgaactcctggactcaagtaatcctcctgcctcagcctgctaagtaggtgggacaataggtgtgtaccacaactttggactaatttttaaatttttgtagagacggggtcttgctatgttgcccaggctggtttcaaactcctggccttaagtgatcttctgcctcagcttcccagagtgctgtgattacaggtgtgagccactgtgtccagccatttttcctgagtctttttaaaaaatagtttttattaaatattgagaggtataaaatatttaaaatatgtaaattttaaagaataaaaatacaatacaaatctttgtatctttcacccaagttttagaagaacctttgcgatccccactgagtaaaggtaacaccactgctctgaattttatcatttcctattcgtcagagttgtatcacatacttgaatctgtaaaaatacattgtttggtttctcatgcttttcagcacgcagacatgtctgtttttttgcgcttcactttactgtgctctgtagagactatatttttcacaaattgaaggtctgtggcaaccctgcatcgagcaagtctgtcagcgccgtttatccacagcatgtgctcactttgtgtgtgtgtgtcacgttttggtagttctcataacatctcatattttttcgttattatatgttatggtggtctgtgatcagtgatctttgatgttactactgtaattgttttggggcatcaagaactacacccgtatgaggcagcagatttaatgtataaatgtgtgtgtgctgactgcaccactgacttggccattcccgtctctcccccttccccagggctccctattccttaagacacaaaaatgttgaaattagggcaacattggcccctaatttcaataataatgatgacctctaaatgttcaagtgcaaggaagagttgcgtgtctttcgtgctagcttttattttatttaattaattaattagtttatttgagatggagtcttgctctgtcacccaggctggagtgcagtggcatgatctcggctcacagcaacccctgcctcctgggttcaagcgattctcctgcctcagcctcccgagtagctgggattacaggcgtgcacgaccacacctggctaatacttgtatttttagtaagagacggggtttcaccatgttggccaggctgatctcgaactcctggcctcaagtgatctgcctgcctcggcctcccaaagtgttgggattacagtcttgagccacctgtaaagagtctgagttctttacttacaatcttttagttcactgagctggagaccccagggaggtcccagcattgtatggaaaacggaccccctaacttgggctgcctgggttttgtcctcaggaggagtctgtgttgctcagacatattcggcaaatgccctttaggcagaagcttactttagtgctttgcttacttatctccttgggtgcctaatttcttttcgtgtttaccagctgagcagctgatttagaaacgttttctatagttggtacagcatttttagcttttgttacagcaagagtgttggagtaccttctctctcagagctcaggaaatggatttgtttttaaaaatcttttttccatgatcgtaaagttatgttcatcatagcaaacatgcgaaagaaagccagagtagaaaacactaaaagtaaattaaaaattggccccaatctcataatactcagagataaaaagttagcatgttaatctgttaccctctaacttttttattcatacagttaagatgactagacaacaacaggcttagattgtatttttattaaattagttctctacacttctaaatatagctctgatttaatatcacgatgtgtgctttcattgtgggtgggcataagaaaagatcccttggaaaatcctctgtctgctatgaagctggagtagacactgtcatgttactcagcataccatttccaggagtccttttaatacatttctccggaattgaggccactatgtcatctcacttaatttgcgtatttccccttatgagcctgtgagagctctccctccctgcctcccttactccttccg

SEQ ID NO: 1312 - DNA, 4601 bp, Homo sapiens
tgcaaaagattgtgaaagaaatttaatgttttttcttttttttcaattaaactgaaattttaatgtaacaaaattaaattttgcagctgaagctgggatgcaactaatgcattctctatgagaaaatttatgttacttatacttacatttaaaaataagaaatgcataaaataagaaacctgatcatttgtcttaatgagattcttttttttttttttaatctgaggaattgccacactgtcttccacaatggtcgaactagtttacagtccaaccaacagtgtaaaagtgttcctatttctccacatcctctccagcacctgttgtttcctgactttttaatgatcaccattctaactggtgtgagacggtatctctttaattttttaattttattattattatactttaagttttagggtacatgtgcacaatgtgcaggttagttacatatgtatacatgtgccatgcttgtgtgctgcacccattaactcatcatttagcattaggtatatctcctaaagttatccctcccccctccccccaccccacaacagtccccagagtgtgatgttccccttcctgtgtccatatgttctcattgttcaattcccacctatgagtgagaatatgtggtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatgcccagtaatgggatggctgggtcaaatggtatttctagttctagatccctgaggaatcgccacactgacttccacaatggttgaactagtttacagtcccaccaacagtgtaaaagtgttcctatttctctacatcctctccagcacctgttgtttcctgacttgttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccagtttttgatggggttgtttgtttttttcttgtaaatttgtttgagttcattgtagattctggatattagacctttgtcaaatgagtaggttgtgaaaattttctccagttttgtaggttgcctgttcaaaaacaacatggtactggtaccaaaacagagatatagattaatggaacagaacagagccctcagaaataacgctgcatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggctttttctgcatctattgagataatcatgtggtttttgtcattggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcacaaggaatggtaccagttcctccttgtacctctggtagaattcggctgtgaatccatctggtcctggactctttttggttggtaaactattgattattgccacaatttcagagcctgttattggtctattcagagattcaacttctatgctcatgggtaggaagaatcaatatcgtgaaaatggccatactgcccaaggtaatttacagattcaatgccatccccatcaagctaccaatgattttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaacaaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaacctcatcaaaaagtgggcgaaggacatgaacagacacttctcaaaagaagacatttatgcagccaaaaaacacatgaagaaatgctcatcatcactggccatcagggaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggaccataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaattaaaaaaaaaaaaaaaaaagaagcataattcaaaaaaaaaaaaaagaaaaagaaaaacagtgtttggggcagaattaataaaaaaaaaaagtaaaaaaaaaaaaagaaaagaaataacgctgcatatctacaactatctgatctttgacaaacctgagaaaaacaagcagtggggaaaggattccctatttaataaatggtgctgggaaaactggctagccatctgtagaaagctgaaactggatcccttccttacaccttatacaaaaattaattcaagatggattaaagactttaacgttagacctaaaaccataaaaaccctagaagaaaacctaggcaataccattcaggacataggcatgggcaagtacttcatgtctaaaacacgaaaagcaatggcaacaaaagccaaaattgacaaatgggatctaattaaactaaagagcttctgcacagcaaaagaaatttaatg

SEQ ID NO: 1313 - DNA, 5362 bp, Homo sapiens
gaaatgttagcaattaacaaccgtcaggagaattttctaagtgctgctctcttataaggcctgcggtatggagcactttgatgacatctcagattcaaagccatgtgtgactggtttgaacaccattggaatcccaggccaggcagctcatcctgtctctggacccagggttcttgtgtgggtcggctttcctgcatgcatctttgggttctaatgcgtatcaatctattgacacgcagagtgctgactcttactagtgaattcaatcataaatagcatgaatattgtgtagttttagccaatattgtgggaaaggatattggactctaaagggtagggtaatcattcctttatgttggccaaattcttttcctgtattttttttttttttagagacagggtctcattctgtcacccaggctggagtgcagtgacatgatcatagctcactacaacctcgtgctcctggtctcaagtgatcctccagccttggcctcctgagtagctgggattacaggcatgcgccaccatgcctggctgtttctcattttttatttttgtagagaggagggtctgactgtgttcccaggttggtctcgaactcctggactcaagtaatcctcctgcctcagcctgctaagtaggtgggacaataggtgtgtaccacaactttggactaatttttaaatttttgtagagacggggtcttgctatgttgcccaggctggtttcaaactcctggccttaagtgatcttctgcctcagcttcccagagtgctgtgattacaggtgtgagccactgtgtccagccatttttcctgagtctttttaaaaaatagtttttattaaatattgagaggtataaaatatttaaaatatgtaaattttaaagaataaaaatacaatacaaatctttgtatctttcacccaagttttagaagaacctttgcgatccccactgagtaaaggtaacaccactgctctgaattttatcatttcctattcgtcagagttgtatcacatacttgaatctgtaaaaatacattgtttggtttctcatgcttttcagcacgcagacatgtctgtttttttgcgcttcactttactgtgctctgtagagactatatttttcacaaattgaaggtctgtggcaaccctgcatcgagcaagtctgtcagcgccgtttatccacagcatgtgctcactttgtgtgtgtgtgtcacgttttggtagttctcataacatctcatattttttcgttattatatgttatggtggtctgtgatcagtgatctttgatgttactactgtaattgttttggggcatcaagaactacacccgtatgaggcagcagatttaatgtataaatgtgtgtgtgctgactgcaccactgacttggccattcccgtctctcccccttccccagggctccctattccttaagacacaaaaatgttgaaattagggcaacattggcccctaatttcaataataatgatgacctctaaatgttcaagtgcaaggaagagttgcgtgtctttcgtgctagcttttattttatttaattaattaattagtttatttgagatggagtcttgctctgtcacccaggctggagtgcagtggcatgatctcggctcacagcaacccctgcctcctgggttcaagcgattctcctgcctcagcctcccgagtagctgggattacaggcgtgcacgaccacacctggctaatacttgtatttttagtaagagacggggtttcaccatgttggccaggctgatctcgaactcctggcctcaagtgatctgcctgcctcggcctcccaaagtgttgggattacagtcttgagccacctgtaaagagtctgagttctttacttacaatcttttagttcactgagctggagaccccagggaggtcccagcattgtatggaaaacggaccccctaacttgggctgcctgggttttgtcctcaggaggagtctgtgttgctcagacatattcggcaaatgccctttaggcagaagcttactttagtgctttgcttacttatctccttgggtgcctaatttcttttcgtgtttaccagctgagcagctgatttagaaacgttttctatagttggtacagcatttttagcttttgttacagcaagagtgttggagtaccttctctctcagagctcaggaaatggatttgtttttaaaaatcttttttccatgatcgtaaagttatgttcatcatagcaaacatgcgaaagaaagccagagtagaaaacactaaaagtaaattaaaaattggccccaatctcataatactcagagataaaaagttagcatgttaatctgttaccctctaacttttttattcatacagttaagatgactagacaacaacaggcttagattgtatttttattaaattagttctctacacttctaaatatagctctgatttaatatcacgatgtgtgctttcattgtgggtgggcataagaaaagatcccttggaaaatcctctgtctgctatgaagctggagtagacactgtcatgttactcagcataccatttccaggagtccttttaatacatttctccggaattgaggccactatgtcatctcacttaatttgcgtatttccccttatgagcctgtgagagctctccctccctgcctcccttactccttccgtcctcttcttttctatgttattccaccttgcttttcataaacgatcaaagcatatgccaattgtagtatttatctcatctttggttttattattttttaattaattagtttgacacggagtctcgctctgttgcccaggctggagtgcagtggtgcgatctcggctcactgcaagctccgcctcccgggttcacgccattctcccgcctcagcctctccagtagctgggactaaaggcgccgccaccacgcccggctaattttttgttatttttagtagagacggggttcaccgtgttagccaggatggtctcgatctgacttcatgatccgcccgcctcggcctcccaaagtgctggggtgagccaccgctcccggtctactatttttatttttattttttttttgagatggagtctcactctgtcgcccaggctagagtgcagtggcgggatcttggctcactgcaacctctgcctcccaggttcaagcaattctcctgcctcagcctcctgtgtagctgggactacagatgctggccaccacgcatggctaatttttgtatttttagtagagacggggtttcaccaaattggtcaggctggtctcgaactcccgacctcaggtgatcgcccgcctcagcctcccaaagtgttgggattacaggcgtgagccactgcgcccggctctatttttatttttatattttttgagacagggtcttgctccttcgcccaggctggagtgcagtggcacgatcctggctcactgcaacctcctcccaggttcaagcgattctcctgcctcagccttccgggtagctgccattacagttaatattacacaccaacacataaacatcattggaaaggaaatagtatggtctagattataaacaagttgcccttataactaaatgaagtaagctaaataaagtgaggctgggagtatagcctcctttttacagtcctaatttaaaatatcctaagtttagtaaatatattagttaggactgagcagctagctcgaataaacaccagcagggccatggtactgttttatggtttttagaacaaggttaacagaaaaatggtcaacatacaggtatgcaacaaatctcaataaatgatactggatctcaggtgtacacaaggaaagcatcacccacaaaggcaggacattggatacccaggttagctgaataagagaaactcaaaaatgattttcatggctgggcacggtggctcacgcctgtcattcccagcactttgggaggctgaggtgggcagatcacctgaggtcaggagttcaagaccagcctggctaacatggcaaaaccatttttagtctctaataaaaatagaaaaattagctgggtgtggtggtgcatgcctgtaatcccagctactctgtaggctgagacacgagaatcgcttgaaccccggcagggcggaggttgcagtgagccaagattgttatcactgcactccagcctgggtgacacactgagacactgtcaaaaaaaaaaaaaaaaaaaaagattttcatgaaactaagcttggtaatcactatatatatacacacatacatacatatatgtatttttttttttttttgagatggagtctcgctctgtcacccaggctagggtgcagtggtgttattttggttcactgcagcctctgcctcctggggttccagcgattctcctgcctcagcctcctgggtagctgccattacaggcatgtgccaccacacccagctgattttttgtatttttagtagagacagggtttcaccatgttggccaggctggtctcaaactcctaacctcaggtgatccacctacctcggtctcccaaagtgttgggattactggcgtgagccatggcacccagcctattttttttttttagtaaaaagagtcttttgatcatattgttccctttcaaagctgctgccacattttgtttttattttttgagacacggtctcactccgattgcccaagctagagtgcagtggcacgatcatgctcactgaagcctcgacctgggcacaagtgattctttgacctcagcctcccaagtagctgggactacaggcacacaccaccacacctggctaattcttataatttttgtagagacggggttgtaccatgttggccaggctggtcttaaactcctggactcaagtgatcctcccaccttggcctcctaaaatgctgggattacaggcaagaaccactgcatctggcctgcttccatgtttttaagttacaattcaactctattgctgataaattttgttgtgtaggagatgcatgtcttgggttgactaacttaagagttactagctatggagtcccacagaatactaaaaccatatagtaaaccagtcttccagaagataatggatgtttcagttgtaaagatgtaaatttgtatttgaagtgttatcattggctaatataaaatagattttttactagattagcaatcaaacaaaaatttaattatcgaaagtcaattaagtactaaaacacacacatacatacactccctctctcacacatttcaaaaataagatgcaaggcacataagcagcattatatcaaaccagaatgcattaggatattgattatatttaaataattatttttc

SEQ ID NO: 1314 - DNA, 7745 bp, Homo sapiens
tgcaaaagattgtgaaagaaatttaatgttttttcttttttttcaattaaactgaaattttaatgtaacaaaattaaattttgcagctgaagctgggatgcaactaatgcattctctatgagaaaatttatgttacttatacttacatttaaaaataagaaatgcataaaataagaaacctgatcatttgtcttaatgagattcttttttttttttttaatctgaggaattgccacactgtcttccacaatggtcgaactagtttacagtccaaccaacagtgtaaaagtgttcctatttctccacatcctctccagcacctgttgtttcctgactttttaatgatcaccattctaactggtgtgagacggtatctctttaattttttaattttattattattatactttaagttttagggtacatgtgcacaatgtgcaggttagttacatatgtatacatgtgccatgcttgtgtgctgcacccattaactcatcatttagcattaggtatatctcctaaagttatccctcccccctccccccaccccacaacagtccccagagtgtgatgttccccttcctgtgtccatatgttctcattgttcaattcccacctatgagtgagaatatgtggtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatgcccagtaatgggatggctgggtcaaatggtatttctagttctagatccctgaggaatcgccacactgacttccacaatggttgaactagtttacagtcccaccaacagtgtaaaagtgttcctatttctctacatcctctccagcacctgttgtttcctgacttgttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccagtttttgatggggttgtttgtttttttcttgtaaatttgtttgagttcattgtagattctggatattagacctttgtcaaatgagtaggttgtgaaaattttctccagttttgtaggttgcctgttcaaaaacaacatggtactggtaccaaaacagagatatagattaatggaacagaacagagccctcagaaataacgctgcatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggctttttctgcatctattgagataatcatgtggtttttgtcattggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcacaaggaatggtaccagttcctccttgtacctctggtagaattcggctgtgaatccatctggtcctggactctttttggttggtaaactattgattattgccacaatttcagagcctgttattggtctattcagagattcaacttctatgctcatgggtaggaagaatcaatatcgtgaaaatggccatactgcccaaggtaatttacagattcaatgccatccccatcaagctaccaatgattttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaacaaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaacctcatcaaaaagtgggcgaaggacatgaacagacacttctcaaaagaagacatttatgcagccaaaaaacacatgaagaaatgctcatcatcactggccatcagggaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggaccataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaattaaaaaaaaaaaaaaaaaagaagcataattcaaaaaaaaaaaaaagaaaaagaaaaacagtgtttggggcagaattaataaaaaaaaaaagtaaaaaaaaaaaaagaaaagaaataacgctgcatatctacaactatctgatctttgacaaacctgagaaaaacaagcagtggggaaaggattccctatttaataaatggtgctgggaaaactggctagccatctgtagaaagctgaaactggatcccttccttacaccttatacaaaaattaattcaagatggattaaagactttaacgttagacctaaaaccataaaaaccctagaagaaaacctaggcaataccattcaggacataggcatgggcaagtacttcatgtctaaaacacgaaaagcaatggcaacaaaagccaaaattgacaaatgggatctaattaaactaaagagcttctgcacagcaaaagaaatttaatgttttttcaacatatttcagttaaacatggcttacctttataaacagcatatttatttcaagctataaatatgttttataatctgtaaatttttagaaattttaagtctagcgatgaagctttcatatgagaaagtgcacattttatatatgtttaaaatattaatttttcattaaagtgtgtaataacacatgaatagaaagcataaattaagtcataaatttagacaaatattttgaatcattaacttttttttttttttgcttatctctgagtctgttaaaagtactttgttcttacacaataagaattgaatactttttggaagaagtgagatgctttttcttttcattttctccttttttctttgagtgtgagttgatttttttttttttataaggtagttagttgttcatgctgctagtgacttaaccatcatactgaaatgttttgaccttggtagaaaatgtcctgttctttatttacttaggtccatgcctgagagatgtagttataaggaagcaaaaagttcaagactgtatctacagccatgctcaccatatcaaatacttatgttctcaactaacattaagcttggtatccaggagctcctctggctggcattggaggagtcacagctttgtggtcatgtcagggaaggggagggatcttatttgtaggcagaatcaggtatgatgtcttgttcacctaccaaatgcaggaacctgggacaaaatgaaataattttcaatgactgggaacagaccgaattgctcagtcttggcttacctgtgaatgttaggactaagggcaatagactcaaggggtcatattcagaacacacaaatagcaggttttcaggtgccccggaacaacactcctcccctgcttttggtccgtcaaatgcacttcttgtgtagatcagatatcctacccctaaggttaggcacatgactcgaaccaagtccccaagaggctttctctgagatttaaagaaaaaggcttgaagtttaccatgttttaaaggaatattttatttgcatataatctaaaacttatagaaaatggcaagaaccttataaagaactcctgtgtacattttattatgattcaccagttgttaacattttccccaactgttttgttattcatttttttatctctttatcctgtactcctaaaccatttcagagtgtgtatggtgtttgttagcccccaatattgataatgctaacataattatttatttagggtattgtttaacaggtctctccactgtaaaattaatgttttctctttggtgattgacaaagattctctccatgaccaaactttcatcaggcttctctgaactctgttcttctcaactaggtcctgacttgtgggcttctgtgttcatctttgcattgtccatttttagcaaaagttctgctatgtcagtttaaccagaatccctcactctcgctatctgattacctttgctatctgaccaaattccttaacccccactatctctcaggcaatatctgatcaccttggcctgccttcagaattctgttaggtcatttcagcaaagaattatcccactctcttaatttttccctccactggcccctctaccaacctggcttcttgtctataaattcctatatttccttattgtttttggaattaaggccaatctctcttccctactgcaaaaccccattgcggtagtttcttcttgaataaagtcttccttattgtttttaacaagtgtctgagtaatcctatatcctgcatcattacataactaatatgtttttctgcatcagtgtagattctatttcattcactggattataacctgttactatcattattttgatactcaaatagtacttagtgtagagttcttatatatacttttaatatttaaatctaaatatttttgaaattgtagtaaattgaattttaaaatttatgtgtccaattatttgcttctagaatcagaaataaacttcagcatattgattttgcattagttatctattgctgcataaccaattttattcaaatttagccccttaaaacaacacatttactccaccttttctatatggggattcacgtgaagcctagctagatacctggactcagggtctttcatacagctgcaatcaaggcgttggccaaggctgcagtcatcttatgattggatggtggggccagggtgtccacttttaggtccacttacatggctgtagactggccacaggtccttgctggttattggttgctggcatcaattccttgctatgggccttcccacaggatagctcacaatagaaccgagggcttcccttagaataagcaagtgatgcaatgtgagagggaaccctggtgaaagccagagtttctttgtaacccaatctcaaaaataaaaagtcattattttagccacttgtggtaggcacaataacacaagccttgttcccatgccaaaagaaatccacatcctaatccctggaacctgtaaatatgttatcttatgtagcaaaggggattttgtagttgtgattaagttaagaaccttaagaggattatctgggtgttccccagtaatcagagatggagaggtgccccaacagaagagtcagagagaaatttgatacactgatgactttgaagatgcaggaagggatcacaagtcagggaatgcagacatcctctagaggctggaaaaggcaagggaagtgattctgcctggagcctccagacagaaggaatgcagcccgctaacaccttgatttttgcacattgaaatgccttttggacttttaaatttcagagctctatgaaaataaatttgggttgttcaaagctactaaatttgtggtaatttattactacgggtattaggaatttaatacatggtcattttattttagaaataattcactaatacagccacactcaaagggaagagattacacaaaggcctgagtgccagggtgtggggtggccatgataaagactgcctaccacataatttgaatactgcaagcttataatttattaattctagtagttgttttgtaaatttattattttccacaaaaaatgttatgtaaattatgcctacatgattttgcctttaagaaaa

SEQ ID NO: 1315 - DNA, 14738 bp, Homo sapiens
cgttgaagtgttaaaacaagaatagagtaagtcctgtgctaatcctgacacaagatagcaggctctggggatgataatgcctgctgctgatgggcggaccagggattagcaaccatccagggaatatgcttcagataaactaaacaggaggtaggatgatgccatggaaaaggcatggactttgaagtcaggtatatcaagttcaaatcctaggtctgctagttgctagtttcacaaagtacttaattttctgatcctcaatgggatattaagagttatcttgggccgggcacagtggctcatgcctgtaatcccagcactttgggaggccgagttgggtggatcacaaagtcaagagatcgagaccatcctggccaacatggtgaaaccccgtctctactaaaaatacaaaaattagctgggtgtggtggtgcacgcctgtagtcctagctacttgggaggctgaggcaagagaatcacttgaacctgggaggcggaggttgcagtgaaccaagattgagccactgcgctgcactccggcctggcgacagagtgagactccatcccgccaccacccaccaaaaaaaaaaatttatcttgggccaggcgtggtggctcacgcctgtaatcccagcactttgggaggctgaggcaggtggatcacctgaggtcaggagttcaagaccagcctgaccaacatggtgaaaccccatctctactaaaaatacaaaaattagctgggcacctgtaatcccagctacttggaaggctgaggcaggagaatcgcttaaacccaggagacagaggttgcagtgagctgagttcatgccattgcactccagcctgggcaacaagagtgaaacttcatttcaaaaaacaaaagagttatctcgtatttcttggttgttttgccaattaaagttaaggtatataaacaataataatagtaataataatgagtgctaacaatgattgagaccttagtgcaggccctctgctaagtgttttaactgcattatctcatttattcttttttttttttttttttgagaggagtcttgctgtgttgcccaggctagagtagagtggtacgatctcggctcaccacaacctctgtctcctgggttgaagcgattctcctgcctcagccttcgaaatagcagggatttacaggcacgccaccacacccagctaatttttgtattttttagtagagacggggtttcaccatgttggccaggctggtctcgaactcctgacctcaggtgatctgcctgcctcggcctcccaaagtgctgtgattacaggcgtgagccactatgcccagccacatttattcttaatagcaactctctgtggtacatactacctggcaattagaagatgctcggcagatggtatatattagtatcatttgtttaaaattaataaataataaaaatattaaatctggcccattgtctgttttcgtagtccatgagctaagaatggtgtgtaaatttttaaatggttgggaaaaaaattaaaatagaggccgagtgttgtggctcacacttgtaatcccagtgctttgagaggctgaggcaggaggatcacttgaggccaggatttcaagaccagcctgggtaacatagcaagaccccatctctacaaaattttaaaaattaggcaggtgtgttggcgcacgcctgtattcacagctactcaggaggctgaggcgggaggatcactggaggctgcgaggttgaggctgcagtgagccatgactgcaccactgcactccagcctaggcatcagaatgagaccctgtctgcaaaaataataataaaaataaaaaaataaatcaggccaggtgtggtggctcactcctgtaatctcactttgggaggctgaggtgggcagatcacttgagaccaggagtttgagaccagcctggccatctctactaaaaatacaaaaattagccgggtgtggtgttgggcgcctgtagtcccagctacttggcaagctgaagcacgagaatcacgtgaacccaggaggcggaggtttcagtgagttgagattgccccactgcagtccagcctgggtgacagagcgagactctgtttcaaaaataataataataatattttatgacatgaaaataatataaatttaaatttcagtgtttataaggtttccttggaacacattcacgcccttttgtttacatgctgtctaaagatgttacatgccatctaaagccatcagcactgcattagtcttcagtggctgtgatggagatacgaatgacctgcaaagccctacatgtttactatgtggcccttgacagaaaacgttcgctgatccctgatttagaacaagacctccaggggccgctacagaacagaaactcagccgacctctgtgttagcaagatcgcccaggggtgacttttcagacacggaatctggtaggagtggaaatcccatctgcccccttgttgagacccatggacaaggcctgtgctggacagtcccagcatccacatgggccgggttgaggagagaaacagggctggggccaagcccatctggggccagaacttagtggagcaggctgagaaatctgggatctctgagctttttgtttttatgctttcgtatttgtttgcttttccctttgtgttttagcaaaaattctcttttaaaattctcatctaagctaaatcaaggaggagaaatgatcggttcacatctgggccaggatagagtccaaagttcttcattgttcttaagccatgctgtgtctgcctggcccctgtcacttccttgtcaggactcccctcctgatcgctccctacccccggctctactcaggccgtgcagctcgcagcacccaggaagaagtctgttacacctttcatgctgttttatcctctgcgggtccctccgtttcccacccctccacaccttcccaacctggcggaatcctcagccttcaagattctgctgaagtgccacctcctcttccgggaggcccttcctggctctttctgcccatcctggaagagggaagagatgaccacatctgcttttttttttttttttgagatggagtctcactgtgttgcccaggctggagtgcagtggcggaatctcagctcattgcaacctccacccccgggttcaagtgattatcctgcctcagcctctggagtagctgggattacaggcgtgcaccaccacacccagctaattttctgtatttttagtagagacgggttttgccatgttggccaggctggtcttgaactcctgacctcaagtgatccgctcgcttcggcctcccatagtgctgagattacaggggtgagccactgcacccggctgacatctgcttttttgccacactctacctcctatcctaccacctgtcactctgcatgggcgatgtccactgtctgtggattctttcctgttagcgatgacgttgtaaacttagcaccccacacggctcctggaccatggtaacctggagtgtgtgaaggctgtaaatgaggatgagtcctctgaaggaccgggaggaatgaactttctagctcaagaactagaaattcctcaataaaagatgatgttgatgaatggaaactgaagcaaggaaggcctagggtggcaacgttcctgcctgggcttttttcttttcctttatgtgaaggatattgaataattcagtaggaaatacccttaactataaaagacagaaaacactaagcaaggaatggtggcacacacttgtagtcccagctactcaggaggctgaggcatgaggatcacctgagcccaggagtttgagaccagcctgggcaacatagcaagactggtctcttaaaaaaaaaaaaaaaaaaaaaaaaattggccgagcgcagtggctcacacctgtaatcccagcactctgggaggccgaggcgggcggatcatgaggtcaggagatcaagatcatcctggctaatgcagtgaaaccctgtgtctactaaaaaatacaaaaaaaaaaaaaaattagccaggcatagtggcgggtgcctgtagtcccagctacttaggaggctgaggcaggagaatggtgtgaacctgggaggtggagcttgcagtgagctgagatcgcaccactgcactccaggctgggcaacatagtgagacccccccacaactccacacacacacacacacacacacacacactattcaaacagaatattcatgtaatacctctccaaggacttccagcacaaggctacattgtaattcagagaagacatttcaggaggggctgagacaatattgtccaacaactttgttgatgataaaatataaggatagaattttcttttcttttttaatagagatggggtttgccatgttggccaggctggttttgaactcctgagctcaagcaattcgcctgccttagtctctcaaagtgctggcattacaggcatgagtcactgcccccggccgaggatagaatttgaaaaatgcaaatgttggtccagcacagtggctcacacctgtaatcctcacactttgggaggctgaggcgggtagatcacatgaggtcaggagttcaagaccaccctgggcaacacggtgaaaccctgtctctactaaaatacaaaaaaattagctgggtgtggtggtgcgcacctgtagtcccagctgcttgggtggctgaggcaggagaattgcctgaacccaggaggcggaggttgcagtgagccgagatcgcgcgactgcactccagcctgggtgacagaccaagactccatctcaaaaaaaaaaaaaaacaaatgtctaactcgccaggagacaagatctttcaagtacagatatctcacatgagctcttatcaccctcaacggaatcttgtcacaggacaaggaaggattggggctggaaggatcttacctaatagcctcttggtatctgctctctccaagggcaatatctgcccttaagagaattgttgtctgtaactttgatctcaactgggtgattgctgagctctcaagacctttatcttacaagcacagtttgagttggttttttcatgctctcactctagcctaggaatcctttcggccactttgggcctgttgtgagttcctagggtggcagatctccatgaacttgcccgtttactctgcggaaaacttagtgttatagcaggttggcgcgtggtggcttacgcctgtaaccccagcactttgggaggctgagacaggtggatcacctgaggtcaggaattcgagaccagcctggccaacatggtgaaaccctgtctctactaaaaatacaaaaattagctgggcatggtggcatgtgcctgtaatcccggcttgaacccaggaggcagaggttgcagtaagctgagatcccgccattgcactctagcctgggcaacagagtgagactgtctcagaaaaagaaagaaagaagcgggtggagggggtggggcggggagagggagggagcggggaagggaggaaggaaacatagtgttatatcagccaacctaaaagttcctctttcaggtcattaatgaaaaatatcccagtaataacattcctttataaaagaaaccttttataaatcagtcgttttattgtaatcaaacttctagattccattctttctgaacaggttctggtaaaatgggaacggtttctattaatcaactggactctcctagcttagtcgattttctagccagctttctctctctcctgttctccgcagcagattttcaaacaccgcattccccttaaacctcccaggctcccatcactcccagcaaagagccagcccgctactttatggagacaggagagactgtcagacagttcctgctgctgcccaggtgcatctgagtaagtttttctctctttctatcccattccagctgaagaagtatcactcctttgattagggccaacctttaaatctgtcgattgagtcagtatgatagtggcctgtgtctataatcccagctactcaggaggctgaggtgggaggatcacttgagcccaggagtttgagaccagactaggcaacatagcaagaccccatgtctgaaaaaaaaaacaatcaatctgtggattggcctgtgctctaggccttctccttcctcccttctctaggatctctcttattgatgatcacctctcctgcatccttctcagcctttgcaccttgtcccatctcatccatcaaaatccgtcttcctccagcaaccctcctcttcacagcccagcttcttggcttagaattatttctatccagggacctccttcctcctcggctccccagctgccttcactctggcttctattcccctggctgcaatgaaactatccttgcaaaagtcacaaccaattccctgctgctaaacccaatgtatgtgtcctagtccttatctaacttatctcctgaaagcatttggctttcctgacgcacgtgtctttgagaaattctcttctgctggccctgtcctctcccactttctttcctccttttcctcgtgctatttgttcttggtcttatcttcctggatcccttcctccatggcatttctgccctgggccccctactctccctgtacccatcttcttggaattcttttggttccaagtgacagaacccaaactcatggttttgttggtagtggtgttttgcttggttggttgtaacagccaagcaaagggatagttgagtttatggagctatttatggttgcacaattaactccataaactcaaccaactaaaacaccactaccaacgaaccctatgacaaaggaaatgcattatttcatgcacctgaaaatcctgaggtagatctgtgatatctggcccagagacataaagtaaggtcgtcatgctcagcctccctctgcctgtctcttggtttgttttcctctgttcgctccactctcaggcagcctctttccaagtgatggcaaaatgcctgccagcatctccaagctgagacccagtccttttacccagtccttttagcaaacacaagacaatcttctactcaatttcttaagctggaagtctaggattcttttgttttgttttgttttttgagacggagttttgctcttatcacccaggctagagtgcagtggtgcaatctcagctcactgcagtctctgcctcccgggttcgagcgattcttctgcctcagcctcctgagtagctgagattacaggcatgtgccaccatggctggctaattttgtatttttagtacagacggggtctcactatgtttgccaagttggtcttgaactcctgacgtcaggtgatccgcccacctcaacgtcccaaaatactgggattacaggtgtgagccactgagcctggctaggaataatttttttttttttttttgagatggagcctcactgtgtcacccaggctgcagtgcaatggtgtgttcttggctcaccacaacctccaactcccaggttcacgcaattctcctgcctcagcctcccaagtagcagggactacaggcgcccaccaccacacctggctaatttttgtatttttagtagagacaggttttcaccatgttggtctggcccgtcttgaactcctgaccttgtgattcgcctgcctcggcctcccaaagtgctgggattacaggcgtgagccaccgcgcctggccaggaatcatttttgactcctcttccccaacatcggcttagtcaccaagtccagtcccgggttctcaatctctctgcgtccctgctgccaataatctaattcaggtcactgtcctttgtctccatccctgtccgacctcctgggggtttcctgcctcaggttctgctgctctgcagtccgcttttcccgtcacagctgggaccatcttttgaaaatgtaaatctggtcccatcccttcgatatacaaagcacccattagcaggaagctgaagcaaaactccgtgttacgttttctgaaaggtgctgcctgctgcggctcctgcctgcccctgcctgcctacctctttatacttcccctcttggtccctgcggtttggcctctgatgccagttgagccactccctccacctggacggttcctctcctgagtccctcctgacagctgctttttgggttgcaagttagacataacttcaccgaggacagcctttcatactgaagtatgtatatactcttcctgttagaacattctactttttccatcttagcacttatcaccctttcttgtaattgcttgttaaatcacccatgggcgcagtggctcatgcctgtaatcccagcactttgggaggccaaggtgggcagatcacttgaggtcaggagttctagaccagcccagccaacatggcaaaaccctgtctctactaaaaatacaattagccaagtgtggtggtgcatgcttgtaatcccagctacttgggaggctgaagcacgagaatcacttgaacctgggaggcagaggttgcagtgagctgagattataccactgcactccagcctgagcaacacagtaagactctgtctcaaaaaaagaagaaaaaaaaatccatacccctctgcagactctaaggttcatgagtgcagatatttgctttattttgtgaaatatccccaatattacaaagtataactcaatatgtatttgttgacttgtaccataaaatgagatgcaattgtattagtggttttccaattctcttctagattttagaatttagattgattccataaactggaaaaatctaaaaatataatatctattctttctctttatttatgtgcttatggttcccccttaacaaacggtaaagtttgagaattgaaaagatcttagtaaaatctagcactaattcacttcatttgacagcttaggaaggggaggctcagagggtctccataacttgcacaaaccacagagctatttatggttgcataattagatccataaactcaaactcagagcccccgactttcagtccagggcttcaccatggtattaacacttttattagcacttttatgtatttttaacttaattatttttttgagacaaggtcttgctttgttgcctaggctggagtggagtggtgcgatcatagctcactgcagcttcgacctcctgggctcaagcagttctcctgcctcagcctcccaagtagatgggaccacaggcatgtgccactacacccggctaatttttatatttttgtggagatggggtctcaatatgttacccaggctgatctcaaactcctgggctcacgtgatcctcctgtctcagtctcccaaagtgctgggattataggcgtgagccactacgcccagctgttattagcacttttaacagactagtgtagtatgattttttttttctattaatacaaaggaatcttattgcttatagcctcacgttttactttttaaaatgtacttttggatcctgtacatctcaatagattttcaggaggaaaatcactcccaggtctgtagacgcctgtgtatcctctaaggttctgtgctccacgggtcgggttaatacctaacacattgctcacaaagagccagatattacacattgtattcagttctcctacagtttcacctcagaaggataatgactgagtagatgccatctggatttgatgatctggggaatgcttatgttatgtaaaagaagtaacagactggtttaactctgtattaaccgttccctattgcttctgtgaagtttacaggactcactgttaacttcacaggggcaatggagcagtccattatgaaacatgagcttgaaagctgtttctataagttaaggtttggaaaagaccgagcaagagtaacacttgaaaaataattattttagaattgggtatggattaaaaagcaaatattggggaaaagtatttaatttatttttttttaaacggagtctcactctttcctccaggctggagtgcagtggcataatctcagctcacttcaacctccgcctcccgagctaaagcgattctccggcctcagcctccggagtagctgggattacaggcgtgtgccaccacgcctaatttttgtatttttagtagagatggggtttcaccatgttggtcaggctggtctcaaactcctgacctcaagtgatccaccccctccccgaccccctccgccgcgtggcctcccaaagtactgggattacaggtgtgagccatggcgcctggccataactttattttaaattaaatttaaatttgatttaatttaatttatttatttgtttttcttgagacggagtctcgctctgtcacccaggctggagtgcagtggagcgatcttggctcactgcaagctctgcctcccgggttcatgccattctcctgcctcagcctcccaagtagctgggactacaggtgcccaacaccacgcccagctaattttttctatttttagtagagatgggatttcactgtgttagccaggatggtctcgatctcctgacctcgtgatccgcccgcctcagcctcccaaagtgctgggattacaggcgtgagccaccgtgcccggccttttttaatttttaattaaaaatttaggccaggcacagtggttcatgcctgtaaattctaacactttgagaagcctaggcaggcagattgcttgagtccaggagttcgagaccagcctgggcaacatggtgaaaccccatctctattaaaaaaaatacaaaattagcagggcatggggacatgcacctgtggtcccagccacttgggaaactgaggcaggacaatcacttgggcccaggaggtaaaggctgcagtgagccaagattgcaccactacactctagcctgggtgacagagcgaaacactgtctcaaaaaaaaaaaaaaaaaaaaattagggctaggtgtggtagctcatacctgtaatcccagcactttgggaggctgaggtgggaggattgcatgagtccaggagttcgaggctgcagtgagctctgattgtgccagtgtactccagtcggggagacagagcaagaccctagcattacaaaagaaatgttttaaggaaaccaaaagtggaaccgattgaccaatatattatgaaactccaatgaattgacctattccaaaaggaaattccttggccacagattgcaagtaagtgttcttcaggtgttattttttactgttaactttttttttaccttgaaattttattttaaaaattgacatgcagaaaattgatttttgggatatatagttatagacattttaattttaaatttagcatgtagaaactacttttaaaatgacttttatataaatgttgagtagatgcaaaagaaaatgtgcaatacaggtgtagggtacagaaataataacaacggtgggccaggcgcgctggttcacgcctgtaatcccagcactttgggagaccgaggcagatggatcacctgagggcaggagttggagaccatcctggccaacatggtgaaaccccatctctactaaaaagacaaaaattagccaggtgtggtggtgggtgcctgtaattccagctactcaagaggctgaggcagaagaatcgcttgaacctgggacgtggaggttgcagtgagcctagattgagccacttcactccagcctgggtgacagagcaagactccatctcaaaaaacaaaaaaaagaacaccacggtgaatcctgtgtactcatcaaccattttaagaacataatggcttgtcttagaggcccccattggcccattctactccctttgttccccctaagaagtaaccaccgtcctgaattttgaacctatcattctcctgctttctttttttttctttttttcttttttgagacagagtctcgctctttcgcccaggccggactgcagtggtgctatcttggctcactgcaagctctgcctcccgggtttacgccattctcctgcctcagcctcccgagtagctgggactacaggcgcccgctaccacacccggctaattttttttttgtatttttagtagagatggggtttcaccgtgttagccaggatggtctcgatctcctgacctcgtgatccaccagcctcagcctcccaaagtgctggtattacaggcgtgagccaccgcgcctggcctctcctgctttcttttattacatgcatttgtatttcttaacaatataggttttgtttttgttttatgatacagggtcttgccttgtcacccaagctggagtacagtgtcacaatcacagctcactgtaggttcaacctctccggcttaagtgaacctcccccctgagcctcctgagtagctgggaccacaggtgggcaccaccacgcctagctaatttttaaatttttgtagagatagggtctcactctgttgcccaggctggtctcaaactcctgggataaagtggtcctctgcctcggcttcccaaaatgctgggattatgggcatgagtcattgtgcccagcctaagcaatatgtttttaaaacatttttacagtttgatttttttttttagcttgacttttagatgaatgaaattatactatttgcatacttatgagccttttttttgctcaatattatgtttttgagattgattcattaaagatggatgtgattcatttatttagggtagtactctattatataaagagatcacaattatcagtttcactattggacatttaggacgtttcaagtttttctttttttcttttttgctagtgaatcagtgctgctatgaacattactctgggtgtatgcttggacatagaatctctggagtacagtctcaactgttaattcaaaataaaatgtttggcccagtgcggtggctcacacctgtaatcccagcactttgggaggccaagacaagaggatcactagaggccaggagtttgagaccagcctggtcaagagagtgagaccccatctctacagaaattttgaaaattagccaggcacagtggttcacgcctataatctcagcactttggaagctcgaggtgggaggattgcttaagcccaggagtgcaaggctgcagtgagctatgatggacagagcaagaccctgtctctaaaaaataaaatttaaaagtaaattaaaatgttcaatgtatcttttcgttatgattccttgcttcaactgattatttcagttaatagaactacctactctcctactgtatgtacgtgggcttgttgtatgcttctgaatcttttcatttattataattttgcttttgaaatgaattttaagcttctcaaggactagtactggacctatggatttcacatctcttagatcttaccatggtgcctgatgcaatgttctgtatacgcctctggtgatggagttttatttccctagctattggtcaggccaactagtctttctcattttgggttaacattatcatattgttttcatcttttctcctcctttcttttcttcttaatttgggggacattgtttcttctgaaaaggggagtgagaaagggaataatagaaggaactgctcaaccagtctctcctgggggcctgcactgtatttgtcatggtacttgacactaaaaaagaaacaaacatgaaatgaaagacaagtttaaaatatatttaaaacagatgtttgtgctttaatttaaaaattccaaatgcaaccctttgacccagcaagtctacttctggaaatctatcttatggaaataattaaaactcgtgcaaaaacatttaggtctaacatgttcatctcagccttgtttataatggagaattagaaacaaattttcaaccatggggatttaacacataagtacaatggaattcctctgttaaaaataatatatatactgacacagatatttatgatttattaattggaaaacctgagctataatgtacagtgtcatcctatttttgtaaaagacaaatgtacaacaacgactaggaggatggtcacgaagaatgtatgctggtaatgaaattaaattttttttgcttatctgtgttttaaacttttctacaataaacctttattttttattataaccacttgtagtcttaccataaaataagcctttctaaagttattctctctgtttttttctttttttaagagatggggtcttgctatgtttcccaggctggtctcaaactcctgggctcaagcaatctacccaccttggccttctgaagtgctaggattacaagcatgagccactgcacctggactttttttttttttttaaagttattctcttattgattgattgattgattgatcgagacagggtcttgctctgtcacccaggctggagtgtggtgttgtgatcatggctcactgcagcctcaacttctcaggctccggagatcctcccacctcagactcctgagtagctgggaccacaggcgtgcgccaccacactgggctaatttttgtatatttggtagggatgggctttgccatgttgctcattctggtcttgaactcctgggctcaagcgatctacctgcctcggcttcccaaagtgttgggattataggcctgagccactgtgcccagcctaaagttattcttaaaaactactccagccaccagagcttatattaatgtaattattttatatagttctttttcctcagaagtaatcaattacaaataaata

SEQ ID NO: 1316 - DNA, 37375 bp, Homo sapiens
aatatgtgcttctccaaatggttttccttcttttgcctgaattcactactatctgattggcttgcataaccactaagtaaattagcatgcagagcaataggtctagaacttgcctattgattccaaatttcatttctaatctttcctatattgtaagtaaacattctttttttttttttttttttttttttgagactgagttgcactctgtcaccaggctggagtgcaatggtgccatctcggctcactgcaacctccgcctcctgggttcaagtgattctcctgcctcagcttcccaagtagctgggattacaggtgtgtgccaacatgcccagctattttttgtatttttagtagagatggggtttcaccatgttggccaggctgctctcaagctcccagcctcaggtgatccacccacctcggcctcccaaagtgctgggattataggcgtgagccatcgcccccagccagcacctgtttttaggtcatcatttctgttggggtttaagagttgaatacccatatcacattgaccaggaattaattgattgtagagacgaagtcttgctatgttgctcagtgtggttttgaactcctgggttcaaaaccctctcaaactattgggattacaggcatgagctaccgtgcccagcctttgaccaggaatttaaaatccacttattttcatgatttatattgatttctggctgaagccaacactcttcactggatttattcaactcacagatttcaatgtttggttcccatcttgtccactttaaggtgcattttatgtgcaataaaaggtgttcagacattttaaaaagattctctatttgaaatttttttagggactcctgagcctctgacatatgtcccaattaccctattctcaggtcaggctgaggtggggcatgtgcctggatccatcgaacagtgattgattggaagcaactgatgttatttctccagtagtgcttggaagcttatggttttcctctggcaaccaacaccatgttcattaataaaccagtaataggcttcttctctgtggagtttctcttgctgccatcttggttcattttcacgaatgattatggtatttacagtaggcagaatactgtccccccaccatgtccacaacctaatccccagcacatgtgaatatgttactttttgtggcaaatggactttgcagatgtaattaagttaacaattttaaatggagagattattttggtttagccacatggatccagtataatcacaaagattcttctagagtgaaagagggaagcaggagagccagggaagatgtaacaatggaagcaggagtcagagaactgtgcctgctggatttgacaaggaagagggatgcaagaccaggaacgcaggcagcctctagaagctggaaaaagcaaagaaatggattctcccgtgaaccaccagaaggaactcagctttgcttttatttttagcccaataagactcatttcaggtatctttctcctggaactgtgagataataaagttaagccactgagttcatggtaatatgttacagcagcattaagaaatgaacagtcttgttcttgttatgagctttgtttactatcttaacctgtgctagatgtagattgactcatgctgaaacaccctggctctcacattgctttccatgtgttggaagagggtctccgccttccattgttggtgcttttgtgaagtgctgctcacaggaagcaacaggagagggttgagttcttcagactgggttgcctgtgaagcccgggtgctgctgcttctctcccaccgctgctgcaaagttgaggacatgctccagggttttttttttgttaggagttctcgactgtccaggaattaggtaatccttttcctgaagataggtggcagtggggtgtggtagtggacttctctttagccagaggcagagactgggggcgggtgaaaggggtccagtggggtcggggctgtcatcacttttccttttttttttcttgttttttgagattgagtctctctgttgctcaggctggagtgcaacagtgtgatctgggctcactgcaatctccgcctcctgggttcaagtgattctactgcctcagcctcttgagtagctgggattacaggcgtgtgccatgcgccaccacgcccgactaatttttgtatttttaggagagatgggttttcaccatgttgatcaggctggtctcgaactcctgacctcaggtgatctacccacctcggcctcccaaaatactgggattacaggcatgagccaccatgcttggcctgtcatcacttttcaagaggcagtttctccttctaaatccatctcaatctccagtgagagaggagccaggagcctggctgccgtgctgcgtggtccatccaggtggaagggaaggctatggaggagagccagactcctgctctttgttttggtcagttcagaagtcacttaaccaataagtcctttcagggaaggaattcactctaccactacagaatagttttgcttcacatgttttcttgacacagaaatttgtagaaccacagcctctttcttttcttttctttttctttttctctttctttctctctttctttcctttcctttccctttctttctttctttctttctttctttctttctttctttctttctttctttctttctttctttctttctgtctctctctctctctttctttctttctttctttctttttctctttctctttctctctttctttctttcttgacagagtttcactcttgtcacccaggctggagtgcaatggtgcgatctcaactcactgcaacctccgcctcccaggttcaagcgattctccttcttctgcctcctgagtagctgggactacaggtgcccgccaccacacccagctaatttttgtatttttaatagagacagggttttgccatgttggtcaggctggtctcgaactcctgaccttaggtggtccacctgcctcggcttcccagagtgctgggattacaggcttgagccactgtgcccagccgcataattattttaactggttcataataatgagccagagttgtgctctgtcgcccaggctggagtccagtggtgtgatcacagctcactgcagcctcgacctcccaggctcaggcgatcctctcatctcagcctccctagtagctgaggccacaggcacgtgccacagtgcccggctaatttttatattttattgtagagatggggatctcactatgttacccagactggtttcaaactcctgggcctgtgatccaccttgcttggatctcccaaagtgctgggattacaggcgtgagccagtgtacccgcaatcttgcatcattttgattaggaattagtcctcagaaaccagtcatggcagcatggcagaagagacagttgaacatgtcttgctttatccactaggcatacttttttttttttttgagacggagtctcgctctgtcgccagagctggagtgcagtggcgcgatcttggctaactgcaacctccgtcttccgggttcaagcgattctcctgcctcagcctccggagtagctgggactacaggcgcgcgccaccacgcccggctaatttttgtatcgtagagacggggtttcaccatgttggccaggctggtttcaatctcttgacctcatgacctgcccgcctcggcctctcaaagtgctgggattacaggcgtgagccacctcgccctgctcactttgcatacatttgagttgggattctttcgctgcaaaacctgatcttcacctagattcaggttaatttattaactattactaatgattgtgaacagtgcattctattaaacttatttttcaggtatgcagttgtgtaaattggttagacttactacagtgtttagatctggaacgaaaacgtaaggcattttccatgtaactgcttggaacacgacagttacctgctactataaaaacggtagttttctatttatggaagagtttttcttaaacttatctagaattaaaagttaatttaaagaaagtactaattatgacaaaagcagggagtcgttagcacttgaaaccagagtttggtactatgagaaggtttttaattttaaaaagaaggaaaaaaagaaacacggacgtcagaaaactggttcagtagggatgggtgctagaaggctacggaaccgccgaaggcccaggagaaacccggaacgtgttaaccgctccaactggagccggacgaaaaaacggccccgcctcccgcgagggcgacgcagttcgcaggcgcgtcggcgcgcctgttctggggcgcttggcttcaccgcgcaggcgcggtcgccgctgttgttgtggtccccatggagctgccgtagcggacccagcacagccaggagcgtccgggatgagctcagccgcggccgaccactgggcgtggttgctggtgctcagcttcgtgtttggatgcaatgttcttaggatcctcctcccgtccttctcatccttcgtaagtggctgcctggcctcccaagggccggtggggatgccgccccagtcccccggcgggtctggcgtaggtacaggggtctcaactgggcgactgaaggccgtagtagcgtcttggttggtccgtaagcttttttgagatagttgttagcgtctaaaaggtacgacgctttaccccaaaatcagactttctgggttctagggggttgggagaaacaccgggcaaccctggactcttctggctgtgggtggcggcggcgaacctcacactgggagttcctagtgccccgctgtcagcctcgtttccgttaatcctggttcctagaggcattcgagcagccctcggccagggtttcccagaggcctggcgggcgaagtcagctgttccaggtcccggagagatggatcctcgcgtccaggagcccacattcttggggtgggtagggtgggagacaggtgtagagagaatctcagtacagcgtgatgccttcagtatccaagggagcaaccaggttggggaacactctctttctgccaggtagtgagtacattacctctgtctcacggctgctgggagaggcgagtattatcatcccaccctcctttacctcccggaggagtctggctcaagagaatttagtggtggcactaagtcatccacctagtgactggaggtggagatttgattgccttttggagcagggatagggatttggtggcaaattggacagggcgtggtggggtgtggccatggaaggcgggggtaccttgggaactgtccccgagaatgagcgccctccgtatgcccacagcagaaatgaggagctgttgggcaaaggcggagtcctcaaagattgggcgcattcgtttcagcgttgtcttggaaaacagttcttgcttttctctcctaagataaattggtagtagtggaggatattttattccaccagtattcattgagtgcctgttttgtgcaaaactctattcttactctctcaattgtcctactgtctgcattgtcctgagatatagggaattctcttttaacccctgagtctccttcagaatctttcctgatgctatccagtctttaagatgatgtctcaggcattgcataaaagactcctgatgagctggcccatgctcatcttcttgtttttaattgtaaaatacacataatatgaagtttatcatctttatcatttttaggtgtacagttcagtggcattaagtacattcacatttttgtgcaaccattatcccagaactttattattattattttaagacagggtctggctctgtgcagtggtgtaatctcgactcattgcaacctctgcctcccaggttcaagtgatcctcccacctcagcctcccaagtagctgggaccacaggcatgcaccaccacgcccaggtatttttttgtatttttagtagagacagagctttgccatgttggccaggctggtctcaaactcctgacctcaagccatccacccatcctggcctcccaaagtgctgggattacaggtgtgaaccactgcacgtggccccgctcccagaacattttctttttttttttttttgagacagagtctcactctgttgcctatgtaggagtgcagtggcctgatcttggctcactgcagcctccaccttccaggttcaagcgattctcctgcctcagcctcccaggtagctgtgattaccagtacctgccaccatgcccggctaatttttgtatttttaatagagacggggtctcactatgttgcccaggttggtctcaaactcctgacctcaagtgatctgtgctccttggcctcccaaagtgctaggattacaggcgtgtgccaccacgcctggccccatcccagaactttttttatctcctctaaccgaaactctcgcactcattaaacaacaactttccattcctacctctccctggcaatcaccattgtactttctgcctctgtgaatttgactactcttgggacctcatataagtggaatcagacagtatttttccttttgtgactggcttcttttcactcagcataatatccttaaggttcatccatggtgtatcatgagtcaggatttcctccccttttaaggctgaatagtatcccattgtatgtataggccacattttgtttattagttcatctgtctatggacacttgggttgtttctaccttttgactattgtagataatgctaaaatgtttacaaatatctctttgagtctctgctttcagtttttctggacatatacccagcagtggaattcctgaatctatggtaattctatgttgaatttttttgaaaaaccaccatactgttttccatagcagccacaccattcgacattctcaccagcagtgcagaagggttccagttgctccatatccttcaacatgtattttgttttcttatttatttattctttttatttttttatttatttttattttttgagatggagtcttgctccgttgcccaggctggagtgcagtagcgcagtctcggctcactgcaagctccgcctcccgggttcacaccattctcctgcctcagcctcccgagtagctgggactacaggtgcccaccaccaccacaaccggctaatttttttgtatttttagtagagacgaggtttcaccgaattagccaggatggtctcgatctcctgaccttgtgatctgcccgccttggcctcccaaagtgctgggattacaggcttgtgccaccgcgcccagcctatttttttttttattatttattttattttgtttatttattttttgagacagagtcttgctcttgttgcccaggctggagtgcaatggcgcaatctcagctcactgcaacctctgccccccgagttcaagagattctcctgcctcagcttcccaagtagctgggattacaggtgcccgccactatgcccggctaatttttgtatttttagtagagacgaggtttcaccatgttggccaggctggtctcgaactcctgatctccggtgatctgcccaccttggcctcccaaagtgctgggattacaggtgtgagccactgcacccagctaatttttatttttttgagagggagtctctctctgtcacccaggctggagtgcagtggctcaatcttggctcactgcaacctccgcctcccaggttcaagcaattcttctgtctcagccttccaggtagctgggattacaggtttgagccactgcgcccagctaatttttatttttttgagagggagtctctctctgtcacccaggctggagtgcagtggctcaatcttggctcactgcaacctccgcctcccaggttcaagcaattcttctgtctcagccttccaggtagctgggattacaggtgcatgccaccatgctgggctaatttttgtatttttagtagagacggggttttgccatgttggcgaggctggtctcgaactcctgacctcaggtgatccacctgcctgggcctcccaaagtactgggattacaggcgtgagccaccacccccggcctttttttttttttgtaatactaaccattctaatggacgtaaggtggtgtctcattttagttttgatttgcatttccctaatagtgatgttgagtatcttttcagatgcttatggccatctgtttatctttggagacatgtctagtcaaatcttttgcccccttttaaaatccagttgttttttgttgttgagttccttttgttgttgttattattattattattattattttttgagacagagttttgctcttttgccgaggctggagtgcagtggcgctatctcggctcactgcaacctctgcctcctgggttcaagcgattctcctgccttagcctcccgagtagctgggattacatgcatgcaccaccacacctagctaatttttgtattttttttagtagaaagagggtttcaccatgttggcctggctggtctcgaactcctgacctaaggtgatccacctgcctcagcctcccaaagtgcggagattacagctgtgagccaccacacctggccgacaatttttttttttttttttaacttttaagttcagggatacatgtgcgggtttgttatataggtaaacttgtgtcatgggtgtttgttgtacagattatttcgtcacccagttattaagtctagtattcattagttatttttcctgattgtctccctcccaccccctatcctccaccctccaaaatagaaaaatttgtttttagaggccgggtcttgctctgtgactcaggacctgtggccacatcctgtgctgcctcatacaaccttatggcctctctaacctcaacccagttagctttcctaaacccatttccctatgattgttaacacttgttgttagccaggttcagaaggataacataattattatcccagcagagtacacccaccctgtaatcggtaagagagatgtttggcctggtcactgggtttgtggtgagagtctgtgaaaagctgtaaggaacgcgctggtcttcagtagggtcaaatgctgctccttcaccatcgtcagaggctacttcatcacagcctctctgatttgaggattcaagtgggaaagactcatgacaagcagcagaaagtcgaattgggaaaacagtgccctcagggatggggccgcgctcaggtacttagattataacctccgttgggatgtttctgaagctttcgtcttagcagaagttagggaggcagcaccccgatctcagcactcagtctaggccgcactggtccccgcactggtctcccccctccccccgcgtgaggccttaggaggtctgaagtatcagaagtccttgggccagttaagcctagcaaggtcctgggaggcgatctcagctgtccgctgcggtgggggtgggatgcctggtaaggacaccaagtccgtggtgttggcgtggttggaattttcctgggatcgctcccttctcttcaagctggtcacggggacgcatggttgagagcgcctagttcattcagtaggtggtccaggactttcttcagctatagaggggaacaaagacgcctttggtgagcaccggctctgcagctctgcgggtgcaggggaggtgtactgcgtaggtgccccaggactggcgggggctgagggtccatgcgaacggcactactacgcaggcgtcgcaggactggcccgggctcaaggtccgtgcaaactgcatgcactgcgcaggtgctccaggactcgcgcggggtcaaagtccatgcaagccgcacgcactgcacaggtgccccaggactggcacgggctcagagtccacgcataccgcacacactgcgcaggcgctccaggactggcgcgggctcagagtctatgcaaaccgcatacactgtgcaggcgccctaggactggcgctggctcagggtccctgcgagctgcacgcactgcgcaggcgccccagagctggtgtgggctgagtggccacacgagccacatgcactgcgcaggcgccaggaggcccttcctctcaatccgagctttgcagatgaaggactctgcgtgtgttgccttctgggcttacgggccgagtgccctttgagattcaactttttctaaattatccttcactttctgctgtaaagagtggccacctcctttttcctctaggggactgaagcgagaggaggatattgcagggtttgcctctgtggtcatcttcttagagagcaccccctccgcccccacacccttttcctcagagccgttgcttagtgagtccctgccatggaccaggcttgggaatggtccccaagtattagtttaggaggacgactctctgcttcacaggacctaccccagaatcctgtgactcagaagcgcgcttgtgaagtgcgcatgtgcgggcagggcctccagtggggctctcgtgggggcagcagccaaggactggggctggtggcctggagagctgcccgcttctccgcccttgccggtagggttcctggccgagagtggcatctggggctgttcagggtctggagcttcctgagttggaagaccctgtcctctgtgttcagggactcagggtgacctgagttggtggttcctgggtttgcctgctctactgctggcagggactagcacggggtgtgcacgttgtcatgccatcaattaattcagagattcacttttgttctaaaaattaatatttgcattattacatttagattcatattaaatcttacactgcatgattctagaacattttaacacttatacgtgggtcttggattaacattgatacatatttgcaaatttatactttaaaacttttttttttttagagacagggtctcactctgttgccaaggctgtagtgtggtggtgccatcataactcacagcagcctcaacctttcgggctcaagtgatccctccctccccgcctcagcctcctgagtagctggggccacacggaccacaggcgtgcaccaccacacctgactaatttttaattttttggtagagattgggtcttgctatgttgccccgcctggtctcgaactcctgggctcaaacgatcttcccgcgtcagtctccgaaagtgctgggattactgcactgcgcctggctcagacagtttttattgtgcttatacatgtaatagatgtaattattttttcaagcaccagttgtttttgttaaccttacaaagctgccttcagttttcctgaagttcacccttctgccttcactcacctcccattcctgagttgttttgtgtattccctataatgctaaataatgtcttggaatctctttttctttttaaaatatggttttaaaagtcagatttattgaagtgtaatttgtataaggcgaaattatcaaaaagtccttagcagtgtctgtagattttccttgcttttgaaagataattttgtgattcatctaagagaatttggcccattcctatttccttctccagagtggatcaggctggagtatagctccttcggttatagtgctgggtagtggccagggcagaggcaccacaaagagagctggatttgaaccccctactccctgcgcaaaggctgccagaagctgcgctgcagtgaacacgctgcgcatgagcccctagacccctccaccccccctactccccacactccccccccccacttttgcctcatcacgcaggcgctggtaggcggcatcactgggcgggtcagaaaccacgcgcatgcgcagacaccctcaggcgactggcgggtcgcggcttccaagctctaaatggagagttgtccctactgtgcggcaggcggaggagacctgtaagctggaagggggagggggggggatctgatttattgtgtgccaggcacactttagatacactataacatttcgtctttattaatctatttttaaaatttcgaaacaaacacaaatgtgcagaaaagttatatacagtcaataccgataactgattttgtttcctgaaccatttggaagttgtcaacccaaaccccctcattccgagatactttggtattcaaaagaatcttgggggccgggcacagtggctcacgcctttaatcccagcactttgggaggccgaggctggcggatcgcttgagctcaggagttcactggcaacatagtgaaaccgtgtgtctactaaaactaaaaaaaaattagtcgagtgtggtggtgcaggcctgtagtcccagatgctcaggaggctcaggtgggagtatcgcttgagcccaggaagtcgaggttgcagtgagccgagatctaatgcaggcgtcaagtacgttaccacgatctgatcctcagaccccatgcaggttccccacgtttcgcagtaatgtccttaacagggaaaggacccagttcggaatcatgcattgcatttcccggcctctagcctcctgtctggaggagtttcccagtcttcccttgactttcatggctgtcatttgtgggtgtcagaggccagtgatttcgcagaagggacgcctactggcatgtctgatacttggtagggatttctgagaggcagtgctgtgttctcattgtgtctcatccgctggtgtgggactgggatttggggatgttcgctgatcccttggggtaggtgccagaggcgccactgagggatctggtcttggggcgcccgcgcagtccttggactaggccttcccggcagatctgcgggcgccacctggcggtcactgccgactcctccgttgcgctccagtcacctctcccatcccggtgccgtggccgggccgttccctggagagtggacggctggggctggtgcagggaacaggggcctgcgggggctgcgcaggcgggcctccaggtcatgcggggcccctctgctcacagggaccagccaggccagcctggggagcgtgcttctttgtttatgtctgtatttctctgcctatctgtggaaaccacagatctccaattgaagccaacaccacaagattcattctgcttctctccgagacgcctgcctgcctgccttccttccttccttcctccctcccttcctcccttcttcccttccttccttcaccaggttatgaaagtggctaatttttcatattttttgtagagacagggtttcaccatgttgccaaggctggtcttgaactcctgggctcaagcgattcacctgccttggcctcccaaagtgctgggattattggcatgagacaccgaacctggccttttttcttttgtcccccttttttttttgagacaaggtctcaccctgtcgcccaggctggagtcccatggcatgatctcagctcactgtagccttgaactcctgtatacaagagatcctcccaccccggcctccagagtgttagggttgcaggccgagccaccatgccaggctgaggcatctttctaagtgtctttgttgaaagtgagaagactggcttccgttactctcaatatgtttatttctgtgatcacccttttgtaattaatctctggtgtccaccgcccactgttacccaagtgaatgcatgcctctccccacctgggctccgaccctggcagggttccttcttgtcttgtatgtctgtctccctcaccctacagaccctgactcctgtgtcaggctgccctttcttggggacccctgtatcaccatgcctggccctgatgcctcttgccagggtgccattctgtgggaaggccctctgcactgagcttgggcactgacattctgccctgggcccctgcctcaccactgttaccctgcacctgcaccttgctctgccccgtctaatctaggactgaattcttctgggaggggagaggttacatgttccctgtcactggaataacagctctggtgatggaattggttttcatttcacaattgcaattttatttatagtgaaacagacaaacatttgtattggagcaaattcatgggcatatctgtaaaaggaaaaatatagtttgaatagcaatttgaatatgagttttttttttttttttttttgtggtcgttatagggagccgaaaaaggcagcagaggctggctgtgtaggtagagggcagcttgcccagttggcagaggtgggagtaggatgttggaggaaggtgtaccggttctgtctggccaaacccatgctggagtcacctcaaaagcagtggcaggggagttccctcaaggggctgctccagactgcctggagatggggctggcttggattccaaagaaagaagcactaaacgccagggtgataagtccacagcattcatgacgggaacttacaagagctgcggcagtcccgggacagccagtgagagaaagggacatttacctagggctgtctgccacccgggggttggggtatggagtgtatgtgggagtttaaggactttgtcatggtggggctagtttgtaggtgtttctcagcaggatgaatctcccagtgttctccagcaacagcctttgctctttatcagtcctgggaacgttcacggccgcagtttgcattcagtcctgcagggacgcacacaactggctgggtcacagagtggtcagggcatagacagaaagtagcgggggactggggaaccctcctgtgacccgtgttggaaggtgctgatccccgttgtccgccctgccagatgtccagggtgctgcagaaggacgcggagcaggagtcacagatgagagcggagatccaggacatgaagcaggagctctccacagtcaacatgatggacgagtttgccagatatgccaggctggaaagaaagatcaacaagatgacggataagctcaaaacccatggtactgtgtcccttgcagcctggaggcttcatgagagcggatgaatagagaagtctgtatgtgaagattagtagaatacatactttgcttcttggatgttctgaatattgatggaaacttaagttatctggaggaaactcagtaataagtattactttcctcttatttgctggtgaacctttgctttctaagcacagaaatatctaagatcctctcagattttcctcagagccaactctttaaaattttaagctaactcttaaaaattgtaggttttcatttttaaattcatcacttttctgagagaagcccagaaaaaaagtctcacagtggattcccagaggcttttgttccactctctagaaaaatgcccagcagtgtcctcttctgagtgtcacctcccgggtccagtgtcctgtgatgaagagcgctttctcagggcagcccgtgtgctgagggaccccggtcacagtgtgtgcacagtcagagagctgtctctgtggctaggaaaacagacagaggggcctgtccaggcccaggacaagctggactcccaccaggggttcgtgtactgtgcacactgggaaataaggaggaaaatttagtcctgttggtaagtggtaactgtattatacaaagaatctttgatttcatgagtcgttttaagagttttcaaaattaaagctattcaaatctcaatctgagtcggatactattttaaataatggcataatgagatggtgggtgacttaaaaattctattttatattttctaaatatgttgagcgattgttccatttataatcagaaagtgtattataagggaaaataacatttctgtgtatttgaatattttgttaatttttcaggactgacataattatttatcctgtttttcctttcagtgaaagctcggacagctcaattagccaagataaaatgggtgataagtgtcgctttctacgtattgcaggtaagtgtgctagagcgtcagccgggtcattggagttggtgaccccggcctccagagccgtgtctgcagatccagggctgggagttcgggctgttccaccttcagctgtcgtgtcgtgtgtccctgcccacatggagctctaaacactctcggtctctaagtcagactaaaaggaagcctttctcttgaggagagttgttaaagtttgggactttttggcagatggactgtgaagtaagttctcggagagctttcaccatgcctgcatcccagtgtggtttgaagggcctggtgggatgaagcgagaggcttatagatgacatcagttttttctgagatcttcaatacttttggcccttacttgttacctggtgtacttcatgcacgctctccaccctccaggtagagaaccagcttttccgactggaattggcttctagcctccctgcctggggcttaaccctcatagcctctcctggagctgttgggctctgctctgccccgagagtgcagttgtgctgcccagacacctttagcagctgccgtaaatatccgagttgcagtaccatgtgatccggtaaccaaggcaaaggattcaagcccacccccaaaaaagcttagtttggcagggtatattgaaggaaattaattctgaggcactgtcatttgctaagagataagtttccgcagacaaaggagttaggccagcaaccctctttcatgtctcttctgagcggcctgttcaagccaggaaggggacagatgacaatcgaaggaatgctgtggggggatggagggaaataaagcatcccccaccattgaaacttacacagggctcacctctgcgtcccttgctaacactggtgtacgtgggagaattcactattttttccaaggatggctttcgtcactaataaggtgtgttgagcatacagtctggctactcaaacgagatactcagtgagaaaagcacacccgtgttatgggagactttggttagtttatcagctaatttaaattatgtgtagattgtgttcatcctaaaacagtgaaatgccagttcacataggaaggctcgcctacttgttggcagtgttcagacatgctgctgagctcgtctttaatttgactttctcattcaaggtttcaccaagggacattagtggctgtgcgtgctcatctgttgtctgtggggactgggttcctaggcttgaggtgctcagtctggagagttttcctggttttattttcgcatttccctgtcctcccttctgtgtggtcggttgtgtgattggcaggctgctttgctcaccagaggtgtctttacaggctgccctgatgatctcactcatttggaagtattattctgtccctgtggctgtcgtgccgagtaaatggataacccctctagaccgcctggtagcctttcctactagagtagcaggtaagaattttctggaagatgcagtggaagagtgtgaataggcttatgtagaggtgtgtggtagaagattaagttagcctgacatcctcctcaccgtccatttagtgagcggggttttgtgtctcagcctcacatgaggcttcccatgaagaaactgaggtctgaaaaagttacttcacttgtccagtgtcaccaaaatgttaaggagcaaagctaggattcagtcctaggtctgtttccgggatccatgcccaatacgtcaagtctgataccccattgaaacactagccgtagttccaaaattatgtatcttttcaatccctattatggttggcttctctgtagcacttgctgctcctggctattcttttattttttattttttgagactgagtctcactccgtcacccaggctggagtcagtggtgcgatcttggctcactgcaacaacctctgcctcccaggttcaagcaattcttatgcctcagcctcccaactagctgaaattacaggcatgcactaccacgcccagctaatttttgtatttttagtagagacagcgtttcaccatgttggccaggctggtctcaaactcctgaccttaagtgatcctcatgccttggcctcccaaagtactgagattacaggcatgaaccactatgcccagccacgttcttttatttttgaagataaattttttttagatattaaaagtagtacatgtcactatagaatgattagaaatatagctatcaattaaaaatcccagctgggtgcagtggctcacgcctgtaatcctagcactttgggaggccaaggtgggcggattgcctgagctcaggagtttgagaccagcctggccaacatggtgaaaccctatctctactaaaatacaaaaaattagctgggcatggtggtgcgtgcctgtaattccagctacttgggaggctgaggtgtgagaatcacttgaatccgagaggttgcagtgagctgagatcacgccagtgtaccccagcctgggtgacagagtgagaatctgtgtcaaataaaataaaataaataaaaaataagattcctattagcttttaatgctgtgatatgtttttctttgcctttttttccccatttattttgatatagttaaggtcacctggcacatcacatgttgtgcctcctttttactttatagggtaagcctattcccacatgttttagtttgttagggttaagtgaaatactataaactgggtagctcataaacaacagaaatttatttctcactgttccggaggctggggagtccaaaatcaaggtgccggcagatttggtgtctgatgatggcccattttccagttcatggatggtgtcttctcactatgtccttgcatggtggaaggacaagctcctttaggcctcttttataagggcactaatcccattcacacggactctgcccttgtgacttaatcacctcccataaggccccaattcttaatgccatcactgtggggggtagcatattagcatatgaattttagggggatacaaacattcagaccatagcaccatatcagtacatttcttttcttttttttcttctcttttctttttgaggcagggtcttgctctgttgcccaggctggcagtggcaccctcatagctcactacagcctggaactccttggctcaagcggtcctcccaccttagtctcctgaatagttaggatcacagttgcacaccaccatgcccagctaattaaaaaaaaaagttttttatagagatggggtcttgctttgttgcttaggttggtcccaaactcctggcatcaagcaatcctccctcctcagcctctcaaagtgctgggattataggtgtgtcaccttgcctggcaaatttctttattaaggaattttcagtagctgttcttcatttagatatctcatttgcagattttcctgatgaaggatatttattccggtcctgattttttgctattaaagataatgctgcagcacacatacttgctggtctttggttgtgatttgtgattatgttagaggtgaatactgtatcaaaaggaatgactattttttttttttttaagaccgagtctcactctgtcgcccaggctggagtgcagtggtgtgatctctgctcactgcaacttccacctcccaggttcaagtggttctcctgcctcagcctccccggtagctgggattacaggtgcccaccacacgcccgactagtttttgtagttttagtagagacagggtttcaccatgttggccaggctggtcttgaactcttgacctcaggtgatccacctgccttatcctcccaaagtgctgggattacaggtgtgagccactgtgcctggccaggaatggctgtttcaaagactcccaatttagctaccacccctgtccccttccccaccctttccttcccctctcctttgtttgacacagctgggcctaggccaggagctctgcactgcggccagagaagcatccagccacccttccatgcatccagcaggtccatgggtcactcttgcagcctgtcttcctggacagggggatatgtatgcctctccattattggtggggcaagaaaggcataggtagacattgctttgtttataatgctttctgagaaaggaaaaataaataatcttacaggtttggttttggaatctattaatatcataaatagtaatgcacatctctctggcaggaaagggaaattcagcccagggtccaccgttcactgcaattcctgcttagtaaagaatacagccctatgattctatagaaagtgacaaattcgggctgggaatggtggctcacacctgtaatcccagcacttttggaggccgagttaggcaaatcatctgaggtcaggagtttgagactagcctgacctacatggtgaaaccgtgtctgtactaaaaatacaaaattagccgggtgtcggccgggtgcggtggctcatgcctgtaatcccagcactttgggaggtcggggcgggcagatcatgagttcaggagatcgagaccacggtgaaaccccatctctactaaaaatacaaaaaattagccgggtgcggtggcgggcgcctgtagtcccagctactcgggaggctgaggcaggacaatggcgtgaacccgggaggtagagcttgcagtgagccaagatcgcgccactgtactcccacctgggtgacagagcgagactctgtctcaaaaaaaaaattagccaggtgtggtggtgcacacctgtaatcccagctactcgggaggctgaggcaggagaatcgcttgagcccgggaggcagaggtgcagtgagccgagatcgcaccattgcactccagcctgggggacagagcgagactccgtctcaaaaaaaaaaaaaaaaaaagaaagtgacaaatttgaacctatgaaacataaacttcacttcagcccagcactgctcaaaaagaatggaaatactctctttgctgtgagttaaagacagcagagacagatgggggcagcactgctggtatgcgctctcatggtgaatgtctttgttttcaggtggtgttggaattacctgttggattttagtctgtaacaaagttgtcgctattgtgcttcatccgttcagctgaacaggaggatggatacagccgcgaggctaaaaaacggatttcctcttcctagcttaaaatctgatttacactgttttgttttttaagaaacaaaagtgcatagtttagattttttttttgttgaatatgtttgttcttggactttatgagagagtcttataagaatcacgattttctacacctgtcattgagccaagaaagtccagtttatgacacgtatgtactagtgaacaccgtcctcgatctgtacgaaatgtgaaatgtttagggacatctccatgctgtcacttgtgatttgccctcttatgtattttggtcatattgccaactggaaagtcaaaattttctaacaactttaagtaagttctttgaagacttagtgctgtttttaatccagtttagaaagtaacttaattttaataccactactaaaaattcgaaaatttcttctttaatcacattcaatatggttaaaagaacaacactaattgacattgcgtgggctttttctccctttgtttaaaatgtcatttgttgagcaagagttgtatagtattatctacttacttgaggctgttaatttttcattacagtgttttgtaaatgtatccacgagaccatgatgcattgttttgtgctcaacttgtgttttgtatttaaagcattttgaatgaagtgtattttataagcatttaatatttatgctctttagaatggaacacagaaaacaaaccttataagtcctgattaatctgaaccaataacctgtgtggcctacaaagtataattctattaaatgttccttaaaacacttttttctaattaaaatctttgcaaatgcttgtgtaacttcctgccttacagctacttgtttgctgtgagccacccgcaactgacaagtggctgttaactgagtcaccatatcccagtaaagctgaattttctcactagtttctgcaagttcatatttgtactcttttgtttcctaatgatctaataagtagtttgttgttattttagctgattggactgtgagaagacaaagtgctgtggtcctttatttattgtcatgctgaaggccaccacagcagcttttgggttccacttactcaaacacacatgcacgcaggcttacccagcaccaagtttacttagctttaagaaaggacagagcagggaacgcagccacagcctggtggaggaactggacaccagcttccagtgtccgtcaccacacgggatacattttgcccacaaaggatgagaagccaacctggggaggagatgagagtagcacacggaagctgcaggaactagtccttcagacgaaatatagcaccaagggggcacgtgcctaactcccgttttagtaagctgcaggcagaaatgatggtggacagtcaacagtgcaccggccatgtagagcgtgcccagggaactgctgggatcactcatccgcatacagtgtccatgatgatacccgtatctcttaaagatattctcattcagttgttacaagaattttgacaaatctcactgaggctagaggtaaaaatttctggttcacagctattaactttccccatgcgtgaatagtttgtgatgattaaataggggaaatgtaaatgtcctttatgtttcacattattgtgtttttttagaaattatacagtttttttttttttttttttgagatgggagtcttgctctgtcacccaggctggagtgcagtggtgtgatctcggctcactgcaccctttgcctcctgggttcaagtgattctcttacctcagcctcccaagtagctgggattacaggcgcccgccgtcacgcccagctaatttttgtatttttagtagagacaggatttggccaggttggtcttgaactcctgacctcagctgatccacccgcctcggcatcccaaagtgctgggattacaggcgcccgccatgacgcccagctaatttttgtatttttagtagagacaggatttcaccatgttggccaggttggtctcgaactcctgacctcagccgatccacccgcctcggcctcccaaagtgctgggattacaggcgcaagccaccgcgcccggcctgccatttgttttaacagatgatgaacacggtgatgaattcagaagatagagaaagagctacagtaaatgtgcatcttacgactcttgtcccccaatttcccaaagttttcctctgttaacagttttttatgattctgccagtgatattccatgcatttatgaatattcatgcatgtgcttttaagacatgttttaaaggtataaaaataatacctaaaaagacaaaagtagtacctatttactgtttttttttaaaaatggaacttgggaagtacagaaaagcagcaaggaagaaaaacctatgactccatagaactagggtgactggcgttagcatctgtgcttttgttttttgcatatatgtgtgtataatgttgaaaggtaatgataggtttattttttttaaatttattttattttttgagatggagttttgctctgtcgcccaggctggagtgcagtggcgcgatctcggctcactgcaacctctgcctcctgggttcaagtgattcttctgcctcagcctcccgagtagctgggactataggcttgcaccatgacgcctattttttgtatgtttagtagagatggggtttcactatgttggccgggctggtcttgaactcttgacctcaggtgatccacctgcctcaggcccccaaagttgggattacagacctgagccaccacgcccagtgggtttttgtttttattttaaaaatactggatatattttatagcttcacgtgaaagcaggtatctctttgatttaaaatacatctaaagctctcttcataccgattttgtcataaatttatggtaaatcaagcagggaaatttttaaatatacaaatccataatctttttttaattttttttttttttttaagtagagacagggtctcactatgttgcccaggctggtctcaaactcttgggctcaagtgctgggattacaggtgtgagccaccatgcccagcccataatcaatttttattcattttatgtgctgttgccaccataaggggctggaatgctaggcaaactggtttactgtcccctgacctgggggggctctctggccttccatagtttttcttacacagtgcatcatgggagaggtgtgtgtgtgtgtgtgtgcacgcgcacgtgctgacagccccccggaaccggagctttagacttaaagctttctcccttatggtggtggtttcctttctttcccatcctcatctgagcatttaaaatactatctgtatgactgatttgttgtgtctgctgttgtggttttgtttctcttgttgtagatccttgttttgtgtgtgataaaaggttatttcagtgatgacgcaagtgcctttagggccagagactattccttgagcttttctgtactcctcctgcatgccttcagtcagtacccaagagtatttaactcacaatcacataatggttttccactagagccgtgtatggagtctgttttctttgcagttgaaatgttagcaattaacaaccgtcaggagaattttctaagtgctgctctcttataaggcctgcggtatggagcactttgatgacatctcagattcaaagccatgtgtgactggtttgaacaccattggaatcccaggccaggcagctcatcctgtctctggacccagggttcttgtgtgggtcggctttcctgcatgcatctttgggttctaatgcgtatcaatctattgacacgcagagtgctgactcttactagtgaattcaatcataaatagcatgaatattgtgtagttttagccaatattgtgggaaaggatattggactctaaagggtagggtaatcattcctttatgttggccaaattcttttcctgtattttttttttttttagagacagggtctcattctgtcacccaggctggagtgcagtgacatgatcatagctcactacaacctcgtgctcctggtctcaagtgatcctccagccttggcctcctgagtagctgggattacaggcatgcgccaccatgcctggctgtttctcattttttatttttgtagagaggagggtctgactgtgttcccaggttggtctcgaactcctggactcaagtaatcctcctgcctcagcctgctaagtaggtgggacaataggtgtgtaccacaactttggactaatttttaaatttttgtagagacggggtcttgctatgttgcccaggctggtttcaaactcctggccttaagtgatcttctgcctcagcttcccagagtgctgtgattacaggtgtgagccactgtgtccagccatttttcctgagtctttttaaaaaatagtttttattaaatattgagaggtataaaatatttaaaatatgtaaattttaaagaataaaaatacaatacaaatctttgtatctttcacccaagttttagaagaacctttgcgatccccactgagtaaaggtaacaccactgctctgaattttatcatttcctattcgtcagagttgtatcacatacttgaatctgtaaaaatacattgtttggtttctcatgcttttcagcacgcagacatgtctgtttttttgcgcttcactttactgtgctctgtagagactatatttttcacaaattgaaggtctgtggcaaccctgcatcgagcaagtctgtcagcgccgtttatccacagcatgtgctcactttgtgtgtgtgtgtcacgttttggtagttctcataacatctcatattttttcgttattatatgttatggtggtctgtgatcagtgatctttgatgttactactgtaattgttttggggcatcaagaactacacccgtatgaggcagcagatttaatgtataaatgtgtgtgtgctgactgcaccactgacttggccattcccgtctctcccccttccccagggctccctattccttaagacacaaaaatgttgaaattagggcaacattggcccctaatttcaataataatgatgacctctaaatgttcaagtgcaaggaagagttgcgtgtctttcgtgctagcttttattttatttaattaattaattagtttatttgagatggagtcttgctctgtcacccaggctggagtgcagtggcatgatctcggctcacagcaacccctgcctcctgggttcaagcgattctcctgcctcagcctcccgagtagctgggattacaggcgtgcacgaccacacctggctaatacttgtatttttagtaagagacggggtttcaccatgttggccaggctgatctcgaactcctggcctcaagtgatctgcctgcctcggcctcccaaagtgttgggattacagtcttgagccacctgtaaagagtctgagttctttacttacaatcttttagttcactgagctggagaccccagggaggtcccagcattgtatggaaaacggaccccctaacttgggctgcctgggttttgtcctcaggaggagtctgtgttgctcagacatattcggcaaatgccctttaggcagaagcttactttagtgctttgcttacttatctccttgggtgcctaatttcttttcgtgtttaccagctgagcagctgatttagaaacgttttctatagttggtacagcatttttagcttttgttacagcaagagtgttggagtaccttctctctcagagctcaggaaatggatttgtttttaaaaatcttttttccatgatcgtaaagttatgttcatcatagcaaacatgcgaaagaaagccagagtagaaaacactaaaagtaaattaaaaattggccccaatctcataatactcagagataaaaagttagcatgttaatctgttaccctctaacttttttattcatacagttaagatgactagacaacaacaggcttagattgtatttttattaaattagttctctacacttctaaatatagctctgatttaatatcacgatgtgtgctttcattgtgggtgggcataagaaaagatcccttggaaaatcctctgtctgctatgaagctggagtagacactgtcatgttactcagcataccatttccaggagtccttttaatacatttctccggaattgaggccactatgtcatctcacttaatttgcgtatttccccttatgagcctgtgagagctctccctccctgcctcccttactccttccgtcctcttcttttctatgttattccaccttgcttttcataaacgatcaaagcatatgccaattgtagtatttatctcatctttggttttattattttttaattaattagtttgacacggagtctcgctctgttgcccaggctggagtgcagtggtgcgatctcggctcactgcaagctccgcctcccgggttcacgccattctcccgcctcagcctctccagtagctgggactaaaggcgccgccaccacgcccggctaattttttgttatttttagtagagacggggttcaccgtgttagccaggatggtctcgatctgacttcatgatccgcccgcctcggcctcccaaagtgctggggtgagccaccgctcccggtctactatttttatttttattttttttttgagatggagtctcactctgtcgcccaggctagagtgcagtggcgggatcttggctcactgcaacctctgcctcccaggttcaagcaattctcctgcctcagcctcctgtgtagctgggactacagatgctggccaccacgcatggctaatttttgtatttttagtagagacggggtttcaccaaattggtcaggctggtctcgaactcccgacctcaggtgatcgcccgcctcagcctcccaaagtgttgggattacaggcgtgagccactgcgcccggctctatttttatttttatattttttgagacagggtcttgctccttcgcccaggctggagtgcagtggcacgatcctggctcactgcaacctcctcccaggttcaagcgattctcctgcctcagccttccgggtagctgccattacagttaatattacacaccaacacataaacatcattggaaaggaaatagtatggtctagattataaacaagttgcccttataactaaatgaagtaagctaaataaagtgaggctgggagtatagcctcctttttacagtcctaatttaaaatatcctaagtttagtaaatatattagttaggactgagcagctagctcgaataaacaccagcagggccatggtactgttttatggtttttagaacaaggttaacagaaaaatggtcaacatacaggtatgcaacaaatctcaataaatgatactggatctcaggtgtacacaaggaaagcatcacccacaaaggcaggacattggatacccaggttagctgaataagagaaactcaaaaatgattttcatggctgggcacggtggctcacgcctgtcattcccagcactttgggaggctgaggtgggcagatcacctgaggtcaggagttcaagaccagcctggctaacatggcaaaaccatttttagtctctaataaaaatagaaaaattagctgggtgtggtggtgcatgcctgtaatcccagctactctgtaggctgagacacgagaatcgcttgaaccccggcagggcggaggttgcagtgagccaagattgttatcactgcactccagcctgggtgacacactgagacactgtcaaaaaaaaaaaaaaaaaaaaagattttcatgaaactaagcttggtaatcactatatatatacacacatacatacatatatgtatttttttttttttttgagatggagtctcgctctgtcacccaggctagggtgcagtggtgttattttggttcactgcagcctctgcctcctggggttccagcgattctcctgcctcagcctcctgggtagctgccattacaggcatgtgccaccacacccagctgattttttgtatttttagtagagacagggtttcaccatgttggccaggctggtctcaaactcctaacctcaggtgatccacctacctcggtctcccaaagtgttgggattactggcgtgagccatggcacccagcctattttttttttttagtaaaaagagtcttttgatcatattgttccctttcaaagctgctgccacattttgtttttattttttgagacacggtctcactccgattgcccaagctagagtgcagtggcacgatcatgctcactgaagcctcgacctgggcacaagtgattctttgacctcagcctcccaagtagctgggactacaggcacacaccaccacacctggctaattcttataatttttgtagagacggggttgtaccatgttggccaggctggtcttaaactcctggactcaagtgatcctcccaccttggcctcctaaaatgctgggattacaggcaagaaccactgcatctggcctgcttccatgtttttaagttacaattcaactctattgctgataaattttgttgtgtaggagatgcatgtcttgggttgactaacttaagagttactagctatggagtcccacagaatactaaaaccatatagtaaaccagtcttccagaagataatggatgtttcagttgtaaagatgtaaatttgtatttgaagtgttatcattggctaatataaaatagattttttactagattagcaatcaaacaaaaatttaattatcgaaagtcaattaagtactaaaacacacacatacatacactccctctctcacacatttcaaaaataagatgcaaggcacataagcagcattatatcaaaccagaatgcattaggatattgattatatttaaataattatttttctttttccttctgtaggtgacgatggcttaatagaatttaccacagttactttagagtctccgaaagcatggctggtggaggcctgactgggaggcaggggatgcgactccttactttgcaaaggctcctctgagccttttgcaacaccaggacttgattggtcagttttcaagacatagcctgatccaaagagttcttccatgagactgcttttcttatctctgaaagttgtatccttcacttttattctggaagacttaccaaatgagggctcatacccactgtcagaatgctctagctccatttcctctctgttactgagatgcttgcctgtactatgactgtacctcatgttgccggcattggctggcccccctgaagcaggaagcccatgatgcaggttttcagttgcttctgtgaatgagtaatgtcttctttgtctgagggggcctttcgtgtagggagcagtgcctttgccaagtgtgtcatccacaccatttctctgcatgcttcttttaaacttttctcttactagaacatcttcttgattgctttctctttcaggatgaataacttcaattatttttggtggtagttcttgctcttctttcacaaaaatgtttttcttttcttggtcttcttttttgtctttttgtcttccagtattctccagcagtatttggacttccaaatgtttctcttcccctgataaatctatattagaaaaataggcaatttagtgctgtttaaaatgaatggatctctatttcaagatggcatgtctagtacacttacgtgcaccgcctcacaagcacactgaaatgacagaaaaggtaagaaaatagatgcatagacaaaagattacagagaaaggtgctattaacaaatgtgttatgttacagtttcttggaacttcccaagcagatgggaattatgaaaccaaaagaaaaatgacattcatagaagaagaaataaaatttgccaataaggttattaatagatgtttaacatcactaactggacatactgccagttgaaacaatgatggctgggtgcagtggctcacacctgtaattccggcactttgggaggctgaggcaggaggactgtttgagcccaagagtctgagaccagcctgggcaacatagcgaaaccctgtctctacaaaaaatacaaaaattagctgggtgtggtggtgtctgcctgtagtcttggctactcaggaggctaaggtgggaggatcacttgagcccaggaggacaagactgcagtgagccgtgactgtgccactgcataccagcttgggcaacagagcagagctgtttcaaaacaaaacaaaacaaaacagaacagaagaacagaacagaacagaacaggacacaatgagaacatttttcatccatccaattggcaaataatttctagagctggtgagaagatggggaaattggaatgtttggtccccgctggtgggtgtgttgttggtacagcatttttggatggcaatttggcagtatcaagattttaggtgaatatactcttagacctaacaacttcttcttagaacgaacctacaaaaaatagacaaggataagtgcaacgatgttcactgtggcgtgggttagtaacaataaaacctcctaaacatctgccaaaggaataatggttaaataaggtatggcacgtgcagtctgtggaattccaggcagttattatagacaatgagctggatccatgtgaactgatggggaaggatgttcccactacagaatataagcacatgagggcagggttttgcatttgcttcctcctgtctccctaatgcctagaacagtgtcagacacatagtgcatgctcagaaagtatttgtcaaatgaatggatacactttctaggacactatgaattaggacaatggactgaaaaataagcagaaaatttaaacacaccagtgaccacagtgcaactgcaactgacgatcagtttccaccaaactgcaacagagagagtggctttgccggtgagttctgtcaaactactgtgttatttaaacattatttggccttacaactaaggtgaggcccttgggcctctactgaaggcccaatgtgttcaacaagggctctccatgctgcctaagggaacacatctgatttgcagccctgaatgaactctgggactcattcatcatgcatgtactttcctcagaagttgctcttacccagccttgcggggctgcagccagatctcccacgagtggtaatgtaacatgaaaacaatgagccacatcttcaaaattccaaaggaaaatgaccctcaacctagagtttcctatctaggcaagtattaatcaagtgtaagggcagaataatgacacttccagatgagaggtatacaaatttaccttacctgcacccatttacaagaagctagtgaaggttgtgctctttaaaacatgatggaatttaccaagaaagaggaggacttggcttaggaaagagaagatccagtagagaaggggagtgacaggaatctgcaggaaatgatgaagggcaatcccaggatgttagctgcacaccagagatgaggagacagactaggacccctgctccattagacctccaggtcccaaacaccaggtgagccagggccttggcctgtcttgcccatggctgatgaagtgttgtactctctatcaaaccctgcagtctgggccagctgaggactctccttggaacccaaagaagcagtttgtttccacctactcccaagagctgaaggtaagctttggtgatcttagaataggaaaatctgggcagcccgttctcttggccctagctctcttgggcctgcccagaagagctctgccagatgccatggatctgagggtttttctatctcccaggatgattcaggacctcacccactgattgggcccttgtatattcaagggagctgaagctggggtcctttttctggaagtctttattcaaaagtggtaatattgccctttgctcagctggatttgaataatttgctactcagtttttcaaagctgaatatattatttaaggatactattatgaaatgaatgtttgtattccttcctcccaaatttcatatgttgaagccgtaacccccagtatggctatatttggagactgggtctttaaggaagtaattaaggttaaatgagatcacaaggttggggccttcatgacggaattagtgtccttataaaaagaaacactggagcactggtgctctctccccgactctcctcgtgcgagcactaaggaaacgccacatgaagacatagtgagaagcgggacatctaaagccaggaagagggccttaactgaagccaaatgcctagaaccttgatctcggacttcctagcctccagaaccatgagaaaataaataagtgttgtttaaaccggcagtctgtggtattttcttatggcagcccaagcagacgaatgtagctacatataaagacagggagctgtgagggaaagcaagggaatgactggcctaaaacccaagacggtggtggtttctggtgggcagggcgaggggatatgattgtgaagggcccaagggtgttccaaggagtactcatccactgtttcttaagcaggctactgggtacataggtgttcctttcattataattctggaaacggttttatgttttttttttaattttttgagacagagtctcactctgtcacccaggttggagtgcagtggcacgatcttggctcactgcaacctctgcctcctgggtccaagcgattttcctgcctcagcctcctgagtagctgggattacaggcacataccgccatgtgcggttaagttttgtattttttagtagagatagggtttcaccatgttggccaggctggtctcaaactcttgacctcaggtgatctgcctgccttggcctcccaaagtgctgggattacaggtgcgagctgccatgcccagctgttttatgtgtgctttatatacacatatagtaattcacaattttaaagaaatcagataagatagactttaaagagttaaaattaccttcatattttctcttagaatcctcttgctttggtagtttattcacacagtgaggaatttcatgatttatttcagttgatttttctttatgatcgatgtttcctgttgcctttttaccctgtaatttagaaaagcagcaaaaacacattttggggggtctagataacttaaaattgcattttattctaatgactacaaatacttttcacatagaacaagtgactgtagcctatttttgttaagacatgtttaatcagacactgcaagattccaaatttgctgtaccttagttgtcaaaggtggaacatctgatttttgggttccctggtgtctcatacttgtgaatggcaaaatttttctgtctgcttggactgattttgttgaagaaactatggaacaggtagattatatgtaagaaacatattttacatttggatacaatattgattttaaacataaaataacttttatgcaatgtaataataaagtatactaagtattttctaaatattcaatatatatataagcatttgttagtttcctgtttttccctccagggcccttgctttgtcttactttgggcctcacagtgtttgagtataaaacaagtaggtgttaggataagacattgttgctgttggaggacaaggctgtcctttgtggatgggattcagcaaggtagacgtgtaattgtgagaggccaggccaccgagctatcctgtggcggagctcttgattatcagtggttagactgtccatgctgaagcgcatgaccactaaatctagactgcactttcctgaaaagtgaaggaaattatatcatttaaacaacccctcggttgattcattgtctctattattctagattataagccagaagcaaacaaaggcaggcaaggaaatttgaggttgttgcatctggaagtaaacatgtagctacttcttctaataaaacagaggtgagtattcctatggtacttctgagtcgaatctgttgctgggagattttggggggaaagcagtgcacgtgctcttgaagaaaagaagacctcaccaatgagaggtatacactaatgatagtggcatcaatatagatgaatctcaaaaacactatgctgaacaaaagcagccagatacaaaagggtgcagctgtgggattccacttacatgaaattctagaacagacaacctaggctattgtgaccaaaggaaagtcagtggttgcctcgggtgaggtaggggactactgactgcaggggacacgaggaaacttcctggggaggtggaaatattcaatatcttgattggggtggtggctccatcggtataaacatctgtcaaaacccactgagctgcgtgcacacttaaaatggatgcattttattgaggtcaagtataccccaataaagttcattttgaaaagccatacactggctaacagatacacttagaaagttcactttttggcagacattttgcttcaagctgaagttatccttttgctccacctgaagaaaggacataaaggggtgtgctgaggatgggagaacgggaaagcatttctattccttgctagccatgtcaccatctcagtctcgttattcttctagaatcacaaaatgtattttaatgcctaatgaagtgatttttgaaaatatccattattttgtctatataaattaggaaaatctgactagatacttaaaaatagattttgagcaaaagtaattaaaacataccttttggatagtcctctgtgtcatgtaaatttttaagtattcgatgactatagatgtttttaatttcaagctcacgatccttttcctaaaaagaaccacaaaaccaatttttctataaatgcttgcttttgtcaaccctgatttcttttaaaaacaatttaaatgagctcagtatcctatgaataaaatctgtagattttagaagaaacagaaataggccatatcatcctataccattcctgacatcgaaaagtactagctctttaaacaaagtgacacattattgtgatcgggacagtatttttgaagagccttgcaggtcagcttgtccactgttttccttctgtcctgtgggccttgaagtttatgaaatattcttctgtactgtgcattacagtagccactaactatatgttgtgatttcatttaaatgaaagtaaaactaaaatttaggtcgtcagccacactatttgtatttccaataggcggtcagcagctgtgtgtgactagtgactacagtattggatggcacaggtgaacatttccaccatctaatagaaagttctatgagacagggctacgtctagacaagggccgggggggaagcctagaacaagggtatcattgttccattttaaatttcatattgatttttttgagtcttggcaaaacagacattttgaaaccttaacttgttgaggaacaaagaaagggtttttattaaatatcaaatgctccttcttacatgtacaccaggaggcaagaaaggctttggactcaagaccattgaattttagtaacaaccatggttaagagaggtgggcatatatgaagtaaggaggaaggaacccagggatgtcagagtgtgacagacgtgcatgtgcacacacacacacacacacggggggtggggcggggagagagagctcttgtctccttgtgccccttagggtcaaatctatgggccaagggatattcagggggtgagaaacatctctgaggtttgggaaagtctcagtgcaagaggccttggcgtggtccaggaaaattgcaagccccttaaaaagcgcctcccccgccgccccattcatcatggagctaaagtaacatggtattgcccaagtgtaagttagaaagggctaaataccctctctaggccagagattgtgcttcccttacccttgcaaccagtgggacctgtggagggagctgcacctgccctggagtccttaaggttacagatccaggtgctcccatagcacaggctttgcaacagagaatctagccagggatcagatggaggatgcatctcagagcatttgcatcaacagtcagcaggggacaatcaccaggatttatttgaccagactgagaagaggccaggagttttagcagccacattcagtacacatcagacagggtcctgggaatttgatttaagactagtcactcgtcaggagaaccagctctagagaggggccagagggcagaacacagaccagaggcctctttttcactccaccaagagtacacatatgttttctctcatgcccaggatgccatctccactgagacagaagatagggatgaggaa

SEQ ID NO: 1317 - DNA, 3327 bp, Homo sapiens
gggaataggtaaataaacagaaataagacaaacataaataagagtgtaacttacaaagcgtgtgttcccagggagaagaatccagagaaaacacaaaatgttgtctagaagccgcagcctagatgctaaagaagtgctgtcttcaaccctgtagaaactgatactccacccgcttgttctttctgcttctagtcctgtgaccccaggaaccatcctctttccctaggactatcagccagcatctctcctctgtcgcctccaacctgccctcttcccgctccaccgagcacacctgcaggcaggagtgagaatcgttgctatgtggagtgggcaagtgtcttgaccactgtccttcccatttacatcatgcctgtcctaggggtaataacaatactcacctcactgggtgtgctgaaggttaaatgagaaaatgtatgcatccagcacagaaagcataatatgttttcttttcttttctctctcctcctcctttttcattctttccacaatctttccttccttccccaaaagttacacttttccaagcttaaagctccatcttggcatcaactgtaacctgaatgtatgccattcacagctgatttgccgggtgctgtgccacacagttctgaaccccagtgagggatcaatccacacccagtccccagctctaccagtctctggagcactctgcactgctctctccagccctacctcatgcacacgaaagggggcttggccaagtttagcatgtcatcactggcagccacactctgacctgcagtaacttctgcactggttgacattcaccgctttgaacatagaaacaagaggctccctgtagctgctgccttttgtgggcttcgccatcgtcctcctgagcaggttggttcctgcgagggatgcagctgtaatgtgcttccttttttacttctttgggccctagctgcaccaacagtatgcagatgttctgtgactgttacaaggacccatgttaggtgtcactgaagcaacctaagcaagcatgaagggatgggaggtgttttttggttcgttctacaaccctgtaaataagactccagcccttcactttggggcccacacatcacagtgaaatagccaggcccatcagtttgctccagtggaaagcagtgtcccagggagagggtgatcgtcctcttcagataactagaaactgcccaggaagcctcagctgtgcaagagaacactcaccagccatgttccacacactgaggctgctgcccttcacctgaggtctccttgactacatggcgatccctggttggctggtgcaaggtgacccgccctgccttggccccattcctgcagcatggacctcagtgggcgatggaaatcacccttttcctgagcttctagagtggctttccccaaaaagtgggctgtgtggagtcttgtgcatgtgctgcatagtcttgagaaatgctccaccaaagagagacagagagagagaaagagagagattctatgggcaatatatttagaaaatataattagaaggtatgttataatatattcctctccaactgctgttccccccatcttggaggctcttaaggtgtatgagctgatgaagagaagggagaggtcttgcaatcaagacgtctgtttaacatcatagggcccagtagctcccagatcaatggaacacagcttgggaaatgtggctccaagagaggttcagaaacctgtttggacatccaagccacatttggagcctcttaaataccacttcccatgctctgactcacatggggtctcgaaatctatatccctaaaagctccccactctctcctttgccctgcatgtgggtggtgctgggaaccactcttctgggacttgggggcagggaggaggttgggtggaagtcccaggttgctgctttctttagcagttatcccattcacttagggctttccagtgaaggagactgctgccaattaaacagaactcccctctccttggtaagagcagtgttaggaatgcccctttctggaatcagcctctgttttcatcctaagtaaatctgagaaggctccttgcttgcatttggaacctgttccagcctacagggaagcatcaggattaagaagaatgaataaatgggctggggctgcacatccagggtgtcatccatggtggtgggtctaaggccttgcctggccccctaggtcctgctgggtcctaaaatcctctttctatcctggtgtattagtctattttcacgcactgataaggacatacccaagacagggaagaaaagaggcttgattggatttatagttctacatggctgggcaggcctcagaatcatggcaggaggcaaaaggcacttctcacatggtggcagcaagagaaaaaatgaggaagaaaaagcggaaacccctgataaacccatcagatctcgtgagactcattcactatcacaagaatagcatgagaaagactggccctcatgattcgattgcttccccctgggtccctcccacaacaagtgggaattctgggagatacaattcaagttgagatttgggtggggacacagagccaaaccatatcacctgggcacaaaattacatttaattgtctcacacactacattgcttcacacctctgtgctttgctctcaggattccctctgttgatactcatttacccaatgcttactttacttggataagtcttttaccaaagatcggcccaggtatcattttcttcaggaaatcttcccaaatatcaggttggacccagtgttcctcctctgtcttcccaacatgccaggacaaaatcccattttaacacttagttcataggtgctgaaaggatgggttcatgagtccatgtgttactaagcaatcaatgggctcggtgcccgatgcacacagaagccaatactatggcacaagcttttgagaaaagaaaagttttattgctagtcaactggcaaggaggtgttatctgactggatcctgcaattaggtgttgccaggaggcatgatctgcctagaccctgccgtagagtgatgccagagcttgatctgattggagcctgaattctgccatgcagtgtctgcttcttttatcagtccccctcctcagtccactcctcggttccagcccttagaagccccctgtggttgcatatttgcttcatctgggcatgctcaggttatgtgaccttcaacctgggggtccatggcaattgaaaaacaactcacaactttcttccataaaagttgagccagattggtctggtgctgttatacatactttccccgaccccagct

SEQ ID NO: 1318 - DNA, 3940 bp, Homo sapiens
gaagcagatttttattcctacttattgggtgtgagaaaatatttttgaaaatattttgcaaattatttaatgtcgagtttaattcttccatgctgctccaaaccaaatgcccccaacccatttttctatctagtttcatatgattagtgcttccctatttattacaaaggtgtgggtgtgtgtttattttccctagaacaaatttacaaaacaaatataagtcattgggattaggcagatgctgcaaaatatgttggatagtcatttttaaaatgacaatgaaggcaaatttttggtctacctgcaagctaagcattgtaggaataacaaaagtacatccattgagttcagcagcctaagcatgatttttattagctaaaaggttttcttatttctgagagaattatatcctgtagttgacttcccttttctctgggtgctgagggagaaggacagaaccatatttaagactgttttttcttttccaaatactaatatttgaagaaatgaaatggctaagttagcatactctgaaggaaggtcttccctaaaacagtgggcatcactgtcttttacatattatcagcttgaactcataaacggggagaaattttaaaaaatctgggtagcttgagaaaacacaatgctaaatgcataaatagaaggcatattctccactctgaaaatctgtttctcactctctatctctcaaagcatgtttggtttcttgtttccgtttttgttttttgcaagagaactctccactaggggctgggtagtaagaccttttacacaccttcaaacaggaaatatccagcacacacacacatacacacacacacaataattgctatttcaggcttttgaaaaacagagttaaagtatgaattgggtcaatttgggcttttcaacttaatacttaaaaattatgttttatgtaaaatcatttgttgtaacccaataaatagcctttctctaacatcagtaaagttaagcttcaatctcccaatagcacatgtctctgcattttagccctaccattgtgtcactgcttggatcttacacagttcaaaacatacgtacaactaactacactagtgtcatgtacacaaacacagtggttgattaacacgagtgttaaggtttatcgccaggtgagctgcacaagcttttgatcctacgcaaatggctggtgccaacctcatcccatgttttctctgtggcccctcggagggctgctcacaaccttaccaccttcctctaggattctcccctagttcttcatcttgcctttctacatttaaccataatcgactcttctcctcccactttctaactacctttcttcacttctgttgtcttgccttcatgcatgtcccttctctgcatcaatatctgtaggctatacgtagaatatatattattttctctaaaacttccttgctgccctctgaatagttatcaaatcttgccttgtgctaccaacattgcctcagaaattatccaaataatcacctctcaccctggaggaggcacgaactcctgtcatttcctattttctggtgacacaatgatcgtttccacagtgcttcccaaggctcttaggtttttggagcatggggtatagaagactgtcttctctttctgtttgtccctggtgatcatttgaccataaccatgttgttctccaaaacgtcttagttcatagatcaaactgtattagattaaacgagatatgacttctgctccaaagtgcccctagagcgccttgcccttttcaaaccacacacttcttagggtcaggtgaattaagttaaatatgattcccttcaatgttaaagtgataggaatgagtctctgcacttcagtgctttaattttgtaaccaggagaggtgatggctgcattcagaaaagaagagaaagcttgtgtctgttctctctgctgaccactggcatgccttgtgaaggaccaagtcctgcttgcggtatggtcagccttagaactgtctgtgagccgcagggaacaagggcttacactgtcttctggggacattggcatcagcccagaggcattctcaggctttgacttcaaagcaacagcgaaaccaaaatggataaagatagggtcagtcaaatgcaacgtcttttcctgacagcaaaacaaacagagccagtgtcaactcatcaaatcctgccacgtaaattggtactctcctgcaggctaatagaaacagttacagaaagtggaaaacttgacttcactaaaaattactgcagttacaaataaaggaagggggtatagtgtatttctaaaatgtgcatctggactaagatttagggagggttgagcgtgagcacaacttaattcacccccgaaagagaaggcttgtcagccagaaataacaaaataagaaaagcccagcaagttggcccccaggtccaagtactgcagattccagtgtatctttccatctcttcttccaacaacacaatgactgtgaaacataaggagggaagaggaaatagtcttcctttatgtgacaaacccccttttcagatgttcagtgggacagtctgagtagcagcgtcttctttcaagagcataatatagcggagcatgtgattgcatttccaacctataaatatccagctcctgaacactcatctttgagttctaaatggaataagccattatttccatattcaaaactgtaacagactggaatgttgttcagcaaatactactctccaccccaggccccctgcagggaagcatcttaacctgtcccctgacacctactgccaccctgactttgagactggtcatgtgacttacttggactaatgggatgtgcgtggacatgatgcaggcagaggctttgcagctgcttgcataccctggctggcttctgcactctgatgatccaccatacaaaaacatgtccctattgacagccgatgctttagcctggccccagaacaaacacacttggagaagacctcaatacaacccacagcctggggctaagccagataattggggagcacaaagcagtctcttagccgagcccagtgtagaccagctgaatcacagttaaccagcagaaatgtgggtcttggaataaatacttgttgggtaagtcactgaggataattggttaaacagcatgcttgtgtcattaaagccaaatcaatgcatgaaaaaatggcatggtcaagtccatgcttcttgtaggcatttcacttattcagttaacacctgagcactgactatgtgccattcattgtgctatgttctaaggatgaaatgatgaactacagtgaacttgctttcatgcagatgatcatcagtactcctcaaagtgaagcaagactgatactacacattatccgactgataatgcttttcttttgtgaatagatgccgttttctcaatttcttgctccttttggtacatttggagcactgctagtcttactacaaaaggactgttagaaaccactagcttgcaaatgtgttcacaataaagctgtgatttatttattatagcagcaccaagtagcatttttaatctactcatacagtggctttcaaagagttgtttctggaccaacagtgaaagcatcattcagggacttgttggaaatgcagattcgtgggccctgtctcagaccaactgaaacagaaactcagggctggggccaggcaagctgcatttaacaagctctccagatgattctgatgcatgcacaagtctgagaaccactgcactagagcaatgtactagagcaattttcttcatggcaccaaggtgacctggaagatttctcaaatgtttgctcaggtttcagataacagcttatacatttaaaggattggacaaggattctcctaagggtaaggatttttcaagaataaaaaaaagaaaccatttaaat

SEQ ID NO: 1319 - DNA, 5188 bp, Homo sapiens
aatacaatacttatgcagaatagtttatgtatcatacatgatacttcatagatgtgtgcatattaatcatagaatactattgggataaagcatatgtgccacttttaaaaattatattctcaaagcattgtaggtaactataatctaaccaaagtttaaaatctcaaattatctaagaaaatatgataagcgatttctgcttaaaattataaaatgaaatcaccataaaactcataagcaacaggggaaagagttgaaataaaaatttgtgctgggaagcaaatctcacaattaagcagaagaaacggagggcaggggaggagggcaggaaagagcgagcgtctgaaagatgcaggtgtgaaaggagccggaatgctggggaggactggaaacagcatggatgaacacgaggatgttcctcaaggatgatccagatggagcgccctttacccaaattgaaaagcgcttggctatactcttgcaacttgcacactgaacgcggtgcttctagggacattttaaagaatgttctggccgggcgcggtggctcacgcctgtaatcccagcactttgggaggcagaagcgggtggatcacgaggtgaggagattgagaccatcctggccaacatggtgaaaccccatctccactaaaaatacaaaaattagccaggtgtgatggtggcgcctgtagtcccagctactcaggaggctgagacaggagaattgcttgaacccgggaggcggaggttgcaatgagccgagatcgcgccactgcattctagcctggcgacagagcacgactccatctctaaataaataaataaataaatgttctatacctcgtgtgtatgtgcatgcacgtttatgcacccacacatccaaatttgtgttaagcacggatacacacattgcagtcgagggtgtgaggacactgtggtcccacatataaaagaataaagtggttagtatgttagaataagtgaagtgatacaattttaaagactggcaagctatggcatgttatgtttatgatgtataattaattcaattcttgtctctaatcacctttcacctccccttatccacacacacacacacacacacacaaacaaggaaaaagataccccgaagaggagcaaaagtacccaatgggcatttcaaaataggtgtagtggttcggaaggaaacatgtcaatatttccctctactcaatttctccttgaacgtctgaaatacactgtggcgatgaagcagatttttattcctacttattgggtgtgagaaaatatttttgaaaatattttgcaaattatttaatgtcgagtttaattcttccatgctgctccaaaccaaatgcccccaacccatttttctatctagtttcatatgattagtgcttccctatttattacaaaggtgtgggtgtgtgtttattttccctagaacaaatttacaaaacaaatataagtcattgggattaggcagatgctgcaaaatatgttggatagtcatttttaaaatgacaatgaaggcaaatttttggtctacctgcaagctaagcattgtaggaataacaaaagtacatccattgagttcagcagcctaagcatgatttttattagctaaaaggttttcttatttctgagagaattatatcctgtagttgacttcccttttctctgggtgctgagggagaaggacagaaccatatttaagactgttttttcttttccaaatactaatatttgaagaaatgaaatggctaagttagcatactctgaaggaaggtcttccctaaaacagtgggcatcactgtcttttacatattatcagcttgaactcataaacggggagaaattttaaaaaatctgggtagcttgagaaaacacaatgctaaatgcataaatagaaggcatattctccactctgaaaatctgtttctcactctctatctctcaaagcatgtttggtttcttgtttccgtttttgttttttgcaagagaactctccactaggggctgggtagtaagaccttttacacaccttcaaacaggaaatatccagcacacacacacatacacacacacacaataattgctatttcaggcttttgaaaaacagagttaaagtatgaattgggtcaatttgggcttttcaacttaatacttaaaaattatgttttatgtaaaatcatttgttgtaacccaataaatagcctttctctaacatcagtaaagttaagcttcaatctcccaatagcacatgtctctgcattttagccctaccattgtgtcactgcttggatcttacacagttcaaaacatacgtacaactaactacactagtgtcatgtacacaaacacagtggttgattaacacgagtgttaaggtttatcgccaggtgagctgcacaagcttttgatcctacgcaaatggctggtgccaacctcatcccatgttttctctgtggcccctcggagggctgctcacaaccttaccaccttcctctaggattctcccctagttcttcatcttgcctttctacatttaaccataatcgactcttctcctcccactttctaactacctttcttcacttctgttgtcttgccttcatgcatgtcccttctctgcatcaatatctgtaggctatacgtagaatatatattattttctctaaaacttccttgctgccctctgaatagttatcaaatcttgccttgtgctaccaacattgcctcagaaattatccaaataatcacctctcaccctggaggaggcacgaactcctgtcatttcctattttctggtgacacaatgatcgtttccacagtgcttcccaaggctcttaggtttttggagcatggggtatagaagactgtcttctctttctgtttgtccctggtgatcatttgaccataaccatgttgttctccaaaacgtcttagttcatagatcaaactgtattagattaaacgagatatgacttctgctccaaagtgcccctagagcgccttgcccttttcaaaccacacacttcttagggtcaggtgaattaagttaaatatgattcccttcaatgttaaagtgataggaatgagtctctgcacttcagtgctttaattttgtaaccaggagaggtgatggctgcattcagaaaagaagagaaagcttgtgtctgttctctctgctgaccactggcatgccttgtgaaggaccaagtcctgcttgcggtatggtcagccttagaactgtctgtgagccgcagggaacaagggcttacactgtcttctggggacattggcatcagcccagaggcattctcaggctttgacttcaaagcaacagcgaaaccaaaatggataaagatagggtcagtcaaatgcaacgtcttttcctgacagcaaaacaaacagagccagtgtcaactcatcaaatcctgccacgtaaattggtactctcctgcaggctaatagaaacagttacagaaagtggaaaacttgacttcactaaaaattactgcagttacaaataaaggaagggggtatagtgtatttctaaaatgtgcatctggactaagatttagggagggttgagcgtgagcacaacttaattcacccccgaaagagaaggcttgtcagccagaaataacaaaataagaaaagcccagcaagttggcccccaggtccaagtactgcagattccagtgtatctttccatctcttcttccaacaacacaatgactgtgaaacataaggagggaagaggaaatagtcttcctttatgtgacaaacccccttttcagatgttcagtgggacagtctgagtagcagcgtcttctttcaagagcataatatagcggagcatgtgattgcatttccaacctataaatatccagctcctgaacactcatctttgagttctaaatggaataagccattatttccatattcaaaactgtaacagactggaatgttgttcagcaaatactactctccaccccaggccccctgcagggaagcatcttaacctgtcccctgacacctactgccaccctgactttgagactggtcatgtgacttacttggactaatgggatgtgcgtggacatgatgcaggcagaggctttgcagctgcttgcataccctggctggcttctgcactctgatgatccaccatacaaaaacatgtccctattgacagccgatgctttagcctggccccagaacaaacacacttggagaagacctcaatacaacccacagcctggggctaagccagataattggggagcacaaagcagtctcttagccgagcccagtgtagaccagctgaatcacagttaaccagcagaaatgtgggtcttggaataaatacttgttgggtaagtcactgaggataattggttaaacagcatgcttgtgtcattaaagccaaatcaatgcatgaaaaaatggcatggtcaagtccatgcttcttgtaggcatttcacttattcagttaacacctgagcactgactatgtgccattcattgtgctatgttctaaggatgaaatgatgaactacagtgaacttgctttcatgcagatgatcatcagtactcctcaaagtgaagcaagactgatactacacattatccgactgataatgcttttcttttgtgaatagatgccgttttctcaatttcttgctccttttggtacatttggagcactgctagtcttactacaaaaggactgttagaaaccactagcttgcaaatgtgttcacaataaagctgtgatttatttattatagcagcaccaagtagcatttttaatctactcatacagtggctttcaaagagttgtttctggaccaacagtgaaagcatcattcagggacttgttggaaatgcagattcgtgggccctgtctcagaccaactgaaacagaaactcagggctggggccaggcaagctgcatttaacaagctctccagatgattctgatgcatgcacaagtctgagaaccactgcactagagcaatgtactagagcaattttcttcatggcaccaaggtgacctggaagatttctcaaatgtttgctcaggtttcagataacagcttatacatttaaaggattggacaaggattctcctaagggtaaggatttttcaagaataaaaaaaagaaaccatttaaat

SEQ ID NO: 1320 - DNA, 8213 bp, Homo sapiens
aaaagtaaacctagcagacttaccctttcatttcttgactggaactatgacatatgaccacacctcaccagaagatagcactggaggaaggattgggctgggggatgagccagtgacctcacatgtctgccacatgtaagatgtagtcccaagagtgagctgatcaggtccaggtacatgttgtttttcaaaaggattttttccagttcataatgccattagcaatagccctttatcacactttaccataccttcaacaacattctttgaatactaatgaggctgaacattaaccatatgctccttaataatttttcctgaaatatttccatttatattcttctttttctttttaagttatgttcttctacacttagaaaaaaaaagctctttaaaaaaatattaactctctttgtcacatctattgcctgtttcaatttttccttttagttttggaagttctcattttagagatatttaaaattttgtatacaatcattccacagagagttggtttctagaggactgctgctagtccataagacatcttagtatgaaacagaaaaagccatctcttccacgagacattttatttccatatgttagaaaattgtcaaatcattatgattttgttagagcaagccacttgactaccatcttttagaaatatttcttaataaatatacaactctacaattcctgtatatggatggtacctctgtagatgtgtcctctgaggttatgtgtgtaaacttccttcgcagagcatacacacctagtttctaaaaagtcagagaagattcatgcgaatgactaagttgcacaaaaagattattaagaattggactctgtgggagactaaaaataagacataattggctttggaatcaattaaagtcattaaaaaggtgtctgttcaaagatttcctactttgaattaactaaagataaatttaagagtatattgcagttactgacagtaataatagcatatgaggttatcaaactgagtttaaaagggaaaaagtaatgtatgccattgatttctatgttttaatataaaagctttcttcaggttaaggtaaactttaacattgcatttataaactgtatatttcagtatgcactctgaaggtgtaaaaaactgtatactaagcttttattgtgattgttcattaataagttacataattttgggaaatcgcttaatttctatgagcctctgtttcttcatctgtaaaacagagataataatgttgggattgtgtagcttataagggtgttataacaattatttttaaggcatttaatgaagtcaaaagggcctaagtcatttaaataggctccaaatggaaagtataattcttacaatacatttaactttataaggtgttacatttgcttacttgattttaaatgattgaagaagaaagaagaaatattttggctgaagttaaaaagcaagaatgtaaagtgaattatagatcctctgtagctgatacattgaaagatcagtctggcatgatgacatgatttggtgaagcaagcttgatataaaagagaaaagcttcttctctaatagtaactgtaaaccgagtctttcaaaaattatttaatttggcactaaagtaaaggacacaatatctacagcctatttttcctcttgtttagacctcgagtttttctctgtctgtctttagctatctcagacatcgctcattgattgatagatatgaatatttaaaaaaagatatgattgaggcagtttgaatcttcagtgtaaatagttttgtctgggtctatatagaaaatatcctttaaaaacacttagtagctaaatcaaaaaatatgtatatatatagaaatttatttacctaaacttgttggctagtgaaggattttaattccactgtaattttctcaggggcaacttctatgtttgtcagttacttaaaaggacaaaaaatacattttagaaacattttaaaatttgattttagcagaaatcattttaataactctctattctgtgatgagctggaattacagtacagcttgaggtatttttcttttccatgctttctcagccgtaaaaatgggtccaggttctcccagcgttccgtgcttcacagagggaggagactaacataatcaggaatggtgaaaagttggtggatgccgtcactggaagaaaaaagattaggctacaactggagatccataagtagcttacagaatcttgcttttaaaggctattatcattataaatgtatcagttactttcagttgatatacacttagaagttttactataatttttgttggagcaataatagtcaccactgtagagataaactctaagctgacaaatgatctgcttaaaacaagaggatctgatttatatctagttccaaaccacagtgtgataatattttagctttaggagtagtatcgttacagttttattggtatggtgtattgtttataatcttagctaccatttcccctttctctctatgcctaactattcatcaacttttatatgtatagttaaagagagtagaagtcaactttcatgaaattaaacttaaatcccttaaatttgttacctatacccttgcccatggcaagacttcaatatagtcaactcaatattaggtaaacaggacactacattagaaaattgaattttgttatgaatgagccagggatactaaaaaatcccctggtttttattttagatgggttgggatttaaaagaaaattactaagttttactgcgtctttggagtactattctgacatttctagtgatctccataaactttcattgccctgtaacagtttattaagctacagtcttcataaatatgcaaactagcttaataagattgtctgccatgattgctcatcaatttggtattgaaagggcaccaacatagtcgataaaaatgtctggtggtggaatggtctgtgacatgcctaatctcattgcatagttcctttaagggggctataaacagttaatataatagaatctcattatttgtatgagtggaatgactattatgttcattaggcttgataacttttgtgtagctacatttcggaaacctataaacagtcgttatgaatgtaaattttcctcctgataattttatttcactacacatgtatttattgtttggaaaatgaattgttggcaaattaaatggacaaaaaattggttttaagatggatcaagaaaaatacatgtttattgaggagactgtagaatgaagaatttattctgagtagtctactttcccatagggagcaagtttatattaacaatttagaaacaaaggtgtttcattagtttttaaaaactttaatttgaaataattatggattcaaagaaatgtacaaagaagtactgtcaacattccacaaaaccacagggcaatatcaacattaagaacagaacattggcacaatccagagtttattcagaattcaccagttatacatgcatcattgctgggtatgtgtgtgtagctctatgcaattttgtcacacgtgtagctttgtgtaaccatcaccacaatcaagatactcaactgagccatcactacacgactcccttgtgtcccctctttatggccatacccatctcccttcctattcctaactactggcaaccactaatccattatctatttctataattatgttatttcatgattgttatagagatggaatcttgcaataagagtcatttcagatttgctttcttcatgcagaataatttttttattttactttaagttctgggattcatgtgcaggacatgcaggtttgttgcatagttatacatgtgccatggtggtttgctgcatttaccaacacctcatctaggttttaagacccacatgcgttaggtatttgtcctaatgctatcccttcccttgccccctaccctccaacaggcctcagtgtgtgatgttcccctccctgtgtccacgtgtaatgcagaataatttgttaaggttagttcaagttgtcttatgtattaacagttctttgccctttatggctgaatagtattccatggtataagtgtacctttgttgactcattcaccctttgaaggacatttgtgtgctttccagtttggggctaatatgaatgaatctgctatgaacatttgtgtataagcatctctgtgaaaataagtatttctctgggataaatgctcaagagtgtaattgctgggtcatctaattaatccatttgtagttttgaaagcaactgtgaaaccatgcagagtggttgtaaaatcttacttcctaccagcaatgcataagtgatccagtttcaatgcatttttgccagcatttggtgttattaccatttttaatttcagttattctaatagatgtgcaatagtatcttactgtggttttaatttgtatttctctactggttaatattgtagaatgcattaggatttttttttttagacctcacttttctttaaaaattttaattttttttcttttttttttttttttttacgctgagtctcgctctgtcgcccagctggagtgcagtggcacgatctcggctcactgcaaccaccacctccctagttcaagcaattcccctgcctcagcctcctgagtagttgggattacaggcacaggccaccacgcctggctatttttttttttttttgtatttttagtagagactgggtttcatcatgttggccagactggtctcgaactcttgacctcaagcaatccacccacctcagcctcccaaagtactgagattacaggcataagccaccacaccttgccaaaaattttaagtattatattcaagggatttccagagaaatagaaccaatagaatgtcatattacatatacgctctctgtctctctctggctgtctctctctctctctctctctctctctctctctctctctcacacacacacacacacacacacacacacacacacacagagagagagagagagagagagagagaaagagagatccttattttaaggatctggcttatgcaaatgtgggagagggcaaactgtgggctggagagtgaggtaagagttgatgttgcagtcttaactctaagccctgaaaacttaggcaaaatctctttgtgcagtctgaacacagaatttcttcttcaggaactctgtgtttgcttttatggccttcaactgatttgatgaggcccactcacattatgaagggtgatctgctttacttaaagtcaactgattttaactgtttattaaatctaaacaaatatctttacaataatatcaagactaatttttgaccaaacactgatcactgttgtttagccatcttgacagataaaattaaccatcacagatacttctcatcaaatatgtgtgttatttcttttaaaattatttaatttaatttatttcaaaaactggtgataaaatacacataacaaaatttatgattttaatcttttttaagtgtacagttcagtagcattaagtacattcacattattgtgcaaccatagccatcatccatctttagacttttacatcttgtgaaactgaaactctgtatccactaaataataatttctcatttccccctcccaacagactctggcaaccaccattctactctgtctccatgaatatcacttctctaggtacttatcattttatgactagcttatttcacttaggataatgtctaggttggcccacactatagcgtgtctcagaatttccttctgttttaaggctaaatgatattccattatgtgtatataccacattttgcctatccattcatctgccgatggacactgggttgcttttaccttgtgactattgtgaatgatgttgttgtgaacatgtgtgtatgaatatctgtttgagtccgtgcttttaattctccatgtatatacccagaagtggcatcactagattatacagtagttctatatgtaatttctgaggaaccatcatactgttttctacaatggctgtgccattttacattcccaccactggttcacaagggttccaatttctccacatccttacctactcttgttattttttcttaagaaattttacttgaatttggtcatataatagaagcatctggattcattagctaatttgtttgataaatagcacttcttgaaaagtatatataaagattgaatttcagttttggctctgcagtatacagctgggctactctggccaagtcacttcatggttttcttagttataaaacaggaacagtaatgtctacattgggaaggttaaatgagttttaagttgtaagttagcatatagatgcaaggcacactattattattattgttattatcatgttccctgaaacactcttagtttagtgctttgtcttaatttttagaaaggataatacacagcctctaactataatctttaatcttttatttaattttcccatccaatgtttaattacctgcataatttaggaatttttcctttgataattttattaaataatatgtagtgattcataaatttgtaaacaccttttaccaaacttcattttatttttgccttacaacaattgcaggagttatatccattactctctcagcatataaatgaagaaaccaacattcagataagagagcgtcttgcgtgtatatggggatggagccaggcaggggcagccctgggctgagacagctcctctaacccctcagcctcagcacatgcggttccatatgtgccattttccaaagatgtaactttatctccttgatcttattaagtttagattttggttttacttatacgaattgtcagaaaaattcctaatggaggctacccttataggacaccctattttacttaactaactacttttcatagaatttttgccataccataaaatagctaatgttaaattatttattgttgtcagtacacatctcaggaatccacaaattttacttttaatggccactgaatgtataattttataacatatacacttacatatcttgttcataaaaatgtagggggcaaaatcaatgtgttttaaaggtctggcttttgatataaaatgaaagcaaaagcagaaccaaccacctccactgaaacaaccactaggatcaccaccaccacccacagcagctgccaactttttagaatgtatgtgtgtgtctgggggtggtacaaggggagttgttaagtaggcaagaaagtgcaattttacagccattttgaaaagtctaagtttggtagaagttctttctatgacattttcttggggctaaaatctgacacttcatcgttcttgatttgcaggagccctcaggcctcttgctttcacatgtcttttacttcacaggattagcaccaactcccttaacctaacttcccataaagaaaagttttctttttcttggtgagagtgtggtgctgtaggtaactcctgggaatgtgatctagctgtcaaaagcacaaaaagtcagctagatacattgggaaaccaaaagtctatttggttttagtagaagattataagagaaatcctgggtactgtttgttgactatgccgtaaaattgcgttcaatggctctcttcttacctttaacccacttgcttctccatctctgttctccttagtttgtggggcacaggtgcatgtggtagtaatgcagtcagttggtagtgacagatttatcactgaaggaagaagcttcttcattctttacatggccatgacagtgactatgacaagttatttgtcttaacaacgcaggctgctcttccccagtagaaaatgagaatataaagaattagcacaagtcaagcacatctaaagggaaaagtaacaaaaatgactatgttaggtggatcagtttcttactaaaaacaacacaacattatgagtacaacttttctaatcacacgttctcattccttttgtgttttctttttcttttatttctaacctttcatggtgaccttttctctctgtaagtttcttctgaaaagaataggaaaattttgtgattatatttattcattgaaagagaaaaataaatgaaaaagcaattgggcatctttgacatatattggtgaaaacttttacttaataccataagaataattttggtccacttattgataa

SEQ ID NO: 1321 - DNA, 11580 bp, Homo sapiens
attataccaatggaaaaccaaggtggaggaaaaaagattggttggttgtcgaagacatagcggatgatgaaattggcccttccaaggctggtggacatcatgggtggtgatttgctaatgtctcccagttttaaccaatttgctgctttaaaatcctgttgtcatcacatttgtattgcaaagaagccacatgtcactgaaaatgaaggatacaggaacacactgtataaccttaaaaaaactactgctctaatggtacagaaggcctccaaagccctttaaaaaactaaaaagaaatgttcaagcaggcggatgacaaagttcagtattttaaaattagccacagttaatccaaatgaaagttaataaattccactaaaagtcacttccagcaacaattcctttaagagtcaacttatttttaaacctacacaatgaattttaaatcagaagggctattgattcctcagaggagttgcccaagtaattgactttatatttaaataaatctaagatttacaaggaagtggatagagaagaccctctggttttatttctattttgaagtcagactttgcatgttagtactgacccacccaaaacaggctttcctgtggagccacacagttgggaagtccctttgttgcctgtgtagtttgtgcatttagaccctgcattattaattctagccattctatctccgcattttatttctctgtgttagccttgttagactaccataaattttatttggggtgtggctgggtaactgcccattctcagtcatactcaggcatgtaggtgtacacacatgcacagaagccaagaactatatttctcaatttgcagacagaaagacaacaggtacaaagccctaaggattataaaggtatgctgcttaccatcatcttagtgaccaaggcagcgaagctgtttctgtaccttggaacagtcttccctgacaagccagagaacagtgataaagccaccagccttgggatcaggactgaaaaggcaagagtgatggagatttctcctgcgctaagccaagagaaggtttcagcacttcagacagctcccaccgaagtagccgcgctcccagctgcttgcagatgttgaaaaggaaagcctcggtttgtcttgaggttgtcagcaggtgcaagacacgtaataaaatgcaatgtgttcctaattcattgcatatcctcagctttaaatttgggtagcaaaatgattactctagattcttcagtcttggcaagtatctgtacctaaaaagcagtttttctacctaatgtctttttttgtttttgtttttcaatacaccttaagcaaattgaagcttttgttcctggaggaaaagtggtttgatatgttcatctatcttttagtaaatttgggggcataacttttccaattctgaggaacttttctaagaagagtgcataaaagtttgttgttgtttttaaaggatgcaacattcagcctgtgtcatgagtttaattatacaatttaaaggacatatgtgcaatgcattttgcagatgtgtgccggatatatatgtgcagataatgggcaagtatatatgtgtgcatatatatatcgggagtatactatataaacacacaatacacgcccacccacacacattgtgtattttccagaaaaaaaaaaaaaagcatgtcaggacttacatctaagttagagatgctgtttagaaccccattaaaaaatgtacatgttatatccctgatttgtttctcaggacacctgtgtttatgtgagaatcatttctagacacatgtcacaataaaaagaaggacatgtatactccaagttaagattttttaaaaaaagatggagatcatctgaaataaaattcagagctcttgcctttcctttctcctagcgacacctagagcctgttgagaaaaaaactgcacattgttctcactccaaacatccacaattcaacaattttaagtcagatttaaggtaaaaagtacatttttcctgtttgcattgcagcttaactgtcttccccaagattctcggtagtttaatcctccagaactcttcaccctcccccaattaaaccatttgccaaagacttgaaccagatgactgaaggatctgtctatttccctcagggcttggcccaccaaagtgagggacatgcctttgaatgactattgaaccaggggagtctggaaatgatgcaggagaaaatcacaaaacctcgtgcaaaatctgacgcagggctgtagggggtgtgtacctgtgtgtgtgcaaaccacatctcccacaaagttttgtgatctccattaaagtttccacatccttcattcataaaacaaaaactaccaataacaacagcaaaacctcactgatttcatagtatctggcaattaggaattgtccctgggaaatcactcaatgtctcaccgcccccccccccccgacccaaacacaactcttgcactaaagaaatatgaaacagggaaacagcatggctggaggctgcagaggtaatgaccaaaaccacctactcagtgccgggcaatgtactgccctgggtacgtcagggtagactaagtgagaggccggtgggacccctgcggttcccaggttgagcagttgtgaaactcctcaaaggcatacatagtaatttctacaaaccaacacagcctagctgttataagagctgtaccagccaagccagacctgtttctctgagagcctgtcggggatttttctcttttccctgggaaaagaaggcctcaaagaaaaagcacagtttcctcccttctaagtcctagcagccctctgcatccttgaaagggatccacaggaggtggttaaacgcatccatctaaggtccggctcctgtcctgcatgagtcattggttactagggcgatgtgcaaatccaacctttgaaacccaggcttccagcccccatgaagagtaggaaatgtgctctcggagaagttttcactgaacacggtctaaggcagaggtgctagtccagggctgggaggggagacagacacggcctgagagctctcagcaaaattgctgggccctgggacagagggttggggctcagatgccagtattttggtatttttttttttccggaaaggataatcaccaccaccaccgctggggggaaaaagtgtctaggagaagtaagaagaggaacgaaggagaggcatttgagtcaagggacagagtgagtaggagaggaggggcacgatggagagattccagacacaggtgggagggagagaaggtgcctgaggctgtgttcccggagcacgaaataaataaaaaataaaccaactcgtaagcacaggccgatcgaattctctccttaggaaccatagcagcatgctgttaaaaacagacatccgcacatccagggaacgtaaggcgaattccagatcccagcaggcgcagtacccaaaccccgctctctccagccaccaactcccggccgccgcggctgcagacacagacccgctccctccgggacggcgatgaccgcgatctggcgccacggagcctgtctgggggcgcccggagagtcgtgggctgggggagggcgcctgattcccccccccacagatgcccccggccgacgcgtctcgctgcgcgctcagcccggagcccccgccgccgtcccccgcccccgagaagctcttacgtcctccttgtcaccatcgctccgcgcctggtactggaaccggggccggccatccgcgccgccgccgccgccgccgccgcgctcccggggcgccgccgcctgcgcccgcgggccgaggggcttggctcctgcgccgccgtcctcctcgggcccctggccgcccaggaggtgactcgcctccgggggcgtggggaaggacctcgaggtgttgatcttgccggtgaacctctggtacagcgaagccatcgggcaccgcgctcctgctggctgtctttagggctttttaatattttgctttctctccggttcccactccccaccccgctccagattaaaaaaaaggcggtggggaggcagcagcagcagcaaggcaagcccagcgccggcgaccgctcctcccgcgcgccactcgcgagtctccgctggcgactctacctggctcagcctcctccgccccctccccggcggctcgcgaagccggggctctggctgttctttctctctttcctgtttttataatttttttccccaactccttgccacagccacgtacggcctaatcaaagagattgaaggaagaaaaaaaaccaaaaacataaagcgagggaaatgcctaggccccagaatttggcaccacctagaaacccgcacacattccgagcgctctcctcgctccccgcccccaggcccctcgcgcagctcctcctccaccccggcccctccgcccccttccccaccggcctcctccccgcgcccgggactggcgcctgggtggcaggggttggcagcccggagagggcacggggtcgcacaaaaagggtgcgagggtgcgtgaagagggtggaggggcggggaccacgcgggtcgtgggtgcgggggcggtgggggagtcccgggagctgagggttctgcggccccgccgaaggtagtgctgcgcgtgccccgcagcacgcgagcggacggtgcaaggggatgcggaggtcgaggcaggcaggccggccagggggcgactgaaggtgcagccggccccggggcgccccagccacgcacgcgctgcggcgccgggctccccgcgcccccagctcttcttgcctaacttgaagcaacaccagagacaccccgaggacctggggtgcaaatggggcgtgggagagccaccaggagggcgcggggtggtcggacgacgctggtgaggaggccgccctccctccacagcccagctccctccgaaaccgccccttcccttcgcctctctccggaggagagcaggaaaggtcgcggggcggcagaggacgcccagaggcccaggcgcccctcgcgggcgctgcgccccgcagagagcccggctgtgaccgtgactccattctcattatcatgaacgcaggcggaggctcggctctccggctgcccgcaacttttccaaagcctgcgcctcactgtgcccgccgagagcgagggagggcgacatggctccactcgccgcgcgctctcgggcttgcctcctgcccagccgcaggaaggcgcgctccagcgcccctgtgtggacacccgcaccagcgggctccgctcctccgctccaggcccggcctggcttctcttcccctcccggccctcccgcgtcctccccggctccctcctgcactcttctccgtccttctggagttgctgggcacgcgtctctctcgtctcgtccccacgtcctccttgcgcgccccttccagcccttcccggccgggaaggacctatcacatccagagagcgaacgtgggccgggaaaccccaactccagaggggggaacctgtgagacccgcccctgcccattccgccgcctccttccacatggaggtaggtcgttggcttcatctcccaggactgctaaggctccctgctccttccgggtttccatgcctgtttccacttagggtttcaaaataacaggctcggccgccacgcacaaggctgactgcaggctcgcccccagccttggcattgccccaagcccagagagaggcctgcctgggcctgaaactgcatgctccctctgtttccctaactgcgggggagaatactggatgccggtgaacaagtctcctgggaagagacctcccttcagtcccttccacctgcctcccttccccaagctttcaatccagtgtgtagtttttggtttaaccaaaatttgtaccacgctcatcttctgtttactccacagtagttaccctttactatgaagaaacatgagtttaaaaacactttaaaaaaatagcaaatacaaaaccaagtaaaaccaggattgcaacagctaagcaaaacttgctgcatgggagaggccaggcaggtgggtctggggtggggagagcttcagctgctccatttgactttgaagacagaggcaacagagccataaaactaaactttaaaagtcaccacaattagatagatagaaaaccttgctctcaaccccctcctctgccccagctgtgcttttgatgggaggaagctgcctctcctaacatggacatgaaagaaagctcatgctattcaccgcagcatcgcgatcctgacatttcactaaatatagatgcagttagggtcccacttatgtaatatacatatgctatctatgaaatatgcatgcatatttttacacaaactaaatgtcatactaatatagtttatacaaaatacaatacttatgcagaatagtttatgtatcatacatgatacttcatagatgtgtgcatattaatcatagaatactattgggataaagcatatgtgccacttttaaaaattatattctcaaagcattgtaggtaactataatctaaccaaagtttaaaatctcaaattatctaagaaaatatgataagcgatttctgcttaaaattataaaatgaaatcaccataaaactcataagcaacaggggaaagagttgaaataaaaatttgtgctgggaagcaaatctcacaattaagcagaagaaacggagggcaggggaggagggcaggaaagagcgagcgtctgaaagatgcaggtgtgaaaggagccggaatgctggggaggactggaaacagcatggatgaacacgaggatgttcctcaaggatgatccagatggagcgccctttacccaaattgaaaagcgcttggctatactcttgcaacttgcacactgaacgcggtgcttctagggacattttaaagaatgttctggccgggcgcggtggctcacgcctgtaatcccagcactttgggaggcagaagcgggtggatcacgaggtgaggagattgagaccatcctggccaacatggtgaaaccccatctccactaaaaatacaaaaattagccaggtgtgatggtggcgcctgtagtcccagctactcaggaggctgagacaggagaattgcttgaacccgggaggcggaggttgcaatgagccgagatcgcgccactgcattctagcctggcgacagagcacgactccatctctaaataaataaataaataaatgttctatacctcgtgtgtatgtgcatgcacgtttatgcacccacacatccaaatttgtgttaagcacggatacacacattgcagtcgagggtgtgaggacactgtggtcccacatataaaagaataaagtggttagtatgttagaataagtgaagtgatacaattttaaagactggcaagctatggcatgttatgtttatgatgtataattaattcaattcttgtctctaatcacctttcacctccccttatccacacacacacacacacacacacaaacaaggaaaaagataccccgaagaggagcaaaagtacccaatgggcatttcaaaataggtgtagtggttcggaaggaaacatgtcaatatttccctctactcaatttctccttgaacgtctgaaatacactgtggcgatgaagcagatttttattcctacttattgggtgtgagaaaatatttttgaaaatattttgcaaattatttaatgtcgagtttaattcttccatgctgctccaaaccaaatgcccccaacccatttttctatctagtttcatatgattagtgcttccctatttattacaaaggtgtgggtgtgtgtttattttccctagaacaaatttacaaaacaaatataagtcattgggattaggcagatgctgcaaaatatgttggatagtcatttttaaaatgacaatgaaggcaaatttttggtctacctgcaagctaagcattgtaggaataacaaaagtacatccattgagttcagcagcctaagcatgatttttattagctaaaaggttttcttatttctgagagaattatatcctgtagttgacttcccttttctctgggtgctgagggagaaggacagaaccatatttaagactgttttttcttttccaaatactaatatttgaagaaatgaaatggctaagttagcatactctgaaggaaggtcttccctaaaacagtgggcatcactgtcttttacatattatcagcttgaactcataaacggggagaaattttaaaaaatctgggtagcttgagaaaacacaatgctaaatgcataaatagaaggcatattctccactctgaaaatctgtttctcactctctatctctcaaagcatgtttggtttcttgtttccgtttttgttttttgcaagagaactctccactaggggctgggtagtaagaccttttacacaccttcaaacaggaaatatccagcacacacacacatacacacacacacaataattgctatttcaggcttttgaaaaacagagttaaagtatgaattgggtcaatttgggcttttcaacttaatacttaaaaattatgttttatgtaaaatcatttgttgtaacccaataaatagcctttctctaacatcagtaaagttaagcttcaatctcccaatagcacatgtctctgcattttagccctaccattgtgtcactgcttggatcttacacagttcaaaacatacgtacaactaactacactagtgtcatgtacacaaacacagtggttgattaacacgagtgttaaggtttatcgccaggtgagctgcacaagcttttgatcctacgcaaatggctggtgccaacctcatcccatgttttctctgtggcccctcggagggctgctcacaaccttaccaccttcctctaggattctcccctagttcttcatcttgcctttctacatttaaccataatcgactcttctcctcccactttctaactacctttcttcacttctgttgtcttgccttcatgcatgtcccttctctgcatcaatatctgtaggctatacgtagaatatatattattttctctaaaacttccttgctgccctctgaatagttatcaaatcttgccttgtgctaccaacattgcctcagaaattatccaaataatcacctctcaccctggaggaggcacgaactcctgtcatttcctattttctggtgacacaatgatcgtttccacagtgcttcccaaggctcttaggtttttggagcatggggtatagaagactgtcttctctttctgtttgtccctggtgatcatttgaccataaccatgttgttctccaaaacgtcttagttcatagatcaaactgtattagattaaacgagatatgacttctgctccaaagtgcccctagagcgccttgcccttttcaaaccacacacttcttagggtcaggtgaattaagttaaatatgattcccttcaatgttaaagtgataggaatgagtctctgcacttcagtgctttaattttgtaaccaggagaggtgatggctgcattcagaaaagaagagaaagcttgtgtctgttctctctgctgaccactggcatgccttgtgaaggaccaagtcctgcttgcggtatggtcagccttagaactgtctgtgagccgcagggaacaagggcttacactgtcttctggggacattggcatcagcccagaggcattctcaggctttgacttcaaagcaacagcgaaaccaaaatggataaagatagggtcagtcaaatgcaacgtcttttcctgacagcaaaacaaacagagccagtgtcaactcatcaaatcctgccacgtaaattggtactctcctgcaggctaatagaaacagttacagaaagtggaaaacttgacttcactaaaaattactgcagttacaaataaaggaagggggtatagtgtatttctaaaatgtgcatctggactaagatttagggagggttgagcgtgagcacaacttaattcacccccgaaagagaaggcttgtcagccagaaataacaaaataagaaaagcccagcaagttggcccccaggtccaagtactgcagattccagtgtatctttccatctcttcttccaacaacacaatgactgtgaaacataaggagggaagaggaaatagtcttcctttatgtgacaaacccccttttcagatgttcagtgggacagtctgagtagcagcgtcttctttcaagagcataatatagcggagcatgtgattgcatttccaacctataaatatccagctcctgaacactcatctttgagttctaaatggaataagccattatttccatattcaaaactgtaacagactggaatgttgttcagcaaatactactctccaccccaggccccctgcagggaagcatcttaacctgtcccctgacacctactgccaccctgactttgagactggtcatgtgacttacttggactaatgggatgtgcgtggacatgatgcaggcagaggctttgcagctgcttgcataccctggctggcttctgcactctgatgatccaccatacaaaaacatgtccctattgacagccgatgctttagcctggccccagaacaaacacacttggagaagacctcaatacaacccacagcctggggctaagccagataattggggagcacaaagcagtctcttagccgagcccagtgtagaccagctgaatcacagttaaccagcagaaatgtgggtcttggaataaatacttgttgggtaagtcactgaggataattggttaaacagcatgcttgtgtcattaaagccaaatcaatgcatgaaaaaatggcatggtcaagtccatgcttcttgtaggcatttcacttattcagttaacacctgagcactgactatgtgccattcattgtgctatgttctaaggatgaaatgatgaactacagtgaacttgctttcatgcagatgatcatcagtactcctcaaagtgaagcaagactgatactacacattatccgactgataatgcttttcttttgtgaatagatgccgttttctcaatttcttgctccttttggtacatttggagcactgctagtcttactacaaaaggactgttagaaaccactagcttgcaaatgtgttcacaataaagctgtgatttatttattatagcagcaccaagtagcatttttaatctactcatacagtggctttcaaagagttgtttctggaccaacagtgaaagcatcattcagggacttgttggaaatgcagattcgtgggccctgtctcagaccaactgaaacagaaactcagggctggggccaggcaagctgcatttaacaagctctccagatgattctgatgcatgcacaagtctgagaaccactgcactagagcaatgtactagagcaattttcttcatggcaccaaggtgacctggaagatttctcaaatgtttgctcaggtttcagataacagcttatacatttaaaggattggacaaggattctcctaagggtaaggatttttcaagaataaaaaaaagaaaccatttaaat

SEQ ID NO: 1322 - DNA, 14680 bp, Homo sapiens
gggaataggtaaataaacagaaataagacaaacataaataagagtgtaacttacaaagcgtgtgttcccagggagaagaatccagagaaaacacaaaatgttgtctagaagccgcagcctagatgctaaagaagtgctgtcttcaaccctgtagaaactgatactccacccgcttgttctttctgcttctagtcctgtgaccccaggaaccatcctctttccctaggactatcagccagcatctctcctctgtcgcctccaacctgccctcttcccgctccaccgagcacacctgcaggcaggagtgagaatcgttgctatgtggagtgggcaagtgtcttgaccactgtccttcccatttacatcatgcctgtcctaggggtaataacaatactcacctcactgggtgtgctgaaggttaaatgagaaaatgtatgcatccagcacagaaagcataatatgttttcttttcttttctctctcctcctcctttttcattctttccacaatctttccttccttccccaaaagttacacttttccaagcttaaagctccatcttggcatcaactgtaacctgaatgtatgccattcacagctgatttgccgggtgctgtgccacacagttctgaaccccagtgagggatcaatccacacccagtccccagctctaccagtctctggagcactctgcactgctctctccagccctacctcatgcacacgaaagggggcttggccaagtttagcatgtcatcactggcagccacactctgacctgcagtaacttctgcactggttgacattcaccgctttgaacatagaaacaagaggctccctgtagctgctgccttttgtgggcttcgccatcgtcctcctgagcaggttggttcctgcgagggatgcagctgtaatgtgcttccttttttacttctttgggccctagctgcaccaacagtatgcagatgttctgtgactgttacaaggacccatgttaggtgtcactgaagcaacctaagcaagcatgaagggatgggaggtgttttttggttcgttctacaaccctgtaaataagactccagcccttcactttggggcccacacatcacagtgaaatagccaggcccatcagtttgctccagtggaaagcagtgtcccagggagagggtgatcgtcctcttcagataactagaaactgcccaggaagcctcagctgtgcaagagaacactcaccagccatgttccacacactgaggctgctgcccttcacctgaggtctccttgactacatggcgatccctggttggctggtgcaaggtgacccgccctgccttggccccattcctgcagcatggacctcagtgggcgatggaaatcacccttttcctgagcttctagagtggctttccccaaaaagtgggctgtgtggagtcttgtgcatgtgctgcatagtcttgagaaatgctccaccaaagagagacagagagagagaaagagagagattctatgggcaatatatttagaaaatataattagaaggtatgttataatatattcctctccaactgctgttccccccatcttggaggctcttaaggtgtatgagctgatgaagagaagggagaggtcttgcaatcaagacgtctgtttaacatcatagggcccagtagctcccagatcaatggaacacagcttgggaaatgtggctccaagagaggttcagaaacctgtttggacatccaagccacatttggagcctcttaaataccacttcccatgctctgactcacatggggtctcgaaatctatatccctaaaagctccccactctctcctttgccctgcatgtgggtggtgctgggaaccactcttctgggacttgggggcagggaggaggttgggtggaagtcccaggttgctgctttctttagcagttatcccattcacttagggctttccagtgaaggagactgctgccaattaaacagaactcccctctccttggtaagagcagtgttaggaatgcccctttctggaatcagcctctgttttcatcctaagtaaatctgagaaggctccttgcttgcatttggaacctgttccagcctacagggaagcatcaggattaagaagaatgaataaatgggctggggctgcacatccagggtgtcatccatggtggtgggtctaaggccttgcctggccccctaggtcctgctgggtcctaaaatcctctttctatcctggtgtattagtctattttcacgcactgataaggacatacccaagacagggaagaaaagaggcttgattggatttatagttctacatggctgggcaggcctcagaatcatggcaggaggcaaaaggcacttctcacatggtggcagcaagagaaaaaatgaggaagaaaaagcggaaacccctgataaacccatcagatctcgtgagactcattcactatcacaagaatagcatgagaaagactggccctcatgattcgattgcttccccctgggtccctcccacaacaagtgggaattctgggagatacaattcaagttgagatttgggtggggacacagagccaaaccatatcacctgggcacaaaattacatttaattgtctcacacactacattgcttcacacctctgtgctttgctctcaggattccctctgttgatactcatttacccaatgcttactttacttggataagtcttttaccaaagatcggcccaggtatcattttcttcaggaaatcttcccaaatatcaggttggacccagtgttcctcctctgtcttcccaacatgccaggacaaaatcccattttaacacttagttcataggtgctgaaaggatgggttcatgagtccatgtgttactaagcaatcaatgggctcggtgcccgatgcacacagaagccaatactatggcacaagcttttgagaaaagaaaagttttattgctagtcaactggcaaggaggtgttatctgactggatcctgcaattaggtgttgccaggaggcatgatctgcctagaccctgccgtagagtgatgccagagcttgatctgattggagcctgaattctgccatgcagtgtctgcttcttttatcagtccccctcctcagtccactcctcggttccagcccttagaagccccctgtggttgcatatttgcttcatctgggcatgctcaggttatgtgaccttcaacctgggggtccatggcaattgaaaaacaactcacaactttcttccataaaagttgagccagattggtctggtgctgttatacatactttccccgaccccagctccacccacttctacttgtaaactctgtgtgtgtataaaatacaaggtctcatttgtgaaaattcttgctaaaatctgtgtcattttaaaatgcaaatgatccacctatccttaattcctcagtggccctggtggagctcctctacattcatgattttcaacttattgtcctctcctctcccttgtgaagggttagaacacctcgactgcaccttaaattttttaaggtcagagagtgtgttttatacatctttaagcccctgaggcctaaatattaccagctcatctgttgataatctcttgggagacaggtttcatttatgtgattattatctttttggtttcacatccagaaatctaagctaatgattttttttttcttttgcaggcttccacattaaggactcagaaatttctaacactttacaagagggaggagtgaacagcaagtggtttggaaatcacaaatttgtaggagctcagcaagtgctacttaggtctaagggacacagggcaggtttggattaagaaatgacaccagtttggggccgggcgcagtggctcacgcctgtaatcccagcactttgggaggccgaggcaggcggatcatgaggtcaggagatcgagaccatcctggctaacatggtgaaaccccatctctactaaaaatacaaaaacaaagttagccaggcatggtggcaggcacctgtattcccagctactctcaagactgaggcaggagaatggcatgaaccggggaggcagaggttgcagtgagccgagatcgcaccactgcgctccagcctgggcgacagagaaagactccgtctcaaaaaaaaaaaaaaaagaaagaaagaaattaaaaaaagaaatgacaccagttttggccaaaaagttcttaaaatgagacttcacattttacagaaataacaataataactaaagaaaaaaaatcctttaccctatagattaaatctgttttctttgcttgtgcaacccacttattttcatgtggaacctggacatctgaactagaaacaacagcaccagtcagggttcagtgggagactagtggtacctgtgagagggaaaactgagctgaggtcaagaaattgactatctacaaagatgcgtgggattaagggaaattagtaaaggatgatgagatgcccaggaactagcaacagtcggaagccattacctatgtttcctaggtaacctggaaggagttcccagaatctggaaagaatgtaacagcaggggagcattgttcaacaggggctgtgccttcggtagaagaatggagccacagccccccatagcccacaggaagctggggggagaaagtcccaacctcactctcctcccgcctccagtctcctcccttggccaaacccaacagaggtcagagatcaaaggagcctattgatgcagatcctcaaccttctggagcacagaggatggtggagagggaggaaaggggatctaaagggacaagtgtagaatatccagtgcaacagcttttgattagaaaagaaagtcatattcctttgcttaatatccaaatcacagcaactctgagcccctacctcccacaaattagtcttttgccctcaagccctgaagagggtgttgcacccaacttcccttactgatagaacacaagccccagaccctcacctgccactggcttttggcaggatctgtgacactaaaattacatccgctcttttctaatcctagctaatatgggctaagagaggacagtcttaggattctgggaacttcctgtccagctgattcacaaaagtcacagaccagctgtcttctaaagtaaaactacctcctggccatgactgtaatatgctagatttctggagccctttagaaaaatgggctcctaccgggcacggtggctcacgcctgtaatcccagcactttgggaggctaaggcaggcagatcacaaggtcaggagtttgagaccagccggaccaatatggtgaaacaccatctctactgaaaatacaaaaattagctgagcctggtggcaggtgcctgtaatcccagctattcaggaggctgaggcaggagaatcgcttgaacctgggaggcagaggttgcagtgagctgagattgtgccactgcactccagcctgggagacagagcaagactctgtctaaaaaaaaaaaaaagaaagaaagaaagagaaagaaagaaagaaagaaagaaagaaagaaagaaagaaagaaagaaaaatgggctccttctgggtgcttttactaaacactaaattagaaaacatgtctttatcctgcagtcaggagacaatgatgtatcggatgtctgctccatatgaattaaataaaaggagatgtgaaagtaaacaaaaaaattgactctaagtcatgagagaaacttttgctttcaaaatttcatgagcattttggacaaaagcatgggttatttcttatgcaaaatggcattgtctgtccttcgatggcactggttttgtgattttctgagcttcagagcctcattatccacttaccatctattattactaatgttgtcttgaactgagacaacatgttgtaacgaaccggttgtgaaatttactggcaacttccagacatgcccacccatcccagagtaggataaataggggcctggaaatatttggtatgctacagattatcattcttaaaggcttaccacaaacatttcaagtttagagcccagaaacattatttgaagaattctggctaaataggcattggcaacaattctcagaaccactttggctgacttgggagcatgcatgactcaactttcacctcttttccctccaatcagttatggtaaaatcctgtttaatttgtattcgtaaccaggatggcttttagaatgtttcccctgaagaaggaggagatacgctggattctagtgcagatcagaaactttgagtatgaaaacactgcgggattggtattaggatgttcttggctacaagtaactaaaaatccaataaaaaaaccctgacataatggagaaaaattctgatttcacacaacaaaaaacactacccagatatgataggctggctcccaggttagtgacaccatcaaaatcctaacttctctccactttcttgcttggccatcctcagtgaaaatctattggcctgtcctcaggttattgaacttgtggttataaaatggcattcactgttgtatcacatgaaaacacaaaactgtccaaattaaaaaatgtttctgcatttctttttaagagggatgcaatcttttcttagaatcccttaggagactcctgttctttctttctttttttttttttttgagatggagtctcactctgtcacccaggctggagtgcagtggtgcaatctcagctcactgcaacctctgcctcctgggttcaagtgattctcgtgcctcagtctcctgagtagctgggactacaggtgcgtgccaccacacccagctaatttttgtatttttagcagagatggtgtttcgccatgttggccaggctggtcttgatctcctgacctcaggtgatccacctgcttcagtttcccaaagtgctgggattacaggtgtgagccaccatgctcaggcggctcctgttatttcttattagcctgaattgcattactgttcaggctgaacctgttactagcaataacaacaaggtcactctgattgacatgctctttgatagtcactgacagcccctttttagcccactcttgtcccttctatcacctgagggagagctataaaccttacattgctgttttaagagtgggtttgtacaatagttagatacaggttagtaattttccagaaacacaggttactgagacaaatgagcaatttccccagcaaaactgtcagtcccgtcaggaaaaaagggaatgttttctccatcaagtggcagttggctggcttaagaggccagcaagcaaattctatgtttacaagatcaataatggggctcctggagtcagagatgaaatctcactatgaaacatcttagctgcatccaaggtcagcaacaggggacattattgttaattagaggcccatgtgatggcatttgttaaagaaatgaatctgtccaccagtagcatacaccttttcacttgtagtgtagcagtcttcctgttccttagctcaactgggtctgagttcttgtctcacaaccaggaagaatgaggcaaacagctaccagagagtgagtggagtagaattcattaagcgaaaaaaaaattctcaggagagaggggatgtggggggtggtttccctccccaaagggaggaaagtcccccgtgtggctgggtccagggcctttcatggactcagaacagggagtgtgtgctgattggtttgtgagtatgtgaaaaaggctaaagtgaagacaccgctcaaaggtgagcacaacagtgtagaaaaccaattaagaaagggtaggtatacgtaaaataggtgaagggtggggatcagtcagaggaaagtggaccaaataggaaggcaaattctcaatttagtccaaggatttaagttgtagcttggctttcaggctttaaactgtcttcagcttggaggtggtatttcaccagggaccctcccttatctgcctaggcatttagctgtctcctgtcactatcagtaacatatggccctttgggttaaagtcctgctcatagacctaacaggtcccacactgctacaatcatttcttccctactctcccagcttacatcaatctctccacctattttctatccctaaaatcctacagcatgtataggttatatactttaatttattataatagtgattcgtcttaaccagggagacagtgtcatgtaagagttcctgtgttcaaatccttgttctgcaacttacttgccatggaatcttgggtaagttattcaatgtctccattcatgtgtccttatctgcaaatggtatagtaagggtgtctggtttataaaagtgttatgattgttacaggtaaaataattggtatacagcaagtgctcaataactggtagctactattatttttaaaatatttatgccctttagcccagaaattctgcttctagaataaagaataagtaatcatgattttttataaaaactatatcttcagcattttttataatatcaaaaactggatatagtctcggtatacaagaatagaggattggttaaatacattataatctatccataaaatggaacactattcagtaattaaatgtcaatatctctctctatatgacatgaatgttcaaaaaatatggttacgtgagaaaaacaaaaatagaaaacaatatggtagtgaagaccatactcctaaaaggatgagcctctctggaagggaattacgccaggacacttaccaagatgttaatggtgattaggattctaggctatgtttttcttatctatactttcaatttttctataatcaatttttaaaaaattgtctataattataagaagtccatgtagaaattcagactctcaaactgtcttatactatttatgtcctggccttggctgactgtcttgcaccaagctccctactctgggaactagagtgaggctgttctaagagggggtacttagccaagggcagcccaccttgggtgggctcagagacccacaagttgtgaggagctctgtccagcagggggatggtgagcacgaggctgagcagctccctttgggatctagacaagagcatgagggatggagtggacgtcctggtaggtgataagaacaaaccagtacttgggaaaaggaaaggaatagagatcccacaagacagagaaactgtgtaaataagaaaacgaaggaggtttccaacattgcctcaagttcccaaaggcttgctgatttctggaccaattttcgtccactggtatccttaaagtcaatgctaatttctgagagtatttttgaatgagtctctgtgtctcacaataaaaacaacagaaccatcagttctcttagcattgtcttcccaaatggattatgaatctctttagggcatgcagcatgcctttcacatcaagcacatggggttcaaggcagtgcacatgttagctgaccacttaatgcttcattcattcaccatttattcactcaagaactattgaatgtatgtttagggggtgccaagtgtatttctaagcactggggaaacaacagtgaataagacaaatcaaaaaatcactgccttcttgggacagggaaacatgtgaaatacaataaataaaatatatagtaagttagggcatgaaaagtgctaatgagaaaattcaagaaagggagtactaagagtgaaaagagggtggacaggcgttgcaattataaacagcacagtcagaaaggcctccctaagaaagaatatttgagcagagtcctaaaggagttggaggagcatgccatgtagttatctggggaaaaagcattcccagcagagagaagagcaagtgtaaatgccccgaggcaatgagagctggtgtgtttgagaaagacagtgacaccaatgtggctagagtagagtgaacaaggaggagagggaggccagtggaaacgggtccattgcctataactgatataagttgtgttgaacttgacaagactggaggacagagaggcccaagaaaggccaatggttgtcacagagaggcacttgttgaggtgaagccttgacctctaaccacctaagactggaaagtggagcctgagtcattgtttggggtcctatctttaagtaggagagatcagggagggaagagaggagagtctggattgcatgtggtcagatcaggggggcacagaaggactgtggcttttactctgagtgatgtggggagacacaggaagcttttgaacagagtcgagacacagtgtgacttgggttgtcacagatcaccaggctgctgtgtggagaacagactgcaggagaaagaaacaggcttttgcagctacccaggggagagatgatggtagttcagatgaggatggtagtaatagaggctgtgggaagaggcaaagccacattccagatgtgatttggaggtgtaacaccacagcaaacatggtatcttgaagtgatatgactcaaaacaaagcctccggcttcactttccagttttagattggagggtaagccaatccctcaacacatccctcccaaaaccaaccttccacctttctggcacagtatgactcatgtcgcttttagacaataaggcatttccatgggccattgcctggatgaatcttctttcctaagctactcccatatttccttctttcgggctattcatcagcaattgtctaaaataattgaatgaagcacattgtcctttttgagatctccttatcaagtctttggtgagctcagacaaaatagccagactgccctgtaaaattaattcacacacatcatagtgagtggtgaaaagctgaaagcttttccttgaggatcaggaaaagacaaggatgcccactttcaccacttctgtccaacatagtgttagaagtcctagccagatcagttaggcaagagaaagaaatagaaggcatctaaagtgtaaagaaggaagtcaagttgtccctgtttgcagatgacatgattgcatacatagaaaaccctgaagactctaccaaaaaaagaaaaataaaaaggactaaaaaacaaattcagtaaaattgcagcatacaaaatctacatataaaaatcaatagtgtttctatatgctaacaatgaactatacgaaaaagaaatcaggaaaacaattgcatttacaatggctaggaaaaatatatacctaggaataaagtcaaccaaggaggtgaaagatctctatgctgaaaattgtaaagcactgaagaaagaaactgaaaaggacacaaatgaatgaaaagatactctgtgttcatggattggaagaattaatattgttaaaatggccatactgccgaaagcaatctgtcaatctgtggacctattaaaactatggaatccctatgaaaataccatgacattcttcacagaaatagaaaaaaaatcctaaaattcatatggaaccacagaagatcccctaatagccaaagcaatcctaagcaaaaagaacaaagctggaggcatcacactacttgacttcaaaatatattacaatgcagtagtaaccataatagcgtggtactggcacaaaaacagcacatagagaaatggcacagaataagagctcagaaataaattcatgctcccacagccaactgattttctaccaagttgttaagaacacacattagggaaaagacagtcttttcaataaatggtggaaaattagatatccacatgtagaagaatgagactagatccctatctttcgccatataaaaaaatcaactcaaaatggattaaagacttaaatgtaaaacttaagatatgaaactactagaagaaaacatggggatacacttcacaacattgcactgggcaaaaatttgtttaaataagaccttaaaagcacaagcagcaatagcaaaaatagacaaacaggattatatcaaactaaaaatccttttgcacagcaaaggaaactattagcagaatgaagagataacctacagaatgtgaaaaaatatttgcaaactatacatctgacaaggggttaatttccagaatacataaagaacttaaacaactcaacagaaaacaaaaacaaataaccagacttaaaaaaatgggcaaaataccctaatagacatttttcaaaagaagactacaaatggccagcaggtatataaaaaaatactcaacatcactaatcatcaagaaaacacaatcaacaccataatcagatactacctcattctagttagaatggctatcaacaaaaagacaaaagaggccaggcacagtggctcacacctgtaatcccagcactttgggaggccgaggcaggtggatcacctgaggtcaggaatttgagaccagcctggccaacatagtgaaaccccgccgctactaaaaatacaaaaattagccagatgtggtggttggcgcctgtaatcccagctacttgggaggctgaggtgggagaatcactggaaccctggaggcggaggttgcagtaagccgaggtcgcgccactgcactccagcttgggagacagagcaagactccaacaatggatgaacagataaagaaaatgaggtatatatatatacaatggaatactattcagccataaaaaataaaatcctgtcatttggggcaacatggatgagcctggaggacatcatgtcaagtgaaatacgccaaacacaaaaagacaaaacacatggttttacacacacatggaatttttaaaaagttgatataatagaagcagagagtagaacagtggttaccagagactggggagagaaaaggaaggttagggaaaattttgtttatggatacaaagttactgttagataggaggattcagttctgatgttctgttgcacagtagggtgactctgattaacagtaaagtactgtatattatgaaatagctagaagagaggcttttttttttttttgacagtcttattctgtcacccaggctagactgtggtggcatgatctcggctcactacaacctctacctcccaagttcaagcagttctcatgcctcagcctcacaagtagctgggactgcaggcatttgccaacacagctaatttttttatttttagtagagatgaggctttgccatgttggccaggctggtctcgaactcttggcctcgagtgatccactgcctcggcctcccaaagtgctgggattacaggtgtgagccactgcaaccggccgagaggcttttgaaggttctcaccaaaaacagataataaatgcatgagatgatgaatgcactaactaccctacttggatcgttatacaacatatatatgtgtgtgtgatatatatatgtgatatataaaaatatatatagtgtgatatacataaatatatatattttttgaaaaatcaaattgtagaatgaggtggtatcccattatggtgttgattgtatttccctgatggttagtgaggttgattattttttggagtagtgtgtgaggtattgctcctcacacaagggcattagctgtgggggtctgcccgcagaccctgacccaaacgacggatgaataaaatgtacactgacacacagatattctgctttgccagtccagctgagcgtccgaccgcctgcacaccaagagaggtttgtcactgcggtcggccctgagcagcttgcactccaggcatttatttagtatacaattaataatagaagctttgaggaaacacacttgtggataattaacattgttaagagagtagttctacgaatgattaaagctcaggtaccacggtctaaagtaaataccattagggggcaatttccctggtcgacctccctcacagagggccatctggctcaaaggttagttaaaggaggtagggtaaacagacttaattggggaagcctctattgttactagtatttaccctatgacttaatgctctgaggtaacaggctgccttcagcctgttcaattattacaagctatgtaacctttcagccttccaaaagatttgtgactatttcctatgactttccctaatatttccctttaatatttctgccatcatcctgagtgaatcccaacaccccattaatatgtacaatgacaatgtgtcaataaataaatcatctacacattttctttgacgatgaaaaacagtttctccatagccttgggaaggagcagggaagggagggaagaaaaacagtaaggaatgcttaagtccggggctcctggtataaagctgcccctaagttaaaagttgggaagaacctcaaagagtgattaaggtatctttctatgtcatgagtcaccactgagaaacatcaagtggtgccttgagacctcctagacttaacatgcttccatatataactaataaattactaggaagagacttagccccttgatgaatgtcttattgagactggacaacataatttctgtgaaatcaataaccagccgttcttcctcaccaataccctccctagctaaacattgttcattagaagagatgaagcagctttgaaacatacattatcccccatctttttagctattgctgagaaattttgagtacgaattaataacagggaaaagaatcatacttaaaagcatgccgtaaatggggctgttgaatttttgagtcaacca

SEQ ID NO: 1323 - DNA, 15183 bp, Homo sapiens
ctttcaggctttctgtatcactttaggtcatgtgctcattcttaggtcagaaatagactctaaggatgagctctccagagtgttgattggctcaagcctagattcttggaccaatcactggcaagagagtttctgaatcaatcactgacaatacaatgattggttaagattaaccaggacccactcctagaacagggacccactggagtcagcaagggttgggtcatgttgaaggttctatttggaggaaatgataagtggttaatccaaaaagttcgttagaagcatgtctctcttcagagtatctgacaaactgagggctgagaaaataaaaattaatgaattcagtcaactttgcttctcagattgctggagggtatagactaaatggtgcgtgttatttcagatttaggatgttttgttttcatttgttaatatgtatgagtgaacatatatttgcatatgggtgttgagggattgatccatattgctgtgtgtagggtaggcaaggttttattttctctatgtcttgccacttcagaaagccttgcttggctattagctaaagattggtataactgttttcaacaggattcaggaacataaaacaagtcacctctattagattattagtctaatgacagtctaaatagttcaagagcccaagaactgcttgactatccactagcactgtttttttttagaaggagtttcactcttgttgcccaggctggcatgcagtggcacgatcttggctcacttcaacctccactgcccaggttcaagtttctcctgccttagcctcctgagtagctgggattacaggtgcccgccaccacccctggctaatttttgtacttttagtagagatgaggttttgccatgttagctagggtggtctcaaactcctgatctcaggcgatctgaccacctcggcctcccaaagtgctgagattgagccattgcacccagcctagcacccttaactaatgcttctgcttgaggataagatggagaagggtattatctagatggagagaaggagggatgtattttgcaattttacctggtgtctgcaccgtctatactattgaaagccatcttgatcaactgtcctgagtgtcatatttacctgaccaagaccttaacattttcatagctcatgaaagacaaggctcaacaacttaagtagactgttgactgcataggaaatttctggagaagaagaaaacacaaaaaaagactaggaactttgcattaaattgtttcaagccactactttcacagaggtaaagatagtgaactctaggatccaactgatggtgtcataattctgcttactctccttactgattgtttgaatttgaatgattattttattttcctatgcctcagttttcttcttgttaaaaaagctatggtgatacctaccttgtgggtgagggggctttgaatgagaatacacgtaaggcatttagcacttgttacataggaaagctattgtcacaaaagtccatatgggtcacatggacttttttactatcatactaaggttctttacaacgacttcttcaacagcttcttttccagcagtttcttcaatttgaagaccattcaggtgacatagaaaaagatagaatttgttggggatcccatttttcctagataccagccctcagtgacattgactggaaactttccttgtcccagattccatgtataaagaagttaaacacacatatatgtgagcgtgtggacgcaagcgtgcacacacacacacacataccctcctttagaagggatcaattctcaggtgattatggtttaactgcagcatgccaccagctgggcagcatgcatctaaatgacattttagccaaggtttctgagaagatgaaatagcaatgactttctctacaggcattagatggcggtgactggagggagatttgttaatgagccagttgatttcagttcaatataaggaaacactctctaaaaattacacctgtctgaaaatttaattagatgctcatagtcgtgttgagttctatttcattggaggtttacaagtagaagatgcacaatcatttatcaaggatatgattgagagactcacacatggaatgcatggttggactaagtaactgcttgtcttacatctacttctgagatgctctgactatgtctttaactcctattcttgtcaacataaacaggaccttcatttggtatttgatctattaataaaccgtaataatcattgtaactcttcacttggtgaattttcaatgctggtcagaatgtgtcattcctggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaaagaatgtgtcattccttggaaaggccagtcattagaactactcattcaaggacaaagcttaattgctctcaaactacagttattgaagaagtcgttgaaaagaaccttagtatcacagtaaaaaaataataataaaaatgaaaattgatgaggttaagtgaaaagtaaacacagtcctttggaaataattttaaaaatccatgcatttacttttactcaatgcaaaaacaaggcaattgcaagatttctgactttctaattatactgttgccacatattttaactttaatgttttgaagagtcttggatgaaattgttttaattgaggccaattcactttttggttattatttataattaggtagaattttcccttaatgtaattttgctagagccttcaaaacacccaaaagaaaagctagcagtatatgcaattaacagttatttatacagctctattttctcatctaatgagcttagcaataaaaaataaacgggacactttggaaggctgaagcgggcagatcacctgaagtcaggagttcaagaccagcttggccaatatgatgaaacccgtctctactaaaaatacaaaaattagccaggtgtgtggtgggtgcctataatcccagctagttgggaggctgagacaggagaatcacttgaacccgggaggcagaggttgcaatgagccaaggttgtgccactgcactccagcctgggcaacaaagagcaaaactgagcaaaacagtcaaaaaaaaatcagataaaaaaataaataaaggggaggaccatcactctgtggtaggtgtcttgcacacagaatcttatttaacttctaactaacctggtgagatagacatttaatataatttagagataatacctttctgaggttcagaaatatcatgtgtcttgtccatgggcattaaacaggtatatgtgggagccagaattttgtcttagagtttcttgaatacaatagaatccatttctgttactgtgaggtggaggccttcccccctcaacctcaaataccttcacaactaggcaggaatgtcaatgcatgactttgtgagttaggtggcagataatataagtcatgtagaggttgaactagagggtgagtattttgcctaaaagtactcaaattaaataaacaaaaactatttggcagctaaataaactcatctcctagccctatcagacatgcatgccaagagtttgcaatctctaaaatgttgaggatacagccatgcatgagcgtgaaagcaagtctagttatgctttgccttgaaaaagtcaaggaaactgtggatgtcaataaatttggatcttattccattgttttcctcaaaacttaagacttaattctctgattgtcaaagttaaactagttcttaaatcatttatatatgcctcattctcagtacacttaaaaaaaatcattgtgtagttccacaaacaagatggcagtggcacggtagggaagttaaatcatatttttgacccaaaacgccatgatctcttctatatatgttactgattagctctcttcttttggttattttgttcccaaagtgctactaaagaatttacaactatagaatcttttaaatgcagtttagagcagaaactattaaggcggcaaaaatagaattaggaaaaaaaaaacccacatcaagtaatggagcagttaagatgttctaattaaagttataattgtaaattgagtgcataaagataacttaaaatttttctcatctgggcattttttcatctgtatcttatttctttatacctgatacttaaatttccatgtcttgatgaatctatgccaaaccctaaataaattaacaggagttttaaaatgaagctttttagaaatgccataatcaagataataataaaggcataacttttatataggtttttctgtgctggctgttacttcaaagtgctattcaaaattcttctaaaacataacttctcctttgataaagtaaatttcaacacaactcagtaattttttgggttatccacagttttctgtcagggccctttattctttctttcaaactcttttgtcccctcctcactttgttttcttcactcttagtagataattttgctgcactgggacttaagaaaatagaaacctttaggcagccactttattacctttctttccttctatagttaaaaacacataaactatccccatcgtttctccctgttttagagggagaggtggcctctttgccttccagctgacttgttcttggcattctgtctcctcctgcttctccttgctgacttcacacctcacttttcccgtctctcaaatttttgaatgctccatgttttccactgtttttgctggagcctaaaaagatggccttgtattcttcacacaaaaaaggagtcattgtcacatctccctacccactttgacaccagtcttgtcactcagtcccttcactccagttcatatttacctttcctttttttttttttttgcataccgccaacctacaaacatgcatttgagaggtcattttaaaggaaagcaaaaaccaaacaaataagaataaccaatggcctttgcacccttccaagcctttccctatatacatgtgtattgtttacaacttgtactcatagaataaaatgattctgtatcctgctttttttcactgactgtaatgcctggtacattgtgagtactcagtgaatattaaatagatgaatgcatatgttaaaaaatttatttatttttttacattgtatcagctatctatagccacaaaggactgtgcagcaaaaaaccacaaaacctctgtgacatgcaacagtaaaccttacaagtccatagagttagctactctcaagtgggctcaactggtctcctctgggctttctctggtgttagccttgggccatctaggcaggtctgttgatcttgcctgggctgcttcatgcatctggggattgcctggtagtcgagtgtttagaatggcctcagctcagacaactgggaagacttgactccactccactccccatgtctcagctccagcaggctagccttgaattattctcgtggagtggccaaaatgtcaatgtgaggaaaagtactattggaaaatacttttcaggacttcttgtgtgatgctaactgacatctcattgtccaagatgaggcggatgtctgaacgcagaatcaaggggcagggaaatagatttgcctctttgttgagagtaactgcaaagtcttatggcaaagaaagtgaatacagtaaaggattaaaaaaatgggggtcatgaatacaatcaagttactatacatatgatcttcagattgatcatttaaatctgatttgtgtccattattatttccttttttaaatatattttttagacagtcttactctgtcacccagcctggagtacaatggtgtgatctctgctcactgcaacttctgcctcctgggttcaagcgattctccctgcctcagcctcccgagtagctgggattacaggctcccgccaccacgcctggctaatttttgtatttttattagagatgaggtttcacatgttagccaggctagtctcaaactcctgacctcaggtgatctgcccacctcggcttcccaaagtgcttggattacaggcgtgagccactgtgcccggccattttttttttttgagacagagtcctgctctgtcaccgaggatggagtgcggtggcgcaacctcagctcactgcaacctctgcctcctgccttctgggttcgagtgtttctcatgcctcagcctcttgagtagctgggattataggcacatgccaccacctgtggctaatttttaatagagacggggttttgccatgttggccaggctggtcttaaactcctggcctcaaactatccacccaccttggcttcccaaagtgctgggattacagacgtgagcctacacactccgctagatttgtgtctattattatttcctaaacatttcccaattagtagggttgctttacttttttcattttgataaaacatttctactataaatagtcctaagtacatcactttttttctcttattctttcttgtttcagtaagtggctgaaacctgccagagattgtttttcacacatagcaagtttggaggttatgtggtggccattggcattgatttagtgatttgctgatttcaaggccaatatctctacaatatttttgggctttctcttatgttcaggagatgaatgctatagctacaactaccatttttttccattcaaagcagggaaaaggaagcataaaaagtaaacctagcagacttaccctttcatttcttgactggaactatgacatatgaccacacctcaccagaagatagcactggaggaaggattgggctgggggatgagccagtgacctcacatgtctgccacatgtaagatgtagtcccaagagtgagctgatcaggtccaggtacatgttgtttttcaaaaggattttttccagttcataatgccattagcaatagccctttatcacactttaccataccttcaacaacattctttgaatactaatgaggctgaacattaaccatatgctccttaataatttttcctgaaatatttccatttatattcttctttttctttttaagttatgttcttctacacttagaaaaaaaaagctctttaaaaaaatattaactctctttgtcacatctattgcctgtttcaatttttccttttagttttggaagttctcattttagagatatttaaaattttgtatacaatcattccacagagagttggtttctagaggactgctgctagtccataagacatcttagtatgaaacagaaaaagccatctcttccacgagacattttatttccatatgttagaaaattgtcaaatcattatgattttgttagagcaagccacttgactaccatcttttagaaatatttcttaataaatatacaactctacaattcctgtatatggatggtacctctgtagatgtgtcctctgaggttatgtgtgtaaacttccttcgcagagcatacacacctagtttctaaaaagtcagagaagattcatgcgaatgactaagttgcacaaaaagattattaagaattggactctgtgggagactaaaaataagacataattggctttggaatcaattaaagtcattaaaaaggtgtctgttcaaagatttcctactttgaattaactaaagataaatttaagagtatattgcagttactgacagtaataatagcatatgaggttatcaaactgagtttaaaagggaaaaagtaatgtatgccattgatttctatgttttaatataaaagctttcttcaggttaaggtaaactttaacattgcatttataaactgtatatttcagtatgcactctgaaggtgtaaaaaactgtatactaagcttttattgtgattgttcattaataagttacataattttgggaaatcgcttaatttctatgagcctctgtttcttcatctgtaaaacagagataataatgttgggattgtgtagcttataagggtgttataacaattatttttaaggcatttaatgaagtcaaaagggcctaagtcatttaaataggctccaaatggaaagtataattcttacaatacatttaactttataaggtgttacatttgcttacttgattttaaatgattgaagaagaaagaagaaatattttggctgaagttaaaaagcaagaatgtaaagtgaattatagatcctctgtagctgatacattgaaagatcagtctggcatgatgacatgatttggtgaagcaagcttgatataaaagagaaaagcttcttctctaatagtaactgtaaaccgagtctttcaaaaattatttaatttggcactaaagtaaaggacacaatatctacagcctatttttcctcttgtttagacctcgagtttttctctgtctgtctttagctatctcagacatcgctcattgattgatagatatgaatatttaaaaaaagatatgattgaggcagtttgaatcttcagtgtaaatagttttgtctgggtctatatagaaaatatcctttaaaaacacttagtagctaaatcaaaaaatatgtatatatatagaaatttatttacctaaacttgttggctagtgaaggattttaattccactgtaattttctcaggggcaacttctatgtttgtcagttacttaaaaggacaaaaaatacattttagaaacattttaaaatttgattttagcagaaatcattttaataactctctattctgtgatgagctggaattacagtacagcttgaggtatttttcttttccatgctttctcagccgtaaaaatgggtccaggttctcccagcgttccgtgcttcacagagggaggagactaacataatcaggaatggtgaaaagttggtggatgccgtcactggaagaaaaaagattaggctacaactggagatccataagtagcttacagaatcttgcttttaaaggctattatcattataaatgtatcagttactttcagttgatatacacttagaagttttactataatttttgttggagcaataatagtcaccactgtagagataaactctaagctgacaaatgatctgcttaaaacaagaggatctgatttatatctagttccaaaccacagtgtgataatattttagctttaggagtagtatcgttacagttttattggtatggtgtattgtttataatcttagctaccatttcccctttctctctatgcctaactattcatcaacttttatatgtatagttaaagagagtagaagtcaactttcatgaaattaaacttaaatcccttaaatttgttacctatacccttgcccatggcaagacttcaatatagtcaactcaatattaggtaaacaggacactacattagaaaattgaattttgttatgaatgagccagggatactaaaaaatcccctggtttttattttagatgggttgggatttaaaagaaaattactaagttttactgcgtctttggagtactattctgacatttctagtgatctccataaactttcattgccctgtaacagtttattaagctacagtcttcataaatatgcaaactagcttaataagattgtctgccatgattgctcatcaatttggtattgaaagggcaccaacatagtcgataaaaatgtctggtggtggaatggtctgtgacatgcctaatctcattgcatagttcctttaagggggctataaacagttaatataatagaatctcattatttgtatgagtggaatgactattatgttcattaggcttgataacttttgtgtagctacatttcggaaacctataaacagtcgttatgaatgtaaattttcctcctgataattttatttcactacacatgtatttattgtttggaaaatgaattgttggcaaattaaatggacaaaaaattggttttaagatggatcaagaaaaatacatgtttattgaggagactgtagaatgaagaatttattctgagtagtctactttcccatagggagcaagtttatattaacaatttagaaacaaaggtgtttcattagtttttaaaaactttaatttgaaataattatggattcaaagaaatgtacaaagaagtactgtcaacattccacaaaaccacagggcaatatcaacattaagaacagaacattggcacaatccagagtttattcagaattcaccagttatacatgcatcattgctgggtatgtgtgtgtagctctatgcaattttgtcacacgtgtagctttgtgtaaccatcaccacaatcaagatactcaactgagccatcactacacgactcccttgtgtcccctctttatggccatacccatctcccttcctattcctaactactggcaaccactaatccattatctatttctataattatgttatttcatgattgttatagagatggaatcttgcaataagagtcatttcagatttgctttcttcatgcagaataatttttttattttactttaagttctgggattcatgtgcaggacatgcaggtttgttgcatagttatacatgtgccatggtggtttgctgcatttaccaacacctcatctaggttttaagacccacatgcgttaggtatttgtcctaatgctatcccttcccttgccccctaccctccaacaggcctcagtgtgtgatgttcccctccctgtgtccacgtgtaatgcagaataatttgttaaggttagttcaagttgtcttatgtattaacagttctttgccctttatggctgaatagtattccatggtataagtgtacctttgttgactcattcaccctttgaaggacatttgtgtgctttccagtttggggctaatatgaatgaatctgctatgaacatttgtgtataagcatctctgtgaaaataagtatttctctgggataaatgctcaagagtgtaattgctgggtcatctaattaatccatttgtagttttgaaagcaactgtgaaaccatgcagagtggttgtaaaatcttacttcctaccagcaatgcataagtgatccagtttcaatgcatttttgccagcatttggtgttattaccatttttaatttcagttattctaatagatgtgcaatagtatcttactgtggttttaatttgtatttctctactggttaatattgtagaatgcattaggatttttttttttagacctcacttttctttaaaaattttaattttttttcttttttttttttttttttacgctgagtctcgctctgtcgcccagctggagtgcagtggcacgatctcggctcactgcaaccaccacctccctagttcaagcaattcccctgcctcagcctcctgagtagttgggattacaggcacaggccaccacgcctggctatttttttttttttttgtatttttagtagagactgggtttcatcatgttggccagactggtctcgaactcttgacctcaagcaatccacccacctcagcctcccaaagtactgagattacaggcataagccaccacaccttgccaaaaattttaagtattatattcaagggatttccagagaaatagaaccaatagaatgtcatattacatatacgctctctgtctctctctggctgtctctctctctctctctctctctctctctctctctctctcacacacacacacacacacacacacacacacacacacagagagagagagagagagagagagagaaagagagatccttattttaaggatctggcttatgcaaatgtgggagagggcaaactgtgggctggagagtgaggtaagagttgatgttgcagtcttaactctaagccctgaaaacttaggcaaaatctctttgtgcagtctgaacacagaatttcttcttcaggaactctgtgtttgcttttatggccttcaactgatttgatgaggcccactcacattatgaagggtgatctgctttacttaaagtcaactgattttaactgtttattaaatctaaacaaatatctttacaataatatcaagactaatttttgaccaaacactgatcactgttgtttagccatcttgacagataaaattaaccatcacagatacttctcatcaaatatgtgtgttatttcttttaaaattatttaatttaatttatttcaaaaactggtgataaaatacacataacaaaatttatgattttaatcttttttaagtgtacagttcagtagcattaagtacattcacattattgtgcaaccatagccatcatccatctttagacttttacatcttgtgaaactgaaactctgtatccactaaataataatttctcatttccccctcccaacagactctggcaaccaccattctactctgtctccatgaatatcacttctctaggtacttatcattttatgactagcttatttcacttaggataatgtctaggttggcccacactatagcgtgtctcagaatttccttctgttttaaggctaaatgatattccattatgtgtatataccacattttgcctatccattcatctgccgatggacactgggttgcttttaccttgtgactattgtgaatgatgttgttgtgaacatgtgtgtatgaatatctgtttgagtccgtgcttttaattctccatgtatatacccagaagtggcatcactagattatacagtagttctatatgtaatttctgaggaaccatcatactgttttctacaatggctgtgccattttacattcccaccactggttcacaagggttccaatttctccacatccttacctactcttgttattttttcttaagaaattttacttgaatttggtcatataatagaagcatctggattcattagctaatttgtttgataaatagcacttcttgaaaagtatatataaagattgaatttcagttttggctctgcagtatacagctgggctactctggccaagtcacttcatggttttcttagttataaaacaggaacagtaatgtctacattgggaaggttaaatgagttttaagttgtaagttagcatatagatgcaaggcacactattattattattgttattatcatgttccctgaaacactcttagtttagtgctttgtcttaatttttagaaaggataatacacagcctctaactataatctttaatcttttatttaattttcccatccaatgtttaattacctgcataatttaggaatttttcctttgataattttattaaataatatgtagtgattcataaatttgtaaacaccttttaccaaacttcattttatttttgccttacaacaattgcaggagttatatccattactctctcagcatataaatgaagaaaccaacattcagataagagagcgtcttgcgtgtatatggggatggagccaggcaggggcagccctgggctgagacagctcctctaacccctcagcctcagcacatgcggttccatatgtgccattttccaaagatgtaactttatctccttgatcttattaagtttagattttggttttacttatacgaattgtcagaaaaattcctaatggaggctacccttataggacaccctattttacttaactaactacttttcatagaatttttgccataccataaaatagctaatgttaaattatttattgttgtcagtacacatctcaggaatccacaaattttacttttaatggccactgaatgtataattttataacatatacacttacatatcttgttcataaaaatgtagggggcaaaatcaatgtgttttaaaggtctggcttttgatataaaatgaaagcaaaagcagaaccaaccacctccactgaaacaaccactaggatcaccaccaccacccacagcagctgccaactttttagaatgtatgtgtgtgtctgggggtggtacaaggggagttgttaagtaggcaagaaagtgcaattttacagccattttgaaaagtctaagtttggtagaagttctttctatgacattttcttggggctaaaatctgacacttcatcgttcttgatttgcaggagccctcaggcctcttgctttcacatgtcttttacttcacaggattagcaccaactcccttaacctaacttcccataaagaaaagttttctttttcttggtgagagtgtggtgctgtaggtaactcctgggaatgtgatctagctgtcaaaagcacaaaaagtcagctagatacattgggaaaccaaaagtctatttggttttagtagaagattataagagaaatcctgggtactgtttgttgactatgccgtaaaattgcgttcaatggctctcttcttacctttaacccacttgcttctccatctctgttctccttagtttgtggggcacaggtgcatgtggtagtaatgcagtcagttggtagtgacagatttatcactgaaggaagaagcttcttcattctttacatggccatgacagtgactatgacaagttatttgtcttaacaacgcaggctgctcttccccagtagaaaatgagaatataaagaattagcacaagtcaagcacatctaaagggaaaagtaacaaaaatgactatgttaggtggatcagtttcttactaaaaacaacacaacattatgagtacaacttttctaatcacacgttctcattccttttgtgttttctttttcttttatttctaacctttcatggtgaccttttctctctgtaagtttcttctgaaaagaataggaaaattttgtgattatatttattcattgaaagagaaaaataaatgaaaaagcaattgggcatctttgacatatattggtgaaaacttttacttaataccataagaataattttggtccacttattgataa

SEQ ID NO: 1324 - DNA, 16558 bp, Homo sapiens
gggaataggtaaataaacagaaataagacaaacataaataagagtgtaacttacaaagcgtgtgttcccagggagaagaatccagagaaaacacaaaatgttgtctagaagccgcagcctagatgctaaagaagtgctgtcttcaaccctgtagaaactgatactccacccgcttgttctttctgcttctagtcctgtgaccccaggaaccatcctctttccctaggactatcagccagcatctctcctctgtcgcctccaacctgccctcttcccgctccaccgagcacacctgcaggcaggagtgagaatcgttgctatgtggagtgggcaagtgtcttgaccactgtccttcccatttacatcatgcctgtcctaggggtaataacaatactcacctcactgggtgtgctgaaggttaaatgagaaaatgtatgcatccagcacagaaagcataatatgttttcttttcttttctctctcctcctcctttttcattctttccacaatctttccttccttccccaaaagttacacttttccaagcttaaagctccatcttggcatcaactgtaacctgaatgtatgccattcacagctgatttgccgggtgctgtgccacacagttctgaaccccagtgagggatcaatccacacccagtccccagctctaccagtctctggagcactctgcactgctctctccagccctacctcatgcacacgaaagggggcttggccaagtttagcatgtcatcactggcagccacactctgacctgcagtaacttctgcactggttgacattcaccgctttgaacatagaaacaagaggctccctgtagctgctgccttttgtgggcttcgccatcgtcctcctgagcaggttggttcctgcgagggatgcagctgtaatgtgcttccttttttacttctttgggccctagctgcaccaacagtatgcagatgttctgtgactgttacaaggacccatgttaggtgtcactgaagcaacctaagcaagcatgaagggatgggaggtgttttttggttcgttctacaaccctgtaaataagactccagcccttcactttggggcccacacatcacagtgaaatagccaggcccatcagtttgctccagtggaaagcagtgtcccagggagagggtgatcgtcctcttcagataactagaaactgcccaggaagcctcagctgtgcaagagaacactcaccagccatgttccacacactgaggctgctgcccttcacctgaggtctccttgactacatggcgatccctggttggctggtgcaaggtgacccgccctgccttggccccattcctgcagcatggacctcagtgggcgatggaaatcacccttttcctgagcttctagagtggctttccccaaaaagtgggctgtgtggagtcttgtgcatgtgctgcatagtcttgagaaatgctccaccaaagagagacagagagagagaaagagagagattctatgggcaatatatttagaaaatataattagaaggtatgttataatatattcctctccaactgctgttccccccatcttggaggctcttaaggtgtatgagctgatgaagagaagggagaggtcttgcaatcaagacgtctgtttaacatcatagggcccagtagctcccagatcaatggaacacagcttgggaaatgtggctccaagagaggttcagaaacctgtttggacatccaagccacatttggagcctcttaaataccacttcccatgctctgactcacatggggtctcgaaatctatatccctaaaagctccccactctctcctttgccctgcatgtgggtggtgctgggaaccactcttctgggacttgggggcagggaggaggttgggtggaagtcccaggttgctgctttctttagcagttatcccattcacttagggctttccagtgaaggagactgctgccaattaaacagaactcccctctccttggtaagagcagtgttaggaatgcccctttctggaatcagcctctgttttcatcctaagtaaatctgagaaggctccttgcttgcatttggaacctgttccagcctacagggaagcatcaggattaagaagaatgaataaatgggctggggctgcacatccagggtgtcatccatggtggtgggtctaaggccttgcctggccccctaggtcctgctgggtcctaaaatcctctttctatcctggtgtattagtctattttcacgcactgataaggacatacccaagacagggaagaaaagaggcttgattggatttatagttctacatggctgggcaggcctcagaatcatggcaggaggcaaaaggcacttctcacatggtggcagcaagagaaaaaatgaggaagaaaaagcggaaacccctgataaacccatcagatctcgtgagactcattcactatcacaagaatagcatgagaaagactggccctcatgattcgattgcttccccctgggtccctcccacaacaagtgggaattctgggagatacaattcaagttgagatttgggtggggacacagagccaaaccatatcacctgggcacaaaattacatttaattgtctcacacactacattgcttcacacctctgtgctttgctctcaggattccctctgttgatactcatttacccaatgcttactttacttggataagtcttttaccaaagatcggcccaggtatcattttcttcaggaaatcttcccaaatatcaggttggacccagtgttcctcctctgtcttcccaacatgccaggacaaaatcccattttaacacttagttcataggtgctgaaaggatgggttcatgagtccatgtgttactaagcaatcaatgggctcggtgcccgatgcacacagaagccaatactatggcacaagcttttgagaaaagaaaagttttattgctagtcaactggcaaggaggtgttatctgactggatcctgcaattaggtgttgccaggaggcatgatctgcctagaccctgccgtagagtgatgccagagcttgatctgattggagcctgaattctgccatgcagtgtctgcttcttttatcagtccccctcctcagtccactcctcggttccagcccttagaagccccctgtggttgcatatttgcttcatctgggcatgctcaggttatgtgaccttcaacctgggggtccatggcaattgaaaaacaactcacaactttcttccataaaagttgagccagattggtctggtgctgttatacatactttccccgaccccagctccacccacttctacttgtaaactctgtgtgtgtataaaatacaaggtctcatttgtgaaaattcttgctaaaatctgtgtcattttaaaatgcaaatgatccacctatccttaattcctcagtggccctggtggagctcctctacattcatgattttcaacttattgtcctctcctctcccttgtgaagggttagaacacctcgactgcaccttaaattttttaaggtcagagagtgtgttttatacatctttaagcccctgaggcctaaatattaccagctcatctgttgataatctcttgggagacaggtttcatttatgtgattattatctttttggtttcacatccagaaatctaagctaatgattttttttttcttttgcaggcttccacattaaggactcagaaatttctaacactttacaagagggaggagtgaacagcaagtggtttggaaatcacaaatttgtaggagctcagcaagtgctacttaggtctaagggacacagggcaggtttggattaagaaatgacaccagtttggggccgggcgcagtggctcacgcctgtaatcccagcactttgggaggccgaggcaggcggatcatgaggtcaggagatcgagaccatcctggctaacatggtgaaaccccatctctactaaaaatacaaaaacaaagttagccaggcatggtggcaggcacctgtattcccagctactctcaagactgaggcaggagaatggcatgaaccggggaggcagaggttgcagtgagccgagatcgcaccactgcgctccagcctgggcgacagagaaagactccgtctcaaaaaaaaaaaaaaaagaaagaaagaaattaaaaaaagaaatgacaccagttttggccaaaaagttcttaaaatgagacttcacattttacagaaataacaataataactaaagaaaaaaaatcctttaccctatagattaaatctgttttctttgcttgtgcaacccacttattttcatgtggaacctggacatctgaactagaaacaacagcaccagtcagggttcagtgggagactagtggtacctgtgagagggaaaactgagctgaggtcaagaaattgactatctacaaagatgcgtgggattaagggaaattagtaaaggatgatgagatgcccaggaactagcaacagtcggaagccattacctatgtttcctaggtaacctggaaggagttcccagaatctggaaagaatgtaacagcaggggagcattgttcaacaggggctgtgccttcggtagaagaatggagccacagccccccatagcccacaggaagctggggggagaaagtcccaacctcactctcctcccgcctccagtctcctcccttggccaaacccaacagaggtcagagatcaaaggagcctattgatgcagatcctcaaccttctggagcacagaggatggtggagagggaggaaaggggatctaaagggacaagtgtagaatatccagtgcaacagcttttgattagaaaagaaagtcatattcctttgcttaatatccaaatcacagcaactctgagcccctacctcccacaaattagtcttttgccctcaagccctgaagagggtgttgcacccaacttcccttactgatagaacacaagccccagaccctcacctgccactggcttttggcaggatctgtgacactaaaattacatccgctcttttctaatcctagctaatatgggctaagagaggacagtcttaggattctgggaacttcctgtccagctgattcacaaaagtcacagaccagctgtcttctaaagtaaaactacctcctggccatgactgtaatatgctagatttctggagccctttagaaaaatgggctcctaccgggcacggtggctcacgcctgtaatcccagcactttgggaggctaaggcaggcagatcacaaggtcaggagtttgagaccagccggaccaatatggtgaaacaccatctctactgaaaatacaaaaattagctgagcctggtggcaggtgcctgtaatcccagctattcaggaggctgaggcaggagaatcgcttgaacctgggaggcagaggttgcagtgagctgagattgtgccactgcactccagcctgggagacagagcaagactctgtctaaaaaaaaaaaaaagaaagaaagaaagagaaagaaagaaagaaagaaagaaagaaagaaagaaagaaagaaagaaaaatgggctccttctgggtgcttttactaaacactaaattagaaaacatgtctttatcctgcagtcaggagacaatgatgtatcggatgtctgctccatatgaattaaataaaaggagatgtgaaagtaaacaaaaaaattgactctaagtcatgagagaaacttttgctttcaaaatttcatgagcattttggacaaaagcatgggttatttcttatgcaaaatggcattgtctgtccttcgatggcactggttttgtgattttctgagcttcagagcctcattatccacttaccatctattattactaatgttgtcttgaactgagacaacatgttgtaacgaaccggttgtgaaatttactggcaacttccagacatgcccacccatcccagagtaggataaataggggcctggaaatatttggtatgctacagattatcattcttaaaggcttaccacaaacatttcaagtttagagcccagaaacattatttgaagaattctggctaaataggcattggcaacaattctcagaaccactttggctgacttgggagcatgcatgactcaactttcacctcttttccctccaatcagttatggtaaaatcctgtttaatttgtattcgtaaccaggatggcttttagaatgtttcccctgaagaaggaggagatacgctggattctagtgcagatcagaaactttgagtatgaaaacactgcgggattggtattaggatgttcttggctacaagtaactaaaaatccaataaaaaaaccctgacataatggagaaaaattctgatttcacacaacaaaaaacactacccagatatgataggctggctcccaggttagtgacaccatcaaaatcctaacttctctccactttcttgcttggccatcctcagtgaaaatctattggcctgtcctcaggttattgaacttgtggttataaaatggcattcactgttgtatcacatgaaaacacaaaactgtccaaattaaaaaatgtttctgcatttctttttaagagggatgcaatcttttcttagaatcccttaggagactcctgttctttctttctttttttttttttttgagatggagtctcactctgtcacccaggctggagtgcagtggtgcaatctcagctcactgcaacctctgcctcctgggttcaagtgattctcgtgcctcagtctcctgagtagctgggactacaggtgcgtgccaccacacccagctaatttttgtatttttagcagagatggtgtttcgccatgttggccaggctggtcttgatctcctgacctcaggtgatccacctgcttcagtttcccaaagtgctgggattacaggtgtgagccaccatgctcaggcggctcctgttatttcttattagcctgaattgcattactgttcaggctgaacctgttactagcaataacaacaaggtcactctgattgacatgctctttgatagtcactgacagcccctttttagcccactcttgtcccttctatcacctgagggagagctataaaccttacattgctgttttaagagtgggtttgtacaatagttagatacaggttagtaattttccagaaacacaggttactgagacaaatgagcaatttccccagcaaaactgtcagtcccgtcaggaaaaaagggaatgttttctccatcaagtggcagttggctggcttaagaggccagcaagcaaattctatgtttacaagatcaataatggggctcctggagtcagagatgaaatctcactatgaaacatcttagctgcatccaaggtcagcaacaggggacattattgttaattagaggcccatgtgatggcatttgttaaagaaatgaatctgtccaccagtagcatacaccttttcacttgtagtgtagcagtcttcctgttccttagctcaactgggtctgagttcttgtctcacaaccaggaagaatgaggcaaacagctaccagagagtgagtggagtagaattcattaagcgaaaaaaaaattctcaggagagaggggatgtggggggtggtttccctccccaaagggaggaaagtcccccgtgtggctgggtccagggcctttcatggactcagaacagggagtgtgtgctgattggtttgtgagtatgtgaaaaaggctaaagtgaagacaccgctcaaaggtgagcacaacagtgtagaaaaccaattaagaaagggtaggtatacgtaaaataggtgaagggtggggatcagtcagaggaaagtggaccaaataggaaggcaaattctcaatttagtccaaggatttaagttgtagcttggctttcaggctttaaactgtcttcagcttggaggtggtatttcaccagggaccctcccttatctgcctaggcatttagctgtctcctgtcactatcagtaacatatggccctttgggttaaagtcctgctcatagacctaacaggtcccacactgctacaatcatttcttccctactctcccagcttacatcaatctctccacctattttctatccctaaaatcctacagcatgtataggttatatactttaatttattataatagtgattcgtcttaaccagggagacagtgtcatgtaagagttcctgtgttcaaatccttgttctgcaacttacttgccatggaatcttgggtaagttattcaatgtctccattcatgtgtccttatctgcaaatggtatagtaagggtgtctggtttataaaagtgttatgattgttacaggtaaaataattggtatacagcaagtgctcaataactggtagctactattatttttaaaatatttatgccctttagcccagaaattctgcttctagaataaagaataagtaatcatgattttttataaaaactatatcttcagcattttttataatatcaaaaactggatatagtctcggtatacaagaatagaggattggttaaatacattataatctatccataaaatggaacactattcagtaattaaatgtcaatatctctctctatatgacatgaatgttcaaaaaatatggttacgtgagaaaaacaaaaatagaaaacaatatggtagtgaagaccatactcctaaaaggatgagcctctctggaagggaattacgccaggacacttaccaagatgttaatggtgattaggattctaggctatgtttttcttatctatactttcaatttttctataatcaatttttaaaaaattgtctataattataagaagtccatgtagaaattcagactctcaaactgtcttatactatttatgtcctggccttggctgactgtcttgcaccaagctccctactctgggaactagagtgaggctgttctaagagggggtacttagccaagggcagcccaccttgggtgggctcagagacccacaagttgtgaggagctctgtccagcagggggatggtgagcacgaggctgagcagctccctttgggatctagacaagagcatgagggatggagtggacgtcctggtaggtgataagaacaaaccagtacttgggaaaaggaaaggaatagagatcccacaagacagagaaactgtgtaaataagaaaacgaaggaggtttccaacattgcctcaagttcccaaaggcttgctgatttctggaccaattttcgtccactggtatccttaaagtcaatgctaatttctgagagtatttttgaatgagtctctgtgtctcacaataaaaacaacagaaccatcagttctcttagcattgtcttcccaaatggattatgaatctctttagggcatgcagcatgcctttcacatcaagcacatggggttcaaggcagtgcacatgttagctgaccacttaatgcttcattcattcaccatttattcactcaagaactattgaatgtatgtttagggggtgccaagtgtatttctaagcactggggaaacaacagtgaataagacaaatcaaaaaatcactgccttcttgggacagggaaacatgtgaaatacaataaataaaatatatagtaagttagggcatgaaaagtgctaatgagaaaattcaagaaagggagtactaagagtgaaaagagggtggacaggcgttgcaattataaacagcacagtcagaaaggcctccctaagaaagaatatttgagcagagtcctaaaggagttggaggagcatgccatgtagttatctggggaaaaagcattcccagcagagagaagagcaagtgtaaatgccccgaggcaatgagagctggtgtgtttgagaaagacagtgacaccaatgtggctagagtagagtgaacaaggaggagagggaggccagtggaaacgggtccattgcctataactgatataagttgtgttgaacttgacaagactggaggacagagaggcccaagaaaggccaatggttgtcacagagaggcacttgttgaggtgaagccttgacctctaaccacctaagactggaaagtggagcctgagtcattgtttggggtcctatctttaagtaggagagatcagggagggaagagaggagagtctggattgcatgtggtcagatcaggggggcacagaaggactgtggcttttactctgagtgatgtggggagacacaggaagcttttgaacagagtcgagacacagtgtgacttgggttgtcacagatcaccaggctgctgtgtggagaacagactgcaggagaaagaaacaggcttttgcagctacccaggggagagatgatggtagttcagatgaggatggtagtaatagaggctgtgggaagaggcaaagccacattccagatgtgatttggaggtgtaacaccacagcaaacatggtatcttgaagtgatatgactcaaaacaaagcctccggcttcactttccagttttagattggagggtaagccaatccctcaacacatccctcccaaaaccaaccttccacctttctggcacagtatgactcatgtcgcttttagacaataaggcatttccatgggccattgcctggatgaatcttctttcctaagctactcccatatttccttctttcgggctattcatcagcaattgtctaaaataattgaatgaagcacattgtcctttttgagatctccttatcaagtctttggtgagctcagacaaaatagccagactgccctgtaaaattaattcacacacatcatagtgagtggtgaaaagctgaaagcttttccttgaggatcaggaaaagacaaggatgcccactttcaccacttctgtccaacatagtgttagaagtcctagccagatcagttaggcaagagaaagaaatagaaggcatctaaagtgtaaagaaggaagtcaagttgtccctgtttgcagatgacatgattgcatacatagaaaaccctgaagactctaccaaaaaaagaaaaataaaaaggactaaaaaacaaattcagtaaaattgcagcatacaaaatctacatataaaaatcaatagtgtttctatatgctaacaatgaactatacgaaaaagaaatcaggaaaacaattgcatttacaatggctaggaaaaatatatacctaggaataaagtcaaccaaggaggtgaaagatctctatgctgaaaattgtaaagcactgaagaaagaaactgaaaaggacacaaatgaatgaaaagatactctgtgttcatggattggaagaattaatattgttaaaatggccatactgccgaaagcaatctgtcaatctgtggacctattaaaactatggaatccctatgaaaataccatgacattcttcacagaaatagaaaaaaaatcctaaaattcatatggaaccacagaagatcccctaatagccaaagcaatcctaagcaaaaagaacaaagctggaggcatcacactacttgacttcaaaatatattacaatgcagtagtaaccataatagcgtggtactggcacaaaaacagcacatagagaaatggcacagaataagagctcagaaataaattcatgctcccacagccaactgattttctaccaagttgttaagaacacacattagggaaaagacagtcttttcaataaatggtggaaaattagatatccacatgtagaagaatgagactagatccctatctttcgccatataaaaaaatcaactcaaaatggattaaagacttaaatgtaaaacttaagatatgaaactactagaagaaaacatggggatacacttcacaacattgcactgggcaaaaatttgtttaaataagaccttaaaagcacaagcagcaatagcaaaaatagacaaacaggattatatcaaactaaaaatccttttgcacagcaaaggaaactattagcagaatgaagagataacctacagaatgtgaaaaaatatttgcaaactatacatctgacaaggggttaatttccagaatacataaagaacttaaacaactcaacagaaaacaaaaacaaataaccagacttaaaaaaatgggcaaaataccctaatagacatttttcaaaagaagactacaaatggccagcaggtatataaaaaaatactcaacatcactaatcatcaagaaaacacaatcaacaccataatcagatactacctcattctagttagaatggctatcaacaaaaagacaaaagaggccaggcacagtggctcacacctgtaatcccagcactttgggaggccgaggcaggtggatcacctgaggtcaggaatttgagaccagcctggccaacatagtgaaaccccgccgctactaaaaatacaaaaattagccagatgtggtggttggcgcctgtaatcccagctacttgggaggctgaggtgggagaatcactggaaccctggaggcggaggttgcagtaagccgaggtcgcgccactgcactccagcttgggagacagagcaagactccaacaatggatgaacagataaagaaaatgaggtatatatatatacaatggaatactattcagccataaaaaataaaatcctgtcatttggggcaacatggatgagcctggaggacatcatgtcaagtgaaatacgccaaacacaaaaagacaaaacacatggttttacacacacatggaatttttaaaaagttgatataatagaagcagagagtagaacagtggttaccagagactggggagagaaaaggaaggttagggaaaattttgtttatggatacaaagttactgttagataggaggattcagttctgatgttctgttgcacagtagggtgactctgattaacagtaaagtactgtatattatgaaatagctagaagagaggcttttttttttttttgacagtcttattctgtcacccaggctagactgtggtggcatgatctcggctcactacaacctctacctcccaagttcaagcagttctcatgcctcagcctcacaagtagctgggactgcaggcatttgccaacacagctaatttttttatttttagtagagatgaggctttgccatgttggccaggctggtctcgaactcttggcctcgagtgatccactgcctcggcctcccaaagtgctgggattacaggtgtgagccactgcaaccggccgagaggcttttgaaggttctcaccaaaaacagataataaatgcatgagatgatgaatgcactaactaccctacttggatcgttatacaacatatatatgtgtgtgtgatatatatatgtgatatataaaaatatatatagtgtgatatacataaatatatatattttttgaaaaatcaaattgtagaatgaggtggtatcccattatggtgttgattgtatttccctgatggttagtgaggttgattattttttggagtagtgtgtgaggtattgctcctcacacaagggcattagctgtgggggtctgcccgcagaccctgacccaaacgacggatgaataaaatgtacactgacacacagatattctgctttgccagtccagctgagcgtccgaccgcctgcacaccaagagaggtttgtcactgcggtcggccctgagcagcttgcactccaggcatttatttagtatacaattaataatagaagctttgaggaaacacacttgtggataattaacattgttaagagagtagttctacgaatgattaaagctcaggtaccacggtctaaagtaaataccattagggggcaatttccctggtcgacctccctcacagagggccatctggctcaaaggttagttaaaggaggtagggtaaacagacttaattggggaagcctctattgttactagtatttaccctatgacttaatgctctgaggtaacaggctgccttcagcctgttcaattattacaagctatgtaacctttcagccttccaaaagatttgtgactatttcctatgactttccctaatatttccctttaatatttctgccatcatcctgagtgaatcccaacaccccattaatatgtacaatgacaatgtgtcaataaataaatcatctacacattttctttgacgatgaaaaacagtttctccatagccttgggaaggagcagggaagggagggaagaaaaacagtaaggaatgcttaagtccggggctcctggtataaagctgcccctaagttaaaagttgggaagaacctcaaagagtgattaaggtatctttctatgtcatgagtcaccactgagaaacatcaagtggtgccttgagacctcctagacttaacatgcttccatatataactaataaattactaggaagagacttagccccttgatgaatgtcttattgagactggacaacataatttctgtgaaatcaataaccagccgttcttcctcaccaataccctccctagctaaacattgttcattagaagagatgaagcagctttgaaacatacattatcccccatctttttagctattgctgagaaattttgagtacgaattaataacagggaaaagaatcatacttaaaagcatgccgtaaatggggctgttgaatttttgagtcaaccagaaccagaactaatgtctgcctatatgcatgatttaattgctcaaggtcactttcaagaagctgtgctaaatgctgacagactttgttggaattatcagaattttttcaggctcagtcatcttggcctacctcagggagaagtcagataaaatgtcagaggtctgactacccaaactccaagtcacatattttcttccttgcctgtgctcactagcttcttctaaagtccattggttttagagtcaaatgatctgcttttgaaatctaacttcaacacttactagaggcttaaaatcatttaacaaatatttattgaatacctactgtgttacaggcactgtaaacattggtgagcatacagctctttgagccttggtttcttcacatatagatggcactaataacccttcctttgacagtaaacccagtagggggcaggattagtgataggattaagtgacatggtggggcacagtggctcacacctgtaatcccagcacttttgagagtctgaggcacgcagatcacttgaggtcaggagttcaagaccagcctgggcaacatagcaagaccccatctctctctcaaaaaaaaagaacattagccaggcatgataatgcacacctgtagtcacagctactcaggaggctgaggcagggcaatcccttgagcccaagagttcaaggctgcaacaagctaggatcacactactgcactccagggtgggcaagagtgagacccagtttaaaaaaaaaaaaaaaagattaagtgagatgtttgctgaacagccagcacatagtacatacacagtaagtggtagccattattgtaagaaaatattcagattttaaaagtgggtaagaaacatttcctcagcataccaccccttgaactagcaagtaagaaacttgatcctctttgagaaagtaatcacaattggccccagaacattacactcttttgaaatggcctcttactgttccatgccctatgattccatgatggttaacttatacatcaacttgactggacaatggggtccccagatatttggacaaacatcatttgggtatttccgtgagggtgatttggatgagataagcatttaagttggtagactatgtaaagcagattgccctctctaatgtggatgggcctcatccagtcagctgaaggaccaaatagaacaaaaggctaacccttctctgagtagaaggaaattctttctgcctaattgcctttgaactggaacatcagcttttttcctgcctttggtcttgaactgaaacatcagctcttccttggtctcaagcctgttggctttcagatatgaacaaacaccatcagctttcctgcttctcaggcctttggacacagactggaactaaaccatagtctttcctggttctctagcttgcagactcaccgtgcagatcttgggacttgcccatctccataattgcatgagccagtttcatcccattccttcaagttctctggagaacactaacacatttccaacgtctttttccactccccataatttactctgtactctagttgggctggacccagaatgctgcttggcctgccatgctcttatgtgtcttcctgcctttgcacaaacatttcctctgcccccaaagccctcctctaccctaatcttcagggtcaactcctgctcacctgttagaactcaatttttgtgtcacttaactcaggatcttatccttttgagtttgggccttctcccatgttagccaatgctcacatcattttcatatactcttttgaaatcacctcttactggtcctgagaagaatgccatgattaacttttacaaatgaaggtttataagccccaaccaaaaaaaaaaa

SEQ ID NO: 1325 - DNA, 18008 bp, Homo sapiens
catataatggggacaaatgtcttggagaaattttgaagattcttctctcggaagattagattgatcatatatccaaagtattcagtacagagactggccagtaaacaactgttaagtcctttctattcttttgtgtatttcctagagtgggcaaagaatggaggggacaggtggtccatttccctttttctagggtagcttagcaagacactagtcatagcaataactctgaaccactccgtttccttttcttagtgaaggtttaaattttgtttgaattttactaaaagaaatgccttgtcaaggatgacttccagaactagggttggctgctttgattaacatctgctctggaaaaagcacccacctcaagttcaaagtcattccctgctctttggagaagataaagtaagcacatgtcttctctcaccagcacaaggaaaacttctccaggtagaggaagggtgaagacctcatccttcaatctttgcttcttgaaccaccttcacagatttcacaggggctaaaaaagtctatcttctcccaggtcagcaaagaaaagcagcatcctttctcttctgtagtcaaccttcattcaggcttaatggagtgaaaaaaattataaccctcttctcagagaggactgtctttgttaaagaaaagaccctgataaacatctggggttagaaggtgagaccctgaatcatgacttagctgaagacaagctcattagaagataattaaacttttctgaattagaattcaatggaacttgaacagaaaagatttattgggagggtgatggagaaagaagaaagatggcaagccacgtggttgagaggccaaaaaactgctaagaacaaggaggtctgcttcagattccaaagtcatttgctctgttctgatgtaactatctccacagcttcctaaccccttcaggacagtctgctttacaggcattcacattgagtacgagtggcttttttagtggaagtcaagtgtataggccaagtcccacatgtgggtcactttgatgtaaaacaaagacaacatctacagactgaagagctgagtcagaaactgaactaattcagtggaagcaggaactcaaaagccaaggctgacaacaagcaagtctttttagaatttgtggatattgtaggggtgatttttcttgtccacaggtctttgaattggtatttgagcccatctttatgcatcttataggacaaggtaggattctctgggtgccatgtatgtggcatatcctagacaaactcagctagttcatcctagcatctttgggatctgccttgcctcaggagtatctgctcctaaggcagtgaggctctctactgtgtaagtgtgaaaataaccattatcttgttatagaaccaaactggggtccattggctcagcacagtaagaccagatacccacaccaaggttcatagcaggaaaaaggaaggtatttatttgcagggtgccaggcaaggaggatcgagcagctaatgcttaagtcccagccttccccatatggcttgtaggtaaagatttttaaaggcaggcataaatttcaggaaagcagaagttacagacaaaaccacaaatcaatactgatttagctaagtctctgaacacccgcatattgattttggccgaaaagggtgggatatgttgaagcagggggctcacaggtcatagttagattcaaagattttctgtaattggttaaagaagagaagttttgtttaaaaatttggggtcagtgcaaaagaatgttactctggttggttatgacttcctccaggcctctcagaaagaaatttagaacaaagaacagtgctgagttcagtccccaattcccccttatctgaggtctacatgcaagaagatccatgtggtggggggtcccagtttctgagaagcaactcagagacatggtaagatgttatctttagtttttgtaggggaacgaaacattctgtgattctagcttccctggctattgttttaagctactgttaccttcttgcttttcaagttgcttatttacttctcagaactagctaggtgcctagaatttcccttgaaggaactcaggatcttcctttctttccatgtttggggttggggctagggaagaggtccttaagaggaattctctaatccatctcaatcttctcccatagcctgtctctctcccagttcagagttttaggaccagaaggaggaattcttctccaatttctctttccttctttctgggtctccaatcttcctcagactttatgccaccactagagatgaaggtagctcaccccaggtggtggttctcactgctgtccgcagtgggtgttcagagacttagcttccaccttcaagatatacagaaagagtcccacagatgtttaatggcagatcccactgaggtagccccagggcctttgctgcccatctttggtgggacccactcacctccacctgttctgttcatgcttcccagaccctctcccagggttggtgagatcctcctgttaaccacagcattctcccttaccagttggccaaaagaagtgtgtgggacgtctattgggcggtcaccactctcccctgccagggacagtatcttctggcttctgcatatcagatcatatctccaatcagatgcctgattcctgactagggcctttatttcttccagacattccagtgggttggcagaagtcaccatgttgcctgtaggaacttcagtcttaggcccagcctttgtcttttctgtggccactcctgacctccctttatcagttgctttcttggaggaatatttaatagagaagagccagggacccccaggctcaggggctccatctgccttgtctctcagagcctcagctacctctcttggctgccagtttggcctcttgtcagtatcctacagaatttctgcctccaaggtcttctgacctcccctgctctgtttttctgaggtgtcccccaacccctggctttccttatcagggccttttgttttttggctacactattggtttgagccattgctggacttacgggaacaggaagacaacaggcgagaaagccctaggttttaacttcccccagcaatgtattccttccatgcccagccactgggcatttgtaaagtacccagagcctggtcatggccgcgaacgcatctttctgtcctatatcccatttagaaaaaaaaaatctgcagctagctcactgccagcgctcatttaattttacataaacacgttccttgaagctaaagcaaatctgactgatttttcaatgtgaaaacaaaatataaaaactgttcttggagttatttctaaacagaacttgtctctaatcctaatataacagaaacgtatatgatgatcagtatttaattttatttttcatgtggtaaatttcaaagcatgggacaaaggcagaacatcccattctgcacaaaaatattgcgtttctctcaggaccttcttgccatctttatcactgtgtgctcagcaaactttgcagcgaccagttggattccatttccctgatgttggtggtatgctcttggggaaatgtcttccagacagggaagaagcgtgacatcatcagagcacggatgaccttgaagactttgctgccctggcctgtgatgcttttccagcattctttcactcagcgtcagtctgaagtttatatggctcatcgtgtgctcaggattgtccttccagaacaggatgtaggagcttagcactgcaatgtttagagggtgacaaaagaatttcttagaccagctgggcagatggcttatgcctgtaatcccagcactttgggaggcctaggtgggtggatcacctgaggtcaggagatcgagaccagcctgaccaacatggtaaaacctgtctctactgaaaacacaaaaattggctgggtgtggtggcgcacacctgtggtcccagctattcgggaggctgaggcaggagaattgcttgaacccgggaggcagaggttgcagtgagccgagattgcaccactgcactccagcctgggcgacagagcgagactccatctcaaaaataaaaaagtatacatataattaaggccaggcatcatggcttacacctgtaatcccagcactttgggaggccaaggcaggtggatcacctgaggtcaggagttagagaccagcctgacgaatgtggagaaaccacatctctactaaaaatacaaaaattagctgggcatggtggcacatgcctgtaattccagctacccaggaggctgaggcagcagaaccacttaaacccaggaggtggaggttgcgatgagccaagatcgcgccattgcactcccgcctgggcgacaaagtgagaccccatctcaaaataagtaaataaataaacaaaaaagaatttcttagacgaaaccttgtgccttttgtgctcagttggataggaagtgagcatctgatcagccagtccactgttcccacattctcgtgataatccaaaatgacacatggcttcttagtcttctttccatttctgttgtttacttcaatcacagtatcattgtggaatgttgacaacattgtcacctccttcttgtcacaccatttcagtgccataagctcaccacagaattaacattatgcataggaatgctacattttctaggatttgacattttccgtgatcaagaatgactatattttataaacggaaacaccactactaaaaacagaatgctataaatggaatgatgtatttttttccaaagtcaatataccacagcgatgcaaaaataataataaaagcgaaatattctgtggcaaactttggtggtaagattaggactgtaatctgtgagttatcttggggtaaactctgcagcagcaagtgttccggggcaaatgggaaatgggttaagaaacccctttcccgctgcctctttagattacataattcactctggttctccagacgttctacttttaataacacaagctaaaatttattgagcacatcatatgtgctaggcactgtgctaagcacttagctttcattgaatcatctaattcctaccacgaccctgtaaagcaggaactattattccttcacctcagaactgaggtgctgagaagttaggtaactttcctgcatagctagaaagtgatggactaatgatgaagcctgtgttttttatctctatgctctactgcatcttactgagccttattatgtctgtcagccatttcctttaccaaagagaacaccctacttcctgcccacccagtgagtagataagtatgtttgaccagctgtccttagcttggcacatgtaatgggtatcaagtagtgtttgggggatggatggagaggtagatgagtagggggataggtaggggggatgggtgggtagataatgggcagacagttggatgaataagtgaatgtatgggtggatgaatggatgatgggttgatagatgagtggatgaatagatacatgagtgagtggatcatagatgaatagatgagtggatggatggatgaatgaataattggatgataagtggagagatgggtggatgaatagatgtgtggatgaatggatgatgagtgaatagatggaaggatgagtggatgcatagattgatgggcaaatggacgggtagatggactgccacatgatcaaggggcttttgtgaagaaaaacatttaggaacacaagaagcccaactaatctagagctacatactctctggctgatttgtttcctcttttctccagatcctatagtctattctgtttgtaggaggagagcttcctctaggtatctagcccccacagaacaaatagagcaacggtgttccctctaacagttgcttctgcctatgtttattttcataggtgcttcacattaactttggaattcaaaatggatttgctcagggtggcttagttttcagtaaggctggctgttccttgattctggtgggatcctgtagcccaaacctgactcagaagcattggcctgcgggatacattgtttatgtctggaggtctgaggcacccctattgtgcagaaacaaggaaatgcacatttcccaacacttcggctacaaaacagaggctaggactgaatatagtgtgctcttttaactctgaaaaagttcatgaaaaagtcgagcttgcaggatgggaacaaactcccttattaggcctttccccttcacttccagattcctgtctaccctcatcctaactcccacacaactcccagctctctcctcttgttcccctgattccagatgacaaactcactcttgctaaggtgttagtgatttacttcttttctttaccattaaagaaaaatttcttcaataaaagccatattaaactcaaagccagagtcactcgaattccccaagcaagtcatatccactgggtctgtcattcaggctattagttttatgtattctttttattaacattatatttaaatcaaattgatcagaaaataactcaagcccaagttcatttcccattgactttagtgtttctagagaggttcttcccgtcctcctcagactgaagatttggggcacaaacatgctaacctttctcaccaatcccgggaccctcagcccatgtctcactgcaaggtatgcaattcaccagaagtggcctgccctgctccttacataaggcctacttgccccttcggagtgaccaaggtgctctggccatgaggctggggctgcagtactcctctggcagtgttctatcatcatcctcaagtactaggttggtgcaaatgtaattacggtgtttgccttttttttttttttaaagacaaaaactgcaattacttttgcacctacctaatagttgtagtacaggaaggtggtacaggatggtagaagaagccgggcatgaaggtacaggaaggtagagttacctccgctggagagttttcaagatgttgaccaacgcgtgcattttgacatgggcataaaagaaaggaaagaaaaaattgcatttgccctcctttggtctccctctgagctttttgataagctctacatgcccagctgtaatccttttgcctgattgtgagctaagattacaggtaaactctgtgaactttctgcatgaaaagttatatatacaaaaaagttccttcccttgtgctctaaatcctgtttgccattcaaagaacagtgggaaattgttgtcgtatccgatcagcctatttaatgtgaaagcagattaagtctttatgctctgtgaactctggacaaacctgcccatgacaggtgtgtcccaggccctggcaattgttcatgctggggccccaagctccttttatatcttcagatggagggaaggtgtgcttttggcagggaggaagtagtcagtgtgaaattggagaaaggcattcagtcttccaagtggacacagtgtccccgcgcacggctggcaagcagggtgcaggctgatttcagccagctcggcccctcagggatagtgtgtaaggtgcccctggcccctggggttacctggctttgctatgaggatctctggctgctctggagagagttaaaagtgtcttagcttttggaatgcttgctatagatttgcccatattagacctaaaaagagcaagcgtgtcagcgctggagcaatgagagtatgtagagttggcaggctggccagggggctgcatcacccctgcgagttcagaggcatttctcatcaatgcccgctcagcaaaaagacgctgaatctcaaccctggcacattgaaaatttctttgaaattctccagcccaaacagctcttagatatgcaaagcataattgacagaaacttgaagctagaagcctccttgaaaggccacctatgccaacccccaggttttaggcaaaaccacccttcaactattctagaaaatactccttgaagctgatgggaagattgctggcttgaaatttccttttgaaaatatgatggatgaactccgagggcatcccgaatccttgtctttttattttattaattttattgtgtgatgaaagaaaaattctctgaagtcagacgtcaacaacccacccccaccactattctcctcctcctcctcttcggttggttccctgggagaccaccgtgagacaagataaatgagcagcaaggtttttgaagccagtgctcaggaacaacacctctaagaaaataaaggaagcaggactgagctgcagtacaactgtcatgcaatcggggcaacctcagtgtagcgacccaggcagaaagtacttctctctccctgcatcaagggatcagtctcaggaaaggagagggattggtgtagattgggtcccgtgcccactccctggtccaatcactgtggccaggggatgagtgattatgattggccagccccaggtcacatggccacaaatatcaggggaacggaaaagcttgctggacagacgaaaacaacaggtaccacacacctctaaaactacctctcaaaattgtgaaaagactagtgaaagtatacataactgtttgggaagcccaggcgggcggatcacctgaggtcaggagttcaagaccagcctgggcaacgtggtgaaacctggtctctacaaaaatacaaaaattagccgggcatgatggcgggtacctgtaatcccagctactcgggaggctgaggcgggagaatcgcttaaacccgggaagcagaggttgcagtaagcctagattgcgccactgcactctagcctgggcaacagagcaagactctgtctcaattaaaaaaaaaaaaaaaagtatacataactgcctaacagaggacgtaataggacacacccaataaatggtcattgttgtttcctccagcagcaccgtaagaaggaatacaaacaatctttcttctgcagtcttggagcaaacaggtgctgataaaatcaacattagttcaagcctcacccccaaagttgaactgagcctgaacctttctgaagaatgaagaatgtttagcaaacattcccctccagtgtgcctaaacttcatgtatctttgtacttcctcggccagatgggcctggaccaccagaaacgtcataaggatgtttatctccttgaaaacttcgatggtccaaaagtatttctgaagaaagacagtccccagtgtttttctgacctcttcacagagccagagccagggcatttggatgaagtggggaaaattcctgtgtccgaactgaatatcagcatcctgcaatgtcttgttgccaagaatgggtcatgtatgtccttctcctcctcaaaactataaacctctccagaacctcctgaagaattaaggacagagagttctgggccctcagtgacaagcccaccacccctactgccctgctccaatgctatgctgtggccaatcagatgtcccaaagttccccaaactccagggtcacctgccctctacctccttatcatgctcactgttccctgtacgagaacatgatgttcccatctaccactcccctaactcaaccctcaaaatcccgctcattttcaagcccaccctaaagcctttcctaccctttcaaccaactgtggtcttgactacctttaatctccttatggaatatgtattttgccttatgctatgttaacttgaatgatgatcttcataatttatttaaagaacatttatcaagaacctactatgtatctgtactaggcactggtgaggagatggatgagataaaacgaacccagccaatctggggctcttagcagcccaggtgcaatgtatttcaactgatgattttccagcattttaaaattcatatgcttgtcctacctagctcatgcattagataattcagtcactaacctgttctgagttttggtgtccctcgatgacaaaatgagagcttcaggctacatggtcaccgaagatctcttcctacacagcagtgaatctctcatgttctattgttgccttgtcagcacttcatcactttgctcctgtttttatcatccagcaatacaaggtgtccctctgagcttcagaaaactgggagcagaagtttggaattaatacataatagcatatctatgtttcctgaacataaacagtgtggtggtcaagttggtgaaaagccataacctcttatctggaccacaatctcttcatctgtaaaatgggacagtgggagtaaaggtcactaaggccccttccaactctgatactctgtgattcataatcatcccctcttttgctcccacaagagcacatcatgttctgcaaggagatggctgccaaaccgcctggaagagggaagcaaacactcatccaccccgagcctcaccccagggagaccagctgagtttgaagaaaaggctgcagtggagtccagaaggcttgggttttagctgctggcccccattctctgcataaatttgctgtgggaaccatttgaacaactttaatctctggaaagagcaacagccgacattacttgattaagtaactcaccctccttaactcatctcccagctcccttttcccaggtttggtacctcctgggtcctgaccacagtcccgtgggtagaatgaaccactgtctgcagcaccatgttgaagacggcagcttcaatcaaagaacttgttggccagctacctgtcactcaaataacttgatggatgatgaaaaatttagtcaactaacactgttccaagcagagaagaagctttttaagtggatctccttttagcctactatattctgtctttgtccattcttgcagctgtaacaaaataccttagactgggtgatttataaataatagaaatttatttcccacagtctgaaggctgggaagctcaagactatggtgccagcagatttggtgtttgttgagatattgttctctgcttccagggtggctcctggttgctgtgtcttcacatggcagagggacaaaaggggtgttctctctccctcaagctcttttataagggttctaatcccatctgtgagcgctctgccaaaggtgcaactttttaatactatcttaatttggggggctaagttctaacacataaattttggagggacatatacattcaaaccatagtatttttcatctccctgtaaaatgtgctggccaatgactctcaacatgaagcccacaccctgtgctttaactcccaccagctgagctatacaagctatatgcttaccagggggcagctgcacttgtccccaagcctgtttatggcaacagtcctttaattgtaaccatgtaatttacttgagtatcaaataaaccaatgaaatacaagtgcaaaaagagatctgttggttatataaaaagaaaactaaattaagggcaaacaaaggtaaatttctaaaaatatttgcagtcagttttgatgtttgaagtaagtgacggtgtttgatgaaaaataatgaaaaacgcagaaagattctacactcagtcctatagtgtctatatcttcttatttccctttgaagaagccaaaacaaaaaaattataaataagacagtgtatctgtagtttatcaaacaaaaacaaaacacaaatgccaatcagaaggacccacactgaaagaaaaaaagtcttaacatcaaaacattgactaatcttttttctttttttgagatggattcagactctgtcgtccaggctggagtgcagtggtgcaatctcagctcactgcaacctctgtctaccgggttcaagtgattctcctgcctcagcctccccagtagctgggattaggggcatgcaccaccatgcccagctaatttttttgtatttttagtagaaacgtggtttcaccatgttggccaggctggtttcaaactcctgacctcaaatgatctgcctgccttggcctcccaaagtgcttcaattacaggcatgagccactgtgcccagccacgaacaatcttttaagttaaaatacaatatataagatatgtttgaatcagttttgttactttttaagtacaaacctaaaaatattttaactgaacgtaaatgaatgacattctgtagtctgggacccaggtattttatagtttttcaacttacgttaatattttaggattgtctccatagttattattattatgacaaatttcaagcatatatgaaatagaaaagtagagtgaacctccatatcccgttgttcaaactgtaccatctatacttcatctttttcctttgctgatgtagtttacaacaaacttcagacatgtcattttatctctacttcagggatatcagtagatatctcttaaaatatggagattttcttatataattgcaacaccatcatacccaacataattagcgacagttctttagtgtcatctaatatttctgccttttcttagattgcccccaaaatgtcttttcactgtcagtttgctgaaatcatgatataactacagtgtacacattacattagtttgtgtctctaatgcctttttaaatttagaacagtacccccttttcatgccattaatttattgaaaaatcccttttgtaaatagatatatgaaaatttcaaagagttcagagaatttcaaagaatagcaattgacaaggttttatcggtgagaaatctcaaaaaatgccaaaacagaccccagatttctcagggtgctcagggagctaatgttgtcatggcccagggaagagtttctacctctttcagactgacaaaatgagcagagaactggagactgggttgaaagatgaaaggtttaaagttctgaaaaacaaagattcaagccgtcaagaaaatgcaaatcaaaaacacaatgagataccacatcacacccattaggataactataatcagaaaaagataataaacaagtgttattgaggctgtgaagaaattggaacccccatacgttgctactgggaacatattttgaaaaacaggctgacggttcctcagaaattaaacagggtgaacaatgaccctgaaattccactcctagatatacactcaagagaaatgaaaacatatgtccacacaaaaacttgtacgtgactgttcataaaaaattattcataatagccaaaaagtcaacacaatccaaatgtccatgatgaatggataaattgactggtagaaccacacactggaatattattcagtcataaaaaggaatgaagaactgctatgtgctacaacatgggtaaagcttgaagatattaggctaagtaaaagaagccagccttctgaaggacacatattgtatgattccatttacgtgaaatactcataattgataactgcagagacagaaagtagattagtgattgcctagggcttgggaattgggaggattgggggaaggatgactgaggaaattctttttggagtgataaaaatgtttggaattagtagtggtagttgcacaattctgtgaatatactaaaagccattgaatgtacactttaaatgggtgtattgtatggtatgtgaattatatctcaataaagctgttaaaacacacacacacacacacacacacacacacacacacacacacacacactgggtttaggagtcctttattagccaggcttgagtgtagaggggccctgcccagcaggggttcacctctgcagaggatagaagggagcctgcttggtggctgttggaaagagtgactcaacaatgccagtgggggtcaccaagggagagcacgtggtcaccctcgcgggtccctacagtcttctggagtgggttgttctgggttaggaaccagatggcctcttgaccctgatttcagtaacgccatgaaaggaaacccaaggggaacatgaaggagaactgattttccttttcattactggctgcctcacttcttctcagggctgcactcacctttattttcctgcctgccttcctggagggcagtgagacgcaggcccagatccttcacacaggggagcgagaagagagggaggaagaggctgcccatcaacattgccaccatggcagcctcctgcccctgagaaagtggaaatgcccaggtatgacacgaaagcaggttttcccaggcagccaggggaagctaagatcccacgtccccgtggcttcaggtggaatgtgctgtggtgggtgggctgtcgggcaacatccaggcctgaggtcacagaataggaacggtgggatggcggtgcagaagtttccttgcctgattttgaaagtcttattcaggctgttcaagctgctagtctcatcagaaatgggtatctgcctggcccacacatttccaattttccctctggccacaggatcctgtgcccatttggcaaaggaataggtctcagaagaagcatgtggtctcatggagattacagagctcaactggatctgcagaaagggctctgggccggctggtaaaatgaaaagattccatttgtggaagggcagcggtgggtgggccaaattcccacgaggctttgaagatgctcctgggcatcagccggccttccagcctcctccctcctcactcccactgcttccaactgctggtgccactcagaagaaaagcggccacaggccacagcccttcctggtagctccaagggaataggtaaataaacagaaataagacaaacataaataagagtgtaacttacaaagcgtgtgttcccagggagaagaatccagagaaaacacaaaatgttgtctagaagccgcagcctagatgctaaagaagtgctgtcttcaaccctgtagaaactgatactccacccgcttgttctttctgcttctagtcctgtgaccccaggaaccatcctctttccctaggactatcagccagcatctctcctctgtcgcctccaacctgccctcttcccgctccaccgagcacacctgcaggcaggagtgagaatcgttgctatgtggagtgggcaagtgtcttgaccactgtccttcccatttacatcatgcctgtcctaggggtaataacaatactcacctcactgggtgtgctgaaggttaaatgagaaaatgtatgcatccagcacagaaagcataatatgttttcttttcttttctctctcctcctcctttttcattctttccacaatctttccttccttccccaaaagttacacttttccaagcttaaagctccatcttggcatcaactgtaacctgaatgtatgccattcacagctgatttgccgggtgctgtgccacacagttctgaaccccagtgagggatcaatccacacccagtccccagctctaccagtctctggagcactctgcactgctctctccagccctacctcatgcacacgaaagggggcttggccaagtttagcatgtcatcactggcagccacactctgacctgcagtaacttctgcactggttgacattcaccgctttgaacatagaaacaagaggctccctgtagctgctgccttttgtgggcttcgccatcgtcctcctgagcaggttggttcctgcgagggatgcagctgtaatgtgcttccttttttacttctttgggccctagctgcaccaacagtatgcagatgttctgtgactgttacaaggacccatgttaggtgtcactgaagcaacctaagcaagcatgaagggatgggaggtgttttttggttcgttctacaaccctgtaaataagactccagcccttcactttggggcccacacatcacagtgaaatagccaggcccatcagtttgctccagtggaaagcagtgtcccagggagagggtgatcgtcctcttcagataactagaaactgcccaggaagcctcagctgtgcaagagaacactcaccagccatgttccacacactgaggctgctgcccttcacctgaggtctccttgactacatggcgatccctggttggctggtgcaaggtgacccgccctgccttggccccattcctgcagcatggacctcagtgggcgatggaaatcacccttttcctgagcttctagagtggctttccccaaaaagtgggctgtgtggagtcttgtgcatgtgctgcatagtcttgagaaatgctccaccaaagagagacagagagagagaaagagagagattctatgggcaatatatttagaaaatataattagaaggtatgttataatatattcctctccaactgctgttccccccatcttggaggctcttaaggtgtatgagctgatgaagagaagggagaggtcttgcaatcaagacgtctgtttaacatcatagggcccagtagctcccagatcaatggaacacagcttgggaaatgtggctccaagagaggttcagaaacctgtttggacatccaagccacatttggagcctcttaaataccacttcccatgctctgactcacatggggtctcgaaatctatatccctaaaagctccccactctctcctttgccctgcatgtgggtggtgctgggaaccactcttctgggacttgggggcagggaggaggttgggtggaagtcccaggttgctgctttctttagcagttatcccattcacttagggctttccagtgaaggagactgctgccaattaaacagaactcccctctccttggtaagagcagtgttaggaatgcccctttctggaatcagcctctgttttcatcctaagtaaatctgagaaggctccttgcttgcatttggaacctgttccagcctacagggaagcatcaggattaagaagaatgaataaatgggctggggctgcacatccagggtgtcatccatggtggtgggtctaaggccttgcctggccccctaggtcctgctgggtcctaaaatcctctttctatcctggtgtattagtctattttcacgcactgataaggacatacccaagacagggaagaaaagaggcttgattggatttatagttctacatggctgggcaggcctcagaatcatggcaggaggcaaaaggcacttctcacatggtggcagcaagagaaaaaatgaggaagaaaaagcggaaacccctgataaacccatcagatctcgtgagactcattcactatcacaagaatagcatgagaaagactggccctcatgattcgattgcttccccctgggtccctcccacaacaagtgggaattctgggagatacaattcaagttgagatttgggtggggacacagagccaaaccatatcacctgggcacaaaattacatttaattgtctcacacactacattgcttcacacctctgtgctttgctctcaggattccctctgttgatactcatttacccaatgcttactttacttggataagtcttttaccaaagatcggcccaggtatcattttcttcaggaaatcttcccaaatatcaggttggacccagtgttcctcctctgtcttcccaacatgccaggacaaaatcccattttaacacttagttcataggtgctgaaaggatgggttcatgagtccatgtgttactaagcaatcaatgggctcggtgcccgatgcacacagaagccaatactatggcacaagcttttgagaaaagaaaagttttattgctagtcaactggcaaggaggtgttatctgactggatcctgcaattaggtgttgccaggaggcatgatctgcctagaccctgccgtagagtgatgccagagcttgatctgattggagcctgaattctgccatgcagtgtctgcttcttttatcagtccccctcctcagtccactcctcggttccagcccttagaagccccctgtggttgcatatttgcttcatctgggcatgctcaggttatgtgaccttcaacctgggggtccatggcaattgaaaaacaactcacaactttcttccataaaagttgagccagattggtctggtgctgttatacatactttccccgaccccagct

SEQ ID NO: 1326 - DNA, 20811 bp, Homo sapiens
ctttcaggctttctgtatcactttaggtcatgtgctcattcttaggtcagaaatagactctaaggatgagctctccagagtgttgattggctcaagcctagattcttggaccaatcactggcaagagagtttctgaatcaatcactgacaatacaatgattggttaagattaaccaggacccactcctagaacagggacccactggagtcagcaagggttgggtcatgttgaaggttctatttggaggaaatgataagtggttaatccaaaaagttcgttagaagcatgtctctcttcagagtatctgacaaactgagggctgagaaaataaaaattaatgaattcagtcaactttgcttctcagattgctggagggtatagactaaatggtgcgtgttatttcagatttaggatgttttgttttcatttgttaatatgtatgagtgaacatatatttgcatatgggtgttgagggattgatccatattgctgtgtgtagggtaggcaaggttttattttctctatgtcttgccacttcagaaagccttgcttggctattagctaaagattggtataactgttttcaacaggattcaggaacataaaacaagtcacctctattagattattagtctaatgacagtctaaatagttcaagagcccaagaactgcttgactatccactagcactgtttttttttagaaggagtttcactcttgttgcccaggctggcatgcagtggcacgatcttggctcacttcaacctccactgcccaggttcaagtttctcctgccttagcctcctgagtagctgggattacaggtgcccgccaccacccctggctaatttttgtacttttagtagagatgaggttttgccatgttagctagggtggtctcaaactcctgatctcaggcgatctgaccacctcggcctcccaaagtgctgagattgagccattgcacccagcctagcacccttaactaatgcttctgcttgaggataagatggagaagggtattatctagatggagagaaggagggatgtattttgcaattttacctggtgtctgcaccgtctatactattgaaagccatcttgatcaactgtcctgagtgtcatatttacctgaccaagaccttaacattttcatagctcatgaaagacaaggctcaacaacttaagtagactgttgactgcataggaaatttctggagaagaagaaaacacaaaaaaagactaggaactttgcattaaattgtttcaagccactactttcacagaggtaaagatagtgaactctaggatccaactgatggtgtcataattctgcttactctccttactgattgtttgaatttgaatgattattttattttcctatgcctcagttttcttcttgttaaaaaagctatggtgatacctaccttgtgggtgagggggctttgaatgagaatacacgtaaggcatttagcacttgttacataggaaagctattgtcacaaaagtccatatgggtcacatggacttttttactatcatactaaggttctttacaacgacttcttcaacagcttcttttccagcagtttcttcaatttgaagaccattcaggtgacatagaaaaagatagaatttgttggggatcccatttttcctagataccagccctcagtgacattgactggaaactttccttgtcccagattccatgtataaagaagttaaacacacatatatgtgagcgtgtggacgcaagcgtgcacacacacacacacataccctcctttagaagggatcaattctcaggtgattatggtttaactgcagcatgccaccagctgggcagcatgcatctaaatgacattttagccaaggtttctgagaagatgaaatagcaatgactttctctacaggcattagatggcggtgactggagggagatttgttaatgagccagttgatttcagttcaatataaggaaacactctctaaaaattacacctgtctgaaaatttaattagatgctcatagtcgtgttgagttctatttcattggaggtttacaagtagaagatgcacaatcatttatcaaggatatgattgagagactcacacatggaatgcatggttggactaagtaactgcttgtcttacatctacttctgagatgctctgactatgtctttaactcctattcttgtcaacataaacaggaccttcatttggtatttgatctattaataaaccgtaataatcattgtaactcttcacttggtgaattttcaatgctggtcagaatgtgtcattcctggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaaagaatgtgtcattccttggaaaggccagtcattagaactactcattcaaggacaaagcttaattgctctcaaactacagttattgaagaagtcgttgaaaagaaccttagtatcacagtaaaaaaataataataaaaatgaaaattgatgaggttaagtgaaaagtaaacacagtcctttggaaataattttaaaaatccatgcatttacttttactcaatgcaaaaacaaggcaattgcaagatttctgactttctaattatactgttgccacatattttaactttaatgttttgaagagtcttggatgaaattgttttaattgaggccaattcactttttggttattatttataattaggtagaattttcccttaatgtaattttgctagagccttcaaaacacccaaaagaaaagctagcagtatatgcaattaacagttatttatacagctctattttctcatctaatgagcttagcaataaaaaataaacgggacactttggaaggctgaagcgggcagatcacctgaagtcaggagttcaagaccagcttggccaatatgatgaaacccgtctctactaaaaatacaaaaattagccaggtgtgtggtgggtgcctataatcccagctagttgggaggctgagacaggagaatcacttgaacccgggaggcagaggttgcaatgagccaaggttgtgccactgcactccagcctgggcaacaaagagcaaaactgagcaaaacagtcaaaaaaaaatcagataaaaaaataaataaaggggaggaccatcactctgtggtaggtgtcttgcacacagaatcttatttaacttctaactaacctggtgagatagacatttaatataatttagagataatacctttctgaggttcagaaatatcatgtgtcttgtccatgggcattaaacaggtatatgtgggagccagaattttgtcttagagtttcttgaatacaatagaatccatttctgttactgtgaggtggaggccttcccccctcaacctcaaataccttcacaactaggcaggaatgtcaatgcatgactttgtgagttaggtggcagataatataagtcatgtagaggttgaactagagggtgagtattttgcctaaaagtactcaaattaaataaacaaaaactatttggcagctaaataaactcatctcctagccctatcagacatgcatgccaagagtttgcaatctctaaaatgttgaggatacagccatgcatgagcgtgaaagcaagtctagttatgctttgccttgaaaaagtcaaggaaactgtggatgtcaataaatttggatcttattccattgttttcctcaaaacttaagacttaattctctgattgtcaaagttaaactagttcttaaatcatttatatatgcctcattctcagtacacttaaaaaaaatcattgtgtagttccacaaacaagatggcagtggcacggtagggaagttaaatcatatttttgacccaaaacgccatgatctcttctatatatgttactgattagctctcttcttttggttattttgttcccaaagtgctactaaagaatttacaactatagaatcttttaaatgcagtttagagcagaaactattaaggcggcaaaaatagaattaggaaaaaaaaaacccacatcaagtaatggagcagttaagatgttctaattaaagttataattgtaaattgagtgcataaagataacttaaaatttttctcatctgggcattttttcatctgtatcttatttctttatacctgatacttaaatttccatgtcttgatgaatctatgccaaaccctaaataaattaacaggagttttaaaatgaagctttttagaaatgccataatcaagataataataaaggcataacttttatataggtttttctgtgctggctgttacttcaaagtgctattcaaaattcttctaaaacataacttctcctttgataaagtaaatttcaacacaactcagtaattttttgggttatccacagttttctgtcagggccctttattctttctttcaaactcttttgtcccctcctcactttgttttcttcactcttagtagataattttgctgcactgggacttaagaaaatagaaacctttaggcagccactttattacctttctttccttctatagttaaaaacacataaactatccccatcgtttctccctgttttagagggagaggtggcctctttgccttccagctgacttgttcttggcattctgtctcctcctgcttctccttgctgacttcacacctcacttttcccgtctctcaaatttttgaatgctccatgttttccactgtttttgctggagcctaaaaagatggccttgtattcttcacacaaaaaaggagtcattgtcacatctccctacccactttgacaccagtcttgtcactcagtcccttcactccagttcatatttacctttcctttttttttttttttgcataccgccaacctacaaacatgcatttgagaggtcattttaaaggaaagcaaaaaccaaacaaataagaataaccaatggcctttgcacccttccaagcctttccctatatacatgtgtattgtttacaacttgtactcatagaataaaatgattctgtatcctgctttttttcactgactgtaatgcctggtacattgtgagtactcagtgaatattaaatagatgaatgcatatgttaaaaaatttatttatttttttacattgtatcagctatctatagccacaaaggactgtgcagcaaaaaaccacaaaacctctgtgacatgcaacagtaaaccttacaagtccatagagttagctactctcaagtgggctcaactggtctcctctgggctttctctggtgttagccttgggccatctaggcaggtctgttgatcttgcctgggctgcttcatgcatctggggattgcctggtagtcgagtgtttagaatggcctcagctcagacaactgggaagacttgactccactccactccccatgtctcagctccagcaggctagccttgaattattctcgtggagtggccaaaatgtcaatgtgaggaaaagtactattggaaaatacttttcaggacttcttgtgtgatgctaactgacatctcattgtccaagatgaggcggatgtctgaacgcagaatcaaggggcagggaaatagatttgcctctttgttgagagtaactgcaaagtcttatggcaaagaaagtgaatacagtaaaggattaaaaaaatgggggtcatgaatacaatcaagttactatacatatgatcttcagattgatcatttaaatctgatttgtgtccattattatttccttttttaaatatattttttagacagtcttactctgtcacccagcctggagtacaatggtgtgatctctgctcactgcaacttctgcctcctgggttcaagcgattctccctgcctcagcctcccgagtagctgggattacaggctcccgccaccacgcctggctaatttttgtatttttattagagatgaggtttcacatgttagccaggctagtctcaaactcctgacctcaggtgatctgcccacctcggcttcccaaagtgcttggattacaggcgtgagccactgtgcccggccattttttttttttgagacagagtcctgctctgtcaccgaggatggagtgcggtggcgcaacctcagctcactgcaacctctgcctcctgccttctgggttcgagtgtttctcatgcctcagcctcttgagtagctgggattataggcacatgccaccacctgtggctaatttttaatagagacggggttttgccatgttggccaggctggtcttaaactcctggcctcaaactatccacccaccttggcttcccaaagtgctgggattacagacgtgagcctacacactccgctagatttgtgtctattattatttcctaaacatttcccaattagtagggttgctttacttttttcattttgataaaacatttctactataaatagtcctaagtacatcactttttttctcttattctttcttgtttcagtaagtggctgaaacctgccagagattgtttttcacacatagcaagtttggaggttatgtggtggccattggcattgatttagtgatttgctgatttcaaggccaatatctctacaatatttttgggctttctcttatgttcaggagatgaatgctatagctacaactaccatttttttccattcaaagcagggaaaaggaagcataaaaagtaaacctagcagacttaccctttcatttcttgactggaactatgacatatgaccacacctcaccagaagatagcactggaggaaggattgggctgggggatgagccagtgacctcacatgtctgccacatgtaagatgtagtcccaagagtgagctgatcaggtccaggtacatgttgtttttcaaaaggattttttccagttcataatgccattagcaatagccctttatcacactttaccataccttcaacaacattctttgaatactaatgaggctgaacattaaccatatgctccttaataatttttcctgaaatatttccatttatattcttctttttctttttaagttatgttcttctacacttagaaaaaaaaagctctttaaaaaaatattaactctctttgtcacatctattgcctgtttcaatttttccttttagttttggaagttctcattttagagatatttaaaattttgtatacaatcattccacagagagttggtttctagaggactgctgctagtccataagacatcttagtatgaaacagaaaaagccatctcttccacgagacattttatttccatatgttagaaaattgtcaaatcattatgattttgttagagcaagccacttgactaccatcttttagaaatatttcttaataaatatacaactctacaattcctgtatatggatggtacctctgtagatgtgtcctctgaggttatgtgtgtaaacttccttcgcagagcatacacacctagtttctaaaaagtcagagaagattcatgcgaatgactaagttgcacaaaaagattattaagaattggactctgtgggagactaaaaataagacataattggctttggaatcaattaaagtcattaaaaaggtgtctgttcaaagatttcctactttgaattaactaaagataaatttaagagtatattgcagttactgacagtaataatagcatatgaggttatcaaactgagtttaaaagggaaaaagtaatgtatgccattgatttctatgttttaatataaaagctttcttcaggttaaggtaaactttaacattgcatttataaactgtatatttcagtatgcactctgaaggtgtaaaaaactgtatactaagcttttattgtgattgttcattaataagttacataattttgggaaatcgcttaatttctatgagcctctgtttcttcatctgtaaaacagagataataatgttgggattgtgtagcttataagggtgttataacaattatttttaaggcatttaatgaagtcaaaagggcctaagtcatttaaataggctccaaatggaaagtataattcttacaatacatttaactttataaggtgttacatttgcttacttgattttaaatgattgaagaagaaagaagaaatattttggctgaagttaaaaagcaagaatgtaaagtgaattatagatcctctgtagctgatacattgaaagatcagtctggcatgatgacatgatttggtgaagcaagcttgatataaaagagaaaagcttcttctctaatagtaactgtaaaccgagtctttcaaaaattatttaatttggcactaaagtaaaggacacaatatctacagcctatttttcctcttgtttagacctcgagtttttctctgtctgtctttagctatctcagacatcgctcattgattgatagatatgaatatttaaaaaaagatatgattgaggcagtttgaatcttcagtgtaaatagttttgtctgggtctatatagaaaatatcctttaaaaacacttagtagctaaatcaaaaaatatgtatatatatagaaatttatttacctaaacttgttggctagtgaaggattttaattccactgtaattttctcaggggcaacttctatgtttgtcagttacttaaaaggacaaaaaatacattttagaaacattttaaaatttgattttagcagaaatcattttaataactctctattctgtgatgagctggaattacagtacagcttgaggtatttttcttttccatgctttctcagccgtaaaaatgggtccaggttctcccagcgttccgtgcttcacagagggaggagactaacataatcaggaatggtgaaaagttggtggatgccgtcactggaagaaaaaagattaggctacaactggagatccataagtagcttacagaatcttgcttttaaaggctattatcattataaatgtatcagttactttcagttgatatacacttagaagttttactataatttttgttggagcaataatagtcaccactgtagagataaactctaagctgacaaatgatctgcttaaaacaagaggatctgatttatatctagttccaaaccacagtgtgataatattttagctttaggagtagtatcgttacagttttattggtatggtgtattgtttataatcttagctaccatttcccctttctctctatgcctaactattcatcaacttttatatgtatagttaaagagagtagaagtcaactttcatgaaattaaacttaaatcccttaaatttgttacctatacccttgcccatggcaagacttcaatatagtcaactcaatattaggtaaacaggacactacattagaaaattgaattttgttatgaatgagccagggatactaaaaaatcccctggtttttattttagatgggttgggatttaaaagaaaattactaagttttactgcgtctttggagtactattctgacatttctagtgatctccataaactttcattgccctgtaacagtttattaagctacagtcttcataaatatgcaaactagcttaataagattgtctgccatgattgctcatcaatttggtattgaaagggcaccaacatagtcgataaaaatgtctggtggtggaatggtctgtgacatgcctaatctcattgcatagttcctttaagggggctataaacagttaatataatagaatctcattatttgtatgagtggaatgactattatgttcattaggcttgataacttttgtgtagctacatttcggaaacctataaacagtcgttatgaatgtaaattttcctcctgataattttatttcactacacatgtatttattgtttggaaaatgaattgttggcaaattaaatggacaaaaaattggttttaagatggatcaagaaaaatacatgtttattgaggagactgtagaatgaagaatttattctgagtagtctactttcccatagggagcaagtttatattaacaatttagaaacaaaggtgtttcattagtttttaaaaactttaatttgaaataattatggattcaaagaaatgtacaaagaagtactgtcaacattccacaaaaccacagggcaatatcaacattaagaacagaacattggcacaatccagagtttattcagaattcaccagttatacatgcatcattgctgggtatgtgtgtgtagctctatgcaattttgtcacacgtgtagctttgtgtaaccatcaccacaatcaagatactcaactgagccatcactacacgactcccttgtgtcccctctttatggccatacccatctcccttcctattcctaactactggcaaccactaatccattatctatttctataattatgttatttcatgattgttatagagatggaatcttgcaataagagtcatttcagatttgctttcttcatgcagaataatttttttattttactttaagttctgggattcatgtgcaggacatgcaggtttgttgcatagttatacatgtgccatggtggtttgctgcatttaccaacacctcatctaggttttaagacccacatgcgttaggtatttgtcctaatgctatcccttcccttgccccctaccctccaacaggcctcagtgtgtgatgttcccctccctgtgtccacgtgtaatgcagaataatttgttaaggttagttcaagttgtcttatgtattaacagttctttgccctttatggctgaatagtattccatggtataagtgtacctttgttgactcattcaccctttgaaggacatttgtgtgctttccagtttggggctaatatgaatgaatctgctatgaacatttgtgtataagcatctctgtgaaaataagtatttctctgggataaatgctcaagagtgtaattgctgggtcatctaattaatccatttgtagttttgaaagcaactgtgaaaccatgcagagtggttgtaaaatcttacttcctaccagcaatgcataagtgatccagtttcaatgcatttttgccagcatttggtgttattaccatttttaatttcagttattctaatagatgtgcaatagtatcttactgtggttttaatttgtatttctctactggttaatattgtagaatgcattaggatttttttttttagacctcacttttctttaaaaattttaattttttttcttttttttttttttttttacgctgagtctcgctctgtcgcccagctggagtgcagtggcacgatctcggctcactgcaaccaccacctccctagttcaagcaattcccctgcctcagcctcctgagtagttgggattacaggcacaggccaccacgcctggctatttttttttttttttgtatttttagtagagactgggtttcatcatgttggccagactggtctcgaactcttgacctcaagcaatccacccacctcagcctcccaaagtactgagattacaggcataagccaccacaccttgccaaaaattttaagtattatattcaagggatttccagagaaatagaaccaatagaatgtcatattacatatacgctctctgtctctctctggctgtctctctctctctctctctctctctctctctctctctctcacacacacacacacacacacacacacacacacacacagagagagagagagagagagagagagaaagagagatccttattttaaggatctggcttatgcaaatgtgggagagggcaaactgtgggctggagagtgaggtaagagttgatgttgcagtcttaactctaagccctgaaaacttaggcaaaatctctttgtgcagtctgaacacagaatttcttcttcaggaactctgtgtttgcttttatggccttcaactgatttgatgaggcccactcacattatgaagggtgatctgctttacttaaagtcaactgattttaactgtttattaaatctaaacaaatatctttacaataatatcaagactaatttttgaccaaacactgatcactgttgtttagccatcttgacagataaaattaaccatcacagatacttctcatcaaatatgtgtgttatttcttttaaaattatttaatttaatttatttcaaaaactggtgataaaatacacataacaaaatttatgattttaatcttttttaagtgtacagttcagtagcattaagtacattcacattattgtgcaaccatagccatcatccatctttagacttttacatcttgtgaaactgaaactctgtatccactaaataataatttctcatttccccctcccaacagactctggcaaccaccattctactctgtctccatgaatatcacttctctaggtacttatcattttatgactagcttatttcacttaggataatgtctaggttggcccacactatagcgtgtctcagaatttccttctgttttaaggctaaatgatattccattatgtgtatataccacattttgcctatccattcatctgccgatggacactgggttgcttttaccttgtgactattgtgaatgatgttgttgtgaacatgtgtgtatgaatatctgtttgagtccgtgcttttaattctccatgtatatacccagaagtggcatcactagattatacagtagttctatatgtaatttctgaggaaccatcatactgttttctacaatggctgtgccattttacattcccaccactggttcacaagggttccaatttctccacatccttacctactcttgttattttttcttaagaaattttacttgaatttggtcatataatagaagcatctggattcattagctaatttgtttgataaatagcacttcttgaaaagtatatataaagattgaatttcagttttggctctgcagtatacagctgggctactctggccaagtcacttcatggttttcttagttataaaacaggaacagtaatgtctacattgggaaggttaaatgagttttaagttgtaagttagcatatagatgcaaggcacactattattattattgttattatcatgttccctgaaacactcttagtttagtgctttgtcttaatttttagaaaggataatacacagcctctaactataatctttaatcttttatttaattttcccatccaatgtttaattacctgcataatttaggaatttttcctttgataattttattaaataatatgtagtgattcataaatttgtaaacaccttttaccaaacttcattttatttttgccttacaacaattgcaggagttatatccattactctctcagcatataaatgaagaaaccaacattcagataagagagcgtcttgcgtgtatatggggatggagccaggcaggggcagccctgggctgagacagctcctctaacccctcagcctcagcacatgcggttccatatgtgccattttccaaagatgtaactttatctccttgatcttattaagtttagattttggttttacttatacgaattgtcagaaaaattcctaatggaggctacccttataggacaccctattttacttaactaactacttttcatagaatttttgccataccataaaatagctaatgttaaattatttattgttgtcagtacacatctcaggaatccacaaattttacttttaatggccactgaatgtataattttataacatatacacttacatatcttgttcataaaaatgtagggggcaaaatcaatgtgttttaaaggtctggcttttgatataaaatgaaagcaaaagcagaaccaaccacctccactgaaacaaccactaggatcaccaccaccacccacagcagctgccaactttttagaatgtatgtgtgtgtctgggggtggtacaaggggagttgttaagtaggcaagaaagtgcaattttacagccattttgaaaagtctaagtttggtagaagttctttctatgacattttcttggggctaaaatctgacacttcatcgttcttgatttgcaggagccctcaggcctcttgctttcacatgtcttttacttcacaggattagcaccaactcccttaacctaacttcccataaagaaaagttttctttttcttggtgagagtgtggtgctgtaggtaactcctgggaatgtgatctagctgtcaaaagcacaaaaagtcagctagatacattgggaaaccaaaagtctatttggttttagtagaagattataagagaaatcctgggtactgtttgttgactatgccgtaaaattgcgttcaatggctctcttcttacctttaacccacttgcttctccatctctgttctccttagtttgtggggcacaggtgcatgtggtagtaatgcagtcagttggtagtgacagatttatcactgaaggaagaagcttcttcattctttacatggccatgacagtgactatgacaagttatttgtcttaacaacgcaggctgctcttccccagtagaaaatgagaatataaagaattagcacaagtcaagcacatctaaagggaaaagtaacaaaaatgactatgttaggtggatcagtttcttactaaaaacaacacaacattatgagtacaacttttctaatcacacgttctcattccttttgtgttttctttttcttttatttctaacctttcatggtgaccttttctctctgtaagtttcttctgaaaagaataggaaaattttgtgattatatttattcattgaaagagaaaaataaatgaaaaagcaattgggcatctttgacatatattggtgaaaacttttacttaataccataagaataattttggtccacttattgataacatgtattgtgttgtcaacttagttttccatcaactttcgttctactggtggttatgaattataagcagtgatgtagattattttaaaataacttgattgtcttagttcatgctactgtaacaaaaattccacagagttgcttaagcaataaatatttaatttttactcttctggaatttggggagtcccatcaaggtgccaacattttcagtggtggggacccccttcctggttcatagactgctgtattttgaatataacctaacataatgaaaggggcgaaaatgctttcttgggccttttttttaagaagggcactaatctcattcatgaagcctccactctcatcacctcattatctcccgaaggtccccatctcctaattccatcatattgggggttaggatttcaacaaacacattttggaggaacatagtctgtaacactgatatttagtaccatcaatgactgttgggaggtgactataatctggtggtttataaagtccaatttttcttctaacacagaggaaaagcagttgatgaatgatctcttcagctgaagacaggagggtcttaataaaatatttcattagtactttttaaagctgctgtaagaatgtgactgctagatttttacagacaaaaatggaagaactgaagtagaagtcagggtagctaggcacagttcctatttaactacatgagtgtccttgggtaatcattcagactttgtctctcgttttcatctataaaatgaggctaaaaattcttgctccaccagtgtcttaagattttgttttacaaaagaatcataagaaaaagctgcactcaagaatcaccgctaaagaacttattcaggtagccaaacactacctgttcccccaaaacttattgaaataaaaaaattaaaagctacagaaatcaatttgaatattaattataaagtatcttacttgtataaaatatagtataataatattattgagaggaaactcagtgaatctacctttactgttaccaatgcttaataagctcaagtggcagatttatattgcacattagaagtttattttgggaaatattcatttctttaataatgctcagaaaaaacaataagatatattctggaaatgagtatgtttgtagtggaaaaagatttattaaacagaaagtctgttttacttcaaaaattaatgaaaatactccttttagaagttatttgtgaaaatatgaaaggcaagatttctctattttctttcttttataaatgttactttattacaaatcccattaaaacaataagaattctgaggcaaaacttgcccgcagaaccctaattaatatttttatgttcaagttgttttactaatcattagtgatatccatttaaaacctttacatagcatagtaataatacatatgtacacatatatttacatacatctttgtagtgcatatttttacttaatattacactgtcttttctattttattatttttacaactttttcttctcttcttcaaggtaactagtataaacagcctggtacatatcactttatctcttctccatcatgaacctctggaaatcaccagatactgattttattcatgcttttaaaataccttcatgatattctgtaatagggaatgtattctatcacttccctagtgttcatattcagtgtttctctcctgtatgctttatatgtttagtgacctactatgtgtcaggtactattttaggttttaggaaacttctggggatgaaacaaaatcctagccctcacggggtttatgctgtagccagaggagacagccagcaaacagtaaacacaaccaaaaaatgggattatagaatgtgtttgaaagtaagcactacgaaaaaaaaaaaaatgaaatggggaacggaatttgggactctcagaagttggagtgaagttgagttgcaattttaatttgagtggttacgacaggcctcattgattaggaggaatttgagtaaagatttgaggaagatgaaggaaatagctgggaagagcatttcaggcagagggaacagccaaagcaaaagctgtaaggtggaagtgtgcatggggtatttaggggcatccaggaggccagtgtggctggtgcacactgcataatgagtaaagtcagagaagtaataataccagttcacacagggatgctaggccattcagggtctttagccatttagagtgaaacacgattttctgggttttgaacagaagaataaaattattttttcattcaaaactgttttggagaattagttataaagagtttttttctatttaattgctgcagaatatttcataatacaatatatcacatttgattcatagccctaatgaatatttacactttttaatttttggccaccacagatcttgctaataaaataatggtacatatctccttatatatgtgtcaaagttcctctaggatgtagtctcaaaagtacaaatgctgggtcattttgtgtctgttttaaggatcacttttctaaacttttaaaatatatatatatatgtatatatatttttaagagacagcatcccactatgttgcctaggctgtccttgaactcttgggctcaagcaattctctcacctcaagtagctggaattgtaggcatgtgtcaatgcactcgggttaaagttctttttattattattattattattatactttaagttttagggtacatgtgcacaacgtgcaggttcgttacatatgtatacatgtgccatcttggtgtgctgcacccattatctcgtcatttacattagatatatctcctaatgctatccctcccccctccccccaccccacaacagctccccgtgtgtgatgttccccttcctgtgtccatgtgttctcattgttcaattcccacctatgagtgagaacatgcagtgtttagttttttgtacttgtgatagtttgctgagaatgatggtttccagcttcatccatgtccctaacaaaggacatgaactcatcatttttatggctgcatagtattccatggtgtatatgtgccacattttcttaatccagtctatcattgttggacatttgggttggttccaagtctttgctattgtaaatagtgccacagtaaacatacgtgtgcatgtgtctttatagcagcgtgatttataatcctttgggtatatacccagtaatgggatgactgggtcaaatggtatttctagttctagatctctgaggaatcaccacactgacttccacaatggttgaactagtttacagtcccaccaacagtgtaaaattgttcctatttctccacatcctgtccagcacctgttgtttcctgactttttaatgattgccattctaactggagtgagatggtatctcattgtggttttgatttgcatttctctgatggccagtgatggtgagcattttttcatgtgtattttggctgcataaatgtgttcttttgagaagtgtctgttcatatctttcgcccactttttgatggggttgtttgtttttttcttgtaaatttgtttgagttcattgtagattctggatattagccctttgtcagatgagtaggttgcaaaaaaattttctcccattctgtaggttgcctgttcactctgatggtggtttcttttgcttattaagatatttctccttttttccctaacacatttagagttttgttttctcattccagtattcaatatcttcagaatttaagtgatggtatatggtggggatctaactttaatatctttgtaatggaaagctgaatgccccaatacactttttgaatagtaaatgtgtgtgtgtgtatgtgggcgtgggtatataaatatagtagggagaataaaggcctcacaaagatattcatatcctaatccttggaacctttaaaccttattttattttatatggcaaaatgaactttgcagacatgactaagttaaggccttgagatggagagactattcagtaggctcagggtaatcacaggggttctcataagaggaatgtaggaggtagctgtcaagacagaagcagaggtcatattgacagaaggaactggtcatgagccagggaatgcaggtagtctccagaactggaaaaggtaaagaaacacactctggaaattggaagggaacctccagaaggaatgcagtttttgctgacatcttgattttaggacttctgacctccagaattgtatttgtcttgttctaataaatttgtattgttctaagcaactaaatttttggtaatttgtgacagcaatacaaaactaatcctctatctctttatctatcgatctacctactcattggtgctattatttttatagaggtgaattttccagagcaaaggaagtgtatgtttataatgttaattaacatttccaaatcactttccaaaattgatatcgcaattcatacttccactaaaatgtcatacacaggcattagatattaatattttcttaattttttctggtgtgacagacgaaaaatagtacctcaacttagttttaatttgcatgtccttgatggctagtgaaattgcacatcttttccagtgtttaaaggtcatgtgaatttcctctatttaactatgcctaatgttcgcccaattgtattttttttactaagttatccttttcttataaattggtagaaattccttgaacctcatagataaccctcaatgtattatatgggttgcaagtattttttctgaatatttctcctaatactatttctaatgtttttttctagaaattattttaatttttatataatcaaaaacatttttttctttatgatttttggtcttctgttctgtttctactttgacatagaagaaacccatttatctttttctttttttcccagagaggatctcactctattgcccaggttagtgcagtggcatgatcctaactcactggaacctctaactcttgggctgaagtgatgctcctgtctccgtctctgaaatagctaggattataggctctcaccacaatgcttggcaaagttttaatttttttgtagaaatggggtctcactacgatgtccaagctggttgcaaactcctggtctcaagtgatcctcctgcctcagccttccaaagcactggaattataggcatgagccaccacatatgaccttatttataataagaatcatttttagttataaaaaagtaggggcaacattgctaatagagaagtcttttgttaatataaacagtaaagcttctttcattcttttcagtctctctcaatgttctattcaggttttatagttgtgggagagcatatctgattttacatgattgttcccccaagtgtctgagatcaatgttaaagtattctgagaaacttaagactattgctatttttcttcacatacaaatagaatcatccatttttagtggctttattcatcaaactagtcagatgatagccagattagctaggaacacacaacataagttgatcagtttggtctgactattggtataactttttcactaaactaacttggtttccttgctttgacacaactagtcaaatcatttgga

SEQ ID NO: 1327 - DNA, 4539 bp, Homo sapiens
aaagatcatgcataattttttaatagtctccaagatctagtgaacacctactcatgttaattattattagtgcattattataaacacattttcattcattaaatcaaaaaaattgtgatgatggtcaaatgaactaagacatataaaatatttgacaagtgcttgacatgcaaaagtccttaatagattttagctattattacttttatttgttgagtatttacaagtttccagtccctgttccaggaattttatattcttggatttttttaaatttctttttaacttttaagttcaagggtacatgtgcagttttgttatataggtaaatgtgtgtcatgagggtttgttgtacagattatgtcatcacccaggtgttaagcctagtacccattagttattcttcctgatccactccctcctcccctactccaccctccaataggccccagtgtgtgttgtttccctctgtgtgcccatgtgttctcatcatttagctcccacttataagtgagaacatgtgatatttggttttctgttcctgtgttagtttgctaaggataatggcccccagctccatccatgtccctgcaaaggacatggtcttgttttttgctatggctgcctagtattccatggtgtatatgtgccacattttctttatccagtctatcattgatgggtatttaggttgattccatgtctttgctattgtgaatagtgttgcaatgaacatactcatgcatgtgtctttataaaagaaggatttatattcctttgggtatatacgcagtaatgggattgctggaccaaatggtatttctatctttaaatctttgaggaataaccacactgacttccacagtggttgaactaatttacactcccttcaacagtgtataagctgttcccttttctccacaacctcaccagcatccatgcttgttaatgtttgaaatgatggagatgtatttttaagagattcaactgtacatatgaatgctacttttatttttccttggactcaattttttgttaatttttatttttgaataatttggatttacagagtagttacaaagagagtacagagttcccataattcccttacctattcctatgggaactaggtaaaagcaatggttgaaaaacattctgaatgtccctctgaatgccaccttagaatggctactgctttttacagatttgttttgtttcagctgccttattaaaatcatgctcagttaaaataagttttcaggctgggtgtggtggctcacgcctgtaataccagcactttgggaggctgaggtgggcggatcacaaggtcagcagttcaagaccagcctgaccaacatagtgaaaccccatccctactaaaaatacaaaaattagctgggcgtgttggcgtgcacctgtaatctcagctactcaggaggctgaggcaggagaatcacttgaacccaggaggtggaggttgcagtgagccgagatcatgccactgcactccagcctgggagaagagcaaggctctgtctcaaaaagagaaaaaaagaaaaaaaaaagaataagttttcagctaccaatccatcatccacagccaatccatcatccacagccaatccatcatccacagccaatccatcatccgaaaacaaagttatgttgcctttttaatataggtctcatttctttttctccttgtattgcattggttgaaacttccagggcactgacaaataattactaataataaacatacttttcctttttaattcttaaaggagaattctcctgttgttcctgccacacagcctcaccagggcatttttggaagtaagttctgtttatttaattccttccttagttattgatctgttttcctccatcccgaatcaactttgggcacttatgtttttccagaaataaattcatttcttggggattttcacatttttaacatggcgttataaatgacattatcttgcaaagttgagtgtttccttatctctgtgttcatttttttctcattcttggttttaggcctttctgctctttctccctctttgtatcccttttgttacacttctaattttttctattcgtttgtggttgccaaagaattcgctctggaatttatttttcagttccagaatatttcttctttttagttcattaattctgctttgatctttattagctactcctttctgttttaacagaatgttaaatattttgtgataatttttaacaaaatcaaattttacaatattgattttataacacttgtattgacaatatcttcaaatttttaagtttttatttcttgaggataggctacacatgtattcatttgcaattttcaaacaatatgctaaaaaaggaatctaaaaatcaaaattaatgttaacactcaaagatgatccctcttcatactttggggtatgttgttatggatcttttttttcttttggtgccaatatgtgtatagtttaagagatccataggctgagttcatttctctagctcagaaaaggagaccaaatgtcttttcatagcagtatctgaaatgttttctttccacatgatggaatttttttttccccctagatggagtctcactctgtcgccagactagattggagtacagtggcgcgatctcggctcactgcaacctccgcctcctgtgttcaagccattctctctcagccttccgagtagctgggagtagctgggattacaggcacgtgcaaccatgcccagctaatttttgtattttcagtagagacggagtttcaccatattggccaggatggtctcgatctcttgacgtcgtgatccgcccgccttggcctcccaaagtgctgggattacaggcatgagccaccgcccccaaccgaaattttgcattcttactcttctttcatacagacattttaattccctcagtgaaaggggtatgttattgttaattttacttttttagattaacagtaaaaataaaacattttctcaaacatttattatccttttacagttcattttatgaacctttaatattctatttattttccccatcagtgcattaatatttcaatgatttataattgtctttataaagatattaacttttgtcagttacataaattttttttttgcattctaactttctgcaaggcacattttctcattcagaatttttcaatttatggttctagttgctgatctctttttctatcaaaggtgaattattcagaaagaatttgtactttcaaagattatatctatccatgtataaatttatataatctatatgtttatctatgttttcttcagatagcttatgtagtctcttgtctgtttgaaatgtatttgggactacagagatgggatttgacattattttttctaaataattaatcattaaacacttatttatacctttaaaaaacactatttaaaataactaaaggaggccagggaagatggctcacacctgtaatcccagcactttgggagcctgaggtgggtggatcacctgagatcaggagttcaagaccagcctgaccaacatggtgaaaccccgtctctactaaaaatacaaaattagccaggaatggtggcacatgcctataatcccagctacttgggaggctgaggcaggagaatcgcttgaacccgggaggcggaggttgcagtgagccaagatggtgccattgcacttcagcctaggcaacaagagtgaaacttcatcttaaaaaaaaaaaaaaaaaaaaaccacaaaacaaacaaacaaaaaactaaaggattataattggattgcttgtaacacaaaggataaatgtttgagaggatggatgccccattctccatgatgtgattcttatgcattgcatgcctgtatcaaaacatctcatgtaccccataaatacatacacctattacgtacccacaaaaattaataataagttttaaaaagagaaataataaataagacctagtatttgctagcacaacagggtgagtacagtcaaaatcaatttaattgcacattttaaaataacaaaaagaatataatttgattgtttgcaacacagaggataaatgcttgagggaatggatgctgcattttccatgatgtgattactatacgcattgcatgcctgaatcaaaatatgtcatgtaactcatagagatatacacttacccacacaacttaaaaaaataaaaaaaaaattttaaacacactcaagtatccagaaataaaaaatgcaagttaacgtgataaaaattacacattctaaatcacagtgaacatcatattaaattacaaaactctagggttattctatttaaaaaagaagaagaaaaagaagaatgccaactcctaccataaattttaaaaggattctaaaatttcaaaccaatgcaataagacctaaaagagaaataggtgttattaattagtattatttggagaaaatagatgaattttagagaaaaacatgaaactaagaagaaaacccagaaaaagaatat

SEQ ID NO: 1328 - DNA, 5973 bp, Homo sapiens
aaagatcatgcataattttttaatagtctccaagatctagtgaacacctactcatgttaattattattagtgcattattataaacacattttcattcattaaatcaaaaaaattgtgatgatggtcaaatgaactaagacatataaaatatttgacaagtgcttgacatgcaaaagtccttaatagattttagctattattacttttatttgttgagtatttacaagtttccagtccctgttccaggaattttatattcttggatttttttaaatttctttttaacttttaagttcaagggtacatgtgcagttttgttatataggtaaatgtgtgtcatgagggtttgttgtacagattatgtcatcacccaggtgttaagcctagtacccattagttattcttcctgatccactccctcctcccctactccaccctccaataggccccagtgtgtgttgtttccctctgtgtgcccatgtgttctcatcatttagctcccacttataagtgagaacatgtgatatttggttttctgttcctgtgttagtttgctaaggataatggcccccagctccatccatgtccctgcaaaggacatggtcttgttttttgctatggctgcctagtattccatggtgtatatgtgccacattttctttatccagtctatcattgatgggtatttaggttgattccatgtctttgctattgtgaatagtgttgcaatgaacatactcatgcatgtgtctttataaaagaaggatttatattcctttgggtatatacgcagtaatgggattgctggaccaaatggtatttctatctttaaatctttgaggaataaccacactgacttccacagtggttgaactaatttacactcccttcaacagtgtataagctgttcccttttctccacaacctcaccagcatccatgcttgttaatgtttgaaatgatggagatgtatttttaagagattcaactgtacatatgaatgctacttttatttttccttggactcaattttttgttaatttttatttttgaataatttggatttacagagtagttacaaagagagtacagagttcccataattcccttacctattcctatgggaactaggtaaaagcaatggttgaaaaacattctgaatgtccctctgaatgccaccttagaatggctactgctttttacagatttgttttgtttcagctgccttattaaaatcatgctcagttaaaataagttttcaggctgggtgtggtggctcacgcctgtaataccagcactttgggaggctgaggtgggcggatcacaaggtcagcagttcaagaccagcctgaccaacatagtgaaaccccatccctactaaaaatacaaaaattagctgggcgtgttggcgtgcacctgtaatctcagctactcaggaggctgaggcaggagaatcacttgaacccaggaggtggaggttgcagtgagccgagatcatgccactgcactccagcctgggagaagagcaaggctctgtctcaaaaagagaaaaaaagaaaaaaaaaagaataagttttcagctaccaatccatcatccacagccaatccatcatccacagccaatccatcatccacagccaatccatcatccgaaaacaaagttatgttgcctttttaatataggtctcatttctttttctccttgtattgcattggttgaaacttccagggcactgacaaataattactaataataaacatacttttcctttttaattcttaaaggagaattctcctgttgttcctgccacacagcctcaccagggcatttttggaagtaagttctgtttatttaattccttccttagttattgatctgttttcctccatcccgaatcaactttgggcacttatgtttttccagaaataaattcatttcttggggattttcacatttttaacatggcgttataaatgacattatcttgcaaagttgagtgtttccttatctctgtgttcatttttttctcattcttggttttaggcctttctgctctttctccctctttgtatcccttttgttacacttctaattttttctattcgtttgtggttgccaaagaattcgctctggaatttatttttcagttccagaatatttcttctttttagttcattaattctgctttgatctttattagctactcctttctgttttaacagaatgttaaatattttgtgataatttttaacaaaatcaaattttacaatattgattttataacacttgtattgacaatatcttcaaatttttaagtttttatttcttgaggataggctacacatgtattcatttgcaattttcaaacaatatgctaaaaaaggaatctaaaaatcaaaattaatgttaacactcaaagatgatccctcttcatactttggggtatgttgttatggatcttttttttcttttggtgccaatatgtgtatagtttaagagatccataggctgagttcatttctctagctcagaaaaggagaccaaatgtcttttcatagcagtatctgaaatgttttctttccacatgatggaatttttttttccccctagatggagtctcactctgtcgccagactagattggagtacagtggcgcgatctcggctcactgcaacctccgcctcctgtgttcaagccattctctctcagccttccgagtagctgggagtagctgggattacaggcacgtgcaaccatgcccagctaatttttgtattttcagtagagacggagtttcaccatattggccaggatggtctcgatctcttgacgtcgtgatccgcccgccttggcctcccaaagtgctgggattacaggcatgagccaccgcccccaaccgaaattttgcattcttactcttctttcatacagacattttaattccctcagtgaaaggggtatgttattgttaattttacttttttagattaacagtaaaaataaaacattttctcaaacatttattatccttttacagttcattttatgaacctttaatattctatttattttccccatcagtgcattaatatttcaatgatttataattgtctttataaagatattaacttttgtcagttacataaattttttttttgcattctaactttctgcaaggcacattttctcattcagaatttttcaatttatggttctagttgctgatctctttttctatcaaaggtgaattattcagaaagaatttgtactttcaaagattatatctatccatgtataaatttatataatctatatgtttatctatgttttcttcagatagcttatgtagtctcttgtctgtttgaaatgtatttgggactacagagatgggatttgacattattttttctaaataattaatcattaaacacttatttatacctttaaaaaacactatttaaaataactaaaggaggccagggaagatggctcacacctgtaatcccagcactttgggagcctgaggtgggtggatcacctgagatcaggagttcaagaccagcctgaccaacatggtgaaaccccgtctctactaaaaatacaaaattagccaggaatggtggcacatgcctataatcccagctacttgggaggctgaggcaggagaatcgcttgaacccgggaggcggaggttgcagtgagccaagatggtgccattgcacttcagcctaggcaacaagagtgaaacttcatcttaaaaaaaaaaaaaaaaaaaaaccacaaaacaaacaaacaaaaaactaaaggattataattggattgcttgtaacacaaaggataaatgtttgagaggatggatgccccattctccatgatgtgattcttatgcattgcatgcctgtatcaaaacatctcatgtaccccataaatacatacacctattacgtacccacaaaaattaataataagttttaaaaagagaaataataaataagacctagtatttgctagcacaacagggtgagtacagtcaaaatcaatttaattgcacattttaaaataacaaaaagaatataatttgattgtttgcaacacagaggataaatgcttgagggaatggatgctgcattttccatgatgtgattactatacgcattgcatgcctgaatcaaaatatgtcatgtaactcatagagatatacacttacccacacaacttaaaaaaataaaaaaaaaattttaaacacactcaagtatccagaaataaaaaatgcaagttaacgtgataaaaattacacattctaaatcacagtgaacatcatattaaattacaaaactctagggttattctatttaaaaaagaagaagaaaaagaagaatgccaactcctaccataaattttaaaaggattctaaaatttcaaaccaatgcaataagacctaaaagagaaataggtgttattaattagtattatttggagaaaatagatgaattttagagaaaaacatgaaactaagaagaaaacccagaaaaagaatatggcacctcttcaatacaaaaaaagcaaatgacttcctaatataataccaatagcagagatgttatgtgggggggtattacattaaaatattaagaaattaacataatctatatgtgtatttttaacacgtgaacaaaaatgtctacccaaaaaaggattaaaatatgcagaggaacatttctgctactggaatgagaatttgaacataataaagatgtcaatttctctccaaattaattgataactttaatgtaatctccaataaaattccaatggtatttttcttgcaacatggctagaggattctaaagctcatctgggaggataaactggcacatcagaaataaaattatgaaagaaacaatactaagcaaatttctcaactcaatgtttaagtatattttgaagatagacaattaaaaatatggaacaaaagatttgataccctgcttgctgtcatggcacagatgaccatttaaaattatctatttataagagtgtgaacaagaaaatgtcttaatgtttttgttgttgttgttgttgttgttttttgagacagagtctcgctttgttgcccaggctggagtgcagtggcgtgatctcggctcactgcaacctccgcctcctgggttcaagcaattcttctgcctcagcctccctagtagctgggactacaggtgtgtgccaccacgcccagctaatttttgtatttttattagagacggagtttcaccatgttggccaggcttatctcgaactcctgacctcgtgatccgcccaccttggcctccgaaagtgctgggattacaggcgtgagccaccgcgcccggccggaaatgtcttaattaaaaaaaaaaacaacaacaactgagaaaggccatttacagattaacctaagagaagaaaatataaaaaatataaaactatagttaatcaaaaactttctttgtctttaagaaaacttagaaagtaagtaaatgtccaacatggacaagttttaaagagccatttctgtatggcagaatattttgatctgatggaatcagatgatggaaaatggggataaaatttaattctatatctagaaactctagggcttttctatttcaaagttccatttttgttgagtttagctagggagattgataatataaatgaaatgtaaacaatgatgattaaaaacagtggttattattttttagcagaaggggcatccaagatccagaggatttaacatgtagacattacaactgggcacagtggcttgcacctgtaatcccagctacttgggaggctgaggcaggaggatcacttgagcccagaagttcgagactgcagtgagctaggatggcgccactgcactccagcctgggcaacagagccagaccttgtctctaaaacaaaatgaaaaataaattacaggaatgcagcaca

SEQ ID NO: 1329 - DNA, 10648 bp, Homo sapiens
acgtggtgataatactggaaaacactgtatgtttatgattctagaattctacctcagtttagcatagttttaaacttaagttcattagtgatttagctcatcaaaatatgtgggtgaaaaatattaaaactccaactaaaaacccctcaaataagactagaataaaattctaagaatcaccctaaatcattctactcaggaataacttttgctatggtctgaatgcttttatctccctaaaatttatatgttgaaatctcacccccaatgtgatggtcttaggaggtgggactgttgagaggtggctaggtcatgagggcagcaccctcatgaatgggattagtgccctcaaaaagaggctccagcgagtgcagtggctcatgcctgtaatcccaggactttgggaggctgagtcaggcagatcacgaggtcaggagatcgagaccatcctggctaacacagtgaaaccatgtctctactaaaaatacaaaaaattagccgggagtgttggcgggcgcctgtagtcccagctactcaggaggctgaggcagtagaatcgcttgaacctgggagacagaagttgtagtgagccaagatcgcgccactgcacttcagcctgggcaacagagcaactccgtctcaaaaaaaatttttttttctttaacatgggaagtattttttccaaaggctctttctaggttaagaaattatgaaaatctccaagaggctgaatattttttattcttgatattattcttaatagtcatgcatcacttaatgatggagatatgttctgagaaatgtgttaggtgacttcatcattgtgcaaacttcgtacggtgaacttacagaaacctagatggtacagcctaccacacgtctaggttatatggtatagtctattgctccaaagctacaaccctgtacagaatgttactgtacagaatactgtaggcaactataacacaatggtatctgtgtatctaaacacagaaaaggtacagtagaaatatggcgtaaaagataaaaaatggtacacttgtatagggcacttaccatatatggagtgagtcagtaagagaatgtgaaagcctaggacatcactgtatgctactttatagacactgtacacttacgctaacttaaaattataaaaaatttatttcatcaataattaagtttactgtaattttttaactttataaactgtttaatttttaactctgactcttttggtaataacacagcttaaaaacacaaacacattgtacagctgtttgtgtttttgttgtacaggatattttttctttatatccttgttctataagtttttttctattaaaaaatgtttttcacttttaaaaccttttgttaaaaactaagacaaagatacacattagcacaggcctactcaggttcaggatcatcggtatcactgtctcccaccttcacatcttgtcccactggaaggtcatcagggataataacaagcttggagctgtcatctcctgtgataacaatgtctttttctggatacctcctgaaggacctgcctgaggctgtcttacagctgacattttaaaaaaacaagtagtagtattctctaaaataataataaaaaggccaggcatggtggctcatgcctgtaatctcagcactttgggaggccgaggctggcagatcacgaggtcaggagtttgagaccagcctggccaatatggtgaaaccccatctctactaaaaatacaaaaattatctgggcatggtggtgtgtgcctgtagtcccagatactcgggaggctgaggcagaagaattgcttgagcccaggaggcgggggttgcagtgagccgagatcgcaccactgcactccagcctaggcgacacagcaagactccatctcaaaaataataataataataatgataaaaggtacagtaatacataaactagtataataatttgtcatcaagtattatgtattgtatataattttatgtgctacacttttatatgactggtagcaccggtttttttatgctagcatcaccgcaacttgtgagtaatgagttgcactatgatgttaggttggctatgatgtcactaggtgctaagaatttttcaacttcattataattttatggggctacctttgcatgtgcagttgaccaaaacatcattatgcagcatataactgtattttaaactgcttttcaattttaaacagtaaaagtagacactttgtgaaaaattagtacctactaggtttgtctcctctctccaaaacaatttttcagttacatggtatttattttatccaggtttgaaatatttgccttttattctctaattataatttccatagttgtttagtattagtaaagttacatatttaaaccagctatactttactaaaatgtaagtttcatgcaggcatgatgagttatttgctttgttcaatgatgtatctgaagtgtctagaagaatgtctggcacatagtaggcactaataaatacttgttgttcaataaattattttcccaattttttacttcctgagtttaaaattttctctaattgtatttgattgttgcatatggtatataaataaacatacacatatacacagatgtttaccccgtcccaagaaaaactcaggcatgttgtgttccttgagttccttcatgtttgaaaatgactgtcttttgcctgtatgcttgtgataattaatactgagtgtcaacttgattgtattgaaggatgtacaatattaatcctggttgtgtctgtgagggtattgccaaaagagattaacatttgagtcagtgggctgtggaaggcagacccaccattaatttggatgggcaccatctaatcagctgccagcatgtataaaacaggcagaaaaacgagaaaatgttagactggcctagcctcccagcccacatctttctcccctgctggatgccctctgccctcgaacatcggactccaagctcttcagttttggaactcggactggctctccttgctcctcagcccgcagatggcctattgtgtgaccttgtgatagtgtgagttaatactgaataaactcatatatgtgtgtgtgtgtgtatgtgtgtgtgtgtgtgtgtatatatatatatatatacgtatatatatatacgtatatatatatatatatatctatatgtgtatatatatatatatatatatatatatatatatatatatatatgagattttggtaccaggagtgtggttcagaggaacagaatattaaggatggagtagttaggttggtttgggtgtttctggaggtggctgcttaatatgattagacccaaaaatgctaaggactctacttctaatagtatggagaacactgatagtccttggtgtgaactgtttaaagagttatgcgaaataaatgcatttgacactcctgattcattgctcgtgggaggcaaggagtttagtgactctatacataatacctttgaccatatgtggagaaccaaggaacataatgaagctggttggttggttgctcttaagttcactggacaaaatgatgaaagaaaataatgaactcagggattctgtctcccagtttcagaaacagacactgagcctcaaatgtgctgagatggccctgagtgagagtcttatctcctgtagagaaagagctgaaattgtggaaaaacagacgcaagctcttatcacatgagtggctgatctgcaatgaaaggtgaatgcacagcctcgccaggtgtctactgttaaagtgaaggcattgattggaaaagaatgggaccctgaaacttggaatggggatgtgtgggaggaccctgatgaagctggggacactgagcttataagatctgatgaacatttttttgccagaaggaacagcttccccatccccagtagtgggaacatcccctccctgacccatgctgccatcagtctttccacctttgtctgaggagacacctgtgatgtctgaggcaacagtgatggcatcccctcaggcagttgccaggcaagataatgttgattctcctcaggagacacccccaacacctctctttgcttctagacctataactagactaaagtcctgacgggtgcctagaggtgaggttgagtgtgacccataaggaggtgcactacactcaaaaagaactgcttgagttttctgatttatataaacagaaatctggagaaccggcatgggaatgaatattaagggtgtgggataatggtggaaggaacatagaattggatcaggctgaatttattgattgggcccactaagtagggacaccatttaatgttgcagctcagggagttaaaaaggttctaatagtttattttcttggttagctaaaatatggattaaaagatggtccactgtgagcaagctggaaatgcctgatctctcttggtttaatgtagaggaagggatcccaaggcttagggagactgggatggtggagtggattagtcactttagacctactcatcccacctgagagggtccagaagatatatccttgaccaatgccttgcaaaatatatttgggagggcagcacctgcatctttgaagagccctgtaattgctcttttctgtatgtcagagctaacagtgggaaccacagtcactcaactacaaaatttaaatacaatgggaataactggatcccaaggtggcaggggcaaagtagcagcactcaactgtaaaaggcagggtgggtatagctactgtaatggaaagcagaggcaaagtggcaatcagaatagtctgattcatgtagagctctggcattggctaattaatcacagtgctcctagaagtgaaattgataggaagcctactgcattcctacttaatttatataagcagaaaacttctaagtcaaatggataaaatactaatttaaattataaaaacagagaatcatgccccctcaattaatttccagacatgagccagtttacagacccagaaccccttgaatgaaggggaggctgggtccccttgatgaaagaccccactacattactgacagtatctttctcccatccttccccaaggagacttcttgccttttaccaaggtaactgtatcttggggaaagggaaatgatcagacacttcagggactactggacactagctctgagctgacgttgattccaggggaccgaaaacatcattgttgtcctccagttaaattaattaattaaataaattaaattaattaccagtcaggtaattaatggagttttagctcaggtccaacttacagtgggtccagtgtgtccccaaactcatcttatgattatttccccagtgccagaatgcataattggcatagacatacttagcagctggcagaacccccatattggctccctgactggtagggtgagggctattatggtgggaaaggctaaatggaagccattagagctgcctctatctagaaaaatagtaaataaaaaacaatatcgcatccctggagggattgctgagattagtgccaccatcaaggacttcaaagatgcaggggtggtaattcccaccatatccctgttcaactctcccatttggcctgtgcagaagaaagatggatcttggagaatggcagtggattaccataagcttaacccagtggtaactccaactggagctgctgtaccaggtttcattgcttgagcaaattaacacatctccttgtaccttgtatgcagccattgacttggtaaatgcctttttctctatgcctgtccataaggctcactagaagcaatttgccttcagctggcaaggccagcaatatccctttactgtcctacctcagggatatatctactctccagttttgtgtcataatcttattcagagagaccttgatcacttttcgcttccacaagatatcacgctggtccattacattaatgacattatgctgattgaatccagtgagtgagaagtagcaaacacactggacttactggtgagatatttgcatgccagaggaccagaaataaattcaactacaattcaggaatcttctacctcagcaaaatttctaggggtccagtggtgtggggcctatcgagatattccttctaaagtgaaggataagttgcttcatttggcccctcctacaaccaagaaagaggcacaatgcctagtgggcctatttggattttgggggcaacacatttctcatttgggtgtgttactccagcccatttattgagtgacccaaaaggctgccagttttgagtagggtccagaacaggagaaggctctgcaacaggtccaggttgctgtgcaagctgctctgccacttgagccatatgacccagcagatccaatgggtgcttgaggtgtcagtagctgatagggatgcagtttggggcccttggcaggccctcataggtgaataacagcagaggcctctaggatttttgagcaaggccctgccatcttctgcagataactactctccttttgagagacatatcttggcctgttactaggctttggtggaaactgaatgtttgactaagggtcatcaagtcatcatgcaacctgaattgcctatcatgaactgggtactttctgacccatctagctataaagtgggtcctgcacagcagcattccatcatcaagtggaagtggtatatacgtgactaggcttgagcaggtcctaaaggcacaagcaagttacatgagaaagtgcctcgaatgcccatggtcaccaatcctgccaccctgccttctctcctccagcttgcaccaatggcctcatggggaattccctatgatcagttgacagaggaagagaagactagggcctggttcacagatgtttctgcatggtatgcaggaaccacccaaaagtggacagctgcagcactacagcccctttctaagacatccccgaaggacagtggtgaagggaaatcttcctggagggcagaactttgagcagtgcacccggttgtgcactttgcatggaaggagaaatggccagatgtgtgattatatactgctgagaccagcttggtcagggagaccccaacccagcggcgctagaggaattaaagacacacacacagaaatatagaggtgtaaagtgggaaatcaggggtctcacagccgtcagagctgagagcctagagcagagatttacccatgtatttattaacagcaagccagtcattaggattgtttctatagatatttgattaattaaaagtgtcccttatgggaaacgaagggatgagccaaaataaaggggtgggtttggctagttatctgcagcaggaacatgcccttaaggcacagatcactcatgctattgtttgtggtttaagaacacctttaagcggttttctgccctgggtgggccaggtgttctttgccctcattctggtaaacccacaaccttccagcatgggtgttatggccatcatgaacatgtcacagtgctgcagagattttgtttatggccagttttggggccagtttatggccagattttggggggcttgttcccaacaatatactgattcatgggctgtagccaatggtttggctggatggtcagggacttgaaagaagcatgattggaaaattggtgacaaagaaatctggggaagaggtatgtggatggacctctctgaggggtaaaaaacagtgaagatatttgtaacccatgtgagtgctcaccagtgggtaacctcagcataggagaattttaataatcaagcggataggatgacccacttgttctgtagacacccctcagcctctttccccagccacccctgccatcgcccaatgggcccatgaacaaagtggccatggtggcagggatggaggttatgcatggactcagcaacatggacttccactcaccaaggctaacctagctgcggccactgctgagtgcccaatttgccagcagcagagaccaacactgagccctcaatatggcaccattcctcggggtgatcagccagttacctggtggcagtttgattatattggacctcttaaatcatagaaagagcagaggtttgtcctcactggaacagatacttactctggatatgggtttgcctatcctgcatgcaatgcttctgccaagatgaccatccatggactcatggcatgccttatccactgtcacgttattccacacagcattgcctctgaccaagagactccctttacagctaaagaagtgtggcagtgggctcatgctcatggaattcactcttcttaccatgttccccattaccctgaagcaccgttctatcaatagaacggtggaatggccttttgaagtcacaatgccaactaggtgacagtactttgcagggctggggcaaagtcctccagaaagccatggatgctctgaagcagcgtccaatatatggtactgtttctcccatagccaggattcacaggtccaggaatcaaagggtggaaatggaagtggcaccactcaccatcacccctagcgatctactagtaaaatttttgcttcctgttcctgcaacattacgttctgctggcttagaggtcttagttccagagggaggaacactgccaccaggagacacaatgattccattaaactggaagttaagattgctacctggacactttgggctcctattacctttaagtcaacaggctaagaagggagttacagtgttggctggggtgactgacctggactatcaagacaaaatcagtctactactccacaacagaggcagggaagagtacacatggaatacaggagatccattagggtgtctcttagtattaccatgccctgtgattaagattaacaggaaactacaacagcgcaatccaggcgggactacaaatggcctagacacttcaggaatgaaggtttgggtcactccaccaggaaaaaaccatgacctcctgaggtgcctgctgaagccaaatggaatacagaacggacagtagaagagggtagtcatcagtaccagctacgaccacatgaccagctgcagacacaaggactgtaattgtcatgagtatttcttccttcttttgttaaaaacatgtttgtgcatgtatacacttgtactaagaaaatatctccattttatttcctttttctgttaccatgtgacataagatttattgacttcacatcagcatttaaatattaactttatgtaatagtatttgggtaggagattggtgcgtttccgtttgtacaaaggatggttttattatgttagatgtaattatgaccttattattgtctttatttgaagatgatgtgtgatctcaggagatgtgtatgggttcaagctgacaagtagtagacttatgatggttagtgctgagggtcaacttgattgaaggatgcaaaatattgatcctgggtgtgtctgtgagggtgttgccaaaggagattaacatttgagtcagtgggctgggaaaggcagacccacacttaatctgggtgggcaccatctgatcagctgccagggtggttagaatatataaagcaggcagaaaaatgtgaaaagacaagactagcctagcctcccagcctagatctttctcccgtgctggatgcttcctaccctcaaacatcggattccaagttcttgttttggggcttggactggctctccttcctcctcagcttacagatggcctattgtgagaccttgtgattgtgtgagttaatatttaaagtccctttaataataataggatatttaataatttaataataataggatctatctatcctattagttctgtccctctagagaaccctgaccaatacaaaaagctcttcaaaacatcatgggagctataaagcagtggttttcaaacttgaattataaccaattagtgcactttgacattattttagtgtattataaccaacattttttttaaagggacagaataaaaatagcagagagaactgcatatagaaagggtaagtatagtttcatgacacttacatatatgcttaggtgttgtgagtttatgtactggactatgatgtagaatgtatttctgacagaaacatttatttaacagtaacaggatctacttacaaaccaagtggaccaggtgttttagtctgtttgtactgctgtaacaaaatacctgagactgcgtaatttataaacaataaaaatttatttcttacagttctggaggctgggaagtccatgatcaaggtgtcagcagatttagtgtcttgtgagggttctctgcttccgagatgagcaccctgttgcttatatactggaagggatgaatgctctgtcctcacatggctcacaggcagctctctgaggactctaacggcaataccattcatgacagcaaagccctcacagctaaatcacttcccaaaaggccccacctcttaatatcaccaccttggggtttaagttccaacatatgaattttggaggaataccttcattcaaaccatagcaccaaggaaggctgaaagcctttttcaactggcatggagtggcagctgaggttagggtcaggggcccttgaacaaaagccttcttaagtttaggaaacaatata

SEQ ID NO: 1330 - DNA, 1235 bp, Homo sapiens; identical to SEQ ID NO: 5

SEQ ID NO: 1331 - DNA, 1384 bp, Homo sapiens
aggtaaacagcaaacttggaaattgaactgctacaaaatgacaatatggccactattcttaatgagtaaggagaaccttaaaaccccactggaaaattgggtgaagaagaccaggcatggtggcttatgcctgtaatcccagcactctgggaggccaaggtgggtggatcacctgaggtcgggagtttgagaccagcctgaccaacatggagaaaccccgtctctactaaaaatacaaaattagccaggcatggtggcacatgcctgtaataccagctactcgggaggctgaggcaagagaatcgcttgaacctaggaggcagagattgcagtgagccgagatcacaccattgtactccagcctggacaacaaaagcaaaactctgtctcaaaaaaacaaaagaaagaaaattgggtgaagaaaatggacaattcacacagaatacacatgactataaacatacaaaagatccaaccttgctagtaatcaaatccatataaatagaagacactttttgcctttcaaattaacttaatcatgagagggtacagtaaaacttgtatccttgtatgtccctccataataccatacatggtataaatttctacaatttttagaatataatctggtgctatgtataaagaggctttttaaaattcataccctttgactcagtaattctccttctaaaaatctatcttaaggaattaattagaaaggccaatgtttatctacaaagatgttcattgctggacagtggctcatgcctgtaatcccagcactttgggaggctaaggcaggaggatcacttgagcccaggagtttgagaccagtctgggcaacaaagggagacccccatctctacaaaaaataaaaaaattagctgggcatggtagcacacacttgtggtcctagcttctcgagaggctgaggttggagaatcgcttgagccctggagttcaaggctggcaatgaactatgattacaccactgcactacagcctgggtgacagagcaagactctatctcaaaaaacaacaaaaagatgttcatcactgcattatttatagtaatgaaaaattagaaactgcctcaatgtctaaagggaatcatggcacatccatgtgatgttaaattatgcaaccattaaaggtgatgatttcattatatttaatgacatggaaaatacaattaaatgacatggaacattacacatatttaacattacatggaacatccatataatgttaaattatgcaaccattaaaggtggtgatttcattgtatttaatgataaggaaaatacaattaaaatgtaaaattcaagagctcaggattacatgcatagtattattagccaaattttataaaacacatatctac

SEQ ID NO: 1332 - DNA, 2101 bp, Homo sapiens
cacatggaattttactgaaccaaatcacgtggatgtatttctggctgaatttaccttctatcttcagtaggcttttaaaagccaagtctctggaagcaaattctttccagatacaactatcctaagatagttgcatccatgtcaagaaatgtttgttctgtgacgggtgcgatggctcacacctgtaatcccagcactttggcaaaaggatcgcttgagcccaggagttcaaaactagcccaggcaacgtagcaagacctcatctgtacaaaaaaaaatttaaaaactaggcagcttgagtggccaaggcaagatgggtcaaagtcaagagtggtggtcatggtcttggagctggaaagaaggatgataggacaagaaaaagaaatatgaacctcctataccagctagagtgaggaagaagaagaaaacaaagggaccagatgctgccagcaaactgccactgatgacacctcacactctgtgccagttaaaattattgaaagttagagataattaaatactgtcttctcatgaaggaagaattcattagaaatcaggaacaaatgaaactattagaaggaaagcaagaggaggaaagatcaaaagtggatgatctgaggggaccctgatgtcagtagtaaccttggaagagattattgatgacaatcatgccatcatgtctacatctgtgggctcagagcattcttgtagacaaggatctgctggaacctggctgctcggtcctgctcaaccacaaggttcgtgctgtgatatgggtgctgatggatgacacggataccctagtcacaatgatgaaggtggaaaagaccccccaggagacctgtgttgatactggggggttggacagccaaattcaggaaattaaggaaatcattctgaatattatgaagagatgggtataaagccccctaagggagtcattcactatggtccacctggcacaggtaaaaccttgttagccaaagcagtagcaaaccacatcttagccactttcttgcaagtgatcagctctgaatttattcagaaatacctacatgatgggcccaaactcatatgggaattgtttctagttgctgaagaacatgcaccttccatcatgtttattgatgaaattgatgctattaggacaaaaagatgtgactcaaattctgatagtgagagagaaattcagcaaataatgctggaaatgttgaaccagttggatggatttgattcaaggggagatgtgaaagttatcatatccacaagccgaatagaaactttggatctagcacttatcagaccaggctacactgacaggaagctcaagttccccctgcctgatgaaaagactaagaagcacatctttcagatgcacacaagcagcatgacactggccaatgatgtaaccctggaacgacttgacacttgacatcaaggcaatctgcacagaagctagtctgatggccttaaaagaacatggaatgaaagtaacaaatgaaaacttcaaaaaatctcaagaaaatgttctttataaagaacaggaagacacccccaaggggctctgtctctagtgaaccacagttgccatcaggaaaatggctgggagatttcccaagccctcaaagggatgaggttgggggagttgcccagaggaattcgtgttccagtttatttttattagcaacacttcctgtgagtcttttggagtatgatgtgtaagacgtccattgggccgccttcgcctgtcggtcactgtgcaacactctgcttcccaataaagtgtgctttttctttctctctctctacacacacacacgaactaaaaaccagaaatgtttgttctagaaccagtagtttttcatataatcaattgctaagctgaaaaatatgccctgcctaacaaacatcaggtaggaaaaaataaacctatttatttaattcaacagatttttgttttgatgtgacttagtaccgtaggtttgtgtatagcaatgactttaatcttctaagacatcattgatgtaatgcacttcaaatatgtgttgatgccaaaattatctataaatctaaatttctatgagtttttcttaggctttta

SEQ ID NO: 1333 - DNA, 2991 bp, Homo sapiens
aacaggagaatttagtatggacaagttggcaatcgaactcctgaatcatcatttgcatgtgtgtgcaggtgtccataggatgaccgcatggctatttggtgatgctctccagcccagggaaggagatgagggagacagccatggttgtgggaagatttctgtttgttacaaacacgggcaatgtttgatgatatcctgtcctgcgtgccccggcactgggtttaaacctaattttatttggtcacctacggtgttgcagcatgaagaaagaacacaggctctgccccttaccaggagcagggctttgagttatttaatgcctcggagactcaattgctttccctgcatcccagtggaagcaagtccatgctctgcccatcccagcaggtgggtgagaccgttgttagcagcagcacctggccctgcctcagtcagagcaggccctcaacagggctgtggattcgatggcccctgacttgaaactctggcctggctcagagcctttctggatttgagggaaatgcatgttggatttggggtgcacagcccaggagacatggtttcctttagcaccttgggtttctgacaggctctgagggcactgagttctggaatgagggctgcatgaaccagaagcccccgagatgtggaatgttggcagagcacagaagtcacagctgattcgttatacattcactaagtctctgtcaccaatgttttgggacaagtatcttgtgccaggtgctggtaagtcttcactccaccccttactggctatgggaggaggcacagaggtcacctctgtaagccttagtttccttatcataaaaatgaaaatgcgtgcactttggaaagctaaggtgggaggatcgcttgaacccaggagtttgagacaagcctgggtaacatagtgagaccctgtctctatacataagaggaaaaaagaagaaaaaaattagctgggcatggtggcatgcgcctgtagtcccagctactcgggaggctgaggtaggaggatcccttgagcccaggaggtcaaggctgcagtgagccatgatcatgccactgcactccagcctgggtgatgaaactagactctgtctccaaaaaaaataagtggtagtgggggatgccatgaccagctctggtcttatccaccttgtagggccttgtgagggagagggtggctgtcttgggcaagagaacctcaggcaagactagggctctcctaatttttgggctcctgtcttggagtaatttattccatggcctcagtggctcatctgtaaaatggggtaataatactgtaatgacaatggggttgctaggaggagtcctgagataatgtttgcaaagtgtctgccccagcccagaccctcaatcccatacaaccctctctgcaccacagtccaagggggcatcctcctcccaccagctttgttgaggattgtgggaggcattctaacttgaagatgtgttttcagctaaatctgcccttctgagagagagagtgttgctttggcagggtggttccattcagcactcacagtggacaaggccctggatgctagtttctgggtggacacacagatggataaaccaaccttgtgcagcacgcagtttaaagaggaagatggactgggcgtggtggctcacggctgtaatcccagcaatttgggaggtgggggcaggtggatcacctgaggtcaggagttccagaccagtctggccaacatggcaaaaccctgtctctactaaaaatagaaacaaattagccgggcgtggtggcaggtgcctgtagtcccagctacttggaaggctgaggcaggagaattgcttgaacccaggaggcgaaggttgcagtgagcagagatcacatcattgcactccagcctgggtgacagagcaagactctgtctcaattaaaataaaataaaacaaaagagggagatggacagacacataggacagaatgatcaaaggcccacacaaaaggtacacagcagagaggaaggggtttaagtggctgggagagggggactcaggggttggatgctggggtccagagaggcctttgatgaatggagaaggtgggaaagttatttcccagaaaaatacaggaaggtgaaagggtccccacccctccccagctcctctggggagactgtctggaatggaggtgggtggcagtaggtggccctgggaagcaatgtggggtcagggtcttgaagggacttggatgccacactgaggagcttaggattgattatgatggaggaaaaccacgctggtggttttgccaagcagaatcccaagggactcattgcacccaccagggttctctgaggccccagctgcagagggcaaggcggagcctgaaggcttctgtattagtccattttcacactgctgataaagacatacttgagactgggaagagaaagaggtttaattggacttaaagttccacatggctggagaggcctcagaattatggcaggaggtgaaaggcacttctcacatggcggcggcaagagaaaatgaaaagatacaaaaggagaaatccctgataaggaaagccatcagatctcgtgagacttattcacgtccatgagaacagtatgggggaaactgccatcacgattcaaattatctcccaccaggtccctcccacaacacatgggaattatggaagctacaattcaagatgagttttgggtggggacacagtcaaaccatattagctttccaccacagaggtcagagggaggggaagagggaagcgaggccttccaattcatctctggccctggaccactcctgggggtgaccttggggccggggagctccagccttcctactcgaggggtttctaacttagaatctgacagcagccaaggaagaagggctgagcccacatctgtgtggttatccaggcagatgctgctgttggccctgtggacttgaaagaggaagaattctctcagaaaa

SEQ ID NO: 1334 - DNA, 3075 bp, Homo sapiens
catagacctacttaggacttggagtaaaagagaagtggttcatacgtttattcactcacaaagtgggtagctgagacatcataaggtcttcaggttagtttttatctttaaatgaaaatgagagaaagtaaagaagaagttcatttctactctggcgtgttttaccaatgaatgcttattggcttcattaaaatccttcattgtagcgtttctcaaactctggtatgtttgagaatcacttggacatcttgtaaatacagatccctgagtttcagccccagaaattgagaaggtcttaggtggggacccaaatgtgcccttctaacgagttcccaggtgatgctgatgcttctcatcaaaggaccagacataagtagcatttcaagtccgctgacaagcaagatgtcataaaacatagatgttatgtaagaaacacgaaaagccttggccatgcagagcaagatggtgattacttactagtgattgctgttatccacgatactagtaccggccgggcgcggtggctcccgcctgtcatcccagcacttcgggaggccgaggcgggcggatcacgagctcaggagatgaagactatcctggctaacacggtgaaaccccgtctctactaaaaatacaaaaaattagccgggcgtggtggcggcgcctgcagtcccagctactcgggaggctgaggcgggagaatggcgggaacccggggggcggagcttgcagtgagccaagatggcgccaccgccctccagcctgggcgacagagccagactccgtctcaaataaataaaaaataaataaatagatagatagataaataaaaatactagtactgtgtaacccaaaagtaaaagataattatttattggtgcataaaatagtaagaaccagaaagaacgtaggccagttctcatttgagaatctgatgttactgagattaagtttttctacccacacacttttaatgtgtgtcattaagtatttaataactgcaatagctatctggaggcagaacatgtcacacatcctctatgatggtataaactagaagtagagagtcagaacttcggccagattttactgacaatttggtcaatgtggtagtttttagaatttaacaatgcttttttcaaaagaaaaggaaaaatcaatactctgaataacaaacagttggccctggcatctatttcacatttttcctggaaaatggcaccaattccccaatgttatgttagggctttgttttaagatttgtagatagaaggaaagagtgccacctgctgaggaagcccagtgcttactccagcacagtggacacagcgtggccgccctgacttaaccttcttagcaccttgaaaaaaaaaaaaaggtgtaaatctatccataaggcaggaagaacaaaacgcccagaagaaattgtcagttggatctagacctttcaaaactaaaggactctaatttgtccatgtcttcaaatcattttagagtatttatgagttataattacacagggatattgggatgccccatctattgaatctaagactatatgaaagacaaaaactgtgatcaagttcttctgaatctgtagaagcaagctgagagaaagcaccttagaaatatgaaatcattgttattttattcaaaattgcaaaatgacctagtctctccaaccaggttggttttttttttaattttctattcaaatttaaccaattcagcctctcaaatctttcaaatcattaattgaattaatttgtaggatttagcacaaaaaatgccttgcctaaaaatctgcttcaatatatatcaaagataggttaaaatatctttcaagatcacagattatggaactattgcatgggttaatatcaaatatttgccctttactagctatgtggccttaaatggttatttgtaccttggtgtgctaagtggtgaaatatagatggtaagatcatagaattattttgagaaaaatgagatgataaagcaatatgcaagtaccataagtaaatgctcaataaatataagttgccactaacatttattattattaaaagttatgaaaaataaccctgaagaaattcttacgagcacagagctaaatagctggacaactgaaagtcaaattcaagtataattcagttttggaaatagaataaaattttaaaatcttttctctacattacataaaaagttattaatattaaagggaataacttttgcataaaaactttgcagatatgttatcaatcaagttggagaaactattcatcatttaacatgtttattttatgtggtcaaaaattaacatgatttaataggaaactaaagtattagtttcccaaaaacttcttgcacaggagtgcttcttcttttcaaacactgaagtcaaactggatgacctaaataatattttttgcttgaatttcatgtgcgcttagcttatagggttttttccttttgctttgttttaaattaaattatactatacaatattctagcctgttaaactgatgagatttcaggggcaaattcatttgataagttataagaattactttattatttcatacaaaatcatattcagagataggcagataatttcaaaatagaagttctaggcttcaacgtaaataactgctgtctgccaacaatccatgtgctttccataaaacaagaccaagagataaatgtgacagcaattaagatatttattagattttaggttacactatgtgaatcactgaaccttctaattgatttattctttgttgcctataacttactttaacatacttcagcacaggctgtgcgtgtgtgtgtgtgtgtgtgtgtgtgtgtgtgtgtgtgtgtgtgtgttttcttctgaacctagaggtagttatccaaatgagaaatatagtcaccaggtgtttagctaatatttaaaaggcctcatccagtcaaaagttacacaccagaggtagacagctataagcagtattttacatcccctcaccatattaattagcattaagggtgtcagtggtggcctttcgttggttaaactggtagaattca

SEQ ID NO: 1335 - DNA, 3319 bp, Homo sapiens; identical to SEQ ID NO: 4

SEQ ID NO: 1336 - DNA, 6443 bp, Homo sapiens
catagacctacttaggacttggagtaaaagagaagtggttcatacgtttattcactcacaaagtgggtagctgagacatcataaggtcttcaggttagtttttatctttaaatgaaaatgagagaaagtaaagaagaagttcatttctactctggcgtgttttaccaatgaatgcttattggcttcattaaaatccttcattgtagcgtttctcaaactctggtatgtttgagaatcacttggacatcttgtaaatacagatccctgagtttcagccccagaaattgagaaggtcttaggtggggacccaaatgtgcccttctaacgagttcccaggtgatgctgatgcttctcatcaaaggaccagacataagtagcatttcaagtccgctgacaagcaagatgtcataaaacatagatgttatgtaagaaacacgaaaagccttggccatgcagagcaagatggtgattacttactagtgattgctgttatccacgatactagtaccggccgggcgcggtggctcccgcctgtcatcccagcacttcgggaggccgaggcgggcggatcacgagctcaggagatgaagactatcctggctaacacggtgaaaccccgtctctactaaaaatacaaaaaattagccgggcgtggtggcggcgcctgcagtcccagctactcgggaggctgaggcgggagaatggcgggaacccggggggcggagcttgcagtgagccaagatggcgccaccgccctccagcctgggcgacagagccagactccgtctcaaataaataaaaaataaataaatagatagatagataaataaaaatactagtactgtgtaacccaaaagtaaaagataattatttattggtgcataaaatagtaagaaccagaaagaacgtaggccagttctcatttgagaatctgatgttactgagattaagtttttctacccacacacttttaatgtgtgtcattaagtatttaataactgcaatagctatctggaggcagaacatgtcacacatcctctatgatggtataaactagaagtagagagtcagaacttcggccagattttactgacaatttggtcaatgtggtagtttttagaatttaacaatgcttttttcaaaagaaaaggaaaaatcaatactctgaataacaaacagttggccctggcatctatttcacatttttcctggaaaatggcaccaattccccaatgttatgttagggctttgttttaagatttgtagatagaaggaaagagtgccacctgctgaggaagcccagtgcttactccagcacagtggacacagcgtggccgccctgacttaaccttcttagcaccttgaaaaaaaaaaaaaggtgtaaatctatccataaggcaggaagaacaaaacgcccagaagaaattgtcagttggatctagacctttcaaaactaaaggactctaatttgtccatgtcttcaaatcattttagagtatttatgagttataattacacagggatattgggatgccccatctattgaatctaagactatatgaaagacaaaaactgtgatcaagttcttctgaatctgtagaagcaagctgagagaaagcaccttagaaatatgaaatcattgttattttattcaaaattgcaaaatgacctagtctctccaaccaggttggttttttttttaattttctattcaaatttaaccaattcagcctctcaaatctttcaaatcattaattgaattaatttgtaggatttagcacaaaaaatgccttgcctaaaaatctgcttcaatatatatcaaagataggttaaaatatctttcaagatcacagattatggaactattgcatgggttaatatcaaatatttgccctttactagctatgtggccttaaatggttatttgtaccttggtgtgctaagtggtgaaatatagatggtaagatcatagaattattttgagaaaaatgagatgataaagcaatatgcaagtaccataagtaaatgctcaataaatataagttgccactaacatttattattattaaaagttatgaaaaataaccctgaagaaattcttacgagcacagagctaaatagctggacaactgaaagtcaaattcaagtataattcagttttggaaatagaataaaattttaaaatcttttctctacattacataaaaagttattaatattaaagggaataacttttgcataaaaactttgcagatatgttatcaatcaagttggagaaactattcatcatttaacatgtttattttatgtggtcaaaaattaacatgatttaataggaaactaaagtattagtttcccaaaaacttcttgcacaggagtgcttcttcttttcaaacactgaagtcaaactggatgacctaaataatattttttgcttgaatttcatgtgcgcttagcttatagggttttttccttttgctttgttttaaattaaattatactatacaatattctagcctgttaaactgatgagatttcaggggcaaattcatttgataagttataagaattactttattatttcatacaaaatcatattcagagataggcagataatttcaaaatagaagttctaggcttcaacgtaaataactgctgtctgccaacaatccatgtgctttccataaaacaagaccaagagataaatgtgacagcaattaagatatttattagattttaggttacactatgtgaatcactgaaccttctaattgatttattctttgttgcctataacttactttaacatacttcagcacaggctgtgcgtgtgtgtgtgtgtgtgtgtgtgtgtgtgtgtgtgtgtgtgtgtgttttcttctgaacctagaggtagttatccaaatgagaaatatagtcaccaggtgtttagctaatatttaaaaggcctcatccagtcaaaagttacacaccagaggtagacagctataagcagtattttacatcccctcaccatattaattagcattaagggtgtcagtggtggcctttcgttggttaaactggtagaattcaacttaagtggattgtctggaacattgtagagatattctcacccttgtatgaacatggtataaggatctagacatatcagtgttctacactatgaacaatgccctaagggtcatgcataaatgctgatctcgagagtttttgttaccccactgtgaccagatgattaaactatccctgccttgagaagactgttataaacatgatatcatgcaaggagtagatggaacatttaaatggacagagagctaggatttcactgaccttacagaaaaagtcaacagtgtcctattcttacttggatatacaacgtaagaatatcttttatctatcttacaatttgtaaagtcctttaatctggataatctgacttgcttttcatagtcatctaatgaggacagtcaaaagattataaagttgctaatttctaagaggaaactaagtaactgtttgagttgcctacatggcagaactcggtcttctattgaagttttctgaatctgccccagggttcttgatccattacgtgtgaactggtgttgaaataccttcaggacttgtatgctcatgttgctgtggagctagccataattccagctcgttgtattcattaaagaaagaaattatcgtcccttatttcaatgcgagactctgttctgtttctgagtggactggatgattttctggcttaataatattacttctatgtaaattctgtttacattggtagagttaaaagtatagatatgactacaaataatttaataagtcaaaccatcaaagttgtatttattattctgtgtatagaataatacatgaccctgcaactgtcatctgatgattgttcagctggaaaaaaatgggtactattgataaaaaaaaatacatcactctttggatgtttttacctgtgagattaacctttgttaaatatgggagtatttgtttttaatgagagtgttctgtgtgtctactggtgtagaacctttatgctaaggtcatgaggaataacataatgaaatgtctaaaacactattatgtgtgccaattccactcatcgcctatagaaatatttgttttaatgtatcaaaatgctgtttttctcctgttaataaatagttatatctactattttattcctagaggtttttaacgcttttcatatagctatgaagtctcttaaaagatggatcacaaaaaagagtgtccctgaagtccactgtttaactgaaacttttttgtttttttttaaatcaggtagaaacctgaataatttctcaacttatccttttctctcattacctgactgcctaccaacaagaaaataaaaggatttcatttagaaatgtaaaaagacagttaatattcagacttctaataacttgggaagcatgttgttatatacagcaaatggcttcacctctcagagcccaagtttctttatttcctcatgttatttgaatctcaatctcattcatccttataattggatttttttctctctctctctttttccttgggcaatctcttgtggaaaaaaaacaaacaaaaaaatgggaatacagttgctaataaaggccatgtgagggcaggccttctgtgtcccaaactaagaactcctgacacagagacagcctagcctaatggatgtgagctgcctgggtttcattccctgctgcaccactcaccatccgagtgaccttgggcccgatattttaaaccctctgtacttccattttgtcatcaatagcaagaatacaacaataacatttactttatagaaatgactctcagataaaatgtaaaacaaaaaacacatcactagttacatacagtgcttagaacaaatatctcgcacatactaagtatttaattaatgttagcgagtaatactatcatcatcacttttctactgctgaattttctggttttaataactttattttcgaaaccatccatgatatggcctattttggcaccactgggagtgctgccatcttctcaaatagaaagcaattgagaacaattcagaataaattagacctctgaagatatgtcagccccttcacaggagactcattttcaaaacctgctacctctagggcactgctgccagggaaggaggcattctgtgaaaatctatttgttttcacatttttattttcttttaaactgtctactcaaatattaaggagaattttgtgcaaacaccatcaatttaatgggtcaagttcattacgagatggaaagtacttcagctgctggaaaagcatgaatttcttcactcagtttttgccagcacagtgtggcataaatgactgcactgattgcaaaagctctggtatccagctacctgggttcaaaccttggcttttctgctttccaactgagtcacctcagttttctcatctggaaaattgggataacagtagcagttacctctcttcagggttattgtgagggcggggtgtgagaaaagcacctagcatgggacctagaatatagcaagtcatcaacatttggtggctctggttatgtaaagaatgcttatactgtactaaatctcggtgagaaccaatgattcacaattagtggaatacaccagatcactgtgctggagagatgggatggccttgagacattctatcatcaaattcgtttatagatttaaaaaaggaaaaaaaaagtcttaagaactgagatgagtcgcccaaggactgcagtgattgtagtttgaccacaagtgaaaggattcccacctattccattacagtgttgtttgcgtgaacacatgcaggttgtgtatgtgtgatgcaccagtactgatttatgttaagctgacttagactgccatgcagggcctagattatgggagtgaacaaatattagacaaaaactaactgaagaacataagagaagagagatctgaatttccaatatagttgtctttctgatttcaaaaatcagaaacttgtccccagattttgtgtacgttcatttctatgatgagtttccaaaaactgcaagagtcaaaatagggttgtcatgcatggatagttggtggaaggttccaagattccgtaactagactttaatgaaaagaaaatttagattttctacactgcctttaaattttaaaaggatggagcaaaagaacactctagatctatgctgtccaatatggaagctactagccatgtgtgctcatttaaatttaactttaaatgaattaaattttttaaaattagcaagtaaattcctcagtgtactagccacatttccagtattcactatccacacgtggctagtggctgccatgctggacagggcagatggacattcccatctttacagaaagtccttttggaagg
